United States Patent 9,328,346 (POLYCOMB-ASSOCIATED NON-CODING RNAS) - sequence listing, part 52

SEQ ID NO: 9490 - RNA, 341837 nt, Mus musculus
gcgcccaguguagagcagcggcgagcgagugucagggcaggauugccgggagccaccgcacacgcuccuuauccucuucccgcgccucucccaccaaggcuugcccgccaccuugguaaacccaaucucccagcuaagcuccuugccacgccccgcaucccgcaggccagcagcuacacgaccccacgccguccuccaggcagcgcggcucgccuugccucgccccgccccgucccuccucgccacgcccacaaggcuccgccccgggccgccccgcaccgccaagcuguucccgcccucgcccagcgcccagguagcugcgaggaaacuuuugcggcggcuggguagcggcuccucucuugcucugucgggcuacugccagacuugcugagucucgggaccgcuccggcucuuauugccacucucucgugcucuccucgcucccccaagaagcaggauggccgggaccgugcgcaccgcgugcuugcugguggcgaugcugcuaggcuugggcugccugggacaggcgcagcccccgccgccuccagacgccaccugucaccagguccguucuuucuuccagagacugcagcccggacucaaauggguuccagaaaccccuguaccaggugaguaggggucccuugagcauuccccgcgcacaguggaaagccaaggcgcgcgugguggcucuucccagagcgcgcuagccugguggggccgcagcggccgugcucucugcugcaggauaccugggaaugguugcugugccuggggccuggaccaucuaccaagggagggaagcacaguaugggacucuguccacaugccccgggcucacgcugcugucaggaacugugcaagccagagcgaggaacagcagagaucgccuuucuagcgcccauuuuuuuugggggggggagggcgggaaggugggagcuggcuccccucugcucuuagcaaaccggcuucacaacgugaagacugugacucgggaauuuaucucccuuacuagcacgucugccuuagcuggacccguaguucuggccacacuuuauccaccguguguccccccaugcuuuccguuccccagucuggguucccgaggcuggccgggcccaagugcaggcaaaguugagcacaaaucuuugaauccucagaggcuagagaagacacagugaaggaaacuuuugaguaggaggguccuccaaaacgugcaagacugagccuuucccuucaaaacagcuucccuuaucuagguuggcaaaucucuuuaaaaaucggcggugcuuggccuacggagcacgaauccaaaaaggauuugacuccucccccgcccaaauucaucugccuugacaggcuggaccccgaagaggagaagauuuuaggcagaggaaaguuucagagcgccugccuuuuguucugcacaaucagaucauuuuguaggggcauauuuuaaccuuagcucagggcugccgcugucaacagaugaauauuaauugccuugugugauugacuguccagcgguugggcgcuuaacgccugccuuagaauccaaucagggcaaguugcuauacuaacaauacgugcaggaagaauggguuucgaaaagauuaauuuuucagaggugcgcuuggaagaaagcagccagccguauuugcacacagacguuuguggcuuccaggcucuccuuccgaagacucgugcauccagcuaggcgcucaucccgcgcuugggagacauugggaacaagccucgccacaacuuggcugguggcucucaacaagucagggaggcgggccggaucguuggaccaaguugugaaugcguaugcgcgccuugugggcgcugccagggagcguucacuggcaggagguuaccuaggcagccagcgcgcccucagccuuuucuuuagguugaugaaaagaggcuagugagccugcuguuuaguugcaaagguaauuggucacccuuuuuuggugacugaaaugcacuugcgcauauguuaaauauugccuugcaggauaucgcucuaagggaggguagaacuaccucuuccacuguuaagucuuaauaacguaccacgugggcgugugcaagagcuguaaggggcaaccuaugaaucaguucugcagagcugaaacaacgggcgaaucucucuccccuggaagugccaugguaauuagauugcuaaggcuagagaacacgcuuuuguugauaauauaaaaauugguccuuacaggcugagcccccacaagaugaauugguccaggguugggguugggcaguauuuggcugaugcaaagggaaguaaaauggugcuuaaagaaggggguaccgagaaaaguucaucuagauaguuauuagcaauccucuuacacacacacacacacacacacacacacacacacacacacacacagagagagagagagagagggagagagagagagagagaggcgcgcguuagcuugcuagucucucuccuucccccagcucucuggcugccugccucuuugcuacaucuguauaaaaguauugggaaggcccacacacugugucuaugagaguuggcuagggcuuguuuccugccucgcgugcuuccagccuaagaaugaucauacuuauagagagacuuauuugucuuagagaauuuuuccuguauuauuucucaaacucuaggaggaagcacuuuucuauuuguuuccauauaaacccagcacaauucauuaaaaaaaaauuaaguugugccccgcaccuuuagauggcaaacauggaaaacaagucccaaauucaaauaucgugauaaccauccagcuaccauguacuguggcagcacaggccuggaccaaacccauuuguccugaauuuuagucggcuaacgauggacgauguagguauagaaaauaugguaaagauccuaauguucaugugcacaaggagcucaucagaguuucagagaagagaugguaauggcagaccgaauacaauggcaagugcauaauuucaaagcgaauaaauguguaauuugcugcuguuucucacugguuagaaauugaaagagagcugcaaauuauuugauaguuaugaaccaucgcgaugaccgcuugacucccccucccgcaucgccaucuacagcuuaagccauguucaguuugucugcuacacuguguuaacugcauuaaugcuuucuuugucccagauaaaaugagauucgguccccacucaggaaauauccucaagaauguccuguuucacguaaggggcgcauuugggauugacugcuaacuuuggccauuagcagaauuggguuagcgugaauaagguacauuucuuaugcuaauauggaugagacuaauggcauuugaaaucagccagccuaaaaaauaaaucacugguuugcugaaggacuaccccagacuucuacaaagcugaucuaaacccuuccaaucgcauguuucauuucuuuuagaguguucaaaggcacuggacagccauuccaaauagcauguuccccaaauccaugaaucucuucagaccccacuuuuuuuuuuaaaaggauuuguaacuuggaaagcacuacagauggaaaccaggcacacagaguuagcauuuggcagggaaauccauauaacugacuuucaguacagcucuuuugcccuuauuuaauuuagaaaaauucagaaaaaagccaaugagcucauaagucuagauguuuauuuuguuuugcuuaaccuacccacaggcgcaaucaagaauggauacaauuuuaggcaagggaagugagcuaguaaucagacaaugauguuuccaauugucucaagggaauguuacagaagucugaaaaaaaauuccucuaaacaaaaaucaaguguaauucacuuuaugaaugccauacaccacuuuugugggggguggaaguugcaggggucggaugggaaugagaaaaaucaaacaaaccaugguaguguuacaacuccccuaagauggagagaucuugucuuggagagggccuuggaaagcacuagaauggaugcagaaggcugaaugcaccuauguguaaaaggcagccuccaaggaccaaaaucacucgcaguugcuggaaauugaugaaagaaaaaaaaauuccaaaggaaaauucuugaaacaaagaguuuguuuuuaaaugugaguguguuugugugugugugagugugcaugcacucugaaaacuagcaaaccuaucuguguugccagcuguggguccccaauuauuuugaaacaacuaaguccaaauguugggagagacaaugagaaccgagguaugggagaauuuuuuuucucuccucugagauuucacuagacauuuagaagagcaggugauuugucaaaacuuuucaaaaguuguacuguccugugcuaacuuugaggaguuuggaaaauucuuuuagaugugcucugaauguauuuagugcauaaauccuuacugagaaguuauuuagaaggagccaucauucugauggagauggcggaugauugguggggcuccuuggcaggcuugcuuuaggugcugggggugccgagaggaguaagaugcaguccccuuugucaaggagcuugcaguagagugggggagcacacgaguaaacaagcuucccaggaaacuuguaggauuaaagagggugaaagaggcuagaaaagaccuccaggaaauuggcuggaauggucacaauaggcagccugggcaagggaaaagaacagaagagaugaagugggagauagggagaagucucuuaauagagccuccaucuuaaaaagacacagaagaagguuuugauggaugcuagaugacacagauggugucaguuuugcaauguguuuuuuuuuuuccuuaugggcugguagauuguauccaauauuuugaugcaauauuuuugagcauucuguugcuuccaucuuuagaguugcaauguuugcuguucacuguagccuaggaaaagacugcuuauuaccaaccugggagaagaguccuggauuuuucuccuaugagacaagacagaaaauauguuuucucuuuacauggcagcuaucaaugaccaugccaacuuuaguguuugaugccuauacaaaagcaugggucuuaagaaggauuuuauuacucauuucuaagaaaauugaagauaaucacuuauaacuugugcacacgauacaucauuuggaaagaauuucacuggggaucauguugcucaacugaaaaguuuuggcgugcugaauuuguacauuuuuugugaaugcuuccuuuuacucugaucucuagcuuuuuuucugcauaugguuauuuguauguuuuagauuauaagcuucuuaaagggaaagcucuuugagcaguguugagcacagugcuaauagugccaugcggcauuuggcugauaauuaacaagaaagaauuucuagaucaguaaguauuuuauaugaacuuucgaauacuuucucaagcuuauuuuaaaagcuuaagcccaaugcuauggcacacucuuaggguguguagauaaacuuuguagucuuuauguauuuuggcuguagacagauccaggcuuauuucaguuaucugcugacucuuaauaacugguagggcuuauuaauauugaauacccaaagaacaaauugaagucagcagcauuguuaugccuggauuaguauaguuaaagaucaacaauuauuauagcacauaaaucaaaggaccucuccuaaaucaaguccuguuugauuuaaugucaaguagacguuuuucuaauguugguguugccauauuuggaagucaagcuaggagacaugcacagaucuguuguaguaccucauggguuuuuguaaccugggaucagaauuccuguacaggcucaacucaagagacuguuccaacagccaacaucuguugaacccuagccaaucuuguaaauggguuugauguauuugguaagcuaggcuauaaccggaaguaugggcaaaaaaaucccguaauuauuugcccauauuuagcagcaugucugaccugaaacaggaucucuagcacuccauuaagaaaugaacaucagaguuggagaaauggcucaguagauuagaguacuggcugcucuuccagagguccugaguucaauuuccagcaaccacaugguggcucccgaccaucuauaaugugaucugaugcccucuucugguguguguaagcacucauacaacaaacaaacaaacacaucuuuuaaaaagagaaaugaauaucagaaaaucgaauccaagccaugguuccccagauuggcuuuagacagcguuaagugagugggaauuuaccucuugagcuaugauggcagagagaacaugauucagaaagcagugcaacaauggccauaucagcagagaaaaugcauuuugaaauucugugugugaguggcgaggcacccacuggaacaucucaggcccaugcagagaccuuuuugaauaaacaaggaaagaagcuuuacuccucuacuuuaaauuaggacaauuaaauauuauauacacacaugcuaauuaucaaaauucuugucauuuaaaaaccaccacuacccccacgaacaaacauaaacccaaagugguuacaaagaaagacauuuuucacuuuggcuucucuuugugugaagauugucgaagccacauuugagaauuugcaucucuaguguucugaacaguuaauuacuucuaggagcugaaauuguauuuauaugccagauuaggaaaucuacucagcucuuugaagugugcuuaauaggcuuauauugauaaauaauugauaagaaaggagauaaaauauaggugaaaauggcgauaagaggggacagggaagucaaagccauuauaaaagaaacuucuauccauugcaugcauucaugcacuguaagaugaaaacuguucauuuuucaacaaaggcuagaguacuuaaaucuauuuuuuuuuaaguuuccacaaugaagcacguuuuguuauaaacugagaagguggcacaguuuuagggcaaaacuuucauugauccuuugaagucuuccuuuugaaaauaacuugaaauccugguuacaguaaccacaagguacaguuucacaguuauuccuaucacaagccugguaucucccuuagguuagggauaauaugguauucauuuuuuaugucuacauuuagugugaacaauagguacuaguauguauuuacugaccaaaugaaugcagauagaauguacuagaaacauacaauuucaauaaaguuaauauuuaggaguugauuuaauuuuacugggauuuuaaaaaaggagucaccuuuucagguuaaaaaaaauccaucuguuaccuauagguaaguaaaaagaguauugcuuuaauucaguugcuugugccuucauucccuggaagaaguagacuauccaagucuuacaagagggguaaguauuuuguucuuguuuccaaggcaauucuaaguaauuuaaagguaagguuauacacaucgaaacauucaugcauuuucuuuacuauauagaucuuuugaauuuugguuuaugacaauauugcucccaaguuucaguaaagaugugcaguucccuagcugcugcucaacauaccacuuucuuauagcauacucauuaagcuguccuuccuaaagcaaacugauuggaaccaagcuccuccucaguguuuacaauuucuuacuuaugccacuaagauugauguuguguuuaaaaggacauauuccgaaauauguuugcaggacaagaaauuuuauaugguaggauaaaauaauuugcauaguuccuuuuuuuaauuccaguucuguccccucuccaaccacugcuuauuuaguauugauaacuauguuuuaggaaauccugagacucuccauugcucuuuacaaaccuggcuuugccuaagugaagcugaagggaaaguggugaagggguagaguuagaaugacagacguggggaggacauuaagagcucacauucugguacauaacagaauauuaacuagcauagaacagacagagaggacuggcaaacaucucaacauggacuuuugcaaguccaugcauucagggauaauacagagagacaacugcaccacaagugcauuuguugcccagaauauuuuacccguacgucuugcuuugcauccaugauuuuaaaauauauagggaagucacaaccucauccaaaccuauuguucacugaaugcaagagccauauuugaauccugaucuccucuagacuggugaguacagugacuuguacagaaugaugauuauaauuuauuacauaguuaaccaacauuugaagagggauucuuaaggacuugacuauuguccagugaaagcuugggaugacauguaacuaggagaugcuucccugagugcuugguucucuaaacugguuugcagcagagaaugaagaaaggaugguggaguugaaacacuggcccugggaguccuguuggccuaagaagauugaagaggaggugacacagagauuuucuuaugguguuauuuaaauggugguauuugaauauguauaugcauauauauucauacauuacacacuuauauccauacaguauuauuuugauagucacaguuaauuacacauauuguuucagcucaaauuuguuguuacucuuaacaguggguagacuuucacagucacaguuuauauuugugauuugaaagcugugcuuuaauauuugucucugcagcacaguuacucauaaagugucugccgcuucucaguuccagggaugggccugguuccaacaugcauguacgugcaugugugucgaguguauucugcauacacacagauaauacagcuacaacacaagcaggguguguccaaucuguugcuugugggucacacacaccuauggccuaguuuagcuaugaauacagcucaacacaaaauuguaaaauuauucaaaaucauuaugagauuucuuuuucauaacuugauuguuugaaucuugagcaugaauucuguaaaugaugacauuuugucaaaacauccaaagguuggagaugucugauggagggugagccuaacucucaguggaaagaacuaaaggauacagcauuccacugaacuagggaaauauguuuuacauacguuggcuccaaauugcugcuguacugguugccacugauauaagagaccuacugcuuaguuaucagguuucaucauuuccccaaguguggagauguaauucucauuaaguaacuacagucagcccauacuaugacccuggaccauucuggaggaccgcuucuaguauuuuaaguauuaagcggguaguauuuuaagugaauggggcgccaaaggcacuuuccaaucucgauuucugaaacaauuaauauauaaaaaagugcuguugugugaggcaugagagaaguaaaggcuuaugacaaaaugaagggcuggagaguuagcucauugggccaagugcuugcccugcaagugugagggccuaaguucaaauccucaggacccauguaaagccagcauaauaacaugcagacucaauuccagcacuccuauggcaacauaggagauaacccugguagcccaagggccaacuagcuuggagcuguugacaacaaagguacugucucaaaccaagguggaagaaaagaaauggcaccugaggcuguccucuacuacacacaagccuuuacucacacuugcuaggugugcuugauggcuuggguucaaucccuggaacccaaagaaagauaggccagaaccaaaugcacaaagcaugucuuccagccguggccuaugucacauguucacacccauuuaucauggacccacacaucauagugaagugggagaggcuacauauguaggauguaucaguauauggaugguaauugaaguccugggagcuuaccaggaaaguguggaguguggaugaagcauaguugagacucaucaguauauaggcucaagugguucuauggguguggaugguauuuuccaggccucuucauuggacaugucuuaaaauauauuuugccaacaucuggugauauuuuaaaaacccagcaaaucuuucaagagcuuucuggauuaagaggaaguaugagucuauguugucauagucuaagcuagaagguaccaaacacccaaauguacauacacauggagaggggaagaggguuagacugaucgagagagagggaggaauauauaucuuuaucucucucuaucauuuaucuaucuaucuaucuaucuaucuaucuaucuaucuaucuaucuaucuaaucuuucacaaccccacuuugccauuugaaagccuuguuuccauuuaucucaucaaacaccuucuuucauuccaauaucguggcauuuugcuccuccccaaguggggacgccacuacucuauaagaugaaaguuguuacacuguuuuugggagaucuggcugagauugcaugcaggcuagccucugagacaugugguucuaagcaaagucuaguaauacuuguaaaacuagggugaucuuucuuucuuucuuucuuucuuucuuucuuucuuucuuucuuucuuucuuuaagauuuguuuaugucuaugaguacacuguugcugucuucaugcacaccagaagagggcaucagaucccauuacagaugcuugugagccaccaugugguugcugggaauuaggaccucuggaagagcaguuaguguucuuaagugucuucagaguuuuguuucugggugaggaaaaagugaggugucuuuaaugucucuauuguuuaacagguugccuucaccaggguuucuauuuucauuuuuaaagauugcuauuuuauuaauucguccaauuauaugucugcacguguuauguaugcgcuugcccucacaugccacaagagggcguccagacugucuggagcugaaauuacaggcaccaugagccaccugaugggggugcugggaauugaacucuaguaccagacaaaaacaccagguucucuuaacuaugccuaguucuacuuucuuuuaacacauacuugaaaacuccuuuguuucuaguagauuggggggggguguaucauuuuuagguugguuggauaguucccccauaugggacuauuguagaaacuaccuacccaguacuuacuguaugccacuugcaaucuggguaauuaaucacaauauauaaagccaaccugaaaaggagguggugcaugcccauuuuauaguuggaaaaacugagacccagaaagguuuacuuucccaccguuuguguaaaugguggcagcaggacugaaaucuagauuuguuuuacuccaugucuaauguucuuuccacuguaucccuauccuuuggaccgugaggaaaauaauauaauguccauggaaaucuuuggucugaauugucauguuccuuugucuuuugagauacuguacauucuaggucuucuacuugauucugccuuugcuuguccagucuguucaugguaaccuuugucagaugugggugcucagugccauguguccucugugcuucuccauugucuuugcuuacucauguaccuagucccauggcuuggcuaucauguuucaaugguuucuacaucuuuuaaucugccaucuccuuaacuguccaauucagaaucucacaauugccugcuaaauaucuccaucaggaaguccuuagugcuucaccuaugacagagccaaaacuuacucgccccaucacuuucauuuccuauuuccacuaaccucuucauaaacuucuacauuucuggugauggcuuuccuuuuugaugcaaagacuugaaaccuugacaucaucuuuaauuucucacacccuuugucauaccauguaugcccucuauuuguagaaacuggauucugaaccauuacugaaacacugcugcaguugucuguuggcuaaaucuuauagaccccuccccugucuacccaucaucgcugcacaauguggucuuaucuaaccuuguuuuuuuaugaacaaccccccccccgcccgagauguaauuguuccuuguuaguaccacgcuaucuucuaacuggauuaaaaucugcacucucagcaaggucucccagugauuuguauguguguuaaaaguuugagaaaagcuuccaagugcaaguuagaugagggucagaacugugcaguacuuguuagaaacauacauuaacaucuuaaacauaaauuaacauccuugucauuuuucacaucugugcuuugcccauucauucacugaaguggccuuggggaccuauaaauaagguauacaugacggagcggggaaagaagaguggaggaaggagagaggaauggggaugaccgauaagaggagagggaaugaaggaaggagaggagggagaaaggcuaaaggauaaaugaugaugggguaaugaacuagccauagagagaaguggggagagccaaacuugcaggagcaucucugaguagcugguaacuuugugacuacuuugggaaacaccuccuucaugguaaaagugcuguagccagggacaaauaucuccacucaugauauugcuucucuagggggauggaaugggugaaugguuucuuagggggauggaaugggugaaugguuucuugcuuuuucuuuugcuggcuuucugaggucuaucuuuucuggucauuuccauaagucacuguacaacuugaaaggucucaaagagucauggaggacugcauucaguguuuccaacagacccuucuauuuucagaaacaguucugcuuuguuuucaagcaucaguuuauuucugaaauaaagguuuauuuuccccacuguauucugaaggguuucuacaaauguuaauuucucaaguuuaagucacuucuugccuuugaaauuucagugcugugggucaauuuaauaacguuaacuaaaguggguuuuuuuuuggggggggguggugggacacuucaaaagccgccagauugguguuucuuuguucuuugaggaaguaaguuugccucauucacaaaaccugaaggugacagacucuggaauccagucauuuagagucuuccuucaacagcauccaguuuuauuuucaaguuugguccuaauagcacugacuaccaacugucacucagggguaaaauuccugaaaaucucaccaacacuucauagaucugugcuaaugagcagcccaaguuacuuagcuaacaccccauggcuaagggagacaagggacuuuacacaccuccagaucauaagggcccuccuucaucugucuccauuccucugcuucccuuccauccucacauccucccucaacggcuuauaauuuaaaacagaagguguuuuaugguuugcuauauuuauugaaugguuuuguguuucuuguucuccuaaaaaagagcugaguauaauguuuuguauuuuccucugcguuuuuguuuuaaauuguauuuccuuuuccuauagugauuuuucucccuccucucucccucucuuuguguccucugccuccuucucaucugccuuugcccagagauucugccccaucacugggcacuggguaccugguuacuuacuucucuugggauauugugaaauucuguuccuuauuuaguuuggaagugaagcacucuaaaaugucccucuuucuaagaauugugaguauuuaaaaugcuuuuuguauagacagaacaagguuauggauauuugacaaguagcucaugacuuaguguauacuugacauuaucucuaacuuuaucauaauccucagugaaggugguuugcaucuuuguuccugggacucccucuuucagggcuggagagauggcucacugguuaagaacccccccccccacacacacauacacaaugccuuuucuuuuucucuaaagauaagggagcccccuugaaauccugcuaacaucuguuggaacuaacaccuaucuuguagguuaaccaaauuacagucugcuucucucugaugaccucaccacauuucagggacccuguuuuacuugugggguuccauuguuccagucucaacccucacuucagguuugagauuuuguuccaacccgacugcucagugauucuguuucuuugucuuuauacuuaugggcaucuuuuguaugucuugugucuauuaucucuuccaagcuuggccaagguuaugaggugaugcacuauauguauaaauauuuaauaagauaaguuagacaaaaugugcuugaagaaauuuccgucuuucuccugucccccuccccacagcuugcagcuagcuuggucucucucucucucucucucucucucucucucucucucucucucucucucucucucucuuucuguauguguguguguagagucaacaacaguugcuuuaucucagauguuuagauuuggagaacauuccuuugcacuuugcuugauggacacaguggaaugcaagcuuucgagucaaccaggaccaucaaaaugcuagcgccaugucacagauaacauuagucucuuguccuauuuuuuuucuaacugguucccuaaauuccccuaagccagaagguuugagguaugagauuguguguuuuuaaagaaaauauuauggauaaagacuaauguucucaaggcaggaagaacaauuaguaccauucauuaaucagggaccauguuuugacucuggguccuggcuaggaaauauaaacugugaaagucacacauauauaugaaccucaggcaaauuuaugacuugucagccuuuuaagguuaaauucuuaaccccaaaucagggcuggcuuuauauguggacucuagcacauuccucugggccacugagcccgccccuccccagcccuuugcuuaacagcagcucuaggccuaaugagcaagaaggauuucugucucuuaucagcugccuaaagagcaacauuaagacugauguacagaguuuaggucaaaacuugaauucuugaacugaaaaacuacaaggucaguuaaaagcccccagaauugcgguaucucuuuagucaucaauaccugucaaguaaagcaggcagacacuugaguucaaacaaauaguaauaguugccaaagccaugaacagucuaauuaaguuuccuaauaguuccuuccuucuuuguuuaguucuucuauaaauagccuuccuauauucuuuaaugagcuuucagugugugccuggagguuguuauggucaugugggaguuuuugauugucagauggugaagaugaugaagguaagaauauuuauaauuuuggcucagauuuuuagaagggccugccagaggaaggcaaguagacaccuacuacuuacugccuuuguuucuuucugaaauggauuuuugaauggcugugaagucaacuugcuaugaaaucagagaagucuuugugccuccucauauuguacucacauuugaaaaaggagagaaaguuccugguucugaaaucugcuuggaauccaggcucagacucacacagaauaacuauuuuaggauauucacuacacaucauagugacuuucaucuucuguguuugcauuuuuuucagauacaauaaugaaaacauuuuuuuuagauuccguuuuguuauugaaaauccuauuuacauaaacaggcauuguuguggcuuagagaagaauguggggucccauucuuuagcuccuuguauaucuuugcuaaggcuugucuaaauagaaguaaugauguuuuagucuaagcagcuuuucucauuuagguaagcagggugguuugaaaucucaguuuacuagauaauugagucucuucuuaauuauuucaggcaugcagguugcucucuuuauaguaaagacccuaaaaaucuaguaaucuccucaggcauccauuugguaauaaaaucuagugcguuuucagggguuaauuuucauuacaauugcauguuguuucccuacccccaugcuggaacaaauucugcuaucuuuuagaguccaguuuccucacacugcaaaaucacacuuaaaaaaaaacaucuaagaguccuacuggaaacacuaagucuagaggaaauuuaaauggauucauauucaugcucauuacacaacuuucauuuagaguuuuuaauagccuugucauauuucuugaaaaaucauauggccgacuuugccagauuuggguuucugcuuugaaugaggaaaaaaagauugagaacuaaagugaagccuaaguauccuuaauuuguccauuucacacacacacacacacacacacacacacacacacacacacacauaaauaaaauaaaauaaaauaaaauaaaauaaaauaaaauaaaauaaaauaaaauaccaaagcucccaauccagucacccagccuaaaucccucagaagucaucuggugcauagcuagguggggaaaaguuugaaaaaaacagagaaagaaagaaagagagaaagagagaaagagagaaagagagaaagagagaaagaaagaaagaaagaaagaaagaaagaaagaaagaaagaagaaaagaaaagacccaggucucuuucacaucugcuagucauucaacuggugugacuucaauucagcaaguuuuuauuggacaccugugguggggguggugcuaauaaucauuaacauuuauugagccaggcacugugcuaagccuuuuaugggcagcaucucacuuaauccucccaacagcacuaccaggugguacaucuuuucccuccauuucacagaugaggaaaccaaggguuagagaggguuagcuccuugucuuugaucaaguaggagcacaaugaaguaaauccagugcucuuuuacuccagaaucccaucccugccuuuauugucauugucaugauagguugagcauuuuuagaaaacucauuuugaaaacugaauaugucugagaugcuaaggauucgaugucaaauacucuauuaucccugcuuuugacagggaaaggagauguauagauagaugcagcucucuuccuguugaaggaaaggagugcauagaaagaccaguggcuggaacucuuggaauguugccuucugaauacacucuuguagccuagggccauaggcaucucuuuccugcuuagugaaagugguucuuccccaggugccaaccucuuuccaucugugccucagcccacucaagccuuagcuaucuugaaaccaucacuccuuagauaugcaugguugggggcguugccccuaucuuuuccaugucacucucucuccuuuauuuccaauuucauugcaagcaaggcuaaaauuaaauaagacagauuauuccugaaccagaucacuguaucucaagagcuggaggcaaguccuaagaguggcaauccgagggagacuguggguccagacaaguguauucaacuagaucuggacucccaagagcucuauuucugacucacccacaguuugauaagagagucaacuucccacugggauaauuuuugagauuuucaguaaaauuauggcaauggaaaggaaaagccccaaguucccuguauggauaauuuauuuuguuuucauaguuucuaaagaaagcaauaaagaaaaaagaaaagacucuuacacuuuccucaguuuuagaaaauauuugguucaggcgaaaaugaauucaguucucucucucucucucucucucucucucucucucucucucucucucucucacuuuuccucucccccacuuccccccucucucuaugugugugugugugugcguguuugugugcuugaaaccauauucuuuggcuucagaucucagcuuaccaaaacccaugucucuagucuucuuguagucagucggcaauguuuuccuugucaacuccuuucuccaacacuuucuccucuaucaaaucucuuccauacaaaggggauaucaccagguuugcacuucaguaaaaugccugagggugaccaacuggugagaauuuugauuccuauuacuugggugaguguggggagguagaaacgauuuccauccccgcccuuuagguucuuaaguucuagcacaacacugugguggagacugauaacauuacuggagcauuuacccaguuauuccccaagauggcauaaacaccacagcacuggagcacgcacacccagucauucagauaaguugaaagaugagaaaaaugaaugauugauagcagcacuucucgcauaggguuagagagaccauuuggguuucuuuugguugcugucuucuuagaugcagugugugugcugcacuaacaaggcaaccgacuccccccaccccacccccacuucccacagucucuauccuagggaaagacgaaagauauaauagaggccgcagauuauuuacaguggcugagaauguaauuacaaggugcaauggcuugaaacugaaauguagguuagccauuagagcugggaaaagcaucuucacgguaaggacaauugggcauuggaaagauuugccagcgagcugguuaaauagcaucuccagaaaugcuaaggaguagggcagggggaugugaagaaaaauccaaauucaguguugggcucagguccagacucaugggcagcuuucauuacugcccagcuucccuucugauuauuuaauugcuaaucucuugaaagagauuuuuuccauguauccaaaacaagccuaauuuguuaagcacuagauaacaaaugccuuugagcacugagaaggaggcauugggauuggucccaacagccuccuauuggacuuucuggaauaugggccaacaacugaggcaguguuguuguuuuuauuauuucacuuacgcagggcuucuaaauccuuauauuauguaaguauugcaguuaaaggacaauuuguguuauacuaguauuauuuaucuugggggugaccucaaacaaaauuuggguuugguccauguuccauuuucaucuuuuacuuggucuuuacuuucuuuguuguugauuaaugcauccccuuuccugucccuuauauccuccgucucccuaccuccuggucuaugcuggaggagguucuuaagcagcaaggucauauucuggaguguugcauaucaggacagcacuugaaaugaauggcagaacacccucaggaugaaacauuuagacaacauuagguugacauuuuccuuuaggugagguagaaggggagauggcauauguguccuagggcugccacaacauguugccuucaauuugauggccgaaaacaaugggcccuguucccccaaaccugacaguucuggagaucagaaauccaaaggaaggcuauuaggcagcauugccuuucuaaagacucugggggaggauuuuuuucuuugcccuuuugagcuuccaguggcuccuuuucuguggcuauaucccucccaccucugccuccgucuucacauguccuucucuuaucaugugccuuuacaaagaugccuguuauuggauuuagacuccaccaagauaauccagaauaaccccaucuccagauucuuaauuauaucuuugaagacccaccccccuuuuuuuuucuccaaauaaggucacaaugacaaguuccaggagcuggacauagacauaucuuuuuaagaaauaacacucaacaaucuguagaugugggcuuucuaggcccucuugaaucacaucaucguaugggcuccugauacucaaagggaauuuguucaaggaauguuuaaaguagguugucagaugucaggguuuucccaagugggaugugcauaguaccugcuguuaacccauuuuuuuucacaugauuaaacugaggacauggggagucaaaaagucauuuuggaucaaaagaaaagaguuuugaagcacaauaggcuaccauguuauucagcauagauuuuugucuuaugacuuuggauuuuuuccuugaaaaagucuauuuucuuuccuaaacacuuuagccacaggaaagcaauuacugcuuauuaccaaccugaaaagccuuuucacaggaucugcgggaucaaggugauggugcacuuuuggugugcugcagcuucccaccucuuugugauuugcugcaauacuagcaacagggagauuuguaagccagaaacaucugugaaacaaaagacugccuuuuuagguacaggcucaaaauacagacauggccugcauacacagcgguuaauauaguuugugcagaugagcguuccacuguagaaacaguuucauauuuguuaugacaaagggacaaguugaaacauuccuggcuuaggaauacauacauacaucuauuuuucuucugaugggggaaaacuuagguguguaauaugacgaggaaguauagagagaucaccagaaugucaccuacugcagaguugcuucagugaucucugauaugacuauucaaauuguguuuggaugcuucaagagacaggagucccauuguugacuguucccaaguccaauagucagcauuuguaugaaccauagaccaggcuccuuuccauugcuuugcaacaaucccguuggcaaaauucugucuccaaaaauauuugcauuauaauccuuaacaguagcaaaauuacaguuaugaaguagcaacaaaaacaauuuuguggcuggaggucaccaccacaugaagaacuguauuaaagggucacagcauuuggagguuugagaacaacugcucuagaccaugacaagaaaugcagacaucgucaagauaaaguucuggcccauggacuugcacagcucauagcaggaauaagacaagaacaucaaugugugcagagcuuuucagcuugcaaaauauacuaucagauagacgcaaaguguauugaaacaaaucagagcuaucauaccuccuaggguuuauuuggagggaagggaaacauuuuaugaaagauguacaugagggagacuugguggauaaacuuuuaauagcugaaacagaggggguaacaaccaaagaaccaaaaugagcaacaugaggaagcagggcaugcauggagacauccauuuuggaaaucuuaaagacaaggcuauaacacaacagccacuggccacuaaagagccuugcaugggaccuugagcaggucacuucgucucuaaagcucagaugcaugccauccucuaaggaagcugacugucaggagauggcuucuggaaauacagauccuuaguccuugcaagcaaguugacauggagcuguugccuaccuuuuagaaaagauaaaaaucugggguuuagagaauggagaauauaaucugcugcuucuuuuuguguccucucaguaccccaucuugugcaguuagugaacacuggcuauucugugcuugcaaaauaucagcucucaaggccagacccuuagagaaaaaccaggcccagguuuguaaaggcaacuugccuaacucacagcucauuuugcaacagagcagaugauaacacuugaucccugaugugaaagacucucuuccccaacggugugaucucauugugauuucauagagaaggaagagcugagcccuuagguuuagacuaggauauugaaauucucugcuaucacucuggcucacgugcuugaagauugcaucucaaaaauuaaaaagaaaaauuauccaucuuuugaaagacaggaucucaaauacuuaccuguguaguauaauaauuagggagucacuaggggagacggugaaauuaccuuagcuaaauuccucuggaagaaaucuaaacuaaaagaauauucugcauucaacuccagagugacugccacaguucuucaguccaacucuagcuucauucuccaauucaauuuucauuacauuaagggcuuugcuaccauuuacauagccauggauguguguguguaugaauccuuucauuauuguaaaauuuauccuaguauuaucaaugaaucugacccauuucuuuucaacagaagucuccugacauucuggcauuaccuccacgugaaagggaagggcuucaaaccacaaucagucccuugagguacaaacaugagucagugaaaagucuuucccucaaggaacuaaaguccacagaaggcagauaaauauaacugugaguccaguuagaaugugagaaguaucaauaaaaggugggacugugucauguaaauucaaaggucuaaaacuuuuggagucuuuuucuuuaaugauucauauaugugagugaguacauuguugcugucuucagacacaccagaagagggcaucagaucccauuauacaugguugugagccaccaugugguugcugggaauugaucugaggacccuuagaaggguagacagugcuuuuaaccacugagccaucucuccagccccuggagucuguauuuuucugcucacaagaacauucucuaccaugggacuccagucuaaagacaacuagggauaaugguccuacaugacuccgccuuagcucuccuuuccauucuagucuugccagguucccuagagugccgaacauuccaccuacuuagagaucccccaauccuuugcuccauuuucuuggagaauuugaaagaaauagaaugauuugacuagaaauggauuguagaaaugucucugaccaauuaagugaagaaagagauaggcgccagaaguccacuuuggagguugugaggugaugagguagcaaugggaagaggagacucagggacauuuaaaaagcaggaacaggagcaggagcucagaguugagagcacaaacugcuguugcauaggaugagaauucaguucccagaacaugucuaaugccugacaguugacuguuuacaccaagucuagcgggucugacacccucuucuggccacugugggcacugcacuccuauaaacacacaccccuccggcuauuauauauacagauggagaaagucuaaagcagaauccguugaauaucacaauauuuggcuauagcagaugaagaugaacuaagauaucuagagugaucagaggucuaguuaggaauccuuagaauaaucuaugaacucuagggcagggacugugucuugcaacauuguauugcauugggcaugguucuuggcacaaaguuggcauucugugaaugcuggaagaaugacuuuuucaacagguggucagauugaauauaggccaugacuuugucuuuccagagugcaugucuauugaugguuggguaugugguccagaaagaaccacuuuguaaggaguguguuguaugugucugugugcaugcacgcgcacaugugggcaugcacacagaaaucugaggauuuaacuuuuccugggcauaaaaugauaggcagauaguuggcaguuggcaguacagauaaagguaguucauccuuuaauucucaagccuagagaauagcuuaucucuaggguugcuuuaaacuuccaaugcuccaguguaguagcgacauuuuggccugccuuuuauagaagcugagucuauggcagccucaggcauagucuuugauuuaaagucugagcucuugauauccaggugcacccucuacaaggucauguucuuucaggcuaacuaaccuucugcuggcuucccugagaucauuucuuuaucagcagagaucacuuuccccaaugguuucaaaugcagccauuucuuucaucuguauuccuagcuugauuagugagaaauuaaugagcauggaagauuugauuuagauaaugauuaauuaggggaaaaggugccagucuaauagcuagucacuauuauaugcuaaggaaauuaguuaauauuuuuggauggcaaauugacuuguccuuuguuaaauauacccuuuuaaaaugccugauacauuugauauauaauuuuaauaaacauguguuaguuuccuuacaagucaugaaguagccagguuuuuauaucauuaaauucuuuuguccaguauuaccucaugauaauacugcuauuuuauuuucagcacaguguuccuuuguuagggaaaaaaaacccacugcucauaaagcagaccuugacaaugaaaugugucaaaucaucacacauacucacauauauauggaaaagauuucaauuuucauuguuacugagcccugacgauuuuuuucuguugcuguuugaauaugcuguaucugcucuuagagaagcauaaggaucaaggucuacauggcaauuuuuucuguucuuuaugugcuauuuaguaugauuuugacaauuuauugucauuaguuaaaauuguagucuuauaaaauaaucaacaaauagaauauaauaaagguaauuagagaaucggaggacuugaagugaccuugagggcuuauucuguccauuucucaauuucaggcuaugugacucaucuuccuagacagcagucguugucauauuauuccccuugugugaaaacaucuaguuguucauuguuugcccgugguuagguccacaggucuuggccugcauucaagucccuucaaauuugggccuuucguacugauuaacuguagcuuacauugcagccugucucuggccaaguugaccuguuuacucuccuagugccucucgaaauccuuucuguccucuguguucuaacucaagccccauguccucuauugauggauaauuuguaaacaauaagaugcacccauuuuaagucaugacuuuugacaaacauguauaaacucuuguaaccacuguuucaauuaaacuauagauuauuuucaucacuucagaaaauguacugcauauuuugucacauaaccaugaaccaauuuaacuguucucuaguuauuuuggggugugaaagucuggucuccacaugaauuuaggcuucuuuuuuauuuguuuaauuugaauuaacacuuauuggagguuuacucuguagcaagaaggcuaagauauuuauuuaaucuaugaagcaaagaguguugguaaucccauuuuacagauaagggcaaaaaaacauauaaaggucaaguaagcugcccaggcuuucacagcuggcaaauggcaaggacuagccucuaaguaccuuaaccuauggaacaagaagaacuucuaccuguuccugcuauuaccacuuuuaauaaugcuggccuccuaucuuggaauaaaauccaauaggacugacauauucacauauacagagagucaugugcacucuccacucuaugcuguuaaugaugggaaagggguagaguuucuuacuacuucacagccuugguggaguuggcuaaggaagacuggggguagccaaaaaugucaggucuuucuauggaggcaacagaaagcgugaccuggguccaaugggaagaccuugggaugacugucaagaagguugagccgcagaugcccaugccuggagacaucaucagauguaaauguaaaggggcacguggaaaaggugcccaaauugagacuacaugaguagaacccuccaagagauaaagcugcugugcuacagauagcccuuuucaguuguaagaccccaaacuggauuccacuugcaagaaagacuuacgguuaaaauaauuagaaauauauguugcauacuuccuucaagugaaacacauauuuguguauagucaagaugcuuggaaauugcuuuuaugguauuuuccuaagaucaaaguuauauaauuauacagaucuaaaacugucagaggcaucuccacuacccugaucuuuaaauauaggcagacacauaguucuuguuagucuucucagucuacgacucucauuaauucaaaugguauguacaucaguugaaugagaucgcugagacauuccaaaggagaugagagucccucucugcucuuuaagaaauuauaauguagcugggcgugguggcccagcacucgggagucagaggcagguggguuucugaguucgaggccagccuggggacagccagggcuacacagagaaacccugucucaaaaaaaaaaaaaaagacagaaagaaaagaaauuauaauguagagaguacagcuauacuaugaagguauuuuuucauccuccaaaauaaaugaaaguuaguaacccuguaaugacuuuaguuauuauuuuuuagcauuugaggaugaaaguuuuuaagucuccccaaguugaccucccuugacuuauuugaacagugaagucuucuauuuauugccaugcuaggauguauuguuuaucacacuuuccauuuccaggugaauuucauucuuuacauaaaagguaugugaauauccuucuuugaaaguuuagcccaaaguuaguuuucugucuacuauaugggaauguuucccuuuuacccuuuugaaccucaugugcuuacagaaugcuucccuauuuauuaagucuuuuguucuuugcuuugaaaauuauuuuauguguguggguauuuuguuuugauaugucuguguaacacaugccuguaguacccauguuagccagaagagggcaauggaucuuuugaaauuggagaucucagacuguugugagccaccacuugggugcuggcaauugaaccugggucuucaggaagggcagcuaguacucuuaaccacugaaccagcaucuauaauaugucuuuuguugguggcaucuuaguucuucuauugaucuuuuggcuuuugccauuacaaguguguagaguauucucucaguguaucuccuuagccauuauuugccuuaggauuuacuugguauucauccuauuuuggaaucaguucuuagaguaauauuuuuaauuuaguugauggcauuccaucuaacuuucuucucaauaccuuuuugcuuuguuacuuuccugcaaaugcucacagcauugaagugguuaaauuucaguacuguuaguucauuuaggcaugaguuugucauacauugaauuugucaugaggguuuuuugaaguuugucuacagauuauaguaaauuuauuuacaacaaauuauuuuuuccauuagguauguauucccuuugauagggaauccuuaauccuuaucauuuaugauugucuuuauuuccuugacuccauagccaacccuuggucccugagacuaauuguucugguuuauugauuuaccaggcacuaauaauugaaacaaaguaaauauugcuauaauuucacauuuacauuuggacauaaauauacuuacaucuucauaauauuuaccaucaucccugaaaaguuuucauuuuagcuuuuauuccuuuuaaauguuuuuugcuaaccugaugagaugaugagguuucuuuuuuuucuuuuuuuuucuuuuauuggguauuuauuucauuuauauuuccaaugcuaucccaaaagucccccacacgcucccccaccacucccccacccacccacucccaccucuuggcccuggcauuccccuguacugaggcagauaaaguuugcauguccaaugggccucucuuuccagugauagcugacuaggccaucuuuugauacauaugcagcuagagucaagagcuccgggguacugguuaguucauauuguuguuccaccuauaggguugcagaucccuuuagcuccuuggguacguucucuagcuccuccauugggggcccugugauccauccaauagcugacugugagcacuucuguguuugcuaggccccggcauagucucacaagagacagccauaucuggguccuuucagcaaaaccuugcuaguguaugcaaugguaucagcguuuggaggcugauuaugggauggauccccggguauggcagccucuagaugguccauccuuucgucucagcuccaaacucugucucuguagguccuuccaugggugccucgcucccaauucuaagaaggggcaaaguguccacacuuuggucuucguucuucuuuaguuucaugaguuucacaaauuguaucuuauaucuuggguauucuaaguaucugggcuaauauccacuuaucagugaguacauaucaugugaguucuuuugugauuggguuaccucacucaggaugaugcccuccagguccauccauuugccuaggaauuucauaaauucauucuuuuuaauagcagaguaguacuccauuguguaaauguaccacauuuucuguauccauuccucuguugaggggcaucuggggaugaugagguuuguaagacuuagccaagggauaguguugccauacuaaauaacuguuuggaugauuguaucaauagcaaaucaaacuguugucaccauagcuuagaaucauucuuaaacuucugcaggcacauugaacaacauuucauuacuguauaagaucuuagcaacacagcacuuacuagaagaaaaaauucaucccuauuauuuuauuccucccauaaccagugcuagugaaaaugguugcaauacuaacagccagccauccuguagcuauagcucagccauucuacaaaacuggaaaugauccccaaggcaaauuagaaaaauacagagcuuucuuugucuaugacaauuaauuuuaugaacuuauguaaguucagagaguuuaaauacacaugauauaggcauugcuuucccaaggaaguaaaucaaaccuuguuaaaugaucagggaccuaguauauggaaagguuuacuaaauagaguucuauccccccccccccacaucuauguguguguuccaaccaaccuuguuuacauuuagaucagccacucuuccucaagggggcucuuuuccuucuugguccaguagacugaaucaguuuccacuccuagaauagcagaauguuuuguaauuucauguagaaagaacauaguuacaacuagccccgauuucuuuuugugucuguuugugacuauaaucauaaaaccuuuaagcauagacuuuauuuaaacuugguuuaaggcuuguauuugagauugagguuuauaggagauaaaucugaacuccaugucuucagaucccaacucguauuuugccauuaaauaucacuuucuuuccaguagcauaaauuauggugcuggauuagguuugcugauauguauuaucugcucucuccuuuacugcauuuguucccuucuguaaagggaagcgaagaacuuguccuuaauaccuuggacucaacagugaugaugugagaaacacauggugaugaauuucauucuuaacuuaagaaaaccuuagacacaugcauuaaggccacaaucaauuacaauuacucugaaacuugguguacuaacaugacaguuucuguuaaguuagggcuaacuagucuccccuccuuuauuaaauuucaaaacuuaaaaaaaggugccuaaaauauccaauaaugcuuucuaaugucacuaagauuuaaugaaccuuacuuucucuaggaucuuaugguguugggcagaaguuaugguccacauacauaguuuaucauccuggugauguugauuuauuacguuuauuuucuaggacuagggauauaucucucuuaauccauuuagaugaugagguccucuugggcagugucaauguuguaccuccaauauaugcuacagugcuuggcacauagauagcaguuuagaauggguuauuggaagacuagacgccaacuggacagguaaaucuaagccagcauuggacuggauguucauuaggauuauuaggauaaaaaauuguggaggaaaugaggggggcugcugaaggaggaugaaaugucauuagagcagaguacgggucuguccccccuaggaaggagggauaaaaaaggaaggguuguguaagaaacccccuagccuauaguguaaaauuaagaaacuuuucaaaugggaaccuuuacccuaggguccccugugagcaaaguucuaugguauacaggaccucauaucuuggccauguacaucauucaugaguugggagccaccccuaaggauuguggccucugcacacaugguagugaaaccagaaagcagcuccugggcuacuagucaauuaaucccuccaggaggagagcccacaugcauauguucauagccacauggcagguacuccacaaguguuuacugaagagagucugaguaaacgaggaguaucggcuuaugugugaguugagggguucgaucccuagucacccuuugccacaaacaaacaaacaaacaaacaaaaccagaaagagaaacaaaagccaccuuugcagauugaaaggaguugaauucaauacccauuaaguauuaauauuuaccaaugucuuggaggacaauugcaaugagauucuucccaccucugucuccaggcuucaguguugucuucuggaaaacaaguuauaaaucagagugguccuugcugcuaccauauuauguauaucacuuacuaacugcuauguaguaaacagcauaugcgucacgaguacacauugacaauuuggacauguacuccacaaucaaaguaaugaagguguccaucacucuaagaaauuuccuuuccgaucuuugugaucuuccccuuuguccucuuguucugccauccauccuuauacagccaccacuaaacucucugucuauagauauuuuccauuuuguagugccuuauagaaauggaaucacugggcuuggguuuguugguuuguuaggauguaccaggacuucauuccuguaugccauuagucccuuccauauuuguauuauauuuuauauaguagucaucuucacuugacauuuuguuucuaucuuuauuugacuguucuccucaagacuauaaaugccacgagggcaaguccauugguucauguauauuguuuuguguacuuuacacucauugugauuggcaaguaauagcaaccaaauaaauauuuguugacucuuguagaccuuuaguuaaaacgguaacaaagcuuugauugguauugauguuuugauuuuuuuuuccggaacaggaauauuaggcuggccagacauauauuucacucgaaaucauaacugagauuuuaaaaaauugucuuagguugugcucauauucguaaauaacaaucaggaaaaauaaauuaggagaaugaagauugauauuuuaaaagacaaauuaaauguuuguguugaacagcccguacuuggugcugcuauaaauuaguuucuguagaauuuaugagucagaccucagcaauuagcugacaguuauucaaaaggaaucagcgaugagggcaauuggaugaauugagauaaacaacauaaucaagaccuacuguauuuaaaaagaaacuuguuguuuuguccuguuuaauuuugugugugugaguguguguguguguguuugugugugugugugugugugugagagagagagagagagagagagagagagagagagagauuuucugcuuacugaaacaugaauaccuuauuuguuucaggaucagauuugcaaguaugucuccccaagggcccaacaugcugcucaagaaagauggaagaaaaauaccaacuaacagcacggcugaacauggaacaacugcuccagucugcgaguauggaacucaaguucuuaauuauucagaaugcugcgguuuuccaaggugaguuugggggaucauuuucgauguacuguucaauggcaucauuauuugggcacuaggcuuucaaauacuaaauauaauuuauaaauuaccauuccagcaugcaugcuugauauaaaaaccucccagugagagacccuggauaagaaacacaguuuuuaaaaggaacuucaauuuaaucuuugaaaaaguggauaauaggccgggcauugguguagcacaccuuuaaucacagcacuugggaaacagaggcaggcagguuucugaguucgaggccagccuggucuacagagugaguuccaggacagccagggcuacacagagaaacccugucuuaaaaaaaggaaaaagaaaaagaaaaaguggauaguauuaaaacucauuguccaagaagauuuuauuucccuguauauaaaaggcaaaaagcauugcugaagaaguccaugauaauuuuuucuguuugucuauuaagacuuuuuuuucaacccucacgaccaccaccaccaccaccaccaccaccacaacaacaacaacucucauaaauuccauagccaguuuucuuccagagugagucagauaccuguggaacacacacgaacuccuucugaccacuggggccauuuccauucaagaggaagcagcuggcucugguguccagccaguuuccaguuugugugcgugaguguguuccuccccucuucuuuugaaugucacuuuuuaccgugcuucucuaggaacugggaaaggaugggcagcaagugauuccacccuuggcaauuuacagggaaacuacagcagcacagggaagacuccuucagaucaaagaucaaguggagaugaugguagugauaagacuguacagaguaccaugugauuuuaaguaauuuacacguaucauuucauuuaauccucacaauccaccuaugggugggucuuuguuauccccauuuuauagaugaaggugcaagaccagaaugguuaggugauuugucaaggcuacccaccuaaaauuaauagugaaggcaagauuugaauccagcucaccugguguuuagaggugaugauuuuauccccuaacuuaggcuaccucuugccacuaggaagauuacuuguggauauggagcuucucuuccaucccuuccuuauaguuguauugggagguugcuguggacggcuauauacuugguaaugugggugugugcacauguauguacaugugcggaggucagaugucaaugcaugugcaucuuccucucucccgcucuaccuuuuauuuuuuuuuuuuugaaagaggcucucucacuuaaugugaaccuuaccuauucagcuaggcuaacugaccacuaagcuuuagcaauccuccuugguugcucuccaucuccagugaugggguuacaggcccacacugcuacaccugacuuuuucugugggugcugggucuccgaacuccuuacuugaccagcugaacucucccccuaaccugcguuucucccuucuaaacuaagaauacugaaucaacugccacuugccuuuaauguuggcuuggggucagagcuaacacuuuggacuauuugacauucuuaaguuucagauuaaugacaccuuuacaagaauuaaccuaugaauuauaaggugggucaauuauaccuuauuuuagguauuuaaagugaaauucuuagcauuagcuaaaauguuguucaaauuagcuaauaaaacauacauugccaaugguuucuugugucaaaagccccagggaauauugauguuagguucauuauaugaaguauaauacaaaagcgugaaaucuuuguuaaccuauuuaugcagugaggcucccgugaagcauuuguugagacuaacaauuuagugauagaaugaauaauucagaccaguuuaaaaaauacaugcaccauucauguacuucuuagauugguuuuggaguugauacacuggcuggaaguggggugauaaguaauguuacaagaggauugggaaaaaaaacccaagaggauuggguugaaguggacagaugaaacagucaaggcauggagguacuugaugagaauggaacauuagugacuucuuucgcuccuagaauaaccaagccccucauguucccuuucuaacauugccugcugagaugcaaugucagaaugauaaugcugguuucaaucuucagagcagcugguauugcugucugaggguuuuugucauuagaauuccuguagcuguccagucuugcgcuuugcauauuguguuucaggggacugaaacaguacgagacuagggacaaaaauaaguccugacaguguuuuggauugguguccagauacggcugcuauaguauagaagcugaauaguagccaacggagcugagaguagaaugcagagccaacaccuacuacuacugauguccucucucuguuucugucucucacacauacauaggaguagaagugugugcacacacauuuauuucuagaaucacagggacaggcagaagggcaacucuaggguuggagcauggagacagcaaaugaugccgacuuccucaugcuugcaaucuuacugucaugccuacuccuuuaucucuuuucauucugauuuuuuaaaaauuuuuuauuuuuagugugccucacuuuaaaaaagcccacaagagaaaaucaaccacaaucacagaccucaaggcauuuauguuaugcuuggagaagcauugaccacaaauucuuucuguaacaaacauuuugacgagggaaggcuucaaacaaggcaucagaacuaggcaauugcuacgaaagcugggcaucuauuuccuguuucucauaacuacuuauuauucccaugaauugggauugagggacacaauugguuuagcucaaaucuaaacauccaucccucaagauccugguagaccaaauuauugagaaaauugcccuacuacuuuguuuaugugaaauucgaugugguagcuuuugugagcuauuuccuccaccacgugcaguuggaguaagcuuaucuuaaucuuggccuagauucucaaucucuuuaggauucugucaguagcccagauugguggggguauuuuagcagggagagcacuuuggagcucugugcacaguuucaugagcaguccuuacugccucgauuuggauuuuaugucuuugauugcaggaagccuuugcccucauacaugagccuggggcccuuugcuaccgugguuggagugcucuaaugcuaaugcuguuuugauaaugauugaagcauuaaaaaaguuguucuuuauccucaaucuuugcauugccucguuuccuaaauuuaauuuacuuagaugugcuuaggaaaauggggcagcacaaucguuuucuguuucugcuuaauuaauucuuuuugagaaacuccacugaaaguacauuucccuuugcuuucuuuccucuccccuacuuuauacuaaugaggauaaagauaauggugaagauucaguaagugcuuacuguauggugcuuacuuuuacauaauuaucucauuuaauauuccuagcaacccuauggggccuguacuguaaucaucacuaguuuauagauaagggaagucuaagguaccaccgugccucccaagcaaucuauccuaugacuugguucuucuugcucucaggccaaacaaaaguacaaagcagugggauuuauggucccccugaagaaaacaugagauccaagucugacauuuuguaucucuaauaccuccucaucuucaggauuacagcucuguucucauucguggaauuucaucaugacuuugaggcuuacacuaccaggaaaucuuuagccauaugaccaggguuuuuaucaacauugaaugauuuuggucuuucccaaggugccaggugccagugacagagggagaaugggcuccuuagaaugcauuaacucuaugcuuuuacuggaaguugacugucccacagccugaacucuugaucagagcaagaaaccugugguuuagcugcaaacaucucuauaugaugucaaaugccacagagcuucuccuuaugcaguuagcucaucugagagcacccaggguccuugcuuggagccuacucuuguuauuaauucacagucuuuacaagcuucauuuucugacuuucuagcuauuaguggagaagcaauuggauggaaguguggcggagugcuauggagacguacauaggcccaauaugaagcaacauggaacaguaagaguagagagcauagaacuugacccaauaacucacuaaaugguaguuaggggcauuuauagaggguucuauauguauuauaguaaccccaaucauauagaaggcaauacaguuaguguucauaggugacugggaagcaaccugggaagaucagauuaaguucauuauccuugucuuaauacuuacaucuuaaaaggcuuaaaguaccagaagaaugcugaauuuaugccagugagguggcucagacgcugugggugcuugucaccaaaccugauggccugaguucaguccauggaacauacuuguuggaaggugagaaccuaguccugaaaguuguucucugaccugcacacaugcauuuguguguaccuccuaagugugaugaaaaaaguguuuuuuuuuuuuuuuuuuuuuuuuuuuuuuuuuuagaauacugaauucuaagucagaaaaaucuaguccaauucaagaccugcauuuacagcuuuggagauauuauuuagauuggauuauuaugccaaaucuauaaaauggggcuaaaauuuuagucauggagaaaguuuaugugaaaaugucuuacaacacacacacacacacacacacacacuuuauaaagacagcucuuuucuaucgacauuucuagcccagguggugcccaagaaauuaugggggccuuugaccucuuugaagauguacaucaugacauacuuaagcagccucugccacauuuagaugguccaguuucagauagcuccagugcaccagacccgccgguccucaugcuuucacaguuagcaccucccccagggagcccccuugacacugcccaggccacaccugaacugcauugucuauuacaguggaggcaaaggaaggcagagccccagggcugcuuggaggauuugcuuucuguggaugggaggagggcagcgguuucuuccugcuuuccuugcucucugcuggcuuucucguucuauaugcgcccauucuugucaguccugucucuccugguccccuaaaugaaacugaccuugguuaggacacccuuucccaucaacucugagcaauuucuucagucauuucugcuagaaauaacuagacucuuuuuuuuuuaagcagauuuaucuuacuucacaguuaauauguggcuaaauaauugcuugacugcugguaaacauguuuuaugauucuaucauuucuuaauuucgguuuuggugaugugcuggguguuuucagugacuacugagcaaguuuucuccauuucagaaauucccccuccuuaacuagcucugcuuaggcugagccccacugagucugaacuguuaacugcuggccacccugucacaccccgucuuuguugaaaacagugugccugagagaauaauuacguugacguuuaaucagaacuuaauucauuuguuggagcuaaauagaauaacauucaauugaaaagaagaauuuuaggaacacaaacccugaccaugagugagguuauauauccucaaaaaugucaauuauuaaucagcccacucgucgcucagcaaagcucugcuaaucccauuauaaaggggaaauuucucaucagaacacagaaggugcuggcucuaauuagaggacuuuuuauugcacuggcucaaagagguauuuugguuccgaaguuuaguuuuuguuuuuuguuuuuuuauguaauuguuuuaauuauuagggcuauuggaaaaaauuaacggaaaaccgaguguuuaaaguaaaucaguuuuggucuaagaacuuugagauuccauuugguuuuuaaauugcaguggcuuuagcugugcaggaguugagggaguugcaaaccuuuccugugcccucuuauugauuuaggaaagucagucauuaggcugaaaacuguuuaauaaaaagagcuuagaaaaaugagccagugugcaaguagagacgucuaaggucuccaaugaggugagaagauuaugcagaugagcccuuagcccuguucacugcagcaccucuuacacucaccaccacugcccaccuuuaucacuagcgugccccaccaagcaaaugaaggguccuucugccuucuaccagcuuccaggaagacucucacuuugccuagaguugauugcuccccacccugcccccccaccgggcuuuguuuacuuucuuaaaacauauguuccuccuccuuuuucugucucacugcguugcaguaccugauauggggguaaugaagcauauguuugagagauuucaauucuccugacaguugaauggagguagaaacaauuuuccucuaagcuggaaguggugauguugaaauuaaaaacacuuuuccuguggacugugagaugcuuccagggcuuagguccgaugcugccuuucuuccugguccuaccugcucuucucccauuuuuuucccccugcaucccugugcuccuuacccaggcucaguugucucauucaucaucugauguuguauuucaguuccagucuccaucaguucucagcuagaauaccagcaaaggcacagcugagucuccccuucuucaucgccuuugcuccccacuucugcaaugcagugcaaugguuauggauacagccuccaggccaggucaacuggccucagauccuucugaaugagagaaaauaagcaagcggauaugggguggaaaugauugugaguugcagggucaucgggaacuuccuucauaaauaggcaccgagagacuaagugagaaaagaagggaaagucuccugcucuaaccaguuucauuucuauuuaucuccuugaaaccuccccucaagccugugaaauugguagcuuguugguuucauuuuacuccugaggaaguggaggcuuagggaaauuacaaguccaaaguagccuagccaauagauggugaagaggaauuggacccaggaaggacagcuggagagaccacgcccuuaaguacuaugcuuuagccagacucccuguauuuugcuuugugguuaugggcagucauucauuucuaauuuucuuucuuucaagggaacucuguuccauuuuauuugaaaacuugcugagcaguaccuagcauguucaaaaggcaaguaucaagagggauucaaagagcuaaaugacuacauagcuaccaucagagaguucagaucucacaaagcaagacguuuuguacauggcuaacagggacagucagcacucuuagagaaaugcugcaugaaaagguuuacaguuuuuauaagguguuggaguggauccauauuugcugaggcuuucuacaguuuuagggacucauuuccuaaggaaggccauuuagaacacuaagcucucguaccucuucuggaaguagaugugccaagguggguccuuguagcucuuuucauuagcuucuuaggaaaucugccuccauagggauuggaaaaaaaguaaaaaaaaaaaugauuucaacuaguggcuggauauucuugauuaggguaggggaagauugucagugugaguucucuccacagauguggcuuuuaacugaagaugagagcacgugagagaguuagguaauucaucuuuuucucaaauccaaauuaucagucaucuuuuagauguacucuuccuagacuugcuggcugaccuugucaucugccacucauccuuuucucuuagaguggggacagggcuagugugccaaggaugugcucugacuuaagcaggcagcaguggaagugcagcucuguuagaacucuuuguguccaagggaaaguuccugcccuuugagccauuaaauaagaagggcugugaggugaaagguaugagggaagguauaggaaaggucuaugcugcccuuugcuacaaagccuagugauuacaaccaacucagacucaguuuagcuggcuuucaaugagacugaugauaguuauuguuuucuuacucuaucuuguacauugacauuuguaaaugcaguucuauauggaacaccuacuuucacuauauugaauggaauauaucugucacauacacauuuuuuagugcuuuuaaagcuuugauauaauuaaaaugaauauaagauuauagauugguauuuuagagcauuuuauguucauuuaaagaugguuucuucugaaacuguaccucucucucucuccuuaucccucucuaguguguuuuugugaguuucucucucucucucuguaugcgugugugugugugugugagagagagugugugaauguauucauguauuucuuuaagacuacaauuuucaaaaugguucccuaguggucugaacgagucucacauagucucucaaucuaaccuguaagaggaauaacuacucugauuucuauuggguuguauuagucgcauuaguagcaugacuuccuacucucaugucacaaaucacucugaacaaacuucaugcuacagggaugauaaucugugaggugggugacaugucagcucauccaaauaugcucuuguguguucuaccacauaagggaaaagaaagucgccuuucuuaaaugucucuuguggauccaccuucucagccucccuucacaaaggugcucuuaguuccaggaagaaaagagacccaguguguggucacuuaggcaaguaacuuuauguugaaugguaaguuuucaguuaucgcccuaccuuacagugugcuuccucacucucaacuagguuaguaguucuucuaauuugaggaccaugaccaugcaugugaccuuaccucuccuuagacuagcagaauaugcaggcuuuacagugaaagcacucaugaauucaaacacuccugcuuugcuuacuaguugcacagggcuuuuuacaaaauagggguaaugauugcagcccaauagaacugugaaaaucaagcccaaauuauggcaagcauaguuaccguuuugcuugcuauguauuugguccucaauaaauggaagccauuggugaagaaaagucuucucauucuauguuauagcuguuugcauuauaauaguacuuccuugaucaauuauaauauaagggaguuuuauuuaaauauaacaauuugaccaaauauagaggguauaaugguugacucaaguagaagguauaucagauaaauggugaacaaaauuauagagugaccauuaauuaaucaccaaauucucuuuaaauaagacaucacuguucauaaagaaaugaagaauuucaguugaacuuauuuguauguauuucuuaugggcacauuugcagaagccaguguggauaguuacuguugcuuauaucagugaugccuugaaaggcauuaaaguaaaacuuauucaagguauuugauuuuuuaaaaaugauuauuacacucucuuaaauauggccaguuccaugcacaaauaucacguauuuauguauuugagcguauuuccuccaaaccauucuauccuccacuuucaugcuuuuccguuaaccagucccccuuacucaaucauacacuuucccuccuauguuuuuguugucuucuacauacauacacacacacacagacagacagacagacagacaacuuuauauaucuguauaaaaucuaugacucacaaaugagagaaaacacaagauacuuguuuuucugagacuaacuuaauuaauuugauaugauuuauaccaccuugggguauuuaccuagaagaugccaagucaacacaucaccagacagcuuacuuuuuaaaaauuacuuuuuauuauauaaauaaaaacccacaaaggaagaacaaacuggagaauaaaauaucccaguucuaucuguuggagguuaauaacuaguaauauuuugacaugucuuauauaccuuuagucuguauuacauggcuguauguauauauauaaauauauaugcauacauguugauuuauauaucaauauauaaaucacauauaaguaacuaauauuaauauauaagauauauuucuaaauauauuauguugcuuuuauguaguauuuuaauagugucuuucaugucaauaauguaguuuuuaacacauaauagaaauuuaauuuguauucaguuaacaugaauaagauaaauaauguccaucuaucaucugacuaaauauaaauucauguccuuaauuauugauucaaggcaaauuccuggaacuggaaauuuuauguuagagguuauauaguuuuugaaaauuauuguaucuauuucauaaaguucacuuauauuuucacuuauacuagcaauguauacauguccauuuuucuaaccauaugugacuugucacuuuauaguaacuucaguuuggaugaaaaauaguacucucgucauuagggaaacuugugggucauuuuuccuuuuacuggguaauuuuuauuguuucaauauuuaaaauuagguauucauuguuccuuauuacaugccuauugauuuucaaaaacuauuuauauauguaggauaucaaaccauuuuauauguuauaaauugguuuuacugguuugauaauucaauuuuucauucuuugugaauguauaaaauucuuuccaaugcaccauuuccuuccucuguuuuccaauauguucuuuccuuaacaauauuaucuucaggaugaaucaaauauauauucuuuuuccuaccagcuacggguaaguaauuuaagauuaaaaaaaaauacgaagauuguagcgucugguccgccaaccucccggagcuuuugaagaugaaaagagguaauguauaugaaaacguuauugaaaacuugaauugagccuggugugguacuaccucccugaaauccagcacuugggaaggagagucacaauguguagggcagcuuggguuacauaguguaagucugggcuauauaagacccaucuuaauaaaaagguaauugaaaagauuauuguaguuauuuuuucccugauguuggcagucugaaugagcccauguccacucuacugacaucagcuguuaccuuuuuucucccugaaucucaaauauuucuggccaucauaauaggaaguaauuuugagauguaaauaaauacacuagaaccugugcccuaggaguuagaucagugcuuaguggcuggugaaauaucccuugccaccaaucucuuggccuaguguauaaauucuaaauauccuucccacauccucaacuguacguagagacccugaaaccacuguuugauguccucuauguguuuacuccuccauguucuacccaccaaaggcagcuuaggaaaccuagugguuccucacagagcacuaggugaggagaaaaucccauagccuucuauccacauaccuacucuuuggggacuugaaaaguaguacucuuuuggguccuugauaaacaguacucuuucuagcaauuaauauuugaaaaggauagaugugccuaucacauaaacugguaacuugaaauugucuuauggcacaaacugucuggaaagaguuuuuuguuggugaaaaacuuugucuuuuuuuaaauugugagaugaccaugauucucccuauccaaaaacaaaaacagaaacaaacaaacaaacaaaaaaacaaaccucagagggacagggaaaacaaaguauuuuguacauuaaacuaaucacuaauggaaaagccuaaguauauucuuucuaaccauuucuagccacaucugccagaugguugaaagaugaagaacuuaaaugauacauauggcaugucaaauguagcuauggugguuuuaguuuugauucaagaggaagaucucugaagaaauuaagucucuaggaaggucacaggccugugggaaguugaugagauuagacauuugaacucauuuggucuuuuggaaggaguaagaaagugaacuaagcuuacuaacaaucuacuauguaccacgaguaauuuucauaacaguaauauuaccauuaggcauuucccccauucuauagauguagaaacugggguuaagagcgauuaagggacccaaggccgcagcaugaguaggugguaagguaaccgcaugugaugaacuucgaaggcauugaccuuuucauugagcuacaguaugucucuuagagcgcuacaagauacagacgagauuccauaagccauucaaaugauuuuguaggcuuuugugaaauagaaagugcuuuuaggaaauuggacaacgauggcgaaauaaauaaaauacucccaagaauaggcccaaacuuauuuggcagaaggcuucaaauuccauugacaugaagaaguucccuguagggcccuacuauggugaauuaauuguaccccaaguauucuauggcugcauggaagucuuucuuauugcauaauaaagcaucgugcacacacccuucagaacucauuuuaauacuauucagccugacaucuaaaggggcugcuacccugacaaauacagucuggccagauguuauuauuuugcacuacauuuaauuucuuccugccaaagauuuagacuucuccccccaaaccccugauaaagaucaggggaaauugucugguauuuacaaaaucucauccaggcguaucuguuacaauguucacuuagcaagguuuauuagauuauuaggacuuuaaacccuugggcucuuuaguuauugaaauaaaaaaaaaaaagaaaacccaaacaucuucaacaaauuuaagugguauaauuagacccuggacuugucuuacaggcauuuuagaauuaugaaaaugauuuaacuagcguuugcuuccugagaaacuugcugaguuugacagggaugaaaggaaagugguuccgcugcuuugggccugggccuuaauggggaaagugauauguggaacugagagggauuuguagaguccuauggagaaaugacuccuguaaguaguuagcuguaucacacagggccucucuuucauggcuuuguuaaaacccaggcacuacacugacaggagcaggagacucuugucuuucccuagcucaugaagucuacuuugacucaccacuccucuagcuucuuuaaaugcuccuuuuuuuuugccuguaugcauuaaaguaaacauagaaagaaggcaguaguagaaaaguucaguaagugugagauauuaucuaucaauuaugauuuauagacaucacagcucuccucugggaauuucgauaugcuuugcaugcaaucccaguugcaagcagugccaauggauagauaguuggcgaugcuguugcugcuuucuucacuggauggguuuagacaugggaggcuugaggugguggcuugaccuagcccacauccauaacuaguggcugacuugggaacugaguuagcuaaugggauauauauguaagagugaaacuacaagaaaauaggcacaguugcccuuguucguuuuuagcaaguuggaugggcaggacacuuugcuucaccgagagaggauugcuuggagaagcucguugacgguaucccuucccuacgccaggcugagcuguuuuuuuuuuuuuuuucauugugaauuugcuugcugucuuacuggguucauuguucauuguuaaagcucggugucccagagaugacuuuugaaauaccucacagcuaagccuggcaguacuuggacuuucucuuauuaguuuuaaaguugcucagaagccuuuuauaugaaaauaggaggagugcaaacauccuuuuguacauuaaauauauaguuaauaaaugcugagauagcacaagugaccuccaaacaagagguaaauauuucguaaaaauuaaugcaguagagugaacucucauuaacucagacucuguucauuugaauauugugguaauuugacuuggacugaaguuaacuuucauugcauuuaugaagaaaacaucuacuaaacacauuaauaguauauauaagauugcaggagggcauguuuaacuugcuugaaggacuagagcaaacccauuaauuggggcugcuaauugcaaagagccuugcuuaccaaagcaaaccugauagagcuucaacugggaaacacguuuaucagccacaagauugcguuacuuuagguauggaaaaauaauaaagagcugauaauggauucuggaaggaauugacuuaguuuccaaucauguuauccaucuaaucuuacuauaacccuccauuuccuuaucaauaaaaugggggacaauaauacgacuuauggcuguugugaggaguaaugcuagaacguauugaaagcuuagaagauugccuaguauauaguaagggcuuagacuuagaaaagaauuguaaauuauaaccuacuaacuagacuuccuuuccuuuaacaaaucagaugacuaaagagcuacagaaaauacccuaugccugccuccauacccauccuuccccagcagauggaauuuagggcuuucuacaugcuaggcaaguaagguaccccugaguuauacuacaccagccuuaacguuguauuugaugauugugaauucugagaugccaucuguagacaauaauuacuguaccuggcacaaaaagagaugaucauuagaguuuaaaggcuuuucaauuucucaagagggaaauucuaauugagcagguuuuauaauuucaguugaccaugaggugauugaaguuuauuaugggaaccugaaaaguaccaagaggauauauguuugaugguuucauuauaauauuuaugguaucugucuguuugaccugucaauaagaauacuuuauuguauaaaucacaaaguucauuuuagaagcuaucaaauucugagaaacacaaaacaacaugaaaaccaccaugcaguguguaaaugaggcucaguguuagaauuccuacauucgaaucccagcacugagaauaaaaaaagacucacccagaguccuaauauucagaggugaccaugguuauagggguuuuguuguaguugauguuguuaaaccauuuucucugugcauaaaacaugagaaaaggagagagagugggaggauaucauacuugcagacauuaaaagccuggugauaaaccagagcaugcauguuucccucacuuauuuucaggugaauuaagauaaaauauuaauuuguagccaugaaaugcacuugaacuugaaaauuguguauaauuuuuuaucuguguguccuuuucagcuccuucuacugaggccaauagaaaugcagcacagagaauguggcuucaauuaucuucauagagccauuauaauucagaagggcuguguguggggcugugucugugugugcacccuuguacgugcuggguggagauuguucccuguuguguggucuagugaugagcauugaacugggacuaagaagauagggcucaugcucugacuccaucaugccucacuugauggccuuaagcaauuaaugucauuuuucuaggcuuuauuuuccccauauauaaaaugugguguuagaguggauaauuucugcagcaccucauagcucaaagagucuggaauuuaaaaaaucaaacgugccugucuggcugggagaaccugaggcucuguugcuaucuuccuagcaagacggagaggugaugaaucucaagugucuuuguugccagauagaccauaggcuaucauuuuuagccuaucagguguuugacuuuugaaagggcuaaauucuccauuaggaguaaauguaagagcugcggguuauuuaucgggacuuacacuuuccauuuauaacugccagugucaaaggcuuuguugacaucauugagucaaucagguaagcuguaaucaguuuagugacggcuaagucacaaauauaucaacuagccaaucguacugccaggaguucucuaaagcuugacugaauuauuuauuuuguuaugaugaaaaugucugggcuuuauuggguuuucuuugaagaacuugauucagcuugaagucuagaagauaaaagaucagugauugucuuucagauuuuuauuccaccuuccuuuaaggcuuuucauuuuucacaagccaaguuguuagcucuuuuaagucaaggugagagagcugcgauauuuuuuauccuagggguuuaaacauguggggaaacuuuugccuuugauuucuuguccuguuuuugucauggaggaacugucuaaccuucagaaaaccaccucacuugcaggagccucauuuucuucaucuauaaaauggaaugaaucccagucuugcugaagucucaaguuuugaggcucauuuaagauaaugcuagugcgccgggcagugcugguacacaccuuuaaccccagcacucaggaggcagaagaaggggcaucuuugaguuuagggccagccuggucuacaaagugagaucuagaauagucagggcuauacagagaaacccgguuucuagaaaaccaaaaccaaaucaaccaaccaagcaaacaaaaaagauaaugugaagguaucuuaguguuagauaaugcuaaugucauuuauaugaggauucauaauuguccuucagcuaaguccucuuaggucuuuuucagguuaguuagauguaacuuggaaaguuagacuuuccugaaaacuagauguucucgaaagguuaaguacagugcaguuuuucgaucagaauguaccuuugcuucacaugaugcucuuccauauauugccacaaaagaacuuguccuccaggggcauaaaaacuguaaagggauucagugaaauguaaaagaaaucacauucccccccuccuccucgucuucuuccucccacggauaacccacggaauccaauuaccgcuuccuguaugugcaugggcccuccacuguagcaugagcaaccuaccagugacuauggggggcgauuaugaucugaauacauuguuuucauguaugaaaauaccaagaacaaagcaaucauauucaacugaaagcuaaacaauuuucaaauaaaacaggagugccgccagucauuaccuaaggcuaaacagauauguauagauagcuccugaaacuccaaaaagggaagucauuuauuuugcuucaaagaugcuguggcaguuuuggggguaggauggagagggggaguggguggauggcaguggguggucagggagagaagauaagaaaaagacauuuuaaauauagcuauucuacacagcucuuuccaugccacccccaccgcacgcucguuauucuuugcccagacaucuuuaauacagacggugaaauuguaguagaaaugugccuuuguacucacaagaaaguuggguggccucucuaagccucacuuuuguuuucuuucuuuuuuuucccaccgagccauucagaggcucugauuaccagcacaacaggaaugaaaagagauaaauaccuaccaccacagcaaaacacaaaagaaggcagauuagaaaauggagaaguguggagggagagcacauuugagcagagcaacauggcugcuagagaggagagcauuggaguagaguacuguggggaugcuagagggaaggaggcccuucagguuuaccuauggaaucaguucauguuuaaucugggucaagcaugaagaauucccuugcuugugcuaaagccaauuugcauauacggagaauguacccaccgaaacugguauuuauuggaaauugaagagcugagcauuuucugucccugaugaggcaaaagcugugugugauugucagcaccccccccccaugguugugagguaacacgagcucagccuauagacaagccuuaaaacuauaccucaauaccucauaaauuacaggccugggaauguuuccgagcucugggaaccaccacaaaggucccuggagaacuuauggagugugaggccuuuucucaauuuguggguuaagcuagaucugcuugguacuugccccucccucucgccucuagcuccaugcuuccuuccauuucuuuagcacuuagcaaacuagaaauaaugcagagaggcuggggggauccugagagccacuugagagucucugucucuugcugccaccucaaucugucuuucuugggggaaaacauggucagcuuucuguagaagacuuugggacuuuaguucucuaaaccuuagauuuugcaucuauacaaucgaacaacuguaugcccaauacaaaugcauggaaagcgcuccaccgacugagcuacauuccuauccccaacacugcauuuuaaaggauaaggggaucuucuggcucagagcuuaggcaaaacagcauucugaaaaaucacuuuucuucuuauuuaaaaagauaaauggauuagcugaaguccaaggguggguuauaguuagucuucgaagccccugaaauucuguguaaagguuuuguauauguuauguuuuuuuuuuucaccaggggagagacagagagacaaaggcagaaagauacagagggggacagagacagaaugaauguauacaguuaaauuauguccuuaaaaaauagcccccaaaugguuaauaaucacagagcuagcugauucccccaaaugguuaacaaucacagggcuagcuagcugaucucuaaaacucccuucaacucuaauuugauucuaugaaaaaaaucuuagccugaaaaaauggauuuaaauuuaugauuauuuaaugggcucaaauaaguagucucaguuauuuuaacagcacuaaaugcaggauucucagauuuaauaauauucauuugaguacugauugcuggcauguucugcuacaacucaggcugcuacuuggcuugagggagcaacuguuauuugggguguucccccugacccuccccccccaccccugucuguuuugucagauguaguuauuuuguccucaccugugugacuuuuaggagugacuaguuuggggcuugcagaauuagcuuuguauaauuguuugucagcucagcacaauaaauuaccccuuaaggaaaucaaauagcaaccuugaagcucuagauuagcaccgaugaaucgggacuuagacugguuggaaacucacuguguguguucuuuucagaaugaagguacuguacaccauuuauuucucuugggaggugauacaauuaaaaugcuaacauccuuagcagcaagcucauucauucagcagugcacacugagcuuucuauuucaauaaagagaggugcaauacaaccauuagacggaacguaugggcuauguuuacagugaguagaauaaagagggggaacugucuuucaagucuguuuaagauccuauccauugcugacauuaggaacaggcugcugacacugugugugggcucaucuuggucuuuaggaggggaacaucuucccgccagaagaguauaguguuugggaaaagcguaucacugaguaggagguagacgguaacguuuauauucuaugaaggaauaacaagacuucucuugauuacugagcuuuuuacuaauuguugucuagggaccucuuccagugccacuauaaucuguuaauaauacugacaacaguagugagaauuucuccucacuuucugcuguauguucuuuaaucccugggggggugggauggaggguugugauacguucuucacuuuauggguagagaaagucgaaguucagcaaaguuaaguaucuuuuuuaagugcuaccaguaccaacuccuucuuggcuucuuugucuccuauagccaguggucaccaagucuuacgauagugcucuuuccucguaacuagagcuuucugcccacauugaacugggacuuaaaucacuucucaacugaugcucccaccucuaguuuugaaccuuucuccaggacaccuucccugacaacccacuccuagguagguuucacucuuugcugaccaauaguauuuugaguaucccugaucugcugaauucagaauaauaauaggcaguauuugaugcauauauagcaagugcuguuugaaaucuggggauauccaggaacguauauucucucagcaacauuaugaaguaaguagcuguuguauucuguuuuaaacauguucagagaucuguuuacagucacauagugauuacauguacauaaaauuaagcacucugaugaggcacgccguuaggaaaagcaaggagagaaugauguguagugacuggccuuaaaacaggcauuacuggcacauggcuuuggauauuucuucguaguucuaauuugcauagcagaaggugauaagcaaaaucccugacuucuacccacaagauuccaggaauaccaaaaauaucaccagucacuguuaaauggccuguggaggaggggccaacuucaccuauugcaaaccccuccccugaaagcucacauuugaaaacuggucuuuuaacucggauucuaguuuuaguuuugcucuucuucuguugaggcaaacuguggcccaugagauguuuuuacaagcucaccuagucuuuguuuuuucaguggugaccaaagagcagcuuacaagagguuuacugggggacuuuguuuauucaaucuaguuauucagugcuuucugauuuuccuguucuaaacaauuuuguauauauacauuauaugggugaauuugauagaaaagacugucaauguuuaugccgccuguaggcccuugugacucagugcuuucacuuaacugacuuuguuuguuucaagugccagauuugaaaguagucccuccacaauguuaaguguaaugaacucuuuauccauggccgcacaucuccacauucuaccaacuguggcuuaaaaauacuuuugaaauuacauuuuuacugaaacugugcccaagaaaucucuaguuucucuuugauuugagggaucagaacugagagaagcgucagcccuucagauaauacauuguccuaaguggacaaaaaaauauuaugaagagaguuucuuaaaaguucaucauguuggagauuccuuggguagagcugcucagauuguuuuuuccacuaugguccucuauugauucccaggaggcuagaugaaaaguauauaccuggacacagacacacacaugcacacaccugcuggagacaaagaguuagaaacccugaauccaucaguggaguagccagugauuacguuagaauccucacaauucagucaucuugaaauauucucacagaccuacagagugugcuucaccaauuuccuaggugucucaauuuauuuacuugaucgucacaauuagccauugaauacuauaggauccaguaauuuuccuucugggcauaguggagauaaaaaaucaccaacucauaaagacaucugcauuguccuguuaucuuaguacuauucagaguagcugagaugcagaaacaaucuaagugccgucauuagcccuuuucugucacuauaauaaaauacuuuaaaccagauacuuucuauaaagcaaauaaacauauuuagcuuacagauuuguaagcccauauaacacgaugccaucccugaagggucucuuauucauaucacgacauguggauggcaccaugucacuagcauacauaagaggcaaaacaucagauggcacaauuggaagccacagugagauugacauguggccaaacuuguucuuuuuaaacaacagucuuguaagaaugaccuagguuccuaugaaaaguaccuucagagaauagugugacaauaauuugucacaaauucucucuuucuuaaaacauguacaauaccucuuaauacucucacauuugcgaucaacaaaaucaaacuuccaucacacaaaucuuuggggggacuaaguacaucuaacuacuauagugcccguugauugcugaauggcuaaagauauaauuuaaccuuucaaaaggaagagaccuuggcagaauuaccuugucauagugcaugcuuggauuuggaaggugaauugguuagaugucucaaaaaugucucuuauuacuuucagaccagugcuuccugugcuccaagcaacuguuggguacauuuagcuuugcauacgguaguauucagcuauauuccuuagaacuuaggguagucacucucuggaugugacuucuccuuguguuauuuuuauguccuuaauuaaugggaagauuucucuuaauuauagaagaaaugcuucccucugauuuguguuuuguucugauucuaucucucgaacaauccucuuaaaauagguucguuuguuguauuuguuccuauucauauaaaucacucucucuauaggaaaacaccaaauuccguuuuugcagaaggcugggaaaucaguaguugacacaucaccauuugacugccugcagcccccacccucacuacaaacaucccagccacccaagaaaaguuuauuuagacuccccagccaaccaugcaaauaagacccccauggcuaaggagcucaguggaagaaaaggcccggauuguuugccacuuccuuacucuagguucagaaugcugguuuccauggggugauucacugaucauggcuugacuuucacuuucgugcugguuuucaguuccgcaaguuaggaaggugccuccauaauguuacaacaucucagacuuggcaagguccuuuagaagcauccuaccucuguucguuuccucuguguaucauauucuaaggaagagauuguuugguuugagaguuaaaacucugcugcucccuuagguagcugagacucuuguacuauacaggucacucuuauguggguaggcauccucucucggaugguggugucuacacuagcacaguguagagcacuguguggacagcaccuucuauggccuaucuccuguacuauggauucaggcagguaaugugaugucuaucagugcagaacuuacauucaagccacauccaccuuuggguuuugauacuuuauuaauaggagagcuuaugaaauuggaccccaagcaccugaguuuagaaguugguuaagugugucuuuuggcuucauguaauuuguaaaugggaucaguauagcuuuuaagcugcugugguaguguuggggaaaauguugaguagagcaggucuauuagcaucaugacuuaaaggcuuccuucuagaagguuucauuaacuuaguaacuaguaccuuugaacauaaacauucaaauuaaucaguggaggaaccagcuaaugguauucuugauagccuacagaagccugucuugaacauaaugguucacuuugcccuuggaucagguauauccagguacauucaaccagaggucuauaggcuucccguguuccaggaugccuauuaguucagcuugcccugauaugagauaacagugucauacagcagugucaaaacauuggauaucucuguuaggucuucuugaaagccagaaguuugucuguguaucccucugcuuuucagucuacucuuuuuuuuuuccauaaaaggaaaugcaguuaaccucaaauguuuuuuuuuaauaaaauauaacuaugcuaucuucugugaucaccuucuuuguucucacaagcacacaaaucgcccaauccucugcuggaugaaguguuuggaagucuugcuugagauuauuauccauggcagucaucaucuuuuucccucuaaggaauauggccagcagaugaaguuugguuuuuuuacucuccucuuuacacucuauacaccuuucuuuccacaugucuucucuucaccuccccccccccaguuuucuuccugcuaggcugacccucuccuuuucauuuccuuacaacacuacccuucaguuuuccuacguaagggcuacuuaguguaguaaugggugcucuuagccgacacgcuuuugaacacugccgaaaucccaacaugugauuagaauggugguaauuucaagcaccauggcagguuauuaauguaguguggguggcuaaaaccuuuuguuuccuuucaaauagguggcugcccacuuauacacuccaugcguggcucucugccaauuguguugggggcgauuucaagccaaauugauuggcuaauugcuuguggucaucuggcuuuucagcugccuguguaacaucucuggagguaauuagcacuuccagaguuggggggggguaugugaauuggaguuauucauggucauggcuuuuggagugggggcagaggcagccaggagcuucuguaaaucucuuauuuuaaaugauuacugaggauugaugaguuucuuuaacaauuuuuuaaaaauauauuauggaggaguuugauaagcaauugcuuucuagagucauuuaaaauuggcaguugggguguauauauuauguuauaaagucacuaguaggaaauaacuucaaaaguguuggacauuuccuaaaaagugacuggaauuucaauuguagcacuaacacacauaguaggauguuuugcagcuaagugugagacuaaaaagaacagaauucauuuuucauucaauaaaaaucucacaccacugauacuucuaacagugacuccuaaauguagaaucaucagaucaccaaugugauuuuuuuuuucauuuaaaaauaauguuuacagggagaauggcucaugaguuuagagcaaauacugcugucgcagaagaccuuaguuuaguuccucgcacccacacuaggcagcucacaacuuccugugaguccagccccagggagcucuacugucuucuucauaagcacaaacauacccccacacagauacacacauauacacauaagaaaguauaaaauaaauaaaucuguauaguauuuaugugggguuugcagggcagcgaauggcugagcagagcaucuugggauucuuccauuuccccccacaaaccuggcaugcguuaguguccgucggaucccaccugugccagugaaaggaaggccucuccgaaugucugcuuauuuugacuguucccccuucacacugaaaugggagcugauguucuuguauuuggaugauacgcuucugcauugcaaauaaacaguaggcuuggaccacugccgagcauagggcugggaagucuuggcucaaccagcuguuggauuccaguuguucucaggcuauucaggguggucuucuuugaccugcugacuggaguguacagacuucaucuuucuuuuagcauagcuucuuuguaucuuggguuaguaggcuuggcuaaugguagaauucagggaagguuagagggauaugauaauucucucucuucccaguguugagguguucgauccucuaguuuucagguagggaugagcgggcuuuuagauaagaaacguuugaggugauuaucucuugaauucuaacauaaggcaucuuaugaaagggacagaagugcuuagccugucuuucccaccagggcuucuaacuugcuuccucagcuuccuguuuccagcaaguuuugaguuuuacuuucacuuguuuucucauucuugucucugacgcuccaacacuuacuuucaaugauuguguuuucugaaaguagauuaaauuacacuuuguuggaaagaaaaacaauugcugucauagaugugugugugugguguaugcauauaucuguguguguguguuguguguaugcauauaucuguguuuguguaugggguguguguauguguguguguguuaaguguuuuagguagcccaugugaaguuccauccagaaguucuauugguccucucaguccuaaaacuggauucaaauauuggcucuacaucuguggucuugagcaagaauauaauccccuuauuuuuauuugacaaauuaguuuaacauaguucaaccuggucuugaacuuaguacccuuccuuaccaccugaguccaaggcccuuucuuuaaaauaggggauaauagaacggucuaucccaaguuuaggaucaaguccauaaauccagaaaagguagggagaggguaguggcagcaggacuuuuguaaccagucuauuuaguuccuaggagcagaccaaacuaggaaagugaagguuuuguccuuguaaggaaccagaauuugaccgggacgaagucacaaaccuaccuagccacaaaccauuucuguuacuagagaacaaacuacaucuuuugaaggugggguaggagaagcaucaaucaaagagcugucuucagcagugugaagugucaugagaauaaacagcugcucccuccacugcacagccccuccugcuguuaaaugacucuagggaagaggaaaccagucaucaaagacuucugcucccugugcacagcugguaauuccucaggucaccccuauagugacuugagcaguuucuagcaguauccacugguccaagucacugaaacauacauugcaaugaagcccagggacuucuuuuugacuccaucauccauccaaggagcaugagagugccugugagcugggccacagcuaguacaguuuguaagugggacacacuagaucgucuaugguuauuuugggaacuauaucccuugagagauucagggggaggaaaagaagaaggacuagauguucuuccuuccuucucugaagaaggaagaagacaaagucauuuccuuugaccuacuugcuuccgagugucagucucucaaggcacccagguuuuucuuuccagccagauuuaacuuuuccuaccuuaagcuggguagaagggcucaaaaauaaagcuagguuuguguugcaaguggggccgagaagcugauaacucccagaguucuggagaagggcagggacgggucugaaacugcauaauguuugacugagagugguagacaaagcaaacgacaacagagauucuggaggagaggcaggguggucccuaaguagaugaaguuagcugaaaaauacuaacacaacauggcugaggcacaucaaagaugagcacaauacaauguaucuggguacauagguuuaguaagaagggauaaaagguaauuucacaggaagaugaagucaggccuaggaucagaauuuaagucaagguugguaugcucaaauuucaagagcuauaauuaaaaucacucauucauuaccuuugaagaaacucuuaaggacagaguaguuuaaaucauggacuuugguguuaugaaggacuugggcuaaaaacucugcaucuuuuguuaaguuuuuuuuuuuuuaggccuuucaauguuccucugaagucacauguucauaggcucaaagaaugugugcugagcaaauuguuucugugguccgguggauguguccagcaagauuuggauugcugauaguaucuuuguaccugaaaguucuaagccauuuguuucagugcuugguuuugucuugucuaagaggauugggcagguuaccuggugcuaucuugauccaagguguaggagcagagauucagcugaaagggacaggaggcuagggaccagggaauaaaagcauuauagauacacugggggcagggagagaacucugagauaauugaucuugugaaaaaucaggaaaacugaaugcuuucacuuauuaaaacauuggugucuuucuaugugcaugccucuuaauacuaagagccacuaagcuacaagaaaagcugaugagauaaagaggcauuugaugaauuuugagugaggccaaguucaaugaccaaguaaaugcaaugcagaacccccaagcaugagaagaaugaggacauuaguggucaaucugcagaaacccaaguguaagugggaauuuaguuuaaauuauuguaccaauguuaauuuuaaaaauuugguaauuauuuuaugauuauauaaaauguccauauuaggggaaguuggcaaaacaaauuuuuaagcccuuugcgaauuucaaauuauuucaaaauaagcucuuuuuuuuuuuuuuuuaauuaagaggucaaacucugucccuuucaacugccauucauuucauugcagggugucuaaggacaguuuugagaauacauagaggacuuuagcacuacauauacauuugagcucugcccuuucccccuuagaaauauauuuauauuuuuacacgcucucaaaacuuccccuaaaugugauuguuaauauguacaguguguuuaaccagccccuuucagaugguuuccaauuuuaugcugauauaaauaauaccacaguccaucuauauacacauagcuuuguuucuuuuaaaauugagaccuagaagugaaagaccagugucaaggaagauaaacucaaaagauccuaaugccuaacaucacaucaugcuccagaaugaagccaugagcagugugcuugagccugccucacugcccagcuaauccacauaggcugacaaauagaagagaaugcucccucgugcucgcccauccuuaugcgcuuguuuggggagcacucauuucccuucuaugaaucucaguuuuaguucugcaguggauuuauaaguuugaguuuguuguuuuuuauuuaaauacauuuuuuguaguaguaguuauuguuguugauuuuucuuuuucaagaaaaaguguuuaaaagcccuggugcuccuggaaugcacuuuauagaccaggcuggccuuaaacucacacagauacaccugccuuugccuccuaagugcuaggauuaaagggugcaguuuaaaaucaauuuuugucaaaauauaacuaugucaguuaugucaauuaguacuuuuuguuauuuuuucaguuuagcacaccaaguaguagguuucaugacggccuuuucaaauaugucgguuuacuugucuuccucuuuucaccaaccuuuacagccuccccguuacccuucaugcugacuccuauagcuuuccuaucccuuauugguuuuuaaggcugggcauauuuuccucuucccucucuucuacacuuuacuauuuuuucaguguaaaucuucaagaugguagugcauggcacacaaguuuuuaaaaauguaguaccuuauugguaccuuaaaaaaagaaaagaaaauaccuuucuagaucucucacgcauucucccugcuucucauauuuucuguccauccacacguccauccauccaucuaucuauccauccaucuauccauucacccauuugucuauccagcucuagauaucauucaacuugagacccucuugccucagcccccaacgugcugggauugcggcugugcuaucccacugaacuuuaagagucuuuaacuucauuucagaugaauguaugaaguauauggacaaauuaacgugugugugugugcguguguguguguguguguguguuuaauaccacuagcgagaggagcugugaaaauuagaggauauggaauuacuacucacaggaguuaggagaguaccaacuugaugcagucuggauuuaauaaaauucaccaucaccuaguaucgggcacuccacacauguaguaaguaguuucccacugaaccuguauuaguguauuggagacaaaaggguuuagaauguguuuggugcuaggaaugacauuuaugcuucaggcuuacucuacugggucucuugaacacagagaccucacuggacaccagugguucuagugcauaguauaacaguagugugcugguuuccuuuuaugccccagggacauaucugucaaaaaaaaaaaaaaacaacaaaaacaaaacaaaacaaaacaaaacaaaacaaaaaaccaaugaccaagaaacagaaagcaaacccaagcuacugcugcuccggagguaguucuuuccgcuuuuguugcccuucacagucuucguuccucucguauuuguaagucugcuuuaauagucuugucuuguaauuacaucuggagacaggagacagcaucuuuugauaguucaaguccuaacacauuuaaauugcccuccuaaugcuguaaaagagucaaauuauauauucugcuuugcacuagacagcaauaaaugucaaggugccauccacucugguauuuaacuccuugaugccaucuguuucaggguucuucccacaaacuauccgcuaccguuucucuagcuccuggcaugaaaggaucagcuuggaaaauaaaucuacuauucaaaacaugcuaaaaggcagaggcaguuuguaaacauugcuuuggaaagcuaggcauagcaauaaagucaaggacaggaaccugauucuguaaaggaaacauuucacuagauugucaucuacuuuauuuuuaaagcugcaauaagauguaaugauaaaaaggccaaugaugcauuucagccaagugauaugaacucuugcuaaaccaauuaaacugucaguauacuaugguuucauauuuccuauaacauacuaggucaccucaggacacuuagucacuugugaauuuuuuuaaccaccaaugcaaaaucaauuugacaauuuauaaucuuauauuucauuauaaaaguauauuauccugcaagaagguugcuuggaaaauaaguucugaagcccguucacucaucuuucugcucaaauagucagagaggaauaaaaccaauugccucagcucguauuuugagacuucuagauggguucucauuuauaugauuaaagaaaagauguacgaagauguuaacaaucuccaacccuaguugcaaaucugagcauuggaugaaauugcaggcauuaaaacgugagaauuuugccugacaaguuuacuuucacacucauacaugcgcgcacacacaccacaucuuucuaaauguacuucagggugggcuuuagagacagggccagacuauucaguguuggcugaccugaaacucacuauguagacaagccugaccucaaauucugcugggauuaaaaguauaugccaccauggccaguaaggggaggcgguuuuaguguccuguguuugggguuuggcauuuuagcucuucuuaaauggaacgagagcacaugguuauucauauuuacuaccaccgcaguuuucagguugauuuuugggaagcugugaguuguagaaggcuaaaucagcaguauuugaaagagggcugggaaaggaguaaaggaaggcuugggggcuuuggacuguucuuauuaugaguuuccuuuggaacuccuuucccccuuucucuaggauaaacaugacacugcuuuugggaaaaaccaauggcaguaauaaaaugcacaugacagauccuuuguuuuaggcccucauuagugcaguagaggguaggucuguucucauaaacacaaacagcaaacaagagcaaauaauuaacauuggccauggagccuuuucuucuguuaugaacucaaugggguuuccuuuaacccucccacaaggcuauuaaucauacuuguaaaugcauuugcccccgaagcuuaaaucaguugugugccucuggcaacuguggcugcauuaacacuagaccauuuaaacuugagauuuaaacuccaaauucucuucuauuuuuuuuaagucaugguggcagagaucauggcuuaucuacucuauuaauuuacacccaguucauaauuuaguauuuccauuuacacaugauggaaaaaccauaugcuacucagacucuuugcuaucguuacugcuucagguauuccuguuuuccauggcaucuuuccuauuugcauguccuuucuuagauuucagucugagcuacugaaacaaacuaaaggaaaagagacacaaagagugggaauugaagaauuaaaacaaacagcaucaacacagagucucacuauguagaccagguuugccuugaacuuaugaucuuccuggcucugcccacagugcauuuggcuuguaaauacauuccaucccaccugguuuuaacucauguucucagcacaagguuuagguacaggcccuugcaccuacaccuacauuuaggcucaaaacaaugcuguaagacaggccaggauguucuguguucacaggugagagggcggguaggggagcaggguggugggaggggauaggggacuuucaggauagcauuugaaauguaaauaaagaaaauaucuaauaaaaaaaagaauuugccaaaaguguaaugcaaggaaaugucggucuucaguguccaauuuaaacccuuuucccgagcuguaauguuguacaucaggagucuuugucauugcuuuagucgaguucaggaugggauuuagaaagugggcaaaugaacaauuuuaggcaguuuuuaaaauuaaggauaauagguaucauuuccauucacuuuaggaaauggaagaaaaaugcuaagaaaauaauuucccaauggugauaagacuagagacaacuacccuuugucuuuuggaacacuagggauugagucuaaagucuugagcauaccaaacaucggcuguaccacugagauacacucccagccaauacccuggauuuuuauacaacccaaaaauacauugugaacauuuccccauuuuauuauacagaugucaacauggguuuaauggcuauucacuauucuuuuguuaggguguacaaguaauauauuuuaccauuccaucuuaauaagaaccagacuagcaauuugagaaugucccucugaugucacaaaauggcuugucaaugugcuuaguuagaauaaguguuccauuaguuagauagcuaugcauauaaugugguguccuuuguauuuuuauuacuuuauuuuauaugaaguaguaguuucuaaaaaauaaccaaaaagcuaacuuuuaaaguuaaggggaacaacaagugccuuuucccuugaacuuucauuggcaauacauaccuucuauguggagucacugaaggcuuaaguugaaagguaauauuuuccuguauaucaguguuguggucuaugcaauuaauuccugaacaucuacuaaauauaauuuauggagauguuaguaauuagguuuucaaaagagauuuuuaugauguugaaauagcauaaaugcuauuuucacaaauaauuugauauaaaauuauauauggacauauauguauacacacacacacacacacacacacacacacauauauauauauauauaguaaauaagcccccaaaccuauuuuguuguuguugcuuuuaguuugauaggcuaacagcuaauuauuuuacuuauuucuucuuuucugaguuuucuaaaaauuuauagcaaauaugcacuuauaugugcuaguuaaaauaaccuuacgugaggaagacaccaauucaguauguaauggucacagguuuuaaaaguaaaacuuuugcuccuucaccaccuucuuauacuugacaacacugugaugaagguauuaguguucauuagaggagcuuauuugcccaagaccacacagauuggauugugcauggggguggggguugaacuuggguguuauauuuccaaagccugugugagauaaaauauacuuggcucaacauacagggagguuuauuuuuauauuugucuuaagagguuagaaacuaagcagucaaagcagugcugggacaagggagggacaggguugagggcauuugugcuggugaaaccugggagguccuuuggcgccagggguuagcccaaaggcccuagaucccugggguuaauaauaucuaacuucauagugcuauugugaggauuaaacgagacaauucauguaacgggcacaugguacaggcuugcucaauaaaugguagcuaguauuauauuuaggacuuugcuuguuauagggauuagaggcuucaagaagccugaggcaggacauguuuacccuagugaauccugucacaucuuaauaguccucaaacauuccugaccauucaaaugccuuuuauuugaaccuuucaaauaaacaagcccuaaucagcuuugugaacccuaccagcuuguucagaaaaaccucucugcuuuuuggggguggguggguggguggugggggugguauuuauuuacucacugaaaauagggacuuugugugauaggagagaaggaagacaugauugguuuggagcuaaugggcaagguuuuuuuuuuuuuugguguuuuuuuuuuuuuuuaaacccaagaagacuugauugagguaacuucuuuaagacucuuggagagucugagaacugagagaacaaaagcucugcaggaaggccaccgaagcgagcaggcucuccaccaagcuuuguauggucuucaauuuuucauuccgguuuugucuucucuucagucccuagaauagaguggcauuaucuugaagccauggagauuuaagaaacaagcaaguuuggccucucuuuguugagcuuaugaaagccauauuuagucuucugaggaauguguuuuucccuugggaggccccucuauaccugcagccaucagaaauuccauaguaaaagcccacauuuaagucuuuacggcugaagucuguucuugugugucuggaccagguccagcugucagacccagauauuauugacuuuuucuuuucuagugagugguuuacaucugcuggcuccauuucuuuaccacuaauucugaaacaccuuguaagcugacuccuacugccucuguauuaaaauuguacccucgaaggguuacaauaacugacuuuuuggcuguagucagugggggauuauuuuucuucacuucuuucuuaccccuuacuguuacuuuuccccuguuuuuugacacgacaugaauuucccuuucucucuuccccugacuuugcuucucuccuuugggacagcagaucuuuugggcucuuucucacucauggaaaugugacuacucuccucuaaaggaugcauucaguggugcgcucauggcuuuuuacgcuucauucaaucucaugcuucuagcuggucccuccaugcaacuaggucuucaguuccuacuucuucugacccaugcuccagggcugcauuuccauugcacaaaaucaacugggauggcuuuuuaugagccacacauuguauuauguucuuccugcuuaugaauguugauaacuuaguauuaguaacagcugacauaaggcauauucacagcugaucuacacauacacauguuaagacaaugacuuugaaaaccacuuuaacagauuauuagggaaaauucaaauguccauugguggggacaguguuucaucugugagccuuauuugcauaaugcuacaacacuuacaaguugaugcuauaaaagaucugagagcugacaaacuccaugucuuuccugugcacgugacagaaccaccaggccacaucaguucauuacgaauucuccacauuccaaacugaaugcuuuacuucggguauuuuuaugcugcuagcaccucugugaccauuuuguuuuuacagaacagaaaucuguagauacuaucauggucaaugggagcaacgcagaacauuaaauuauaugcuauucuugugaaguugggcaaaaauaauguaaagauucauugagaaauuugggaguuuugcuuggcaugccacuuuuuuucuauuaauuaugagucuccugaaucgcauuugccagaauggcaccauugagucaagaaaauaaauuuauucauauuagccuuucaugaauuuuccuuuuugugugcauuuguggugcuguggcuagaaccacaggcuugugcauuggguugugacuacaaguuuuaggcauuaacuugcucaugacaugcggguauucuagauuugacaaguugaugacuaaaacuagucaccacaacuaccaugcucaagccccugguucuagcuaacauguaugcagacauucucuuuccacucccaaguauagaugugacuaauucaucuucacucuauacacagugggucuugaaggccccugcauuugacucuuuugggaacucagcccuuguguccuacaaagaaauuuggcccgaucugaccaguagccaagguuaccuguaauggucuauucuccucagagggaagcaauugaauagaaggcuaauuacagcuaguuuagcucauacuuugcuaagcaauucaauugaaaaugauugcagugcuuacuuaguguucaaauugugugaucucugcuauggaaaugugaucugccguucuuuuccccagaagugcuucaaggcaaaucagucacaaacaagaaaaguuaaauaaugguacaaaguaguuuccaaucauagguuacuaaggaucauuaagaaaaaauuuccacuuagaaagaacauagguauagacuaagacgaacucugcaggguuuguaagccaguuguuccuagaaauuggugcuauugcucaacauucacuuacuuguuacuguuuucauucaaacauacaggugguuauacaccauuuuaaaaugcaugcuuugaucagcuaauaugaugcugggcaauuuuuaauggcuugaguuuugagugggggcgcuucugugaaagacaacaaacacauacaaaacauucagccccucccccuuuuuacuagcauauaaugugcuucuccuaucuguccuguccuaccugucagcuuuaccuuaugcuuuagccuggagcauagaccagggauaaaaugagagcaggggucaaggaagaaaugggugcugugucgggcauggaucucgcagaagagaugaggaaugguguuuugggucaagcaccaucugggaggugaagcacauaaucaucaggagucacauguucccugcaugugcucaucuuugaaaagcuauucaucauuuuguguauagcaucugcucauucucuaagaauuuucuuauuucuugaaauuucugauucuaagccuuuaagagacaggaauggcauaggggagaguauucagguaagaacauggucccauaacgcgauauccagaugucacugggaauccuugagccaauguguguugguucccauuaguaucucuuauaaaauacuaugaagaagugguauauacaucuacucuuuucaagauuguaaaggcaaugcuguuugagagacauguauugguaggcucuuuacaauguuucuaacacaaacaaauucaaaacacuaauuuuuuugguauuauagacacggucuuuucaauuaccuuguaguuuuaaaugcagaauaauucuuuaaauuuacuccugaagucagaaggcuagguagauggauuaucgaguucaaggucagccuagauuacauaguaagacccugucucaggaaacaaaaucaaucaaagcaacaacaaaaaaaaauuacuccugaaauguaacgacucuaaaggcaagcaggaaugucaguuagaaugcuaauauugaaaaaagcagaacaugaaaguugcccccaucauuuagguacgaguacaaggcaaagggucagggagacaaaugaacagcccugguaaucuguuuuugccaugagugcaucaagauggcuacauucgaucucccaugcuggaaugucaaauauaaauauaggaugucuugauuuuagcaaaaacauuugggaaguuucuuuaauauccuugugcauaagauugggaaaugugacagcauaacuagcaaugaggcaaaaucacagcuggucgaaugacugauucaaugucaaccuggaggaagauaucuuucaggaagggucacaguacuguuaguuuagcacuggccagacauucacucauuuagcuagcacugugcaccuacaaugaacaaggcacccuguuagcaacaacugugaggaacaaaaaggggcguccagauuugacucuugcugccacggagcagccuguuggucauaaucgaucacaaagacaggcuuuucccaaugcagauaacaaaaagccgggugguguauuuucuuauccaggaugacagaauccagauugcaaaugaucucaaccuguaggaacuuuaguucaaaaccuacaagaugaaauuuaacagugauagauguagagucuugaaauuuggacugaaaaaaauauugcauaugcacaggauaugagagaugugacuuggcagcaguuuaugucaaaaguucuuggggauuuaguugaucacaaguuuaauacgagccaacaaugugguggagcuuauuuuuucaagcaaaaacaauuuuaggcuguauuagaagcaugugugcuacucagaccacaucuggaguauuauguucaaguauagucaccacaguuuacgaacuuugacaaaguugaguguauccagaaaacagugaccaggaugugucugaaaaccaugucaaucaugccaagugagaaaugguugaaagaaagaacuugugauauucaauuuuuuuaagccuuucuuuuuuauccucuuuucuuuuuuuaguuuagauguuucaagucccaguuagguccucuugcuauguaucucauuuucugcaugacaacuacaccuuccccaguagauuaggauugcuuuaaacagaauagagccucuguacuuauguuacauccauggggcacaguucaccacacaaacuagaguggguccucagcagugcgagucaaaugacuuaguggaguuucccauggcaguagucuugaauauagcuggagaaagugaugaauaacuauuguaccugcuucuagugucacuaaauaaagaaacaaacacaacaaaccccuuuaaaaagaauucauaaaaagauguacaaguuuuguugaucucuucauuggauuuuauuuuggugucuaaugagauuugauagcagacacucauuucugcuagcugcucucuucagaaagccuugucuccaaaaggagcauuuuuucaaaauaaggaaauuuuggcaccagaaugaagagaugcaaagaaaacgagacaucauuuuuaauucccaaauuagaaacaguauguauguauauacacacacccacauacauacauacauguguauguguguguguguguaugaucuuccuugccaauaauggacacacucacaacucuuuuuggaauagucaucuggcaauguguauuaucaaggguuuggaaacuauucauuuuuuugauccaauaauucuucuuuagggacuuucuccuaagaagcaucauuuugaagaaagaaacaaaagucuuacgaacagagguguuuuauaauaaaaaauuggaaacaauaaaaaaauuaauaauagaggaguuuguaguuacauaaacugucagguaugcaucugauagugugcuguaaaucuuguaguuuccacagaauauaaagcucuguauguggcgcaauacaucagcaugaaugcaaacaucuagacauauguaggaaaaguucugcaaauucuucuaccacaaagucaccaguggcugcuuuucaguagugagcucaucaauuguuuuguaucuucuaaaauuucccccugaaaaugaccagucuccaaguacgcguccuugcauauguaaguagaguuguugagguuuggauuuguuuucuucucuccuauccuuccuucuuuuuuucucccuccuuuccuucucuuccuuuucacacacagcaccauaccucagauugauguugaacuuaacucuguagcuuaggcugagcucuaauuugagguccuccugccucagccuccugaauacugggauugccacaccuccuguggcauuagcuuuguaacucagguuuuuuuuuuuuuuuaaacacagccuuguguaucuccauugaagcuaaugccauuauauaaugugaaggaggacuacccaaacacauucagagaaaauuugcuuuuaauucaaaaucuaaauaaaauuaauuuuaauuuacuguaacucaaagccuuuguaaauauauuucaugaacaauuuuugaucaaggguauguuaaaaauccucacaaagaaaauaugaaaagagcaguaaugaacuugucaggcagcuuuggaggauggaaauguccccuguaguuaguaggcauuuaaugaaguguucaguggcuagcuacuggagggaaggagggaagaacaaaagauugauugugaugaauuaacaucaaauugcuugauauguaguggaaggaucugaaaauaugguaucaccuuguuaaaucaagucuguuuggcuauuuguguagugcccagaugcaucaaaguucuagcugucagacccuggauauuguaaaaugcauccauuacaaguaauuugcaugaacccaucacucugggcauucauugcaauccaauucucaacugccaucaaaauuucuaauaguuuccccaguauucuuuuaguuucauucaugugcuaucuuuccuaaaggaagacauuccacaagcauguuugaugcaaacuucaucugugaugauuuuaugucaauuuuugaaaugcauguuagugaagcuuaucucaucuuuaucuaaugcuggugguucuuaagugacucaauucuuucacaccaaaaaacaacaaaaaaaaaucuccccaaaacaaaaauaccaagaacaccacaggucucugaaauaguucuguuugccaguaacaucagugauuaccaguaucccaacaaagagaaaaagccagaacaaauuugguuuuauucugauggcaugaagaaaggcuggauguucaauaacugaaguuuuuaugcuuauucauaucuaguggcucugcuuuuaauuccccccccuaaggugcgaccaucucccaucuuguuguuggaguaaaggcagaguauuuuucucuauuguuguuuucuuauaguuccuggcccugauguugcuguugguuuguuuuauugcuguuucuggaaaucuuuagacuuugauguguuugaaugccaccucuacacuucccuucccuuucaagugcaccacagaguauugugcacuuuuuuuuuuuaaucuugucauuguucuuuuaaguacaggaugaugaaauuugccuguagugauaaauuagauuugaucaagucaucuagcauagcuuucuccuacuuccucaucaaaugccuauggauggagaugcauuucuuccacaacgaucuuauccauguugauaaugccuuugcucucucuuuuuggggucaccaaagacuucacaccuuucauccuugucccugcucccuguuuuccacccagcacuggcaucuuuccccacucuggugccucggcauacuauuuccccgagaauaguuuuagugcucuguuaucacuucccagucuuuguguucuccuuuucccuuagcagacaguauacagugcucucaaggaggagggcacauuucacagaaggauccuuucaugaagacgauguaaaugcuacagugacaacuugguugucauauaguuuguggccagaggaagaaaugacagaagaaauacaaaacuccagcaucucaacgaagaaaaaguaaugugugagagaagggguugauacuaaguucacauuacauaccaauugaaauccaguccgauguaucucaauccacaaagagcauauugagaagaauguaaaugcccauugaguuauuugaaacaguucagcuauacuuuucuucuggccuguagcuugcacugggagucagcagugcaguguucauacaguuguccaggccuuaggaacuacccagcuagagagcuuguccucaaaggcaggauaggaucaggcagucugguggcucagcuuguuggucuuucuugcucacauagccacagugcuuguuauuaauuuuucuggugccagagauggaauucagggucuuuuguaaauuuagcacccauucuacuauugaaguacaucacuagccuaaacaauuuccauguucuuaccacagugugugccacccaaccauuacccuauauuuugacauuuguauucuaguuguuugcugcuauaaagaauaccaccaaugaaccccuccuuauaaaugcaggucuucucuagcuaucuagucuaguuuuauuagacagagacuuggaucuccucuguagcaagcaggccauuggaaugggaagaaagggcaagguucagcaguagggguggacaaugcucuguacuagacaagaauuucuauauuucugguagucagaaaaguuaggugcuugacuuaagucccauagcugcccuuagaaaucuggagguauccaguucuuugcucuguaaauucuacuucuaaugaggaaagacauuuuucuauuggagaauauuuucaacauaaagaauaaguuuaauauguucaguaaauuuucauuuaaguuagugccuguuaaucuuuuuaaauuuuuguaguggcuguuaauguuuuuuaguacauguuugguaaaaaguuauaauuauuugaccuaaagcaaauuucuaaaucaaaugguagaaucuuauaucccauuguguauauaucuauuacagaaaucgugcuuuaagugguuuuuugauaguauguuauugaauuauucaaaaacacaaucauucuuuuuguuugauuuauuucagaagcagaaacaggcuugauucaaaucaauuucuggauaacccaugucauuagcuuuuagagcaauucaaagucacauuuuuaccaggaaagacagagaccacccaagucauaauuuauauugcuccuccuccucucccuccucccccuuuuagaaagggucgcauuuuucccuugcuguccucaaauucacuauguagucacggauggucuugaacuccugauccuccugucucuaccucuaggaguaggcauguaccacuguaccuguuuuauguaguuuggggcugggacgcaaagguuucuacauguuagacaaucacucuaguaacauccucagcccuuucaaaagugaauacuucuuuggguagaaguucccucugggaggcaauugguaugccuuuugguauuaauugcuuauuauuugucaucucuccugaaccuagaguuuuuagaagcacguuuuuccuccguguaguaacuguuacuuacaagaagccacggcuuguuaauaaagcggagggaucacccugagaccuuugaggcuuuggcagaguaaguaggagcccuuggagaauguuuguuaggguccuaagcaagaguuccuuuucugggauugcuuucucgcuugucauuguguuggaaaagcaucagaaaaggauauugauuucuaguugacaggaggauguaagccaaaaagguguuuaaagaagaugaagccuuguaccuuuuguuucaucuuuuuuuggggaggggggguucaagacaggguuucucuguauagcccuggcuguccuggaacucacucuagaccaggcuggccucaaacucagaaauccgccugccucugccucccaaaugcugggauuaaaggugugugccaccacgcccggcuuguuucaucuuuauaauuuauuuauauagcccuucuggaggcaccacaaauauucugucucuuaagaaaaaaguaccuacagcugacacuguguucuugguauuacuaagugcuucuuuauugaacacacauucaguuucucacaguucuugcaaaggacucucuacgugccagcuaaucaauaaaugcuugauuaaugucuucuaaaugcaaauuuaacauucaaauaaggaaguuucccagugcccuccucgucuaacacuaaauguguguuaggagaaugugugcuugaauaguugguacccauucccgugagaaaauuggcauguguguuuucugcuucuguguuuaaguuuaugugaaccuuaauaaccucuaggcuauuagucaaauuacucagaagucaccuagacuaucaggaucuuccgauaacaggcagacaacccauacgucuggaaagauguucagcuaaucauugauuauuccuugaaauagaugucagagagguacugguuguguuuacuuauacuaauagcucagauuugguuggccuauuuuaauuguccugcugucugggauuuccugaagaauacuguuaaugacgcuuuaggggggcggcuuuaauggaagaaaugagugcuggaguugcuugggaguggcuguuaaugcaaggcuccuggggugcuugaagcugggcacagaaaggagauggggacuaccuggaggaaguagccaucaguaaccauguguuuuuguagcauggguagauguggucacagaggaccaaggcucugcucaaccauuugugccuagauugguuagggauaucaugaggccaauacacaaucagcucugugccccauaccaugugagacuggagaugauuauaaugaaccagacauauuaaacaguuuauguuucaucucuagagacuaacacauggaagaaauaucccuacagcaaugaguagggauuucaacaguuacaauuauuuuauuuuauuuuauuuuauuuuuggguaaaagaccuuaaucugcaaacacuuaacaaggucaaacaaugagauggauacaaaaugucaugcgugugucuuuagaaaguuuauuaugcugagaagaguagacauacaaacaaugucaggcaguaccaggcaguaccagccaguuguuuauugacugguaugggcuucagaggaugacgggcuccccagggucuugagucagucagaaaaguuuccagauucuuaaguaggcucagaggguugaggaggauucacaugggcccagcauguggccagaucagcagaaauguccuuugcccucuaagaagugucagugucugaccucccuccaaaacuccuccaccaaacuugcuuguccauuuaauauccuuaaagcacaccuggucaguaauuagcucaaucacaccuuguuucagucauuacccuuggauuucccaacgaugagcuuaauccaucucccacauuaaagugaguaccuacaugacccaaacucagcugaacagaauauccuugucucuaguaugucaauuuaaugcugcgguaauuuuauugcaaagaaagggguguuggguuacaauuugccacccaaguaucuguacagaaauuguucguguauguuguuaaaaaucucugaugucaaagggcucucauuucuccugaacacuacuuuaucugagggaagaaagaaagggaaaugagcugaaacucggacucguggaauuuaaaacugauaagaucuaauuuugcucauucauucagagauuaguuauucagaguuuauagcuuauaaacguauugaugagagauacagccccuugcuucuaugguuuuacagggcuuuaguuugcauuuuaacuacacuucccucaccucugaccugcugcuggaucugauggcacaaacugcugguacauacgcuaugcuaccaaagugagaagggagaggggcaccuuuauuagaucagauuacugccagaugccuggaccgcucucacugguuacuguuuaaaggggaggggggggcacagaucugaccacgucuaggaauggggccaggugucuauacuaaggcaacccaacuccagaaggcuauaaaaauagcccccaaguaguagguucugauuucccacggagcugaccaauauaaauccacccgccaguuaauuaaaaaugcuuggagagaaugugcauccucugugacccaccuguccuugugaacacuccgugcuuacaaaugggaggcuaccacugacuguuucaguuucuggguuaggaaacacccuucuucacuuucacagcacucaggagguuuaacaggcaugugugggugccugaucccaguccuccggucucaggguuuauuugaggguaaaaugaucuguggcuuccaaagaaacguguacuuuccccacauguguucgggcuuccuggcaccaccagaaagcagguuuagagaaaccaccucaucuuccaugauaggaguuuccuucagucugucaaaauuugauacaaaaaacauucuuucucuaacuacugguacuaggguacuaugggagccugauaugcugaauuuggaucuuuuaguauuuauuuauguaaacuuaggaauuccagguugauagcccuuuucagauuuauuuucuuuaauguuaacgacuguuuuguuugcauguguguaugccugcaccaguugcccauggagccccaaaaaaggguaucagaucuccuggaagugaaaguauggaugguugggaacuacaagcauuuuuauggugccacuuggccuuuuucacaucccuuugauuugccccugccccccuuuuaugguaugugaggccaggcugucuggaauucacuaucuagcacaaucuugccuuaaaugugugccaauccuccuacuucagcuuccaaguugcugagguuagaggugugagccccacauaguaccugaccugccaaauuaacaaaaacuaaaaccguacacaaaacgaucaaacaaaaaaccuuagugaggaaaaacuaggcaguagagaacuugccuaacuugcacaaggccccaggguccauauuuggggugagggaagagaacagagagaaggggagagaaugugugagagacggccacuugucuacucagauauccuguuuucuuuuagggcccugaguucaauguccaguacuauagaaauaaaacaaacacauaagaaacccaaccaaacaaguaagguucaguguaacuggugucucuugauuucuuugcagcuuugaaugcauuuuccaucacaacagccuaccuauuaacagucucucguuguuagagcacucaaaagauuugugucagaaaagaccuucuucaccaguauagaagagugagacaaacaauaugguuucaauaugggguuagcauucuaagacuuacaugcacacaagguagcauaaaauugacuaucaagucuggaaauaauuuuacauacaguuuuagaaaaaaaaaauaggagaaagaacaauuuacagccucuucggugcuccuaagagacaagaagaauuccagagguaaaaaguaucucugguuccaagggucagaggcccaagagcuugaaugggaggaucaaaaggucaaggcauuugauagggcuguuacauucuuaugacaucuaaaggcaaaaucuagcuguaacacuugugguguauaccugaaggaaauuagucagcacacacagagauaucuacagacccauguuuauugcugcaguauucaugagagccaagccaaagaagcagccuacaugcucaucagcagaugaauggauaaagaaaauauguuaaacugcaacuucauucagucacaaaaaaaaguuugcagggaaacuaguggagcuggagaucauuuuauucauaauauaaaugagauuaaacaugaaacacguucauuuuaaacaugaaacaaguuuauguuuuuucuaauaugagaaaacuuguguuuaucacugucuacaucuaucuaucuaucuaucuaucuaucuaucuaucuaucuaucuaucuaucuaucuauagauuaaucaaccuguuuauccaucugacaugaaauuaugagauaagaggaagcugucuaaagggagggagaauuagagaggauaaugggguaagaaaauauaaaauaccaugcuacauuuauauguagaaucuaaguuuaaauacauacacauaugugaccugacagaaaaaugagggcuauguccaggguaagaucaaugggcugagauauaggggaaguacgggggaaggcaguauauaagcaaggcacacuauauuuguaugcaaaaguuauuauggacauuauuuugucuauuaacuaaacauuuaaauuaaaaaagaaaaauauaaagaacuucaaguuuuuuuuuuaaaauagaagggggagguggcugcuuacuuccugauauauguguacacacacacacacacacuggcauggcaggauugugaguauugauuagauucucaaaccuuggggauuaacucauuuguccagugaaacuucuuccguacaaggaugccacuauguaggaguuggaaaccuuccucuauaucacuauauugguuaauuuuagaacaguuuguuuuugauuuuugugauuuuauuuuuuagaaugaguccuuugacugaggucuuccuuaucaauugaagauacugaggaccuaagugggguaaauguagugggaaauugcaaucucuuggagaucuuuccuucccaauuaggugcuacauuggccuuauacaccacugagaaaggagaguuuaaagauacuuaagaaauacaaguuuauuguaaguuuaaaagcacgcacauggcucuuggacagaccucaaaccugagacaugugcuugcuauuacugaggaaaguaaaugaagacgcauggaaguugcuuauuucuucugcccagugucaugcaagcgugccuuuuacuuacuuuuaacuugcacacuguuagcaaagcuuuuccugauuagcugccucuucacccuucuuaguccccucugagguaugcaugcuuccucauaagcacaucuggagcaucuggccccagggauuuauacagguaccucuuuagcuugcucuuuuagccuaaguaugucucccuccagccaguguaaccuuuucucuuucuucuuuucuuuucuuuucuuuucuuuucuuuucuuuucuuuucuuuucuuuucuuuucuuuucuuuucuuucuuuucuuuucuuucuuuucuuuucuuuucuucuucucuucucuccuuccuuccuuccuuccuuccuuccuuccuuccuuccauccuuccuuccuuccuuuugauuuuauuuauuuuuuguuauggaguagcuacaagguugucaccauagaacuaucuuugagccaccuugaucacuagaaaaaaaaaagaaauccaagcauccuguuuggacagguuguaagcugugacauuagaccuuccugguaugcagaauggcuuucaucacucucccagcccauucagcaagguuaaaggucucaggaagguauuugacuuguggcucugauuugcccugacugcugagcaaugaugggucuuuuucuugaaccacuuaggaggugcccuugggagcagcauaccagagacaacuagaaaaggagggggggggaagaguuacauauuugaaaugaagagguuacccgcaggagaguagaauauacaccaaaggcuuuggcgguaguuuuguaauuugcaggcucugcucaggaagcaaaauggugcuguacucuucuuuuggagucaggacgagaaguugaaaaguauuguaauuugcuuuuaauaaggcccucugcagcugggacucagccucaugcagcucacagagaagggcuuuguucacagagacacuuccaaauaaucuauguguauuuauuuauucauccaagaauaucugguuucuauauguaaggcacaucagaucauaugaucucauuccccccucccaucuuccuaaagggaagacuuuggguuugaauuaagguauuuuuuuuuauugagucagggaauugcuguauaacccagguaauccaggggccuuagcuuagcuuccagagugcuagaauuauaggcucacgccgucacacuuggcuucuugaacaaaggucuguuggcuucaggccaagucggcuugcugcuuugccacaauugacuaauguacuaaagcuuuaugaggagacugugggcaagugucuggaagucccagggcuguagggagaggauugggguuugccauuuucccacagggaaguagcagagcgacaugacucuggacccacuucuaguuccugagguggugcuagcccagugucugauacauauuuggcaccuaaaaguucaugggggaauuggaugucacccucucacuccaucugucauuucugucucgcuucagaaucugaccuuagguguaaugacaccguagguucuuucauguuuagaauauguuucuguauagacauaugugcugcaugauaguguuuuugaucaacaguagaccacauauauaucugcggcuccagaagauguuauugcuuagugaaguuaguuaccauauuugauaguaccacuauuucauaguuuauuaccgacagaaugaaaauuuuaaacaauuauuauguguacagauauuuugccugcauguguguuuguguaccacauucaugucugguagucuuagaggcuagaagaggccaucagauccucugaaacuggaguuacagauaguuacaucucuccaacaccuucuccuaauucuuugagaguuucaugcaacauguuuugaucauacuccugcccacucauuccucccuccaacuccucacagauccaccccauccucuacuucaugucuuuuuuaaaacuuuugauaggcuaucucugaguagauuuccuugucuucugccucccaaaaucuuuccaugcccucuucugcaauguucucugagcucuaagguuaugggaugcauuggagguguuuuauuuauuuauuuauuucuguaccuuccccucaucuggucuccauggugugaccaguuguugcugucuauaaugaucuccauuugcuguaaaaggaagcuucuggcuuucuacuguaggauugauuacagacuguguagucuuauguaaacacacacacacacacaucuggaguuuugacaggaucuuauauacagcaauagcguguuauuuuuuaaccagagucacauuaagauccauggagcccauguuuaucaguaauucuauggcuagauagugaagucuaguuauuucuuuucuacuacaggaagugacuggaagcguaauggagaguugauuccggcucacaugaucugacauuuuaacauuuccugagcugcaggaugcuugagagcaaacaacuugacuuuuacugaaaaaaaaauugauuauauugucacuuucaccuagugaugggccuuuguaagaggacaaagguauucaagcugggaaaaaugagaugguuagcaggauaacaguaacauaaaggucuucagucuggaggaaaggaucucauuaagcauugauuaucagcaugguguuaagccuuuuaaaaaggcuuacuacauucuauggcuuuuuuuuucuccuguuuuucgagacaggguuuuucuguguaguccuggcuguccuggaacucacuuuguagaccaggcuggucucgaacucacaaauccgccugccccugccucccaagugcugggauuaaaggcgugcaccaccacugcccagcucuauggcauuuuuguacuaaguaaauuuaaauguguagucuauuuacaucauaaauacguuuuguguauauuauaacagccuaauauugccuuaggcuacauccaguucacuuguuuaaacagaguugaugggacaagcccaacugucaccaggagucagucacaaagcuaagcuggcuuguguguugacaugcaaaucuggaaaugaagucagcuugguccaacaagaauauggauaguucauucaggaacacuaggaauuaguuuuguggacaagagaaacuaaaaacaggagaaaauaauugcagucaaaccccauuuauacaggauauaaauucuaggauccuucaugggugccugaaaucgcagguuuuguacacacacacacacacacacacacacacaaauauauuuguauguauguauguaugaauguauguauguauguauguauguauguauguauaugaaagcacucuauggcucagacacccuuuuucccaauuucccuuuucaugguuucaguuaccagaagucaaccacaucucaacaauacugauauugucugggcugugggucgaugcuagguagcaauguaaaaauuuuuggcacagcaaaggaaacagcgaagugaagaacgcagcacauacaagcagcaugggagaaaguauuuacaagucacuuguuuaauacuggguuaaauauucaaaauaugccaggaacuuaguuugauaagugauaaaguaaguaagccauucagaaaaugcgcuuaugaagcaaauagcauuucucaaaagaaggccuacaaauggccaacagauguaugaaagaugcugaacagcacuaacuuucacgaagacaaaaaguaaaacugaaguuauguaucagcucagcaauuaauauaauagggauacuaucaaaauaacaacaauuauuugugaagauuuuaagaaaagggacgucacauuccuuguuagugggaauguaaauuaaacagacauuauggagaaaaaaguggaagugucuauagaaacuaaauuaggacuauuuuaugcuucuguagucucacaugaaguuagauaacuuacucaagaagguuuauaaaaaggcacacucaucucuauuuuggcauuauucagaaguuauauauccccgauaaaauuuaauuccauucagcauuuaaaagguggaugacuauguccuugugauaaauggguggaucugguggucacuaggcuaagugaaauacaguagguacagacaggcaaguauucugagcucuugcuuauguuuguaauuuaaaacaauugaacauaaagaaucaagauggaaaauggugggugugagaggcuaaggacgauuugggaugagguuagugguuauuauuuuugugagauagauggaauuaaugacaaauauuuuaaggaguggacaugcucaaauaaaucauuucacauucuguauguguaucauagcaucucaugaguaccucauaaauaucuacaauuacaagugucacuagcuacugccauuggagaagggugaauuuaaucucugaugagauuaagacucucugagccucaauuuucuuaguguuaaaaugcauguggcacuaguuauuucacagcagagaagaaaacagugcacauugcaguguggguggcauaguuucucauuuugaauugccuuuuuaaaauuuuuugccuacauuuaauuguuaaaauugauaaaacuaaaaguuugaaugcaggguuuggaaauacaguagugucaugaaauacugguagagccguuauuggaagcaauauaaauaucagagaauaaucaauuuaggcaacuaaccaaaauuugaagauauguacagccuguguucagcaaccguggaaaccuucuuauuuugaaucuguucuuuuuuugcuuccuggccauugguuauaacaucuagaacuuagaacauuccgauuguaaaauauaaggccuuugugacuuuuucuagaauucucgucagaauacuaacauucuauuaguaacaugccacccuccuccugccuggcugguucugaucuguuaacagcuugaaaacuugcuuucagaauuuucuugcauucuggguaaaagcaaaguguuuaguucuuaaaaaggauuucacuguauuuugauucuucuguauucucgauaaaugaggaucccgucuaagagaaauccaaauaauguuuuggcaaccuugguaaacauggaaggauagucuuuuagugacugaaagaaaggagucuaucuauaugucauugacgggaaauaacccugugcucuacaguaaauuguugcacuugauuaaauuaaauauuacagcaaucaucagaaacuaguucacaaaaaagugacugauaauaugauguaaaauuaaaugguuuggcaaguggaggauuuugaaauuaggucaaaggacaguguuuugaaucaugaaaauuuuaaugccaugguaggaaugccaucuugauagagaagggaaacaugcuacuauccaaaaugucugaauauuuaguaacaaacacaguccucauauauuauuacacuacuaaaacagguuccugugcucaaaguaaacuaaaugucagagaguaucuuaagugugagcagaaaguugaacauguaauccacaacuuuuuuuuuucuuucugacacagucaauaaagaauguaucuguuauagguacauauagcuuucaugcaccuugguuuauguugcacccugacagggcuuucaggugaaugucacauuguagcuucggcauaaaagccuuugcuacauauugcaaguuaaauuuaacuuggugguaggauggcaaaaagggccacuguguaagaaguuuaaguagaugcuugcuagagaguauauagaguuuugaucuggccaugguaaguugcauucugucuacacuugcagaaaguggaaggaaacgguuuagcagggaguuuugauuaguaguguuucuuaguaacugcuuccauaaccuuguccaguaauuguauuggaaagcaauacaaauagaaucuguaaguauugagaggucuaggacaaaggaacagucacaauaaaggcguuguuagccuuuugcaggauuuaguuuguugaauuguuagagaaaggcuuuagaaacauagaagcauccacacauacccacauuucugaauuaagaguagacauuucugaaagggcaaggcucagaaccugaugguucuagaacaaggggaaaaaaacaaaccuuacacauguguuagagucgacuaggcuaacugacugauuauggagaaucagaugucuugggucuaauggcacauuaucuugggcuguuuagcugccuucauucacuuguucacuuuccugucagauuuaacacccugugaucaucccaugauaccuuuuggaauguuuuagcagacacuagaacaaaagcuaaggaugccaucagauagauagcaucugaagccuacagcagagacuucccugcuuugcucaacuuaccuacuuguacauucccacaaauguauuugagaagugcuuugaugguuaagucagauuauuagucagucucucaaaggauaagaaugcgccuuccuccaucacaucgccugccucucagaaggacauuuucucauauugacccuguccuauucauuggucccuuucucuuugcagaacguguugaggaucacauuaggaguuaauggcagauccagaucuauguuauaaauucuuggcaggcuaagaauuugugagucuuucugcgacuagggccacaguugcuaggguacuuuucaaguucccaguaagcacugauaccauagggggaaauccuuguuaauucaguuggcaccugaaauacaaugcuuuaaaaaauaucuuguggcuauuuccauggaauucaagccacaucauuuaucuuuuguucugggggaauagcugauggugcacccaauaaaugcuuucuauaguuuagugucuucugggcuuauauaagcacugucuaaacuuuagacucaaaagccuguuuugcaccaggugagauggcuuagugggcaagacugcuuucuaccaagccuaaaaccugaguucagugcuuagcauccacucugacaaguugucuguaacuucaguaagcaugguacacuuguccccaugagugugugcaugugcauauaccgacaaagaaauaagaaagucacgauaaaaaaaauuagacuguuuugcauaauagcaucuagaaacaauuuuagucaaggacccaauuuaagccauuuuuacccaggucaagcuagagauuagagaaagguggcagaugaaaucaacuuaaggucugucaccaguuacaaaaggaaguaggucauuggguuguguuuauaggaggaaagagaauggauugcuagauuguuaucacuggagugauuguggaggaaggggagacacucauuugaagcccuggcccccagacuaaaggagcccagagugcuuuaaggacucacacauaauugaccaaacauuccacaggaagaaggccugccucuggcuacaucacucugccuugaagaaauggacgggggaggagggagagaggggagcauuuggcauccugugaagaccuuucuaaagugucuccagauuuuccagccucaguuucacaacucugccuuggaaacuggcaaaucuuuagaagccucagcaaacaacuugagagaaaguugcuuuugcaugucagcaagcaguaggcacaugcaguuuauacacucuugauuuuguauguggacguuuguuguuucggaacuggguaaucuugcuuuuugacaggacucuucuguggugcuuaauaguuugcaacaaauacuuccugggacacugaagagagaaaauaaaggauuuacuuccucucucgaucccguuaagaucugcuuguaagcagaggaagacauaaaaaaagcagcaacucacuagccaggagccgauaauguguaguucauucugguaaaacauacaugaugaucaacaugaaaacaaacggcuaaggaguuuucauuaguaucuaauuagaggugauuugguugcuaagugcauuuucuaauucauuaagaauuagguaaauuaaaugugauggaaaugauuuaaguuugaaaauacaauaccaucuguauuaauuuuaacuuaauggaauaaaauccauuugcugucuucucccacccucauccaccccuuuccuuccaaauccuaugugguauagaguacagaggcuagaucucuugucucugggaaucaguuggucaguggagcacgucugucuaugucaggagaugagugccagcgacaaauggugcaugagcacaugaugcugauggggguuguguaugcaccgcaugagaacagggaaggucccuugcaauacugugagggauucaggaagguauuuuagaauuuggaggggcuuaaggcuugauuccgcucuugauauugaauugcagcaugaccaaaggauuaacaaacgugccuuucaugaaauaucucagggcacagagguucucaaaugauugcaaauugguuaaugacuuaagaaaaaacacauuacuucuguaaacaggaaauuuugaaguauuuuccuaaaugugcauauuuaaagcauagaauuauaugccaugucaauauacacugaacucaaaagcaaagugacuuuaaaagagccugaaaauaagcauucucauuugggaugaugcuuaaaagacuacuacuaucucuccuacuuuaaauaacaucaugucagcauuucucagugacuagaaaaguugcaacacauuccuguuccacuugagguuauuugcaguguauuucuagcuuuggcuagaccacauucacaaguuucuagagaaacaaccacagugggacauugcgugauccucucuaccauccuuuaucaaagcugagcagguaggcuaggcaggaaggacaucaguguggaaugggcuucucuuuuucaagaaucaauaaucagacaugcaagcuuguucuaagcugguugaugugaaagcaguauggugcuucuaguauucagucuuugaagggugggaggggauaagagacccaaacggugaaaugucagaacagguuucccaucucugagaaaguggcuagaguccuuuagcaaccacaguauuuuccagugaacuuauggugguaagugguagaaaguucaagugaugucuuugaaguugagcaaguaagaaugaguuaagagugucugguaaguaugaggaagucaucccccgucacacucugucaggauauccaaucucucugggaagaccagaccugcuuuucuagcacaccagggucugauuaccacugaucucaaaguaagcuacagugcugauaagaguuguauuuauucucucucucacagauacgugguuaucaacauuagggcagaaaugucauucgacuuuugucuuucuuaggagacuuuuuucuuucccauuauauucagacuuaggaaauagaauagaaaaauccccauaaaaggacaugcuugaucucuuuuguccuuuaaccagcuuaaaguauguaaaaaaaaaaaaagaaaaaaaaaagaaaaaagaaaagaaaaggaaaaggaaaagaaaaggaaaugaaugaaagagucuuugagggaagcaagauaggaagaguugagucccagugaaugaagagucuaauaaagcuaacauucccucugggaagugaaggcugcagauuucuucccugagauuuuuuuuuuucauuuucauucaucaacuugcucgacugagcauuugauugcuagacuucccaauaccacuuacuuuggaauuuacauuuacaucgauagaaauaauguccauauccucaaaaugucagguaucaucgaacuguaccauaaaagcuuuuauucuauacauaggaugaaacauuaaacgcugugaacgggacaauuuccuuauuucauagaauacgggugggaaucuaguuugggaggcaaagaucuuaacccaaugcaaauauuugauuuguugauauuccuucccuuaaaacaacaacaacaacaacaacaaaacaaaaccucucucucugagugcaguguaagccuuucuugaugcggcugauuuaguccuagaaaaccagagcaguuuuaauguguaaaauaacaggucuuuuguaaaacauaauuuuuacagucuccuguagcaugcgcuggucuuaacuuucaauuccccaacuuccaucuucuaaguacugggauugugguaugacuuccaugcucaaccuugcaauucuggcuuuugugucucuauuuucuacauuuuacuuauauaucccaguaucucuguauuuucaucagcauacauagcguucuagauuuacaagagcccuauucuccaggaguuuauaguuuuuuuuuaucauuauuuuuggcacaggauucaugucagugaugagagaaauucccuaaaucuaucuucuuuauauuuauuuuuaaaagcucuuuugacuugacuacaacuuugugguuuugucuuggcucuggucauguacuggucgugugggugugguagcugggucauacuaucuauucuuucacauguuuuacaaccaagauauugcccagguaaaacaaaugaggguuuuuuuauugcagaguuuaauccaugcuauuagauaaagaaaugcuuguaaaaagaaaggaaacauuacauauacaucuuccaguucauauugucuguuugagaucacaagaauuaauuuucucagcauaauuuuuuaaauuuuauuggguauuuauuucauguacauuuccaauagcauaauuuucuuuagaaaccuccuauuuuugguaucuuccacaaccaagccauuaaagucuccuggaaaugagaacuugaacaucucuaacaauaaggagaaauuacuuguuccuguuuaaguagacauuacuuuuccaaauauacaauuuucuaaguagaauuaaugaagaaauaucauuuaaauuauuuucuuaguauaauaucuacacaauagcuuuuuaacaaaauaucaguauuugagcuuuauaauaauuuuugaguauaauuuuuuuaauucuacccaaaguuaacaauguuuagaugguuaggauguuaguuuauuugcuuuuacucucucugucucugucucugucucucucucacacacacucacacacacacacacacacacacacacacacacucacacacacauacacacucacacuuacacacucacacacacacucacacauacaugcacauguguuauacuuugcauuacuuuauaugcauuguuuucucauaguaguaguuuauugaaaauuuuaaaaaaucuucaucuguacgaaucuucaucuaauguagaauuagucacuuuucuuuaguccguucucuauuaugucuccacaucuagcaguuguuauuauuccugguuuguagaugcaaugcucagguggacagauucaagacucccaugauagaugguacugcuugucuuuggauucuuugaguguguucugcagucuuucuacucugacauauagugaaggaagcaacaaugauggauauuuaaugauuuagcuggacuguuugucaagcaaacauaauguagccaugacuuuaaaauaaauucacuucugauuauuaguauuaucuucucuaauauauagaaucugauagacagggaggacucacuucccaaaggcauucuuuuauauugucaauauauuuucugacuuucacuuaaaguauccacuauaaaaguuauguuuaacugagaaaugauagccuaaagugauuuuacuauuguuuuuuagucacuaaaaacugguuuauaguauuauucuuuauuaaauaauagucuucccaguuaagcauuaagacauugagaagauuauccugucaggauuaaaugugguuucaaacuauuguaagugacccuuuaacaccuauaaaaaguaccgaaacuuuuguggaagaaggacgaaaaaggcauguguaugucagggcuccaaaaugagaugugaugcagcaauuaaagauagguuuguuaaaugagguacaaccaaaggaaauauagaaauguuaauaaaacaaaaacaaaauuaaucucauguuccaaaaccaaacaaguccauacugccagcagacaaacuauauuaucagucuucauauuuuuuuuuucauuccacauagucaauuuuuagagaagcuagaaacucuggucuuugucuggagauagucuuuucaaaacugaauucaggucagcaaggaaccaugucuggacucuggccuuuggcucuuugacuuacagaaucaaugggauaacacuguuuugcucuggauuccuaaguagauagcaggcaaauuagaacuaaaacauccacauucugaaaaccaagauaacauuucaucuuacuugagucuguuuucuuuaguaucaccuuacccagggagccccuguaaguguuuaauagguaccauugcuucuggguuuagaagugcauugccugaagacuucuuauuguauacugauaugccuuugggggaaagaagaccuauaaguguuaacaggaucucuauucuguuuuugguucuugcuauugcuauuucaaaucacauuaucuuaaugaaauaggagucaaugucauaggaauuauguuguguuugacaaaagauuaaggaugucuaggaauuaugaucauguuacaguaauugccgaaaaugugguguuaauguuccucacuucaauuguuuuguguugauugaacaaccuuuggaauagaugguaaagcucaaugccauuaguaauaaagaucuaaaucacuuaauaauguuucugaauguaguaguuuuucaguguuuuagaaaaugacaauuuuuuaaucaaggugcuuauauugaauucaaacaggauaauagcauagauucuuuucuuuuuuuagcguuuuuggauagcaggaacuauauuuugaauaaguguaucuccugaaauuagauuuucgaggguucuucuguuauacuaaguaccuugagauaggaauugaaugauggagucacucaacccacaagcauuguugagccucuacaaagugucaagcacucuccuagguagugugugugucugcgugugugaaugugugugugugguauaugagaucaaauuuuuggagggacuuuauaguuugggugauagaugcugucuguaugcauucuauugaugaaauaauacaaaauucagugguugaauauacucuuagcacauaugauacccuguguucaguuucuagcacacauguguacauucaaacacacacauccgcgugcacucacacacacacacacacacacacacacacacacacacauacacacacacacacacacacacacacacacacacacgaaggacacccauugugugcagaaauaguagccuggcaaauucuugaggcaagaaaaauauaagguuguuaagugccaaaauccaucugggcuggaaucaaaguuugcauaaaggaaauaguauggugagaaagaguugaaaaggaaggcagaugacagccuucucuucauuucauuuuccagcuguauuuugagggcuguaugccgaaaacuuacugaguaugaauaaauuuuaagucggucucuaauugagagcaacacccaaggagcaaaaccucgagcuaaucuguacaacauguggcauuguaaaacaauccuucagaguguccugccuuaaacauccucccuuuagucucuguguauaucauccgggccacccaaugagcucagcuggaaaugagaggcuuggguuagaaaauuuugccagaguaauuaagaucucauuggaucaagcugaccagcugugugcuuucgagaacacuaguuuuuagugaagugauaagaguauguuuuuggggguauuuggaaguaaaauucauugaucaaaugaucuuauguacaagcccuuuaccauagacaugguuauccauaaauggcccacacuuuucuguuuuuuguuuuuugguuuuuuuuuaagcaaugcucuugaauuuuacucuucaaaucuccuacguguauuuugugauguuuugacugaauuggcagucaaccagaagucugggugauugcaaauggcagauggagaauaaguuauuuauaagugacuugaaugauccauuuauccguguauuugacuaugggugagucugcuuuugaaaaucauucucaaacuaaauaaugaagucauaaugaaaaggucugauuugugcugcugagaggcuggccugauuccugcaaccugcugcaugcuggguagagaguaaaaacauugccuguuguucaaccuguuacuuacacagcauuauucuaagugcuacugauguaucuaacagacauauuuuauucuauggcuugcagcucuuuccuuuuaguuugcuguccauaaauauagaaaggaccauauucuggggauuuaaggaagaaaagucagaugcuaguauauagaacuguuagagaaagaacuauuggcauaaaauggaaguauuagaguuuguugacaugaacaaaucuuugcaauauugcaagaaguaaagauauugaaacaaaacaaugauauaauauucaaugcucaaaaaguuagugguuaauauucuguaaguacauuauagauaggaauguaauaauaagcuuauuauuuuuuacaacuaauauaugcucagucaaacuaagcaggaugaagucccaccaagaaugagaacaaauaguuuauauggguaaagacugugucaugcuuuuuuaaacugugauuucaguauauugcggugaaucagguaagccagggaauauggaauaagaguauuguaaaacuauuccuaagaaagcaguuguaaacagucuugcuccucaaccaaagcugcagaauuguuagaaugaaaauguguuuugguacaaaguagaucuccacaaaccuuuggaugcucuuguuauugccucauccauagacuuaaaucaacucgguaucuaggagucugcuccuggaccacaagauucaaguaaaauuaauaccauucaauaagcuaucauggguuugccuuuuaagauuuauguauuuuuauguguauguguauuucaucuacauauguaucugcauaccacauauaugcagugcccagcucugaguccucuggaauuggagugacagacacuuguaagcugcaguguuaguccuggaacuugguucuuugcaaaagcaacaaguaccccugagcgcuaagcaaucuccccagcucccauccauuauggauuuaaaucucaugaaugucauuaacacugcuuggggaaaacuauuuuagacccuuaucauuucuuauuugagaaauguugaauuuuguggcauguuugaaacaagcuuucaucauauagcccaggacauccucagauucacuauguggguuaguguggccuggaagguucagugccccuagcucggccuuccaaguguuaggauuuuuuuuuaucaguuucccauaccacuacccacuuuuaucugguuuuagcuucuuucagcuuaccuuuguuuaguuucaaaaucuuccuuaucuugacuguauuaggauuuggugagcucuguuuaccuagucaauauucauuuuguuucgacaaacugauaaggccccuccccagucuuccucuguucagauuagagugccuagcuguaucaccugcccucaaauaguagacuucaccaacucucuagaugauaaaaucuuucccaagcugcauucugucuugucacuuggggucucagaauaguauguuuuaauucaggaggauaaagcacuuuacuuagguugcuggcccuguguacucuguuacauuucuuuaugggugguuuacagcuuugcaaccuucuuuaggacuucagggggaggauacacccauugaaacucacauaguaccaccuacacuuuuuguuggcugaccugucugggagccuccagcauugucugugggauuuguuuaguggcagaagcaugucaaggauucguguuuaugccuggcacugauuuuagucuugcauuguacuguaguaguaaaccucugagauggccgccuuccaagagccauuaaguaaaguuuagaaaaauaugugguagggguuuuagcugucuguuaccuguacaguuccugccaguuagaagacuuucacuagggauauuuuaugaggguauaaaaacuucuuagcaaauucacuguuuauuagguaugguguagaccuuauuucaagaaaccaguuuguaccaggaaguguacaggaaggggaagagauuucagcugucucugugagugccuuuucaauauguuaggcaucuugggcaguugucacuaagugagggaggcagcuauuauuaaacauuugugauugaggacaugaaguuaagcacuauaauaauaaaaaaugucuuauaucuugguaguuaugccaaggcaugucuauucuacuuugaugcuauuccugcaugaugcucuagaaaucaaugguaccaggagcucuuaaacccauacagugaaaauaaacaagauggauaaaaaagaagccagucaauaaacguucaguugcauuagucaggccacuuacauuguuaaagcuuagaaaugacacuguauuauuccucucuugucaucuguauuucucucucucuccauccaucuuguguucccaccccgccaaaagacaaaguaauauaggagugagguaaagaugauuggguggaagaggcaaucauucuaauauuuuacuuacuuucuuacuaacuguuugugauuaaaaggaccacaaauuauauuuauaaagauaagcaugucuuuaaauaaucuucauugauuuagggggacaucaagaugccccaaaaagcaauuaggcaggaaaacauagaacucgcuuuguucugaaagaagugacauuugcguuccuuuacagucccuuggcauuuauauagcaaaggaaaacauccaaaucucacaauaauaugugagguuuguagguacugggaauaggaagcugugcuuuuucuuauugucacguuuuguaagaugagaaaauuuuuguaugaugugcuugaagacauuaauguauaaaguagucuguuauguucacauuccuuagguauuaaagagauuggacgucuguuuaagggcauuauuuuuuucuuauuggcaccaucguuaaucucuuuuggaagaaauguaauguauuuguaccacuucuaugauucuuuuucuuuauuugagauaauauguacugaucacacauacuaaaggauaguugacugccaucaaauagaaucucuucauuccuuacauuuuauuuuauuucccuuuaaaguguauuauuuucuuaccuggcauuuaaaaaaaaaguuuuauauguguauauucagguacccuucaagguaccuuggaggaaccagcagggggcauuauauucucuggauuaggagugacaggccaccugauuugaguccugggaucugaacugagggccuuugcaagagcaggagugaucuuaagcacugagccuacuauccaucacucuugccuggcauuguuuuuuaaaucaaagccuuuauguuuuuacaggggaauucuuuuggaguacuaugcuuugguugugguuauuuauaucugacuggcaucguuggcagagaaagaacguugacagugagagagacugggaaaacuugcccuguuggauggguuaguguuaagagaaagcuggauauggguaugagaaaaugguggucaugaagagaaucaacagggcguggagacuggaagcauuauuuuauuaauucucggaagaagcacaguaauggcuugaguagaaauagggaaauuaacugagagcaguaaggauuguugaguggccgccauaggaagaaagguaaugaaucucaccuuugucauguguugaguuuguaauacgaaugacccacagggagaugaccaagaaagagucagaaauacagaugcagagcucucaagaaagguugagacuuaccauuggaaguagaaaagguugccaaacagaaguuuuuagggguuaaggaggaauccauaaaaggaauguucagaagauucaaauagacagcaaagacacacaggaagaagcaguguagacguucgcagagauuuacagaagaggugaaagagaauagagguuaggaguggccauuuuugaagucauuggugacauuugagaaccaacuuccauuaguguaaugagcgugaaagucacaaaauugaaggcgaggaagugagagcugacuccucuugucauacguuugacaaugaaaggaagggagugggagauugggucaagaaagauacauggaaucccaggaaaugcaugcuuaaaaucuucugucuuaucagagacaucucacuugcuaagguuggggaggccaggauugcauuugggacuugggauauuuaggaagaauuuaaagugagggaaagcauaaauaauggaagaaaguggcaaaguaugacuaaaggccucgugaaauaucagccaggacuuggguaaaguuaagcugggugacugguuuauucuacagaaauggcaaaaacucaugacuuccuccaauaucgcuuggcagggaguggggacaauagucaugaaaagguggaguagaaaauucacagugaggaguuauaaaagggggggguaaucaauauuggaauaaaaaaagugauuacuuaacugauacauuuucucaccauucauucccuuugcaaggaaugaauucucccuguccauguggcuucaagaaguguucccuccaccccuuaacuuauuguuagagugaugacuagcccaucauuauggaaaaggcagaguucaguugccaugugugagauucauuggagacauaugggacagaaagugcugauuaguugcccaggacucagaacaaaggagggagaauuuguaaccuccccuggccagcccuucgaaagugcacauuucuauucugugcugguuacaaaaggaagcugggcuaauugccucuugaaauguguuuguguucucauggauuuuguuaauacucugucucacugugcucacaguuguuuguguucacugaacucuaacagguaugacuuagcacagacccuaagugaaaaaaaaaaugcaugaaauccuuugguuagggcuagauucugugugcacuuccugugaauuuagacuuguggccucugcuagguuuuuaaaauaagguugauuuugcaaggugaucuuuuuagaacgauuccuuagcucuucuuacacaccacacaucuucauaaguaagauggcuacuuguguuagaacacaagaaaauauuccauguagccucuacuuucugagcuaucuauggcugucauauuuaccucuaggcacacacagcuuccuacccuggcauccucuacaggucuucaggccuucaggaugugugcgggguuuauguggggaaggaaggagagcagggacaaaaagguaggugguuguugaugcuagaagaaaacuuaagcuuagugaaaguuacuaggaauaucaggccaaaauucaccuccauacaacugggguucugagagcuauuuccagaggcuuuuuagcuuucuuuucguguguguguguguguguguguguguguguguguguguguguguguguguuauuaaaccuugucuauuucccuuuaguuauuaacuguaaaacccuuuacaaaaccucaaaaagguuucugggcuuaaguagauacagauggggaggauggaaacucuauagcuguguucugcuuggcaguggcccaagagaaagcccgagucaaagaguaaguguugucagcagaggcgaggcagggggguuggcagggggaguggagaaugccagcaccuagggccuauugaagaggagagggucaauuugagugacucuggcaaagucucuggacagaacagccuuuuuaaaaggcaccuucucuggaggucuuucuuuccuccagcugguacucacuuuaucuugcucuauucuuucuguaucccuuuaaagggcucuagucuuuaguaucuuguaucucuuguuguuaucuuguauuuaguaguuacagucauguucuacauaaguguuuugguuacuaauggaccacacauacgauuacauugccuaauggcaucauaggcaucauaguuugggcaaguacaguucaugauguucuuagaacagaauugccaaaugguauaauucuuggaccaucucccauaacuaagcuucuguaaacauaccuagucuuaccacuuagacugggaacuccuugagggaagugugcucugugguauggcaucuauuccaguaaauaacugcacagacagcaaaaguaggcagcucgcgauauuuucccuauuguugucaaaacuauauuccgaaugcuauuauuuggaggaaauuggggauauuugaaaugggagcauauccuccagccauugcuuuucuagggagacaagaaagacuucaguucuuugcuagagggugacucguuccucugucuuccuauuucuccaaggaacaguuuuaacuaauacucucuuuguucugaaaacuauuaucaauucuuuuucagucauuuauucccuaggcccaggaacccaauaauucaauaucugguucagugaagacucauugcugagccugacgcugacaguaacaaaacucuuuucucagaguuacucagccauugcaagccuuaagggaacccuagaguaaauggucauguucgcggacuaaguagcagaauuguuguucauuuucuuaguagguucauccccagagacugacuuccuggucuuauuuaccuguuuucuuuucuaguacugagaauuggccagagaaguuuuggugccagaguuugaguucuaaaauagcacauauguucuuugaaaacgauuucuuuucuuuuuuuccaugcuaauggaauaguagauugguugguugguugguuggucaguugguugguguuguuaccuuuuuuuuuuuuuaaaugagugaagggauaguucuuucauuugcuaaauauauugugaacgggaagguauguugcuggagguuaagauaaccuagacauagaucuggaaaaucuauuucaauuaucuucagggugcuuuaguaaaaauaauacauuucaaagagcuaaggcaaucauaaaagaaaguaucaugaggagaguggcccucauuuuccacuuucaaaauuauauacuuaagguggaauuaugcacugccaggucagagcaccauuucugugcaccaguagcugccauggggaccugcugaaguaagggaaggggaccacuuucuaugaacacagagauuaaaacaugcauuuccugagacuccccaaaauaaauugccaccuaaugcucaccuggggacuaaaaaggaugcuguuccauauuuacaauuugcauacggaagcaguguuguugcucucauuuccauauauaagguauuuauacugguuacugaaagacgaagucauuuuucuuugcuuucucuugauuuaaguaucauuuuccuucucuccuuauugcucaaauaguggaaggcagaggaaauaauuucagaugauuuguuucugaaaaauacuauguguagcaucuuuuuuuauuucuuucaacugcucauacuuacauugucuuuauaccuuaguacuuuuaguaccuugcuacugcuuaaaaguaaaaaauggcaauuaguaguuacuugacaaagcuucuuaagugggucuaaaaugucugaaauuuuccuauaacauugucuaucuacuaaaaccagugagguccagugggcuuaccugggugaagugaccugguugaccuuguugguauacacugcugugaauugccugacccucuauaacagugauuaagaugcaauuccaaaauggugcuaggacauaauagcugugggcugcagauuuuguuuugguuguucugaaaaggaacuccauuuuccugagagcacagaaucacccgaugugcaucagcuuggaccuuguauaagaaaacuucauauagauuuuuuuuuugcaacagcuggaaucugaacugguuuccuuuucuaugagugcauuucuuuuccuguuuauuuguuaagaauuacagaguagguuccuuauggaggggcuugcuugugacuuuccaauaugagaucacaauggccauaugcaucaauuuaugaaaaaaauuauaaaaguuauuuuucaaaauaccauuucaguuguguuaaguacauuguuuuguggauuauaucuaaaaaguaaaaauaaugguuacuacauucaaauucaacagucacauagugcuauguuaucuccuugcgaaguuauaguugccaugauaggacugaauuugaaacauauagagggaaaagacauaaauauuaauuuuccauuuuuguggggaauauaaauaagaagauagcccacagauaauuguaauuggauuuuauugaaugaauagaacuuaugaauaggucaacagcuggucauauuaaguuaaaagaaaacccuacaaaguaauaccauguuucaagugugagugucuaggaaaaaccuuaaauugcaucuauucauuucaggaaggacagagacaucauuuucacaauugggaaggcuuuacaugucuaagugccaagugagcuuccagagacuacugaaauguaaggaaggaauuucagaacaaaaggagaacccuugucauuuaauuuguuguuccugagcaggcuuugccagcuauggcucucauaccuauauucccagcauuuagaagguucacaaagaggauuucuuugaguuuggggcuagccugggguauggagugagauccuguuucaaaacaaccaaaaaggcauaaacaaaaccgaaaacacaacagcacaaaagagcucuguuuuacccuugaauuuuaauaagagucucccuugcuuugggaauaaaugcuuucgguaacaagagaaucagauugaaugugagcaaauguaacauacuuucccauaaaauuucaaugcaaguuuagaauuguccuuccuaggaggaggaaaaaaaaaaucaggaaacagccaauuauucaguuccgcuugaguucuggguagaaggcugcugcugaugugagcauuacauauugaaagagauuaaggcgaggccugagcagugauggggccagguggaaaggcaaggcaaugggaauugcagcugcuuguguguacccaccaucauggcaugccaacagcuggagaacaaauuuggucuaaauucccgggagcuacuguugguuaaugugagccuuccaggaacacauaccaaauaauagccuacuuuccuaauucuauuaugggaaauuuuuucgaagucaaucccugugaaaugagaucaggaaugguuugagucuaaaccaugaagugaauacaauuuggguuucauggccuuuaaccuucuccugcaucuccucucuccuaaggggcccauuaucuuucaccuuuaaaauauugcccugauuucauccccccuucuagcauucugucuuccucucuuccaugcucucaucuucuuguccuuuuucuagcuaauaccuuguagucaagguuugggguuuguuggucuacccuucuuuucuucuaccuaaguuacuuggguacuccuauucauagagucgcuuucuuugggaaggacagcuugccaguauucaacugugucuccguaggaguggaaugcuuuucuguuaacuagggguauauggaagugugugugugugugugugucuguguguguauguguguuguguguguguguguugugugugugucuguaugugugcucucucucucucucucucucucucucucucucucuguguguguguguguguguguguguguguuuguuuauguugcauagugccuuuaguacaaaggaacacaacauaaauuauagccuuuguuaccucuguggccugcucagcccucuuuaguucucaccacuugugucccucuucucugucugcaaagacuguuuuugaauagaagauguuugcauccauuuauuuucuaucugccagaaacaacaguuuuaacaaugcuccugcugcccaguggagcaaagaaacuuugaagauuaacaaaaugcuuguucuuauuuagagagaaaugacaucguuugucaaaaauucuucuguuacuaugcuuaaagaaaauguuuuuuuccccuuagagcauuagucagaauacugaggcccagauuuaugacuaguauugacaagaaauuauuagacagauguuccauuugcugucugggggcuuaucaaaaaauaauugaggagcugucauuuucuacaagagaacaauuacgauugacucagcuuugcuuauuguuuucauuaaugcacuguaaacaaugaaaacgcugaauguuguuaaaaucaacaugagaaaaucaccacuaggaagugaguggccaccuauguguucuccuggugcugcugagcagagccaaaguucaaugcccauagaguguauacacuaaagcauguccauaaugaaaacaaaaacacccaggugacauuuaggggacuuaaggaagugcugagguaguaggcugaaauguacaagcaugaagaauuugcuuggcacauucauagaacaguucauaugaaaggcauuaaagacuugugcaagauauaaccguauuuggaaucucacacacagucagauaacuucuguuuugagaggaaugcagucaugauuuauuugaaaaauguauggcuaucgaauagucauaauuuaccccauggaaccuacccauaaagguaucuuguuuuaccuuuguuguaugguccauuaguucugaccaugaaccacauguugauacaucucuagauugaccacuaagaacaauauucucuuucuuucucucuucuucucccccagcucucucccucccucucucuugcccucuuucugucuuccuccuuuuucaucugucauucagucugucugucugucuguuucuguuuguauauaugugugcauauggaggcuacaaguugaaucauuguccaguuuauuuucacuuuauuucagacaggcucucucaguaaaccuggacuguguccagcaauccccagggaucuuucugacuaugggucccagcacugauauuacagucaugugcaacacacaccugcuuuuuacaugcaaucuacacauaugaacucaggucuucacuguuauucaguaaauccuuuaccaauugagcuuucuucccagccuguuccugcagccaaaacagcuuugugaaaugauuugugacauguacuaaugagaucggaaaucaggggugaccuauuaaauaggugcucuauucuccaaugguagaaaaguaagcaaaacucuuuaauuaaugagggggcgucagaaaugccuuucucaaauaccaagacuguacuuaauaagaaggaaauaaaaucucauauucccaugaguuuuguuuaaaggacugaaaaguuugguuugaaguugagcuucucaaauauugcagcuucuuauuuaagcaucucuaaauauguuuaguaauauuuaugauccauuccgcauuuaaagauacacccccaaacuccaggcagacaaauuuugaggcuguucagccuguugcgaccguaauucaaauuauagccuugucuacgucagcuucaucccugugacuuaaauuugguccccccauccauagcuccuuuggucuugagagcccagaaaccucaacaggaucaaguucaugggauccagaccagaugaagcuuugucuuuuacaaccaucuguagcuagaacauuaggccuugguaccuugguaccuauacaaauaaaacucuuuuccaauuuaauucaaauggauagccuaaggaaucuuuuuaaaaaugauuuaggaauaguagagaaugauuguuggugguuaggaacacuugcuguucuucaagaggacccaaauuggaauuccaauaccugugucaguuggcucacaaccauuuuaacuuuauuucaaggggauuuaauauuucuggcuucucucucuccccuccucuuucucucucuuucucucucucucucucucucucucucucucucucucucucucucacacgcacacacacacacacacacacacacacacacacacacacacacacacacaaaugagaucuuucaguucucuuuguaguagucggguccucuuuaggagacuaacuugguacauuuucagaaugggacgaaugauagaacuuuucucauaacaacugaacuauccuuauagcaacacuguuuggauuaaauaauacaaaacuguucaaaguauuuaucagagagaaauaauucuuuaaaugcuaguucuuaaucaugauucgaaaauuuucaaugucgcuugagugccucuuaguugcuggcuucucaauagucugugaauacuauguagaaaggaacugggcuuuguggcuguccagcaccucauccaaucaagaggaaaaggaauaaucacagcccccacauugggauguucagaauauuucaacuauuuacuagacuaacguggaugacagcgucagugagucaccuacucuuggucuucuguacauaugcuaccuuccucucucuuaaaacacagaauugccaaggacccaaugagacaauuccagcagugcuuugcaaacucaaauucguuuucuaucuuuuugagacauaaucuuguucucuggccuuaaagucaucaccuuccugucucagccucuacgguacugaagguuacaggcauguuuccauacucuuagucagaauaaaaaucuugucaugagugauggugaugcuagagaaggugucuauaaaucccugucaggaaccugaggcuuguagagacaugugcuaguucuucucucucaagccccagacccugucugcugaaguaauucacugucaugugauaaccagaauuuuuguuuuaucucuauaccccaauccccaacacacacacacacacacacacacacacacacacacacacacacacacuagaacugggcccuccggucccaaacagaguaaaauuccuuggcaauagauuucuuucaccuaagagcccaucugggccuucuaagggaauucccaggaaaaugggagauaacuacuuucagucccagagucacuaugcuccuggaaucccuguccaaggcauuauaaggaagguucccugggauggaaaaugggggccuuggagccaagucuccuguuuuguuuaauagugagccaaauauagcccuaguucucagauguguacuucugaucuccaaagguuucaguuaaacuuaccagauucaaggacccuuauuuccuaugaaaauguuucucaggacaaacucuuaacauugaaucugccuuagaaauaguacccccauccucaauaccacaugacaacuaugcuuuuauuccagcuuucaaaaugaugcccuuuacauucagcuagauggcugaaaucuuuaguuuuucuuccucuuagaaugaauuuaguuccaaccccagauucaaggagaaacuacauuaguguucaguuugauggaagcagugaagcagguaagacaggugugcagguguggacagcaauuagaaauuaauuugggcucugggcucugggacuaagagaggcugugagaagaaaggagaaggagagagugugggagacaggauaggagauggaguccauaaauaguuauaagagauugugucaaagcaacacaauuuggauucaagauaggaugggucaagugaagauuagugauaggaaguuacuugauaaggcuuccccucacuaaccucucuuccugaauuaccugcuguuccaguuauaacgcuacacauauaacuggcucucguguaccuagauccuuucauucugauaacaaucugaccuuccauuuaccaggccaucucagaacauugucuggcagauuaacauaucaccccagcucugugaauggacccuuauaacaagacuagcucccccuccucuauuuuauccuuuuaucuauaaguacuuuaaaaacaaggccugacagcuuuauuguugaggaguaauugccaaaaggcuuaguagacucuacauucugucuugggauguugauucuucugcuguacugugucauuccaauuauguugucauacccugagcuccugguuugugccugaugcuugaacagguagugaucaugugaauggguggauggauagcucauuuguacauagauagcucguuuguacaguguauuugcugcuucccaaauuccagcauauggagauaccuuuguauccaucaucugugccuuugagauaauccagucucuguuccuuuuaucuuaaacacgaaggaacauucccagaauggaaaugugacucacccaugaucccacugugggugaguggaugaggucaagacuggaagaacccaguucucccagcucuuaagcuggcucuuuuuagcuaauaacuuuacaagcugaccuuuugaauaaaaaagauuacauuuacauuugauaucuauguacuugugaaaucuauauagauagcucuguguagcaggaaccaaagaaugauaaauuucaaauaguucuauaaacugugcauccaaguuaauuaagcaaauuuguauugauuuaagagaaacugguuaaugaaguucaugauucauucauaaucaauuuaacucauucugaaaauaucugugguacaggcaagauagugagaaagaaaggaaccagggagcaagaagaauuggguagagggagaagaauuuagaggacagaaguauuguauguaauaagaggaguagauaaaguuuugagggucacuauuuaagagauaauuacugaagaaaagagagugggagaaauugcugagggcaaucuaaacagaauuauuacccagugucuaauuaaacuagccauugcugcuuguuaucugucuuccccagguucaaagcacacucccagugcugggacacucacuauuccaccaucccuuagaagcacguaggcauuauugauucucuaaagcacacacaaaugaccugcaccaaacucuaauccauagagagacugccuaaaaguauuucaaggcuuggugucaguagaacuagcuaauugaaauaacguaugccuguucacguuacacuuggcuaggucaccuggaacuccaguuucucauaauugaguucuagcuuucauuugugucaaguuacugcauauucacuggagaaaaaaaaucuaaauaucaugaauauaaagaaaguaacacuccuaccgucuugucacuauugaggaaaacuguuauuaacauguuaguguguauuuuuaugcauuuuaaucuuuuugaaauguuggaaguuguagaacagcauugcagagaauuuggcauauuaaaaauguaugaacagggaggggcagcuagagagcaaguacuugaaugagguucauaacucccaagucaggcaacuaacucacaagaucucagaaaccuguaacuccaacuacaggugagcagucacucuauucuguccccuaugggacccacauagugaggaauacagacagacggacauacacaguuguuuuugaaaaaauaacaacuuaaaagcugugaagauggcucaaguguuuucugcuaagccucccgaauuuugaguucagucucuuaaagucauauggcagaagagacagcugacucaugcaaauugucccuuggccuucacacacaugcauggcauaugcauguacacacauacacacacacauaaauguuuaaaaugcaugaaagggagcacuaaaauuaccuccaaccaguccaacauauuauauuuauuguuaauaacuugccacgucaucauucagucuuaauuuucuuguggaacuccaagaaaacaucauguuuuauuauguuaucaugaagcauacauaguuugaugcuuuccuaauuuacuuucauaguuuaucaaaaguaccuucccaugucauuauucauaccuacaaucauuauuucaaauggccauauagcaguuaacguuugcggauguuucacaauuuauuguggaagcuauugaguucauuuaguauuucuccuagcaguguaucaguggacucaugucaccacacauucauugcccuuuuguuuuaucuguugcuaucuuugccaauuugcuagaagaaugaugccacuucauugcuugaacuuucauuucuuugcuaaugggguugaaccuuaaaaaaagaaaauaaaacacuugucuuuugacguguggcuuucaacaccuacugaaugcacagcuucuagucaaaagcacauacacauauuuaggacucauggcuccaguugugacagaacaaagauugccuugcuaauacguuuuaauauagcacugggcucagugccacagccacuaaauaaaucauaaguuuccugacaacugggcccauaucuuaaucauuucugcauaccccauggcccuuugccuaaugcuugacguguugaaagcuuuaauauauguuuguuaaauggauaaggagguagagcuuuugugagggucaaugguaaguuacuaaaauagauuuccaagucuuaucaugugaaaaaauaaucccuagaguuaaaacuuaaaaccauugcuugaaacuugacuuuuuaugucauuuuauaaggaguaaugagaaaacagauccuuccauaccaggaaguuucauuuggccaaagaacuccguguguaaccaguuuuaccaaaucuacaaacagcacuuucacaauagcucaagcaaaaguauuaacuacuguaaauggccaaguacuuaaaagggaggugaaugguuuacaaagaaaaacaggacaaagucaagaaguagggaauuuucuuuucccauucuuacuuuggaaauagagaauugcgacuguaacccuagcacagauuauuguucauuuggucugauagggaaacucuaguaguuuauggugaacuggcucagccaagacaauacaaaucauagaagaauagaguuaggacugagaugaguaucuuuuuuuuucccuucgggauaucucuugacugccacacccuacccuucacagcaauguagcaaagcaguuuaaguuucuucacucuucuugcuggcuuuuuauuuuacauauaucucucuugaauuuuauuuaaaauuuauuuuuauauuuguuuauuugucaguggaugugcaugugugaguguguggaggggaguugugggugugugugcacacuugagcacugcuggguauucaugcaucuuuguguguuucuguguacuugcuacuugugugagggugucugaggacuuuagaagagagcaucagacucacuggagauggaguagaaggcagucacaggcugaugaggauacucggaaccaaacucaugucuucuggaagagcggacaaugcugucagcugcugauccagcucucuagcccucucuucuuuacuucucauucucugguacauuuccugcuucuuaugccuguguuccucaauacacugaauucuuugaguucaaagucuuggucuucaucucuauagcuugugcuugcuguauuuccuggcuuaauaugaauucuucagagagaucauauugauuaccaaacuugugcugcuguuuuuaucacucaaaacacuaaguaucuuaauuucuagucauaugaguuugucaagauauucaguugucccuugugaucucagccaucagguuuucuccuaauugaggcugcaucuggagugaggagcaauaacuauuguggagaaacuagagcaggcugagcaaguagaggcugagggauacagaauauuagggagcaccgcgaggcuggagagugaauguguuaggugcuuugaaggguaguaaccacuaucauuaauuugugcaucugccugugucauuuuacaagaacauauauguuacagaaauuccauguguaguuuccauucauuguacagaaagaacugagaaauguuaggugcuguauccaggcucuuguaguaaagaacagaaaucuaaagugaaaucugucccacacccaaaucugauuuaacccuaugucuacuucuccacauagcuucucuguacacaguaguaugucaccauuauugaaaggaauaaaaaagaggaaagccuuuuguuucuguaugcuauuuucucuuaaauguuuuuuaaauuuuuguuuuguuuauuugguugguuuuauuguucuuuuccuuaaaugcccugagcaucaguggcccauuggauuagugcauuucugcauugcagccuguaaaaaaccccauaagcuaaugaagaccuuugggauggcaaggggaggaaugaaagaacaccagacaccaugcuuuaucacaacaguguuagaacgccaccaucccagccacugcugccuucagcccauugccuauacauucucucucuuuuuuuuuuggcagcucauuagaagcgauuuggugcuuuucaggauuugaaaacuuaaggaugcacuuaguucccccaagaaugaagaaaucuagcuuaaaucuucaaaaaucccauuuuuagcuaaugcauucucaaaauuaagguuaauauccauagcaauugauugcaccuagcugacaaaagaauguuccagacccauugaagguuccauaauuauuucuguccuccuuucucgaggcagucuggcaccagcuuuaagggaacacaggaagaugggucugucucaaccuuucuacccuuugaaggccuuauuaaguuacaaacuccaucugcucccaagagagcuccaauugaaugaaauauucggucauuuaguagaauaucaugacucgguuuugucuuaaugcauuguaucaucauccuauaagauucaaaagcuuucuuagcaaaauuugagaaauguaauuagguugaguauauuguagguuauaagaccuaaaagggcuaugaauaagccauuugguucauccccuacuuaggacccucaacacccaaaucuuacaugagcaauggcuuuuggauuccacuuaaaaauaauuuuaagaauagauacuuugugggguuuuuuuuucuugucaguagucuguaccaguguuuaaauaugucucuuucauggucaugaaguucuuaauguuugaauuccuuccuagcuaugcuuuuaagcccaauugauaugagcaauuuagaagucuuagggagaugcaugacauugaaaugugcugaaaaguacuccgacuuggauuacaguagaaacaaugaggaaucaugccagccuguaaggauguaagcagaauagaaaaauggauagcugauuucaucauggauuugcaugcaaauaagaaugaagcaguguacagggagagagaaugaacagcuaagaacguaagucauuggaaaugacucaauaggggagaaagauuguaggguaauaaugugaaauuauuagaagcaguaggagccaaguuuaaagagguuagaaagaacaggcugaaaacugagaggacacgauuguaggcuacucauaggauucugccauggccaguguacuaggauauaggcaagaaaagcagaugcagggagauacugacugguuugccaggaugguguaaugguggucuacuaacuugagagcuaaguaauauaugaacuuuaaagcucaauucaaggaaaacugugaugacacccuuauugaacugguauuccuuucuaaagccuuaggcaagaacacacauuugagaagaguuucuuuuaaaugaagaucuacauaggcaaaggucuucccagagaauggcugaauacaaaugagaaguagacucuuugaggagucauuuuggaauccuuagaaaaaugaaggcacauguucaaucuugaauaguauuuuuguuucauccccaauugcacauucuggcuaaagaaagaaaacauaagggguggguaaagacgaucuguguccauggugggaguccaugguaaggaguugucucuaaugaggagugguaaaccuagcaaaugggcacgucuuguguagacuugaaauugcacugugauaaucaucuacuagaacucacaagauucugagcccaccgcuguagucgacuuuuguacuaauuucagaagguuuggcucaggcugacagcuguuguaagaaggauuaccaagcaaauauugcugcccuguucugcagagugauauuaacuauugaucccuacccccccuggaucaucugacagcagugaucucuucccauacuucucaggcuuuggacagguucugauaauugugugaaguuuuggaccuuugcucuucaaaucauuuuacaaguuacuguggagaaacuaaugagaauccugugaauuugcuggguuugaacuguaaaguuugaacuuuucuuuuucaucuuaagguguaagaaaguucugcuacguuuauuuaaaaaaaaaaacaguaaugaugaacauaucucgugaacagaauuuuaguauuggguuuugaaguuauuaguucagggcuugaagagaagguuauuauuucacccccuauacuauuuugcacagacuagaaagauggcucaacugcuaagagcacuggcaguucuuccagaggaacuaaguuagauucacagcauacacauggaagcucacgacugucuauaacuccaucuccaguagcaucuuucugccuucugugugaaccagggucauacaugaaaaaaaaaaucaauguacauaaaauaagguggaaaaacaaaaauauuaaaaauaguuugcacaauaaucuagacuugaaauuaaaaaauagguagcuacugaaguagauuuugaguggcaucuuuuaacaguaaaugacugacguucaccucauuuaaauguaguacucuguuuccucagucauagagauuccaaaugagcccaccaugccuucugcccucaagggacuucugucuggaugguggaaggcucagcccaauaguaaugcauggccaaacaugucaaauggagugagggaagcaagcuuaguccucugcaguuaggaguaugaguggugagagagagaccaggugaagggaguauuggaacaggggaucaggugacauuuaagugggccuugucuccagcacggaucaggcaggcaaggcacaggaaaugagauuuuucuuuuccuuuuuuuuuuccagauggaaaagauuugaacgugguugaaagggagcuuacauuuaaaaaaaaaaaaagacugaugaaauaaaaacauuuaccucuuucaguugaauacugauauaaugaugaauuauaaaaauuauuguuuuauuuugacagaucaggaugaauguauuucuauggucucucugacauuuacauuugcauuuuagaguucucaugauaauggaucaaaaaguuaucuuagacuucuggagucauggaguguauuguacugccuaguuuauuaugguacgacaaggauguguuggauuuuaaagcaucguuaguuaucuguaguaauccacccaaauauuuugcaagaaguuuuuagaaaaagauuuuauuuuuacucuacuuuuuauaaauaacauuucauguuguucuguuuuggcagagauggaggugagauaaguguaaaauauauuggaaggucugugaaauuuccuccauuuuucucuugccuuaaaaaguuccauuuaugugacuuucacucuguuuuauuccauacauucucucccugucucuugcucucuugcaucuauuuaguguaucagcuacuucacaacaguaacgcauaacuugcuggccuauaguucuaucauuacaugacccuuuggggaacuauauacuacaaaggaacguaaucuuuggaacuucacacuuucaacgacguucauggaauaaagacuaauauuggcaauguuccauuucuugccuguuuucaacugcuuccagcuuucuguggagaggugacucuacacugauaaaucgacagauuaucagcaugcauaccuuaauacuggcuuucuucaagaugaccacuucaguuagauugcaugaagauuguguaucuccuauuucauauccuaguccgucacuuuuuucuaucugugugcuacauggguggaaauagauucuuuuaggaaguagagauguaauagaguuuuaauuuuuauuuuauuuuacuuuuuuccccccguauauguguuuugccugccuguaugaaugugcaccaugugugugucugggacccaaggaggccaggaacgggugucggauccccuggaacugaaguuacagauaguugugaacugcccuauaggugcugggaauugaacucagguccucuggaagagcagcuaguauucuuaaccacucugcuaucucuccagcuuccagauggacuucuaaaaagauaguaaagucuugcuguguuucuugcuugcccaucacaaagcuggcucuagacucuucucucaugccugggucauaucuccccccgcccccaugcaagcacagagucagugauggugccacuagacuuugaucaauauucgaauaggaacuaauucuggauucuuggcugccaugaauguuuucguagaauucuuggcaucaucuuuucccaccuuugcuuuugauuaaaacggauugaacuccugugugaaauaucaaaguguuuuccuuugcucuuuccuccaccgcuuuugcuucguugaaguggcagcauugcuuuuuuuuuuuccauuuccagaaaaagcaggcagagucaugacucugcaaguagccguugcuucugucuuuucagaauacuaugucuuaauagaaaugcccguucucaugggcaacuucuuuuauacagucauagcagcaugcaccaaaaaaaagaagcuuccaguauuagucuugauucuguuuccccuucaacaagucagauucugcauugugcuuuuucucuguggaugggcaaaacccagaaaauuagcucuuucuuguuugguacaugauuguuucuuauuuuugaacaugacuugugaaaguuuguccugucuguagcucucuaccuauccaugcucggcaguaugguaaaacguuuuuuuuuuccagauuugagagcccugaacuggagagaugcuuugggaaauaaacaauggaaaagcccuccccccaaaucauuccaauuuaaugcacuucuuuccauuuauaaaacuaccaaagaggugucuugguuuccuuauucaucugugaauguacacuguugcaccugaaauuaacaguagauauaguuggccucuaugugguaucauauggcaguauaugauuuuaucuuaaaccauuuuagauuuccaugccauauuucugucauuucuauauuuuaucauauaacacacacacacaguauaaacauagacacauaucauuuuauucuuuaauuccacuuagaucaaauauguuggccugccuuuucuauguggcugaaagaggucacauacuagaggucucaaaauaaauggcauucaacaagucaaucuuagaaacaguaucuauucauucuccaaaggaacaaagauucugagggaacuuuaugggggaaacaguuguagcaacaaaguuuuguuugauaaaaugaguucaaagcuagugauagugaaugcuugauaugcaacucauaggcacaauaucccuguguaucuauuacugcugguuaaacuauaaaaacaaaguagucugcugguaguuagaaggagacuuaaaaaaaaaggcagaggagcucuuuuuuuguuuuuacagauuucagaaagaaggcugccuugcaccacugggugaauucugucuuuuuaugguggauauugcucugcuucucaucuugacugggucagaaguucaguauaauaaauuuaugaugacugugaaaccaaaccaucccuuuggagacaaauguggagaguaguggagaaaacaaauauguacuuuccuucgcccugucauguauaaaggaggugaauauuagaguauucaucauugacuucacuggaaaaugaaucucucgaagaaaaguuacgguuugaaggcccagcauaucacuggggugaaaagggggauuauuuccauauguguugguguuagcugguauuugaaguucuuuaaaaagaaagcaguuggaccucauuaauucgaaauucuguuaauuuguaaacaacaucgccugugggagcuuuuaaaccacuuaagagaauaaacuuuggaaacacuuaagaccuagcuccugguguacuaauuucaaauagcaauuugcaugugaaacaaaaauucuugcugggccacauuuuguucaguuaauucuuacuauggcaugcacaguaauuccucugggaauccaaaaucccuccaucaaaacuauagcccacgcagacuugcacauacauaguuuucccaccaugccaagaauuuuggauccugauuauacaaaucucuaccccuucacauuucaaaggaggaaguauuauggaguaaccucaagucaaaugguuucuuggaggguuaaagggaaaaguacuucuugauguuuucuuuguacaguggaaaagugaauuuacaaggaucucauuaaaacaaugagggaggaaagaccuagaaaguuuguagucagcagauaaugagaaaaggaagauaauuguacagcauucuuuagagcguauuuaccagcuacacuaaauaugauuuuuuuugcuuaaugcaccauuuuaauuuuauuuuaauuaacauuaacaacuauauaugaguucuucuaggguuacuuuugucuggucucuugaacuccaggaagaaggacacuuuucaguugaaaagaaauuccugaggaagcacaagguccuaagcuuuucugguuggcugcuucaagccauagccugccaucuucuuucccuuccugauugucugagaagcuaucuuucuccuugcaggucuauuauuuuugaacaaggcuguagguaucuuaaaugcuucucguauuugacaaaagcaagagaauuucaucugaauccccacuuucugcccagugcccagugucuagcacacuguuaccucaugaccaguuaucacuauacugaaucguuaggaaucaaggaguuggcaccuauacauuccucauuuugcucauuugauuucuuuccucccgguuuucagcuccuucuagaccuggguucuguucaucggauagauuauuaagucuuagcuuauauuucuuagcuuaucucuuccaaauuaguauauauaagcaaaaucauuucuccaaaccuggaaggcagcauccugcccaagcccaggaaggaugcgacaggaauauaaaaagggacuuuguaucucugcuccuucuacuguuaccuacagacuccugcuucgugaagugaaccccucaggccuugguucuacauuacucaauuuaaaacguccuuccagcaacagggccacagacugacuuucucuuaucuacagauuuuugaacuagacaugguauaggaguauggucuaaaaaugggaccacguauuugaaaucagggcuguucccuauaugcgguugcucuuguaacucaaccauccauaucuuuuugucacuuuccauaaacaauagagugagcgaagcugaggagagccaggggcuuugugaaauguguuugcuucucuuugaaucguaagaauaaauuacauuuucucuuucuuucuuccucuucauuuuuuucaauuuguuuuguuuugagcaaaauauauuugucagacuuaaguuucacaaagaguuaugucuagccacacaugugucuagaugucauuuacaaagauuuccccagauuuguaugacuagugaccucuuccugguguuuucauggggaauaaauacaaccaaccucaccagggaagauccaaucauggguucuuuuuccagauuuauugaauuaucauugaaauuaaaaguauacauguuccacauauacaguguggcaaguuauuuuauacauauucugugggauguuaaccacaaugaagcuaagaagcugguaccucacagacugaccacauuuucucaccuaaggaaaggagcucuuaagaucuacuuuccuaccacauuuuuauucuaugccauagcauuacuaauuuuagucaucuugauguauauuaauccuagcuccuucccaccagcauuccccaggccucagagcuucccuucuacccauccccagccauauuuuuaaggcucaacuagaagacucaaugaucacauuuagggugacuuuccucaaaggucuauuuugucagccauauuuuaacuuuuccagaagaauauggauuuuuuuuuccuuuagcuuugucuucuaggagaugugguaucucaagcuucaccagguaaaaggucacaugacucaaggaaaugcaauauggagauauuacauaauauaaagaauacaaugggaaguguagucuuuuuguaggagaaauguuuucacacugugaaggauacaguggaaaguguagucuuguaggagaaaucuuuucacacugugaaaugaagaggugcuaccaaagacuuccaguuguuauuguuuuuuuuuuuaauaucuaauuuaugugauagaaucacuugucuauugcugccugguaaauuaccuccacacauacaacagcaauaauaguguguuaccuuaugguuucuuuggacuuuggaaaugccuagguugugugauucuggugugagauuguaauuagauacagaucggggcugguagaugugcuuccauuuggcucacucacauggccaauaaguugguggugacuauaugugggaaucucuuuucugucuguguguccuucucuguauuucagcuagaauauucuugcacaaccacaguuggcuuuucaaaaaccaaacaauccaaagcaaaaugaaauugccuuuuuugacuuaagcugagaaaucacacauaaucacucuguugucuuuuaucgguuuuacuggccaagccugauucauuguagaaucacuguggaagggaccacccagggaugugaauaccaggagguaugcaucauuggaggccaucuuuggaaacuggcuacuacauuauauguaaaugaggaaaacucuuuccaaguacgaaauguaggaacaauaacaguaaacgcuacuuuuaugucuuauugauuuccauguagagaugucuuaugcauauuuggaucuggucucugcuucucucauugccucuauuuugaccaucacuuccauugaucucuucaguaugucuuuuucucagggacuuaucuuuggguucacuccauucuuauuauguacacucuuuaccugggagagcuccucagccuuagcacuaagacuucaagugugcaucacugcuuaaacuucuuucauuauaggcuccuaucuucaaagccauugccaaaaaauagauauaaaaugcucugucuuaagauagauauaaugaguaguauaauaaguugucaugcuguaucuuaagauagauauaauauguaguugucagauacuguuuuuaggauauaacugauauaaacauaacugauauaaacauaacugaucccuccuuuuaggcaugagugcuaugccuccucacuugccuguguucccacugagaauaggaacagcuucuaaucuuuuuaauuucucugaguagccugaugucuaacacagguuugauguucggauguugguaugugaaugaaaucuccauuuuuaagcaucauuacuucucagggagguggaaugucaagcuagcaaaaauaaucaaguugaagauaauuuuguuacuuuuuaaaaaaauuacagguagugcaguaggauuagauggagucaaaacaauaaucagcaucuauauaauuugcauugauaaaauacuuauggguuaugugggacacuuauaaacagagaggaaugucugaaaauugccaaauauuuauugaggucucaugauccaaugcugcauaaggaggcucauagucuugggugucauaaagauggaaacaaagauaugucuuuucaagauuuuuguuugguaccuuacaaauguagccuuuuggaaacaacucuuccugccacccuagcagagcccuagcuuuuugcuuugacccacacugugcuuguaguaaccugguucugagaggcuuacaccaaacguuccaucguugaaggacaggaaaagagagaaagcugcugcugcugguaguaagguuggaggugguggcagugccuguggugaugguaguuagcaucuacuaaguuuucugugugcaagaucauacugagugaucugaaugcauuauguuuguuacccuucacagugacuccauaggacaggugagacuaaauuuaaugccaaauuuaggagaaaagaggguucuaugauuacacagugaguaacaguuggauguaggcugagacugacaucugaauugugacaguuuuguaagcccaucccuaccucucacuccucuucuugcuuaccuuaauggcuacuacaaaugauacugcuuggaaccauuaguucagaaggaaugcuaacacucaugcaaguugccuacaaaugcauguaugcuagauauaggagucuauaauuucugcuauuccuuuggcuuuuuuuuucuucuaauuugaaacucucaacagcuccgugaagugucuacaaaagccauuaucaccaaugauaaggaaacgggacucaaacagcuaagaggcucucugaacaucaucuagcaaguuugugacaggacugggauuagaauuuaggucucuuaauacccaauucauuguuucucuucucuuuuagugcagagaguuaugagugcugagccacauuucuaaucaucauuagcuacuagaaacacauggcuguugggagagaucgcaaauuguaucagcuuuuauacugggagaacaaagggcagggaugguucugggcuugagaauuacccccacgugcuacugauuccuuugccuucaucucaacagcacuuugagucuuuuaaauagauuuucaaauuuagcuuuguuaagguauauuugggaagugaugucuguuuaagguauagagcauguugauuuuauacacguauauauuaugaaaugauauucagaaucaaguugagaaugggagaaauagucuuucccagggaauaggacaccaaauuucaguagcaaauggucaucucugaaaauauacauacaaguaacauugugcagacugagcaggauauauuuauguauuuaagaguauauauacacaagcauauacacacauauauguaagaacauuaaugaaaaaaagaggcuaugauuuuuaaagagaccaagaaaggguauaugaauggauuuggagggaauaagguuaagggaaaaugguguuagauuugaauuugaaaaucuauuuaaaagacucauuauaaucucacaaauagaaauuaagcaagaaaauaaaucuuauuugaacuuccgagaauguucuugggccucuugcaaacaauacaauuguuuccacaagggggcaccaaaaaugcuuugggggucaguuagaaagggcgaacaguagauuauuggguucuaaaagucugauuucauuuuuuggucuguuuguauagaauggcccucccagcacagucucaagaaucgagaagcagaugguguugauucugaugguaguggcuuuguacauguauacgggcaaggaaugggucuaaagaaacuugacucugggagauaaaaagcccuucccagcaaucacacacuaguguauucucauuaccuguuucuuuuuuucuguuacaucuuuguccagcaaagaugcucuuucauuacuguguguuccuuaacaccaggucaacaaguuugccacaugagcccgcugaagauguuucuagcaucuccuacucagggcguuaaagaaaaaauaaagaaagaauacagauuucuacuacacuauuugcauuauuugcaaaucaugguagauguugguggaauguucccucaggaauaguuccaguagcaccguuuucccuuuaaugaaaccuguauuucaguucggccaggaggaagaagagugguguggccuucacagauaaagugguuuucagaauccauguuguauauaaugaggucgagagauacaagcacccucuguaugugaaaauuaauuaagcuauuauuuuaauugacaccccgcugaucuuuucuuuaucagaaauauuuaagaaauguguacgugauaauaacuuucaaacauaauauuuccaaaugucaaguuaauguguucagggagcaagaagauucaagcacucaguuugagacucacaucacaucuguuuccacaaagugcuucugggagccuuugaagcggagccagugggggaccuuaaguuauuugcaagacauugaggugaagauggggaauaucccuuccccucuuuucagcucuaaaacuagaaauggagauuucuuagaauaagcuguugcuuccucacaaaauaaauuaggagucauuauuaguugcagaaauaacaauauguauaagugaaaagcagaauuacuuuuuaggauuuaggguagagguuauuaaaaugacauaguucugaauaauguugccuccccuagcuaagauguaauuacugaauuuuuuaaaaaccgaaaagccauaaucuaguaguucuaaaaauccacucagccuucuguaggcauucgagaaucacuguuuguuuuuugaaguggaaguaacaucuuuugcaguuaguuuuuggaacguggccauugcugaauaaaggcuuccaauggugcaccauaucucuucuguauaauugcacuaaaagaauacauuggcauagcaugugcuucauaaugagcugggggcaaauguaaaaacgccagaaaccuucaacugugaauuugguauucuggauauuguuuugcucuaacagcaauaccaugaaaauugaaugaaaaggguuuuuuuuuuaaauaaguuguugcuauuuacucugauaguuaaaucaaaggucucccagguacagaccugagaagugacuuagacguuuggauuuauucaaggaguucuuuacaaaguaguucggcuuauguuuaaaccugcguuugaagacaauagagguucugucuaaaccugcccucaacaacguguuggcuuaagucuaaauauguucuuugaucacugucaccccaagucauucaaggaugagaguaugugaccuggaggcccuacuugcuacuaccacauugaauaauaguugucaaacacaugcaguuguuauauaacgauuauuauugcacuagcaaucuuuuaaccuuugugccaagggcucuuuccuuucugauuccuuccauguuguuuuguaauaaagucaggaagugcagauugucaagaaaugugaagggucugggauuuuuuuuaccuugcuuguaagccagaaacuuagcuugagaccguuccuugaaugcuggaaagaggcacaaaacucuuggaaaagagaugaaggaacauuuauggggauagcagcaguagcaaaaacaucagcaauuuuguccuaguucucugaacucacuaaccaucaaaaugguccaaauaauaugaaaagggucagacuacauuauuacaaccaggaguaacauuuuaggggcauuccccaggucagaaguagugaaaucauuuaucaccagcaguaaguauaucagccucaaccuuagggaccugacaguauacugagucagagugaucuuuaucuuccaaggccaugagcacauuuguccuuuaugcucagugaggcccuaugccucucacgcaaggcucuuagugauacacaagacacauguucuugaaaaaaccuacccuggaacuacggcauucagugcuuuuuguuuauaagauaaugcuaaaauguaaguuaaauggagaaugguuugccaacacagacuagggccagggugguaucugaagaacugguggucugagccauccuucggacugaguaacaggacagaagacgguagcuguuaccaucuuugcuagcacucuuuccugcaagaguuugguccugaggcuacuucaucucuccaaaagcaaaugucuaagcuccauacugacuccccgcuuaggggaaugagggauuuaucaucauguuccaugaccugagguuggggaucccagguguccaaaagauaucaugugaacauuuccccuuaacaaagcaaaccaaacuaaacaaaaaccucucauuugacuuaagauuuauguaguuccaaaucagaggcuuaaaucauugaagggaaagaccauucuuuuggaaggagagauauggaauuuggaguuucaggccaacuccuagucccugugcaaaaauccaucuucugacauggccuuuaguaagauucuggacuaaaggggcagcaggcuagccaaaagaccucugucucuaugccauauuuuccucauauagaaacaaacgguauuuuaaaguugugcaaucugaaauuaacaaaaaugauuaaaguugaacuauuaugucugucaggaaaguccauuucuuuaaaaaaugguuuuauucagaaagcacuuucacuuucuuaucucuugucugauuuaggaauccaaucuggcagaguuguuauugccagauuacauuucauguauuuauuuuuuuaaauuacaaauaaucuuguggcuauggaauugagccaggaccucagagcugucugaggugcuagcuagaagaccauuguuauucuucucacagagguagcaggagcaggagaaacuugggccagaugacacccuacaugugcucauugguugacugugagaauuugcagcagucacgugucuucuccaucugaugauauuuaguauucugcuagcccucacaugccucuuuuaucucuaaauuccauaauauguaaguauuugaaauuuuugaaagggugacucauuuuguuuucuucauaacagaaguagcauauuuauuugggagaaaauaaaggaauauacauuuuuuuuaaaggagugauuuuuuuuuuuaguacuuuuguguguauuucauuucauacaugcaugaaauaaauuuuggaucuuuuuuugauaagacuccuuuuaguuaauaauguagaaugaucagguggugguggccgugcacaccuuuaaugcuaacacuugggaagcagagagagggagaccccugaguucgugaucagucugaucgauagagcaaguuccaggacagccuaggauaaacagaaauuacuucuuuuaaaagagguagaauguauaucuucccuuaucauuuggaguuuauccugaaucuaaucuucaggucccauacccucauccuugacugacgugggggugacagugaucaaagaacagauuuagacuuacaguauacaaaacgaacaguccauugcugggucugguauuucacacuuucaauaucagugauuuugaaggcugagguagagagauugcaaauuuaaggcaaacuuggaccugauaccaaaauaaaauuagauagagcagauccuauuucaaaauaaagcuaagugggaugaaggcuauggccugugguacagcagugauugcaugaggccuuggauucagcucuuauuaucuaucucccacuagaaguuuaugagacuucauuaaguaugaauuaaugauaauucuaguacagcuucuauauuaauagcacguauaucuguaccuuuaucugccaugaaaacaaauugggauggcauauggaaaauaauuaaucacguggagagucuuuaauggcuuucuaaucaaaaugaucaacuauacuugucaaaucucagagcacccccucagauacugacagucuaugaggcaauuuuuguacagguauguaauuucaacaaagcugcuuauauugcgaaacuuauuuaagauuauuucauuccaaaucaauucaaaagaaugcuuaauucaacaguguaaaauauagggccuuuaaaauguaagaaccaaggaguccaacaaaagggaguagacaggggagccaccauuuagugucuagacaaguccauccaagucuguuuccuagcagcaaaagucaacaagaaauuacauuggccuacauagcuuuuauuguugcugaagaaaauaauguaugcuuuucccccacacaaauuuuauccugaaauuuauuauauguuccuugcaugagggauaauagguuauagcagacaucuucaacuacaguuuuguaaaggaacaucagaccuacugaaauagauaauucuugucuugaccuuauacauuaagggcuggagugugauauuaaacuauaauucagguucgacauuuucuuagaggcuguuauuaugucgucucacuuauguuucugaugauuugauccagacuagugcuugaaaaucuaguggcugauaaucuaacuacauuuuccacuugauuauuuccugaauguaagaugccugaaagguaaucaccaaaggguuaagguuugcaugggaaccauauuguguaaaccuugguuuaguaacucuaagaccuugaguauggacuauguugcugcugcuuggcacaguacuagaaauggagcccaaggaguugagcaucuaaggcaaguucuccauuaccaagcuacaaacccagcccuccccauuuuuugaguaugcauucgauaaacgugggcugaguaagcaauugucucacucuuugcaacuuuugagcgacuguuucuacuaggacacaccaucuaugaaucuauuuuccuugauuugcguguuuguguggaugugaauguguuauggcauuuguagagagaggucagacgacaacuugcagaagucgaaauuuuucuuccaccauauaggguccaagguggagcucagcuuguuugacagcagacaccuuuaccugcugauauaucucacgagccccaaaucuauguuuauuuuuuuaauguaccauacaauuuuuuuaucugccuccccuuauacaauuugcauuuaccaugucucuggaaagcagcuguuauaggaacacaaacugcaugccaagaauuaacuccuacaaguuguguguguugaguguauuauauauuauauaauauaugcaaaauauauaauuacauaauauaauugcauaucauauaauauuuaauauauuuuuguauauagauacauaaauauuaacuccuacuaguuuucuacuagcaaacugccauuaauaaggacugguuaaacuauaaacagcaauaagagaaagaauaauaaagaaagaauaauaauuuuuaguuuaauugcaugaguaaauaucuaugauaaauuauaauugggagcaaaacauaugugcauguuuauguagguauauuaugauugccugauacauguuuaucuauccuauuauuaaucugucuaugcaugcauguauuauguacauaaguauuauagauauagauauaucuccauccauuuaaugugucuagcugcuuaucaagaugcaaagaccuagauagacacaugaaauaagcauacagcuuuggugggagcaauauuagcuagucuucuguuauuuuguauuuagauauuuuucuacacaaaacauggauuguccauguuuacacaugaaacauaaaauauaaaauccauugucauagaauacaauguccuucaguacucggucaaucaugcuccuuuggcuucuguuuagguagcucccuaucccuuccuauacacauugcaaacuccagccacacaaggccacuggaauuucccuauugucagccccucauggcagagugguagccauauauacaucuuuuuuacuuagugcagugucugacacuuggcaaguucucaauacguguuuguugaaggaaucaccagugaauaauacuguccucuugccccuuuccgagucacuaauguauuucuacacucuugcuuucaaaucauugcuaaaaucauguguuugaaacaggaagugguaguuuguuuucaaaugauggaccuuccagcauagagcuggcugugguauguuaacaugggauggugcuaaucauugagcgugcccagguuuguuuaaugcaacauuuauauauguucuuaccauuauacaucuuuuaaccucuaaucacuaucguucaccaccuacuucaugaaagcaccccuucauuuuaggacuacuuugaacacaucaaaagacauaauccaaauauauccuaaauacagaaacauccacaagauccauuucccuucaaagaaaauauaucuggcucuuuuuuuucucuccaaaaaugaauuuagaccuugaagagcucacuagauuuagacaguaccaccuaauuauuuuuuauggucaauuuuacuucaaaaacaauaauuaagcaugguucucuguaacaucuagucuuuuuguucccccaaggagauauuuugucuuacuccuucuuuuucauuacucagcacauuggugugcgugaauuaucauuaucuauucuggauuuaagcaaaagugacgugguaggaaccaaucuagugauagugcgcaaguuuacuuaaugugacacugucaaucagugacugauauuccauuuuguccccauuuauagcuuugguuucuuuguuuagacagacuauauuucuacucauuuuaugauuacuugcucuuguuuguuggagaauuguaguaguuacaguaaaaagagcuauaucuucuuucuccaucacagggucccucugagugucaggaauuguugaauccauuuguucauaagaguucagaucucuccuuuuacuuguuuauacauccaagucauuuggaaucauauccuaaauauugugucauuuauagucauuuuuauguauaaucucuaauaauuaggauguauaaauguuaggcaccugcaugcccuuuccaaagguagacaugcacagagucuuacuuaguaugcaauuacugccucacugagucaauagaagugaauuuaaagaugaccccuaaaucaugccaaaacaagcucagucucugagagcuccaguugguccuggagguccaccugagcaagcuguuccaaauaacagauugugaacgggggcgacaauuguagcauuacuaaaauauuugaugugaaggcuagagcgaugaaaaaggcguuuccugcuccccauuaucuguucccagcacccauguggugguuccaaaacauuucaacucuguuuccaggggauccagugcccucuuugccuuccucaugcaucaggcacaggcauauucuguauauguacaugcaagaaaacacucuugaacagaaaauaaacauaaauuuuguuuauucaaaacaaggucuuccuuaaagaaaaaacaacuuuuggauuuuuuuuuauugugaguaccuuccugauaaacacaaaacucuagugucaaugauaaaauguuuucuugaaauauuucaacacaaaugaaaagcauucauugguuaucuguuugcuauuugucacaauuuuucagcuucauacuggagaagguagguaguguauuuuuauuguguauaugagcaacuuaagguucagagacaucgcuguguaguaaguaguugaaccagguuuucugaauauuagacucaaaacauaucuauccuauauguaauugaagacaaaugggaauaaauguuuaaagagacagagauaagacaguuauccauuccacuauaauuuggacugaaguuucaaggugcuaaucuucccaagugacaauuauaauugacuguguauaaauauugugacacuguugcucuuuacuuaauguccaguuaaggaugugccagaauuacauagaaauuugaaauguuaauaaucggccauaauauuaacuaaaauuauuuguucauuccaguagaguuuaaaagcauguuaaugcacuauacauguugcuagcuggugaccuuuguaauccaauuaugguucauuuauauuugcaaaaucaucugguuagaaguuuucuuuuaacuauuaacuuaaugucauuuuucaauuauuauauguguagaaaaaauuauauucaaaauguugacauauguacgagucuauagacaucauauuacauauauuugaauguuaacauucuuuguuguuuaagcacagcccuucuugugauagucuaaggacuguaucacagaggcuggaaagauggcucagcaguuaagggcacauuuuucagaggaccugcaauccauuccuagaaucuacaugguagcuugcaaguaucuguaacuuuagucuuaugggaucugacacccucuucuagccuccaccaccaccaggagcacaugugcagagacauacauuuaggcaaaaauacccaagcacauaaaaugaaaauaguaauacaaaagaaauguguugaguucuuacuagaagcugcccauuggacuaagucugcagcaugcauuuucucagucacaccuuuggauacagucagcuugagacuaguucuagaguaucuaaucacauuccugagcugucucccacucaccagcuccuugcuuccauaucuuuuucacuccacgguuugcagacuucccuguaguuucaagagcaugugucaaacauaugccauugucuucuuugcuaaucccugaggagagauaguauauuauuucuaggagaaaaaguauauaugagaguaaaagauucaaccaaagcccccuagugaauauuuuuauggauuugcauuuguuauacaccaaaauacaaccccaguuacuuuuaaauuuuauaauuuuauuuauuuauuuauuuauuuauuuauuuauuugcaucccaaaugcugccuccccucccaguacaccccucacagaauucuucccccuccccuuuacaaccuuccgccuccgggugugucaugucuuuacaggauuaggcaaauucucucccacugaaucaggacaaggcagcccuaugcuacauauguguggggaggccuagaucuaacuccuguaugguguuuaguugguggcucagucucugagagcucccagagguucagguuaguugacacuuuuggucuuccugugggguuccuauccccuucagagccuucauucuuucccccaaacucuuccauaagggucccauaucucccuucagugcuucucugcaucuguuugggucaguugcuagaaagagccucucagaggacaguuauucuagguuccugucugcaagcauaacagaguaucauuaauugugucugugauuuaggcuugcccaugggaugggucucaaguugguccaguuauugguucaucauuccuucagucucugcuccaucucggucccuaaauuucuuuuagauuggacaacuguugaguggaauguuuuauggguggguugauguucuuaucccuccccuggagauccccucgccucuucagguuccacuguuaggcaucucagcuaaggucacccacauugauuccuguuucuuguuuugccuucugcucucuguauauugcuuugucuauguauuguauaugccccucuuuucuuccuuggcauccugauauccuaaccgaggaauccugaugcacucauauggucuuacaaacuuuuccagucuuacaaccauuuagcaauccaaguuuuaaggccccucaaagucugaguggguacuuucagaucccuucuugugacguugaauuauuucuguuacucauaauuaaauugcaccauuugaaguggugauugcaaaauguugcacuaauuuacaagacaagaauccauuagcagcacuacuagaaaaugaaggcaggauugaguguguaaguguuugucugaggcugccuucagcuuucucggaacaauuuccauuuuauccuuggguuuauguuacuuuuucuucaguuaaagauguuuucaugguaacauugauaacaaacauaacuugaauaaguaauguuucuauacuugauuuagguucucuuuuaauuucuuaaaauuauauuagcauaugcuacuuacacaaaauaauguguuucaauauaauccauuuuuuuuuuauuucuaagcauuuccugacuaggcuucuuagcugucaucaguugcucacaucacugauggguuucaacagcucuuuuguggauauguuuauugccacaaccagaauuauaugcuauagucugaauaugcauaauuccugcuaaggauacacagagaguaauaauauugggaaauggucauacuuuuuagaggaggagaugagagaaacauuacagugacauaaaacugagugauaaacucgaggacaaaaaaggucuuucagaaagugcuucaaggcuaagguuagaguaacauguugcuaagaaugcugagaguagguguugaaaugauauggauuguaguuugaaguuggcaaugaguaaacuugcuuaaacucauuuauucucagucuuaaaauuuugagaguagaaauaucacccuaauauuguuaugagaagcaaauaugauguucaauauuggaguaagcauugcuaugccugcaaguuacacauacagaagguaaugucuugauccaaaucaaucacacugcuaguauguggcagagugaaaucuaguacucacauuugcuugacuccaaagaucuuucuguucuguuuuuuuuuucuuuuuucuuuucuuuuuaaauagaacacuugaucaguuacuacuuggaaauacagauguucaggguuggaaggaaugucucugcuaccuauuaugccacugaugagcuauuugaauuccguucacaacuuaucucaacaaaagcucugccaagauuucacuaugcuucucuugaacaccucagcuuaucugucauugaccuaaucuguauugcgauuguacucuaagggaaaauaacaccgcugucguuuaagugccugacauguuuguguuauguugaggaugauaccggugugagagaagagacuaucagguagauaugcaagcagccuaggaaaguuuuuuuaaagagacauccugagucccuaagccaugguuacaggacauaaccauagaaagaccaauagaaagacagacagaugcacacaggaagagaggggaggagagagcaaacagaggcugggauaaagagacaccagaaaagucccguuuugacccaagccucacuuguuuucuuuuuuuucuucugaaauagggaagcuuccuagauuccuaugaagauuggagugauuuucauugucauagggaaauagccauaacuuuacaacuugcccagagugcagguaccuuuccucuauuagauuugucaggauguuuaaguuaauuaauuugugguuuacuuuccuguaauucauacuugauuauuggaacaauagguauacuuuagucucauuuauuuauuuauuuauuuauuuauuuguuuguuuguuuauuuguuuauuuauuuauuuauuuuuauuuuauuuuggugcuuaaggaaagcuggacauuuguuguugggguccuaauuuaaauucacauuguuuuacuuacaacccaguuggugcccucacuuguaguuagacuacugcuguaaacagccagcugauuuuagacugaggcauuggagugggugggucuccauucucagcucauuucaacuccauaucucagggacgauguuaugcagucuuguuggagguuguaauuuuaaaccacuuggaauaauauucuccuuugcuuuaauguuauacaucccugugcauguucuuccguaauugaaagggauaucgggcaaauuugaucugucuggcuuugacuuaugcuguccuuaucauggccuuugugucauuaagaaaaaaauugguauugaucuuggaccauaccacuacauugugcugcaauuuuucuuccuugcuaguggaauauaaaucgauaaaaggcagcugcuuuagacgagggccagauauggugcugucauuuauauauuguaaauccaaugauagcugaucaaaucagugccucuccuguuccaaacuugacaugauugaauugucaauaaaaaagauuuuacaguaagggaaggagagcugacaguguaaaugucugaaaacccaaugaagcucaauagaaaaugaaacaaugugcuaggauaucauuuuauaauuuccaauggggaaaaauauuuagugaaucauggcugggauugggaugaucacaggagaggaagcagcaaugaaaagccaccuaucuugcauuauaauuuuggugaaaucugaaaugcaaauuuacagaugcaaauuuucagaauuaugcauccuacccacugaguuguuuauuuacagacauguuucaaauacucuccaccuccucccucuuccacacgcacacuuccuacugauaauauccagcuucugggugaaaaauaaacauaucucugccuaggcauucugcugacauccaauagaugacucaggaacaaaucugauaguucugacccugcauucuucaagucaaucaggagggcuuuauuuucccuuaauccaucucuaaaaguagccagacguguuuuggaagcugaaaggacugugcuccugggauugucaagaaauucugccaguuuuucaagagaccucauuuguuccuuugcaaauacaagagcgugacacuuauuuguauguugagaagcauuuuaagucccacagggagagaccaggcugggaacugauaagagaaugcuguuuccuuuaaacccccuugcaugaaguucuugccucaguaguuguucuaaaugcauggaaccugauuagcagaaaauuugcuucugaaaaaugccaagagucagagauuuccacuugaaagcuccauugugaaccuguuggaauauguguaggugacaccauccaaugagcagggucccaaggugaaugaauaaaggagggagguaagcugagagagacccaggaucuuucucugguuucugacuauggcugcaauguggccuuccagucuugccacggcugccuugaaaugcuucucuucccaauucuugaguuaacauacucuuucauaaguugcuuucgguggcuuuauuuauuuauuuauuuauuuuuggauuuucgagacaggguuucucuguauagcccuggcuguccuggaacucacuuuguagaccaggcuggccucaaacucagaaaucuaccugccucugccuccugagugcugggauuaaaggcaugugccaccacgcccagcucauugguuauuuuauagcagaggcaagaaaaguagccaaugcauauacauacauauaauaaaauguaguauguauguuaaguagguacgguacuaaugaacugcaacaaauauccaaauauaaggaaagguaugugaauaugauugaucucaaaaauaucuugucuggcuauagaucguaacaaguucagcagauuauuuuuccuccuuucuuauuaaaucgagaacuuucaacuuuucacaucuaagaagcacuugauagcuuuucuuuaguaugcccaaauugucagcaucaccacucucaugcuugaaggccauuuugaaguaaaacaaggguuaguggagcagcagcaacaguugguccugauaacugaugacgccacucagugaguaacuggcagguagcaucuaaaacaaggacaccugacauauccauguucugggugggacagaacuggaugaugcaaacaguugcugcaucgcucagaacacccugaaaaugaaaacuuagguuuuacuuauguaugacuuucauuuaauaaucauuuuuuaucauugucuucuguaggcagcuagaacuaugaagagauacauaguagaaaguuguaaagaaaauacuacauuguuucauuucacccucaucaaaaucucuauaaaaguuaaucaacugaguccccagaggguggaccaaaugaggaauauucgagacucuugccccacauccaguuuugcuaaagugugacaacggagccaucagaggaaaugaaaaggugauaggugugguugugagugccagcauucauagcuacugaguggcugaggcaggaggguugcaaguucagggcuagccugggguuguauaguaaggcccugucccaaaagaacauagugaauaacaugugaccuuagaaauaaugaaaaggaagcguuaugacucuggagaccaagcagacuuuuugugaugccuaguaggaacacaucucucuaaugugcauucuuagauucuuuauugcugacacuguaucaaagauucuguggguagguauuaaagagccagugacucucugaagugugaggcaaacuaucauauacugacacguguucauuuucuagauauuagguucuuacguuuuuuuguaaggaugcauagccaaagcaaauuguacuguauuuccaggcucauagcuuaaacuuuccauuagacauuuuccacugacuucuugauggcaacauuaaauaaacaacaacaaaaacccuuaacuuuccuccuuucuucauaucaucucuguguaaauugcuggaucuuuucaacacccauacagccuuuaauucuucucuugccuguucuaccucuagcaugucacuauugguucuaagaucuccccuuccucuaggccuacaucauucccuuaggaccccuucuccugcuguuugauuuuugagauugcucuugcuugguucuuaaguucuggccaucuuuguuuuauaacacuggcaaaguuaaguuugaaagaucaccuucggcauauucagcugaguauuuaagaacauaguaucuguaggcaauggaauaauucuauaccugaauuauaacuuugaugcccuuuuugguaugugugucaccuaggugaagcuaacagaugucucugaucuguccuuuccccauuugggcucaccgaguucuaccugaaaggcuucuugggaaaguggagugagcuaacacauauaaggagcuuacuuagcacagugccagcacauuguaagcuuucagggcacaguuauuauuuucuucucaagaacagaaaauggcuuccuaauacauaccauacagaacagaaaaucuuucuguucuucccaacacuguugggacacgacuguuuucaguuuuacucugcaccuagcaagagaaaugucuugacuccuuauuucuuagauggcaucucaggccaugcuucagucccuugucugcauuuuuccuuaugugaucgcaucucagaaagucucacucaguuccuucugccuuccuucaagccucagugccuauacuuccuuaguaguuaucguuacaauggcucuuaccauuucuuaguuuuguuuguuuguuuguuuguuuguuuuucucucauugucucuagugcucaguuagugccuuauacaguauucugcauggucuguacuuauacguuuuuauguuucaaaaugugaaguugccuaucuauuguucuuagcauauuauguuguaguuuucuauucaaccaaaggaccauugcaaaauaaacaauauucuuuuucuuccuaagaguuugugguaacuauacaauugcauguucaucgggcugguuucuggaacuguaaaacuuuggaucagaagauaugcuauuaaaaaccuguaacacacuuacuguggagaccuggaaucucuugucgaguggagggacuugggaaaaccaucauccccuucuucucaguaccucguguagcucauucucagaaauauguuguuaaacaggcaagucaggcuugaugaacucucagaucuuuuuccagugcugaccucgaaaacuuugaugaaaguaacacucaacuuugcuaucugccuuugcccuggcuugcuuggguuuugacaguacauaguaucucaaacaaggcuuaugugccguccuuaaucgaaacuauuugucucuccuagugagcagacaaggcugagguuuaggaaaccacaucagcagauuucauuccagggcggggaacuguuucugacaaggaguccugcaaaguaugcacgcuucagagaaaagggaagagugcauaaacaaauccucccuuugcugaaggaggaugagaguuggagaucacauuauagcagagguauccuggaguguccuggguaaccagccaaaaauuugauccgguuucgcuuagcaugagguaacucaaccacaccaacugacauauuucuccagugaccucuacaucugaaaauguccccuaaaauacagcugucugcuccucauccuuugucccucgauauuuagcccaacagcucacacaauacgauugugcagauguuucuuucuccauuccuuuccaugagaguauauuagguuccuuuacauuucugacacuuuaaugacugagucaccuccuggagcucaggagccacuuucauguaccacagaccaucaagcucugagaaacuuuuguacuguguaaacagucucuugauucuguccaaucaccacugccacuaagugccuaguuaggguggacaauuuacugcaacuagcacuggcauucauaacccaaacucacugagaacaucacaugguauucucuaauauuggaggguucuacaucacauuucuuaaauucuacaucagagcuauugaugagauacugacauuuacaggcaagcugguuuuguuaugcuagccagagaaucaaaguuguuuuuuuguuuguuuguuuguuuuuguuguuguuguugguuuuuuuuucuggcuuuaccuauucuuucagaaaccugagugugucauuaauauuuaacgcugcauauaguuuucccaccaguaauaugcuccccagagauuuguccucagaguauaugggacaggguaauuaggucuauugauccuugccauacucaguguuaucguaauggugaucaauuuuaaaaguaagagguggaaauucauuuuagccaaggaacugggacagcucuuguuucucaaacauucuuugcccuagcagaggccuugcuaagcagcuaccagaucagaagguguucaaagcacuuuuuauagacuugauauaagaggucaaaaugaggacacacugcuucaccaagaaugggaaagucuuacacuuuaauagauuugggucaugguacaaguuucacaaaaccaaagccucagucacgggcuagccugccauuuagguagacaagugaauuaucugaaggaacauuccuuacguaaaauuuuuuaacauagauccagucucaggagauuuccuuuacuaauccucagaguagugcggguaauagcucauggcuggggauaucuucaaccagaugucuuugaugaccauauaguaauuugaagagggagauaaauuucuaaaguccuagaggaaugggcacugguuaagauagcuucuacaguugccaaugcauaaugucuuuccucuucgguuucccacagaaggcuuguuaaaaaaaaauuuuuuuuugagaauuucauauaugacgguuuuaagaccaccgacucucacuuauucaaagggaguagauuuaguuauauagcuagugggaacagaguuuagaggcuagaaacuauauugccaagugggcacacagccaaaagcaggaguccagcugcaagaggcauggucuauuggguugggcauggaggucaguugguagagugcuugccuagugugcaugaagcccuggauucugucccgaagagcucauaaaagagcucauugagccacauagcuauaaucccagaacucaaaggaucuaggcagguggaucaaaaauucaaggucauccucagguauauaagcaaguucauggucaaccuuggcuauauaagaccuuguaugcaaaagaaagcaagaugaucugcugaagaaaccuggagcuaaccccagacagcaagaucaguguaaugucaagccagggagcucugaacugaggacucuuuaucuuguuacuuguccugaaaccuuuugcuugugcccauugcccacguuuuucauaaggcuuaugcaaaucaugccuauugauuuccacacacacacaucuguauacauagccugagucaacuacagugagauccaaacucauuugaauuuaaauauuaacagcauauuuuuucccagauggcuuuggagugaacaaagucgguccuucuagcuagaaugguaaaugauuuugagaaaaaaaugaaucugucaucagaguaucuaaacauuuugaucuguuauguucauaucuuucuuuggcuugaaaaaauggaauugcuguuuguagaguucaauaaauuucuguugagauuuuauccaaguaauaugaauguuucuucagauccuggacuaugucauuaauuuaaauaugguuugggaucaucacaauaucuuguuguaaggauuuuauagucuagaagaggaagguugaaaucuuucaccauuauuuuagcaaaaucuccuuuucuuauuuacauuuaaguaauaaacuucuguuaguguuaucuauuauaaagaaaccuguauacuugucuacgaauuuuuuuaaguacuuucaaaaugaaagcagucacuuaagacuggaaaaaugcuuaagacaagguuaaacucacuaccuaaacugugugauuaguccauuggagugguuuguggauuccugaggguagauuuuggccuacaugagcaacuauguuaacuuuuaaacggguaguuuuuuccaaugugaacuucucuuaguagaaguuaggugaucuaugcuguauguaaauuaugugugguaaaacugaggucagucucccauuaagcagaagaggauuauucauuuccagauaugcaagucgcaucauaggauauaaauugcauagaaguguuuccuguauaguugugcugugcuaaacagaaaauaagggaaaguaacugaguauuucaauccacauagaucuugagaggcaccauggaucuuaccuuuguucuguucucaauccuguuccuuuugauugugcugcuuucucccccuuccuucagguauuugcuuccucuuuuccuuuuuuccuccagaaaugaagcucuguaacuuaaaguaugucauccggagacaucuaauuagcuagagcugcauacaaaguacagagcucccauuuuuuuuugaugacucacagagagauugacaauacaacuuauuguccaaaccagggcaauuuugagagagaaggaaaugguaaaaauaaugagcagauuuucugcucuaaaagguauaaacuuggccuuaggaaacuaaucuacauuccugauagccuauccacaaagaugcuaguaugucugguauaaaaggccacuaagaccaucuaaucuaucccuaguagaugaagcuaagaacauaccagcacucccuggugcugaccuaggccuuccaucuuauaggucaguuaucuucugacuacacacuguacuucacaacugagcauuacagaaagacaucaagcacaaagucacuuaauuuuuuuaggucccuccccgccuugaugaauaguuucuggauauagaacuucucaguagugaguuucaccacccucuccaaucacugcuuuacaacuaaucacauuuggugguacugguugaagccagaccacaauaucauucuccuauccucugucuuucacacccacaaauaaauaaucuaaacagauaccguagaaacauucagaucauugaaacucaaacguaauggucuuucuuucuuucuuauuggaagaaagggaaucuugcauugauuuuugagacacacuuuuccugaaaucuguacuugagugauuuaccugauaaccaacaagguaagguuaucuccugagauaaugagcauuggcuuacaccccuggguaauguguaagaaucagugaaacucccaguuguuacuuuuuguuaaguuuugaaaugguucagacuauagccaaaagaaauugggccagagacuaggaaucacuuuggaaaugaaugcaaugcucagugucucccauugcuguuacccugcacagucucauuuaucucugcucaggcaccagauccauaggaaaagaauaggcagcaacaacacaauuuguugugaaacacuucauuacauagcagaaauaacagaaaacauacuggugaguuuaaagauuuggggaaacaaugauuuauagaaaaagaacauuaucaaauccuaauggaaauguggauugugauugauacaaggcccuuaacguuaagaucaauaucuuacuucccuuuuauguauaguucaauaaucauuuauugacuagauagcauugcuggaugccaccauugauucccuaaggugacaggaguucuuccuuucauuugucuaauggcacugagugggggaauguucugcaguaaggaguguuagcacugcgauuugccuuaguaggaacugcaucaugggcucaacugagccuugcaaguuuccccucugucuguagauuuuuaucacuaccucccucuuaccuuucuucccaguugguauuuuccacccagugaauugguuaccuugauauuuuccucucuucuacaaaucaacuacuggauguccaggaaaaccagauauuuaccauccuaguuauagagauugaaaagauugaauaggaacacuggauaauuaacuuauaugggaacuuucuagaaaguuuguuaaugcggggguauauacaauuuugaaacuauggcugugguuuauuccuuuauuccugagucauuuauuucuguagaccucauacuccucuuacacacuuagcauuuuugauauuuuauuacuuguuccuuauuuugauuaauuuccuugccuagcuuuuauauguuugcagguuuuuuuuuuuauuuugucuuuucuuuagucaaaaucuucugucucuuccacauucucuuuaacuugucauauaugaguaaacagaaaaaauaauaauuugaaagguaaggauugacuuuaccuuuuauaugcuacuguaagugaaaccuggguuucugugcaugcugauaacccaucuacaacugaguuauaucacuaaccuuacaacucuaaaaauuaaaaaaaaaaggccuugaacuaguucaauuaaaacaucuuaucaucuguaugcaagacacacauuuauauuuggacuugcugaaaccaacacgcaugggcuucguuauguaugaaauucucucucuugugcugugcauuuuugugggggugggaaguauguuuagguggagacuguaggugguuguauuacaaauuggugggaguuaugguagcuauuugauuguuuucugguucuauaaugcuuaaccaaucauucauaugucuacuauccaauaaguaguagaagugagaguugaaaggagauuugucuggcugcaaggccacauucucucuccacuauacuauacugcuuccaaguacaaaugauuuuuaguuuuuucucuuuccaauauuauagcaaaaaaggaccacauauauuucccuacuggccucaguguucuuauauucaauuucuuuauaucccaaagucuuuugagucauuuuuauauuuauuaaggacuguaaucuuugauuuguauuuggggauuggacaaucuccccacauccauuuucuuuccccaacacguaugaauuucuuugaaaaauaucaaacugucauuugagacuaagaaagaagggcagaguauuuucaauuucuccuugucuugcaggcaugguuuucauuaggcuuuuugcauuucuugucagaaacaaacauuugggcccuggcuuauguuuaaucuuguguuuugcagauauagucucucccuaaugucaggaucuuuucaugaaugcauggugauucaguggccagguccuggcagugccauuauagugccuuagucuucaguacuugauugggauucuuaacacaagcugucucuucauugcuggcguguuaauucacaccaauagacaagcuagaaggccaggcagcaagcuggagaagacagugcacuggaauucuuuaacuugaucuugcuucagaauccccuugagcacuuguuaaaacucaaauucaguaggucugggguagaucccagcaagucacauuucaagcuagcuccuaggugguaacaguggugcuagucuagagaccucacucugagauucaugaccauaggaaaaaugggagauuagcuucacuacuugauucuuucucagacuuaagcacagugucuugguacagagucaauucucaauauaugucacugauucuuauucauucucucuguccuuuuccuagucaguuccauugcagaguugguuguaagagcaguaaguugcucugguccaguuuggcauauuuacccuguauuagguaacagguguguccaaauacuuuugggacaugcugucauauacaaucuucuuucuugagaaccauacaaauaugucacacacaaaaaccacagggggggggauugcgggggugguauaggggacuuuugggauagcauuugaaauguaaaugaagaaaauaccuaauaaaaauuggaaaaagaaaaaaacaaaaaaccaaaaacaacucuuucaaguauuuuuaugauguguuggaucgcauucauauuugaccuucagcauauguggccuuuggaacaucaguugaauacaucuguuagagacugggaacaugcaauaaaauuacccgccucugcacuuacauaugccuuccuaaaaaccaucuccuagaauuccauccaaauaaguuaucacauuuuucagcaaagcacuuauuuccacauuuuaaaauuaguacaauuaagugauauauaaacgagagcauugaugagaaugguacgugaagaccagguguucgcuaagcuugagcgacauaugacuuucuaguccaucuugaugguuggcucggugaagcucuucaaaggagcaguauuuuuaugacuauucucguaccucacuccuaucucuucuggaaauuuggucuucaacacuuuuaacugaaagagacaauuguaauucuuuuuuuuuucggugaucuuaucccuuuggcuuaguucaaccaguaagcagagugacucuccauaguugucuaguugcaaaagcagagaagacuucucauuuguccaguucucuguggcaccaaugucguaaaaaugagagcacacagaaaacucuccacacucuguucuuguucccuacagcuuagagaaccauaagugcuguauucgugcauuaagugccagaacauucagucuugcaccacauggaguccauuuacccuccuuauacucaaaugcaccaaauuguggcauugcuacaucuaacuagguauuaagcacaguauagucuuuucacaagacaugccucuuaaaagauuaagcuacucuacauaaaauaagugcuguuugacuuuaaauggacaaaaauggccauucaacaugauucuagccaauacuuuugggcaauagaguuugaaaucaaaauauaacaugauuccccgggaagcuguacagugaugaugauaauggaaaugauaaggauaacaacagccauuaaaaagguccugcuaugugcccuuuuaccuaauguggggcuuuucacuaacuccucucaacaacuccaagaguuaguacuauugcuuaauacuacucuguucucucucucucucucucucucucucucucucucucucucucucuccugauauuuuucaucuuuucuuugcagauuuccuugcacagguugcacauuuuguuaguuaggaaccacagaaaguaacagccacaagcaaaugccaggcuauauaugacacaugucaguuucccaacauuuuacuuugagggauauaggaauguauuacucaaggucuccgcuaaaaauuuuuuuggcucauucuuaguaugucuuaguucauaggucacuuucuacagauuauaccauaaucauaucauuugccucuuccuuuuccccccuccaaaucgacccacugacuguccaugcucucuuucaaauucuugacuuccuucuucauugauuacauucuucagcuagguccacccgaaucagggcugaggcuaggaucagccaucagugcugugaaggaccagaggauggagcugguuuuaguugcuauuuuuccauuuucagcgcuaacuaccaauaggcaaaccugccccuuuucuuuucuuuuuuuuuuaaauauggcuuucagggauuuaauuagguacuccacuguaaaguggaauuccagucugaagguccccggauacaaugaagaguccucaagaacaauggccucugcuaacucaguuaaauuagcuuuguuacccuggcauguuuuucauuccacguuuguguagcucuccaagcucugucauuagcuucuugcagaccauuagcuucuugcagaccacuagcuuggauccggaaguguugcuuucucccugaauccugcagagaggaggaucugagugucaaauuagugaggcaacucacauaagcccuauacaucagucaacaaaacuagauuccagcucggaucuagugauuuccaaaauugcgguuuucccaguucugucaccauucugauguucuaauugaauacaagaaauuuuguauugugaggcagaggaggcaggaggugaauuuggcaucacuaguggccagauucaaagauagaugcaguccuguaucuuugcccuauaaauuggcucguauucuaugguucccaagcccuacacugcuucuguucucuuuuaccuguucauuuaucuucccaggguauuuugggagacugaauucuaggacaggcuacucaucuuuauucucugcauugcaugugauggagaugggagguaauaaggcuuagggaguaggccaaguugaauuccuauaaaugguccacuuugugacacucccauaaccuucuguguuuuaaauauuuuauccuuuuauauuucccuuugauuugcaacaccaaauaaaacaucaacauaauuaaaggcuucggcuuaaaaucuuugcuuuuaugcucaccauaacuccaagcucaguuuugacccagauauaccugcuucagugcacuuuggucaguaaucacucucucuugcaaaggugaugaaagaacuagugucauggugacuccauugauaaggaccaagucucacuauauaguagcuaaugguaauauucauucucucucucucucucucucucucucucucuccauauauacauacauacuugugagaaaauauaauguaucuacuaaguuuuuguaaauagaaaagagcacauuguucuauaaaauggacaaacugaaaaagucagaaguccagagugguaaacuuuauaaaaguuugucaguuuuaaaauauuuuuaaaggaagauugagacauagaaaauucagagcccuuggcacucuuguuuauagaaaugcaagacaucuugacacaggcucuauuuucuaauauauucuguuaagaaagacaauuugaaaucauacuuaacaaaugaaaccguuuggagaagaaauaaaugaauuccuugauuuuguuuuggugcaguugaggcaccccugagaugaccauaaaaauagucuggaaugcaagaaaaaggucagggcuagaaagagauuucagaacauucaaaagaaagccgggaugauaccuguggaugagaugagccaaugcagauguuuugagacuauuaaaaauacagguuccuuggucuugccuuuggaaguucugauucagcacaucugggauggagccagcccccuuuauuuaacaagcuccccaggcuguuccgauuugcagccagguuaguucauuggcacauccaucaacucagcacuuggcuguugcuuuguugccuccaaaggggaucauaaaaugugaaagauucuucuccuguccuuucgaaagagaguaguuuccaaaacaaagcaaguuuaaagauaugguuuagggaaauauuuaugaaaacuuaagaaguaauggagccauucauuuccauuguggccuuugcuuuggguuaucuauuuauagaaaagggagcucuuucucucucucucucugugugugugugugugugugugugugaauuuagcccccaaacaggaaugaaugauuguuguacauuuuucaaaauuauacaaagaauuuuucuuuuuuuuaauuuuaguuuuacccaaauagaauauacuuagcaauuuuaauaucuucgucacuggaaaauguugcuugauuucaagaaauaugaccucauagacaagaaaaguuguauaugagcuuugagaaaaaucuuaccuuuggauaguuauauuaauaaaugauaguucuuguuugaguaaccugaaucagguaccagugcuaagccauacuugagguuaacuuuugaagauuuuacgguaaguguuguauccauaucugaggauaaacucauaacucuuucagauccauuacucaugugagacagauaaagcuaggaagcauuguucucacuuaccuaucuuucaggaagauagggggccuuuuuaaaggugcauuuuaggcuagcuauguaguccaguugaaugguaguaagagaaauagcuacugcaugcuccaaagagucaggcuccuuuacacugcaugugaacuguauuugccuuuucaguugaaccauaaguuuaguauagaaaggacagugguagguugggauagggaauuucacaaucuaaguuccaucuaauuuccuggcuguguaauuaaaacaguuuauaucuguguuggcuaucacauuggcuccuccuggaggcauauuuuaaaauaucuuccacugugauauuggaucuuuuacauauuuuuuagucuugaccucccucccccaaccuaucuagacuggugguuccuaauacauugccuuuucucuggguagggauucuuuuuuggugugggguaggaauucuuauuggauaagcuuccuaauggggaaugauuuccaaaaugauuaaucauacauuuuuacuguauaauuuacuuauguucagaaaauuacauguaccuuuuuugagaugaguuuucagaaauguuauaugcuaucuacaucuuaucccuauaaaauagagagaguaggaugggguuaauaccgucauuugguagacaugaaacugagacuugaaaugauauuggcacaaccucuuuuacauuuaguuguuuauuuuuauuuugcaugaggcauaggaagagggauagagcagguaauguauguggacaagcuuuccaaugguuuugcaggucuucaggugagugaucaucaccaucauuaggaauuuuucucauagaggaaaauuacaaagaacuaugugguuucucaaagccacauaguucauucaaguuuguggauagaugggacggagucacaaaguugguucaguauguuauguuguacuggugugaggguguauguauuauucacuuuucuguaaauaauaaaaaguguuugccauuauaaacuguacuuaagauuacauugucucaucgaaugcuguucaugcucagaccuucaauacacuaauuauucaucugcuugcucuauuuguauuaauccucauguugaagagcuuuaagacuucagagcuaugauuguuuauaauaaagucucuugagaauggccaaaaugcacugggagaaaucaguaaagguuucuguccccuucccagaccuauuuuucuguuucucugucacauuuuucacuaucuuuacacacacacacacacacacacacacacacacacacacacacaucuagauaauuaauucauucaugugcaauuaaaccuagaaugcagacuucauggagacaacacauaaaaaaaccaaaagcuuaagagaccuauuagugaaguucauuugagugccugagguauaaagaaucuuuauagccuugacaaaaucuaucuuuaaguguucuuuguuuaaccgcaguguacauguuauguucuauauuagugcucuugaccuuuuaauuaaaaucccuugaaaugaagauuucaagagaugacauagguuuuguugguuugcaacaguugacauuuguuaaggagaauaccaauuuuccuggcauuuauuaaaaaacaaaaacccuaagccucacuugcuauuucuuucccuaaaagggaaggcaaaaauggguucuguuguuguucaguuaguuuuccuguacaauuuuauuaaauuacauucagcuuuaaauggucuuccuagguucccaagcaaaaguaugcacuuauaaacauacugcuagcaaucauuuccugauaaaagaccuggaaacaucuacuuacuggaauaagaaggaggacagcaacagcggcguugcuuuauguccucucaaccgaaccugauuuuaaaaagcacaaccaaaaauguagccaguugggcugauuacauuagaucuaccuacccaauuucuguggcugcuuuaguugcaaaguucuuggugccaaacacauuucuucuuucuaacucucuuucuuuucuccucucucuucuucucugccucuuuuguccccccucccucuaggugccuguaggugcauaugugccccaguucaugggugaagaagaacuccauuuuagccuuuccaccuugcaaaggcaggggaccucucuugguuuugcuucugcacugcauauuccaggcuagcuauucuaugagguucuccauaguccuccugucuccaccucccuaggagugcugggguuacagauucggaauacugcaucuggauucuggggauugaacagaucucaugggauuuuccagcuaguaccuuuacccuuaauucuccuuugaauaaacccaccuacuuugugaacuuuguuaccacauuuuaugugugaagucuuucaagaaaguuggaaaauucagugaucaacucugcuuuuccucccacccuuugguuacuagugcuuuguuuuucuaguucauuuccugaagggauucuuguuuauucaauuagugggcuagugaguaagcugguucuacaugaguagauuucaaauggaagcagguguggcaagaucacagcuuggccuauuuguaacuaauucaauuugcuuaagcaaagugcccaccucuaucauuaaauguucauuucauauuugucaucacaagagaaaauuuugauuugggagugcuuuuuagaccauggaacgcucuuuagcuuaguggcuuuccaaguauucuccuggccgguuuccuaucaaacuggacccacuuacuacacacaguucuaauacaucuuuuccaggcacaaucuuuccagaaagcucuuaggacauuuccuacuuuuaauuuuugaaccugcagucugcuuuauaaugugcaaagccauuuacacaaucuuuucuauauuguuucuuuaaauguucaacaaacgagauuucaucacaaaaugagccaaaauaugcuagauugacaguaugcauaaacugucuccugacaucaagauaacuauguuuccacauugugcaugcuugauuucuauaaaacccucaaacaaaucagauuuaaagggaagcuugaacuucuuaauuccacagaaacuaauaccuggcuuauaauaccugguuucuagcaucuaaaaaacuagucuaaaauuaacaaaacguuaccuguucuuguguugaagagacagauuuuccuguagaacauuuaguaaugcugcgauugcauagaugcugaaugaguuuagaugaaggcaaaauauuuucaaaacaaacaacaacauaauuauuacuucaucuaaauguagucuauuuggccuuccuuccuuccuuccuuccuuccuuccuuccuuccuuccuuccuuccuccuacucuccaaggcacuuaaucuuugagaugcccaaagaagaaauuaguaguaccacacuccaaagaaaguauagcuuacuuggcugucacugaucacaacaguucuaccaucuuuagugguuccuaucccaccaacaagaaagcagggauuucucuacauaauuacauuguuuuccuuuguguuaacauacuaauuuaucagggcaccaggaacaugagagaaccacuucuuaugcaugauagguuagauaagaaaccaaaaucaaauuuugcuuuucuuucuauaguuucagauuuuugaucuuuggggcuccagagaaguucaagcuaugugaaaccuguuucuacagaaaagauauguguaugaugguggucucaaccuauaagaaagggucauaacaguagucuaugggaagaaggaggaaggggacaagaaacuugcaaggaaaagaaauaguuaaacuaauaggacaauuuagaagguaaacaaaugauaugaaaacaaaagcaagacauuucaagcauaaaaauaaguaauauuucaaauccuauuugacacuagaucucaaacuugcuaagaugaaugugauaacaggcccgguccuuguagaaguccagccaguaggauacuuauucugacucauuuuaucaguaaugaagaugacuuucucuuaaauucaacuucaagcuuuguguauaggacuaguuucaggagauuuguuugguuguugucuguuauuguuauuguuguuuuuaagacaguguuucccuguguaacccugauugcccuggcacucuguagaccaggguggccucuaacucauagagaucugccugucucugccuccagaaugcugggauuaaaguggugugcuaccaccaccugacuuagcacucaucagaauggguaaccuguuuuuuucccaugagguccugaacuaaugagagguccaaaacuugcuuucaaauauuagaacuugcuaccucaaaauucuucauauuuuugaagaaggauguacauuuucuuuugcacugagccugagaaauuaugaggcauacucuuguuuuugucccauacugcuuuaacaaguaucaccuuaucauaaaacaagauuuccacuagccuuuugucuuguguuuucuauggugauguaauaaaacaccgugaccaaaaagcaaguugucaaagaaaggguuuauuugacuuuccauauuguuguucaucacuaaaggaagucaggacaggagcucaaguaggaccggaaccuggaggcaggagcugaugcagaggccaugguggagugcuauuuacuggauuacucuuugcuuucuucuagaagccaggaccaccagcccaggggggacaucacucacaauaagcugggcccucccacagcaaucgcuaauuaagaaaaugcaugacaggcuuacccauaggcccaucuugugagaacauuuuuuuucuauccacaggacuaucuugugagaacauuuuguucaagugacucuaguuugugucaaguugacauaaaacuaaccagcauagcuuucuuacaccuuuucauucucuacgugccacuccagcuguguugcagagaaggaagccucagauaaaauucaucuauuccuaaguuuagaguauuuaauggguuuuccuuucaaguaccaauuaccuucuaaaagaggauagcacauaagccuagugugacaggugauguucagaggaaugcauuuugaggcaaauuaaaaaaaaaagguguuugugauguuacagaaacauuggugacauuugaacugugcuaguuacuaagcccguucuuuuucccuucaaggcaggguuucucuguguagcccuggcuguccuggaacucacucuguagaccaggcuggccuugaacucagaaauccggcugccuuuuucucccaagugcugggauuaaaggaaugagccaccacugcccuccaagcccguccuuagguaccauuccauucacaaaucaaaagcagucugaugguuucugcauuccucuacagauagccccaggacccaugugauaggagaaaaccaacucucacaagcuguccugagaccuccauuaacuagauagaaacauaugcaacaaaaauuuaaaauaaguaaugagauacacuggacaaagauuauuuguuauauacuauugguucuagaaaagugacaucacauuuuaugugaaagaguuggauguccacaggagaccuggaacaaacucuuuuucaccaacacugaggggacaacuguaauaagaucugcacucaaugaacucaaagucuggcugaggagguagacaaugacccagugagaauaucuguuuguggcugaggacaucuggcuagaguuaagaacuugaauuccuaaucugaggcucagaggaaggcccuuacuaaccugcagcaagggaguucauauaacccagaguucuguccaggaaacugagacucugugaagcaagguagagugucaagauuggauggauugccauaauugacuagggcauagaaaucauauaaauccaagcuuacugccaccaauacaaauguugcagcuggauaaagugucagagcaaaacuugaagccccaagggacuugauccugaguauuaugcuguccagccucuucuccaguuuccaagguuaccaugagaucuggcugaguuucccuaggggaucuaugaggcaucucauuuguagucacucaagaaaauaguaggugaugaaguuuggcuaacuuagcugaagacaaaauugaaagguguuacgauuuacagaacacuagagaaaaaauguuccauauguguccagccacagauaaauggauaagaaaaauguguauauacacaacagcuguuuuuguaaucauaaagaggaauaaaguuauaucaucucaggaaaauagacagucauauuuuuugagcaaggguaaaaaaaaagaaauaucauauuuucugucacuuuugguuccuagauuuuggaauggauaaaaguguguguguguguguguguguguguguguguguguguguguguguguguaagaaaaacaaaacuguauagaggaauaaaugaagggaaagggagauaagggaaaauagugggaauauuuucaacauaaauauauacuuauauaaagacuuaagaaauaaggaaguaaaaagauaaaaguuaucacugauaguuuguauacuacaccacuggaguuagggguuauuuugaaacaacggguccucuagaauuauuccuugagcagcaacuccccuaaauuaucaaggcaguagaugcugaaccucaucucaauaaguaguacccugaugcauagaaacagagaauguuucaaacuuagaaaaggcugccuuuuuaguaguuucucuucugguuaagauaaaauaugcucggcaggaaagaugguccagggagugcauaaagaugugaggagcugagcucagugcccagaaacaaugaaaagguggaagggagacaacuuguucucuggccucaccagaucugcaccaaacuccacauggucucccucccccaagccccugccucgguacaaugcacggaauuucuaguuaguuuacuuuguuuuaaaauagacuuucuccuguuagcucgccccauuccugguagcuuugguaacuuuguacacuuuuuuuuuuugccuuaucaugcaacauaguuaaacaaacaaacaaacaaacaaacaaacaacacgugcuccuuuuaauuguagaagcugagcugaaacuuacagcagcacaccagaauaaauuuucaacauuacucacgcaauguuuaauguuuuaaaaggaaaucuaaauuauggaaauaguaaacugugaaaaaugaccauagucacuggccagucacuuuugcucuguggaauauacuggaguccacguauuauagugauaaugauuguugauuguuuacucggaggcauuuaugaaagggcuggccuucugucuuucauacuguagccguccagagagauagacuagucuuccaguacauaacaugcuuugcaaaugucucaauaugauuuauaguacuuguaauauaaccuuuuaaaaucauauuuuaaguccguaaguguuuagauacacaugcaagauacuaaacuuguuuuacugguauuuuuuuuugaaguuuugaaugaaaaauggcacuuugcuggauuuuuuuuuguaacaaucuaucuuauuggauguaagucaggcuauucagaauagaaguuugaaauuuucucuugcuucaccccaccuugaccaggcauugcaacacgaauuuggaauugagaccaugugugacccuuauccauuuauuuaauaucuaauccuagcaaaccauaagcagacucagugccuuuguaguuuuucauggcuaugaccacuuucugugaguuaccacaaggggagggcaagcucccuggccagcagauaaagaagaguuuuuccaaaggacauuguaccugaggaauauaauggcuuuuaacuuccuugcuucuuuugauuauaucaguuguuuuuggguuguuuucgccagguguguuguagcuacuaaguuguuuucuuuuuuuuuuuuuucuuuaacucucugugauccacauaauagaugcuuuucagcugaagccaccauuucauugaauauugauacagggauuggaucauucaaccacaucuuuauuaaauguccucuuaagugucagcgcugugagguaaauaccaagucaagaagauaggaguccacaggcuagagggaacccggauggaugaauggcuauuugcaauauguugugauuagcucugauagggugcugcuggaaccaacccgaaaggacugugccuacuucuucacgucuguucuucuacuugaaaauccauuagcacauucagccacuaaguaggcaaccuaguuuuuggaaacaggauuaagggggagaauauuuacaacugagguucugcugagauccagauaaauuuaggcucugggaugccugaggccaugaugggagguagguuuacaacaccaauucacagcagugaaagcuggaggaggguaaagaaugggagagagcuauagaagccauucuacccgaagcaggcaaagauaaaaaaauugcauugcucacccguccacaugugugugccuucaagacuaagaaggugccugacccuggcguagacuugugcauuucuccuaagcuauauuuagcugucaaguccucaaauuucuacauagcaacuuacacacacgaggaggccuccucugugcuuagggacauucucaggcacuuacguuuugacucuggaauucacagacccugcucugguguguguuuuauugcuuucagcuuauuuccuguucucuugauuaaaaacuaaaaagcucuguagaaaugacaaguuuaaaaaggagcagacaccaaacauugcuuacugcuguccauucugcccaggugaagggacuccagagcaacugggaacaaaagcacuaaauggggccagcuuucugcaaugucuuguucaaagaaagaaagaagugcuugggaggcuuagcuuuucccagugcucuguggagguuuguuuuuccuguuaaguuuagaacuguuuauuuuuuuuuucuuucauucuaaugucucuugggcagauagaggagaaaccuccugcauuagcgucauuuaagugaugcuaaaagggcuaucagggggcaacugaaaaugaucagcuucgacagcucaagauggaccagcucuuucuuuucaccuccugaggguuuaaacacucucaacuuuauuaacaagaacuugcuaggacaagucugcuaagcuuaucucguuccaaaugaacacuuuaauucaucaccagcuuacagcgacucucugaagguuuacagaaggaauaccauacaaaaagcucucaggggugcaaggcagugaucugguacuggcccuagacaguguugguuuuauacacaaauauauaagcuauuuguguugugagcagucaggcagugguggccugagggguugugcuaaaauggaguucauaaaaagauaucacccaggguucagaguugugguauuucugaaugugguaacuuagaagaaaauuguugaaaaaagucugcgugguauaagguuugguauauauuuaauaaaagcauuaaaccuuuuaauuccacagaagggcauuguuaaauguauuuuuauccaucaucuuagcuagaaaucugaauaguuucagacacucauuaagcccuuaaauuucuuaauagaaauuuuaaacauaugcucauauauguuaacuguaauaacuuuuccuugauacauuuuuguguguuuguaccuuuaauagguaacaagguguuaaguauuuuuuauuuaauuaugcucuuuuuaaaaaccuccccaacuuauaauaugugcaguguuuaauuaaaaugcauuuuuacuaagucauaaugaaaaauuucuuggagaggcaaucaguuuuuaaugucagcuuacuuugauggcaggguguguguguguguguguguguguauaugacucuccugguguguauguuuuaacucaagcuaaucacaaaccaaaagauuaucauuaucauuuuauuacauuacucuaguuaaagagaauacaucaaaagaaaaaaugcauuuggaaguccuuugcauaauggucuuuuguugaaaagaaaccuagcucccucccuccccuaguguguauagaacaauucaggaccauucuggcagcuggccauggcgucugcccuggcguuggcaagaacagaugguuuuggggucuguuguucacauuugauuuccauguuacaaauuuugaaugaagucuuuacugaacccuuuguccugcagucugcagcucuucacaucagggggcaguuaggcgccgguccugacaugccaauuugacaccagaguacugcccuuuaucagaacuuggauuccccuagcucuggcccucuacuggaaggaagcaguaaguguggguauacugcccucugguguccagcucggggagcugccgaaggcuggaguucugcauucuaggaacccaggggagaaaacugcuugccuuggcuuucugaucaguugggaacagccucuuugaaugccagagccuuaccacaaaagcuccugagaugugaaugguacaauguuuuaggcuuugaaugcugggaaugacuuuaaucuuaagaucacgcuaccuuccuuggcucauuucagacauauuaauugagcauguacuauguaauuuacuauauaacuuuuaauucaggauuuuuaaaaauuagucuaugcuaaguacacagugcccuggcaugaagcauaugacagugaaaaaagaaugacaaaauccccaaauuauacugggugggggauggggacaaucaggaggcccuuguaagaagccaccaagucagaaaguaacaauaauggcaaucuuaaacuuuugcuagggcucugaagaaaaagaaaauuggagcucaagagagaugcugugugguagugauggaaugaugagaaaaaauaauuuccaagugguuuugagaaguuaggcuagggagacagaaaggccugaagucucccaggccuuuuguggugagcaucagauuaugauacauauuuccugauuccaaagcgaauauucuuacuucugauaugaaucuagguagaacaacccaagucacugcucagaugcuucuguguaucgggcagauagcucaaccacagcacaaacacaaaugacuucccucucguugaugaucugaauagagaauuaugugucugaaaaguaucuuguacauagaaguucacagucaccccuacgagagauuuuauuguuuauaugugcuauuagauacucuacucuuugggccuagcugauuguguguugggggaggggcauaugauggcuaugccuuagguuuccagagaagcugcagcauccgaucacuuagugcugguccaucuuguuagcugcagcaggaugaugcccccagugucuuccuggacuucacuuuugggguuaaguagaagcuaucuugguuugcaucgaaaggauccaagccaggagaacucuauggagggauggcuucuuuuguucaccaaaugaccaugguggucaacacacuaguaaacuggagcccucaugcacaugucagugagaacagacaugcccuuuguggagagcccauuccaucgacacuuugccaugccuuuggcccggucagcuuuuacuucccaacuuucuuugcaugaggcuaucuauaguguucuuacgacuucucuucagaagaaaauagccucuuuucuucaugcuuccuuuuuguguagcacuucaaagacuagcugggagaaugucucccauucaccuuuaaggguuaauuucaccauuauauaaucaacugucaugcauaaguguggguuguaucuagggaguuuuuaaaaaaucaacauguuugagacuauagagauaaauacauuuuauauauacuacaaucucguacucuucacugucucaaccaauuuagaggacagcacaggagacaauaaaauaugaugaguauaauccagaggucaguuuucccagggccucuuugaguguaaucacucuccugagaaaacaaucaccuccuccucuuucacaaaaagccugcuccauaugguugggggaggggaagaaguuccuucuuuaccuuuggcgccuccugaucaccaggaccucuuugcugaaaaguacuuuuccuccccuucaugguuuuuaacuuuauucucauucuuucucucuauuucuuuguuuuuccuucucccacuuucuguccuuagcugguaaauuagccagugagucuggagugaggcgcuuguuuguuuguuugccucugggaggacugguuuccauuucuucccuaucauucagccaacugacuccuuguccauggaguccucugguuaccuuuuucugagcccuggguagggggcgggacaggggcuccgcacucgcugaccucauuuuguugcauguccuggaucagaacucuuuuggaaauuagccuuggggagcuuuacaaaaaaagaaaaaguauucaacaggaguuccccaaauuuuuagcugacugagaauuucaccgguuuuggaaauucuucuguuaaguacucccugcucuuguucacuaaagccgaagaagagcaaaaugauccauuugugaugauugaaaaugacaaucacuuauguuugugcaguauuuucaaaaagacauugaaauucuuuugagguguguguguguugcacauaccauaguacacauguggagaccagaaaaaaaaccuguaggaguuuugaacugucccuccacaugcaggccccagggaucaaauucaaguugucagccuuggcuaccaacauccuuaaccacuaagccaucucaccagcucuuuaaaauuauuuugcauuugucucaucuuucuccugcaacaaccguaggagagguauaagugcaucucuacugggugacuaaccagugagauagagucaguugagauccuagcagacacugaaucagaaaauuugcuuucagcuuacagcucauagaaguagcccauguuuucuagugacccuggaagcaguuuguucugugguaaccaaacaagcaucaaagcagagagguaucucuggaagaucuucacacacucauaggaguuacgugccagcgaguauggaaggggaugagagcagcagggaucauuuugcagagucuguccaguagagcuuggguaucaaaaucuuagggaaaagagaacuccgcuaucuuuguggcaaaaaaggauuaugcgccuuuaaugccagcacuugggaggaaaaggcagguagaucucaugaguuggaggccagccuggucuauagagugaguuccagcacagccagggcuacacagagaaacucugccuggaaaaaaacaaacaaaaagaaaacaaagucacaccaaacagcuacauaaaagaagaguugugcaucaagcccaaggcagaguuaaacauccacugcaggaggagaccuguggcacaccccuucguuugguucacuuaccacaaugccaguguaguggucauaaggcucuugauuuggaacuuuucuuagugaagaggaaugguugguuauguuuaaaaacacuguccauguuuucacucuuucugugugaaauauguguucuuuacuuuggacaggauuguguuaaaaggagcuuuuugauuaaagacuuguaucuuuucuagaucuuuugucccugaugguugacuuguaaguuuuguaaaccuagguccuuaucaaucuauugauuucauauuagacuguguaggcauagguaucagucuauggcucuagacacugauugccauauagucacaguaaaacacugagucucaugaacugguagccuucgcaagggggaaaaaauaagacauguuggaauuuuaauuuccugagaaugucaacuuacugugccugucaagacauuaaucuggagcuacuguuuacuuacggaauauuagucuuauacacuuaaucagacauuguguuaucuuaugaaaugguuauccuucagagacaucaccaguccuuguauucagagccacaucuugccuuuugaugagguaagccuaugugucaguaagacaugaguaaugugaaaacuagcacccagcacuaaagacccaaucacugacauccucuagcauccaucugagagaguaccuauuugucugucuuucucaucucauuugauucucucagaaaaaagaucuuaugaaauuaacaaaaagagagcaaggaaagguauggaggagcauuugaagagaggaaaggggggggagagauuaauguaauuauuauacaaucucaaaagaugaaauuuuuuuuaaauuccuaugaacuaauaguaugacuugccauucacagaagauaaagaagagacuugguauucacauaaccuucugucccuaaaaaguuguggagcugagacuugggaccauguuuuuaccuagcucaagagcauacauggcuucuugcaaaaggaacugaauuuaugaaaaaacuuaggucaucucuaucuuugaugaacagacggguaagaucugaaccaaaagaggaagcaagagccaggccuggugugaaagcaagugaaguccccuaaagaaagguuccccaccccaaguuagucccccuuacuugagaaaucugcauuuuacgaggggccucucaacauuuccuacugacuuguuucucacagggaagaagccaguggauacucaaauaaaaucagaagcaaagcucccaagccaaaaaaaacaaaaaaacaaaacaaaacaaaacaaaacaaaagaguuuucugaaacagacaaacccagagagaaauagaguagguaguugccuauggcuggaggagggucugcaggaaauacaaagugaccauggauauguacagaauuucuuuuggaggugaauauguuuaggaaucuaagaguggugauacugugcaucuguguacacacacacacacacacacaaacacacacacacacaucuuuaaagaaguaauauuuaugguaugcguguuacaugucaacuuuuuaagaacagugaugauugagugcccuauccccuuccccuuccaccuccuuuucuaccacuuuccuuaaugucaguaccuucugaagagucugcuguuaagggagaaagcuccuggaaauggaaugucugcuuaaaguauccauauccuuggggguucacagugcucugggaugccauucguggccuaugacccuugacuaaagaacagagcuuugaaaucagcucugcccaggagcuggucgguaugggcuccuagcuuucagugcagauuuucuacucccugauuucaaguuuccuaucaaaagugugagagccaguucagguuuccccuucucugcaggauacgaagggaaaggcuguucuuuaccuuaugagaaaugugacuaguuagaaguguaacuucccucgaacagguugauuuaucuugaaguacagcaauuugcuacacgugcguuuuuagaaagcacuaaucaauuccaggucaggaucaguuaaagcgccccacaaauugauagugaggucuuaaaaaggcucagcagccuuggaacauuaaauuuacuugcuguaaauuuggaauaagagcauaaagaaucacuuuccagcaggaugaugaaaauucaucauguucauuauguguuucuucagaagcacacuacauuaauuuuccagcucaacuaaguggaggauguaggguuucucguuacuaaaaaacuugcucugauguugagaagggcgcuccaguuccauuaaugaauccagucugcucugacuugagaugcuguuuaauguguccuaaagcucuaacauggcucagugucauccaaaccaauaccagguuuucuccccuuaaaacagcggccaggaagguguuuauaagacuccuuuuguuuuccaagcaccgagugcaauagcuuacaaucagcucacgauuauccgugguagcagaggagagcaaugguguggcuccacuuagguuaaaaucuuuaucuuugagcuaugugcugguccacauuugccucuggggauguauccaaaugaaggauagaggaagacaaagcaauccagcaucucuuccuugaaggccucuccagaaauuuccuucacucuugagcauguuggagaaugauagcuuuccccucuccccacagagggggcuuguucgagauagcaagcaacauguuucucuguuugaugggcccuucugcugagcugcagccagcacagggaaguucaaaggaaaagcaaggcaccaggaugcucaggcacuguguccugucaucugcuuuacuucauuuugcugauaagaacuugaaagcaacaucagucuuccaagaauuacugacacaugcugggcuugucuuucuagcuguaagauguacuuuccaugccauuuuaaagaacccuccccaaagagcuuugcggauuauuccugggcacagaaccacuucgugcuuccugaagagcugcuuguguuguugagaagagcagcagcuauuaaauaacuucuaaaaaugcuagcugagagugcauauggggaaacagagguuacaccuaagguuuauaccugugcuccaguacuucuaagccugggguuauuuagagguuuuuccuugggcuuuuucaacuacauuggauccuaggacacuagaacccugggcuccuuuucaggcuuugcgucgguacagggggaggcuuaugaagcugauauccuuuagacucauacaggccuuuucggucaucuucucccuauaacccuuagguacaugccaaacuugcagcuguucaucuguauccuugcugccaaauguuuuggcagucuauuugcauauacaugauacccaaacuuguggucugcaagcaugagagcuaaacagaaaauuugaguguuagcucuccuguuuaaauuccacagucauuucguugcucuuugucaguggcggugacaaaaagugccgagcuauaaguaaucugaugggaagggggccauccaagcugcauuuguguuagagguugaacagacaugugcaauccaucaggcagucauauauaacucgaaacuucacagagucugguccugacuuguuuuaugguaagguccuaggaggggauaaggaagaggaaaugcaggaaaugaaaagcaugagagaaggaaagggggagggggcagaaauguggauuaggaaauuugaagagacauacugagaggacaaaugugucugugaguuaaaacaggggccagguguggggugcaagccuguaaucccagcuacuggaagcccugaagcaggcacaaugcaaguugauucaagauggcuuugaaaacauagugagacccgucuaaaaguaaaaauauuaagaacgugcuagagugugacucgacgaggaagacuguguaguaugcuuaaaacuccagccuuaauccccaacaaugcaauguguguaugugcaaauacacacacacacacacacacacacacacacacacacacacacacacacacaaucuacucacaccuuaguauaguaucuggcccagagcagcagucacugaggauagcaauaaugugguuuaguagugaugugguugaugcaggugauaauguugcccauccauccucuuauagaaagaaauagcuuugucucuuucccuggucuucuccagugcccucacuugccuaccagccauauuucaucagauuuccacuucuucagucuaguccaucuguggcaaaagcauugucuuugaaaucuuuuucaacaagucaauaagugcuaggcaauuucacagaucuugagacgaugagaaaaggaaaguuaauauuugggauaagccacaauggaaaaguucucugcaacucaguaugauucgucuauaaucauacaaaaccagaauucauuuggagcuuugcuuuuggaaguuuuuaagugagguauucaggucuuucuuugccuuucuuugcuuucguugccugugaguuaacaauugcauagguagcuugugcagagauugauccaggugguaguguugcccauucaccuucuacuagacagaaaacaacugaaccuaauucauucuuaagggaccagaauucugucaguagcugcccugagucugcugggacagccuuguguaagcaaguggguaacuuuggcaauuauuuugaggcuaacuaacuuaaacucaaaauuagcugaggaccauauuuccaaggcaucaguaacuacccaucucugagagaagguaaauaguuagaguauaaaauuuuuuucuauuaaauacucuaaggcagaaaggcaguuagaaugagauuuccccaagucuucuaaaaauaaggggaaaugguuauggcagggacaguuuuuuaaaaaaucaaauauuacuaaaaauauuucuuaagguuaaagagaaaugaacugugcuauugaauaguuagaaagcuauaaauaacuccuaaccuccaaauaacauucucuccagucccaccuuuuuaagauuagaaaaauuuaguggcuugucacagcuuaugagaucgaggcugaauuccauagcauugcaucuaaguuccugcccagccuggccccagccuccuuuuccauauggucuccauagccauuuuauuucauccacccauauggcauuuauagagagacaccauguggaagacauugcuagguguauugugaucuaacaccacauuacucccuuuugguaggggcuuuauuaguuccccauggcccuacuugggccccauuaaaaaaauuaugaggugcugagugucuggcaaugauuguagaaauggccugggggaaaauuggacacggauauggugggagaaggaagaaagacauugaacagcaaaauugauagguacaaaccacucuguauauuucagugaauuuccaacucccacaaacuuagugaaaaccaugcaaacugaaauuggguaagcagugugugauauauuaacauaauaaaacaucacauuacauggaaauguguaugugaaauaauguuaguaguaacaguuaauuaacauugaugaaaugcuuauuagaugcugagcauuguuguauauauggauaugauguauauguguauguauguguuuacaaauguaacuaucacauccgaacuuagccauuaauuuggcccaguguuacagguagacauaacaaacaucagaaugguuaagagccaaggucacauauuuaacacauaauagagucacaauuugagaugauauauguuccagcgucugugcucuuuaguauacaucugucucugugcaggaaaaaaaauuaccaaaaugugugugaauuuagcuaacuacauauaaguacauuuguaaaaacaauucacugugagacaaauaaacugagucaggaauuaauguaauagcuuuaaguaagacauuuggccugcuuagcaauuguuucgucaucaguaaacacuucucuuccuguacagcuaccuuuugaggauuuaaugagauaauuucuaccacauuccuugugauguccuuugauaaugagcauguuuuucaaaaccaaccauaauugucgaccauauuucuacuaguuagaaaaguaaacgcagaguguaugcgaauauuucaagucuucugcaguugucuaagguauuuuuaugcaguuuuauuuuucugcaguugucuaagguauuuuuauggucuucagauccggcuagauugcaacaaaauaagaaauauccuugauuuuuagaaggaaggacaaacaagcagauugcuaguuugauaucauggaaacaagguaauuaguggauuaacuagaaguuuucuucuuaaaauuuaaugguguccaacaugaaccauucguaucuaucuagcauccucugaccuuucaucgcuuugcuuauucuuuaauccauuaauuuagcgaacauagccaagaaccuccugcauacccaugucauaucuugacucuggaguuaaggugaaggacacacauagcccuugcuuucagugcaauauaguguagcucaggagguggauuuguaaguauguaugcuucaguguguauaauuuacuauaaauauccuaugagagugaacgagaagcacaggccaaaguaguuuucauuuucuaauauagcuuuccuuuucauuaaauugaauguuuagauacaucacagguaucuagacuuuaagaaacuaugguuuuuugaggaacugcaugaucaagcuuucugagcccuaugauauuuguacauggcuaaacuuccacgcaaauauuuugauaucaugucuggugucuuggauaaccagugccuuuguaacaucuuuauaugacuuaagagucucaccugguauuuucuaaucauacacagaaccuuuguucuuacuauauucaaaccaaauucucaagagauaccuaggcaauaggagaugagcuggacaaacuagucuuucugguuuagcaucuaucuguuagaugcugccauauguuugaagugaccuuuuucuuguucuuuuuuuuaaucauagagauuaugcuaauacuggaauaaaguguauauucaucuugcuagaagugagaauacuugggaacuuucuuacauuuuuagcugcuuaucauagcuaauaaucuauuucuuucaauuaaugucggucaccagaugaguccauuauuaauuuaauuucccaaaauuugccuguaaguuugaaacagcuuuaugaguuucuguuuggauggcaaguuaugggucaaccccaucuagcuaaagaggggacgucagacaagccaaggccuacuuauuagccuuuugucauucugucuuucccauucugcuuuggguguugguuugcccuuaauaguccccauuaagaagacucaucaaggaguugugguagcuuaggcaaucauguugguauggucaucgauacguaggagcaacaacacaccuagguuuguagaucuacuuauggcuuagaauucaagaaagaaagaaggaugucaauauggggaacaaaagauguauggagaagaggugagagcaggaaaauaagauugucuauucuuuuaguuuuuguuaguuuuuugagacuuuuguacaauugauucauggguauaagauauuaggagucgguuuaauacuguguccauauucugcccuaauuuaaacauauuuuaggagugcacagguguguugugugaguaugauguauauggggugacacaugccuuagugaguguaugaagaucagaaggcacuccuauuggguuaguucugucucuccaacuuucauguguguucugcagguugaacuuugaguugcaauugcuuuuccccacugauaagucccacagacaccacacucauuuuugaggauguucauugcugugagagaauaagaacccguccuggauuaugauuggaaugcgagugucucuuaagucacaggguguuggggauacaggcuuagucuuguccuggcccuugggcuaccacuaggaaaggcuuaagaaggaagcaacucugguggagaggcacaacagccagagaauguggacacagagauuaggagauggaaauagacguaaaaaaucuugagauauccagccccaaagacucagagauuaacugcuaacaaggagcgaaggggauugagcgccguuugcuacauauaauggagaagcuuuuuucuuaaugauuuuccacauccuccauaguuauauuuugcuacagcaguugaaagcccaaaauacaguugaugaucacuaaugcuaacaacagggcucauggaguucugugcaucauagggauggaccacacaugccugaggaaggguccugugaaggacuggaauuuguggaauguuuggugucauuacucagaaggccaggagggggcgccaaccauuuuguugcuucucugguguaacaagauuuuuuuuuuuuuuugagaaaguuuuccucagaaauaacaaagaauuuugcuuaccauauuaccccaguucucucucucucucucucucgcucgcucucucucucucucucucuugcacacacacacacaaacacaaagcagacacaguauguauguguuaaugguguauuuagaguaauagauaagcuacuaauaauuccaaaacuguaauucuaaacauucaagguaccauggaugcaaaagggccucuuugaugugacagaaaagaugucuuuuaccauuguuccuucuacucacucauugacauuugccaugcacaccauuuuuuuuuccuucugagaaguucuuuacuuuccauuaauguuggucucauccuuucuacagauaacacuuuaaaaaaaaaacagcucuggcuauaaaucuuuccuuaaacuuuuaaauuuucacuuguaaaugaauacauacuaauguuuggaguuaucagaagguauacuuacacuucuucuagaugucuagaggugcuuuguuaauggauuaugguucuguuuccaagguaucgcuuuugaaaaugaugcucuccgcacuagcagugccucugcauagcgaauuguucaugcacaauuaugucauuucuuagucaauguauaaagucuuuagcuuuguuauaaucucuuuacugcaaauuuuguuuuuguuguaauuguuggggaauuuuguggguuuuuuuuucuuuuuuuguuuuguucgguuuguuuuuguaguuaagagagcacgauuggucacagggcauguacguugaugcucuaguccugcuaucauuugugaguuacucugacuauguucuuauuacuagcuccuacacgcugugugucagagguuaugcauguuugucuguggaggaaugcgugugcauaugugcauguacguuuuccaacuuaggcaucuccccccagagacuuguacuuaauaaaaauauacauccuauucucucuuuuuauaucauuggugauuucauuaauaaugaguauaccaguugguacuacuuucucucuuucaccaaggagaaugucuggucucucauauugaauguuagugaagaaagcuagaugguuccagcucuguaccacuuaggaauugugacgguuugggcagcuuaguuuggcuuccugaaccugcauuuuucucuccauaaaguggugaggggaaccaccauaaucaccuuacuggaugguuggaaaaaaggcacagaguguguaugaggguugguggguggugauacugucagcccaaacaaaguaagaugaguccagcuauguugggaagaacaccaaggaaaugaccgcuugccggcacccagccuuucuucauguuuguacgcagcagucuuuguuuuagcaucaauacucacuuacccauguucaaacaaauuaauguucucaccuggcccaaucauuuuuuuaagcaaguuuaguagccacuguguaagcuggcccacauaaccccuuggcuuaaaaaaacaaaaaaguacuaucugccacuguacuuuuaauaagcauugagaauugacagggaaacuuuauuuuuuauauggacacauucagugcccuauaucuggcaugcucucagagauacaggggaaggagagcaaggucaaugcagagagagcaaagagcuauguggaaaagaagucugaauuaucugaaaaaguucaaagacaaggaugauuugaaaaccauuuacaucaauauuccaaugaagccuugguguuagggugaaucagaacuguacagcacgacuauuucuuauugcccucuaugcucagaucauuuguaucccaagaaagaauagaaaacaauggaauggaccucacugcuuugggccauucuggacuaagagguacugguuuaauuaacacccauauggagauuuuuuuuuucgaaaugacauauuugaauuucaguacaucucuuagucucugacuugaacaauaacuauugaagggauuguuuucccuuugcaaucaagacagaaucaucaauguugucaacuccacuaccccagaucccaugauuuggaagagauagcuugggucuggccuggugcugaccacugaagaggcaacagucaauguuaucuuccuuuaugcuggagucaagaacgccccaccucccacgccuauacaagugggcccccaggcaugguuaaggaaagugcucagcaacaggagcaggagacuucauuaggggaggcaacuguagcuguauuuuagcgauucuguuuaaaacacgcaaucucaaaaucacccuuuucuaggcauauugccaaauuacagcaaugggccauuuuuuuaaaugccuauuuaaaauaagcccccuugaaugcagcacuauggcaaagguccccuuggcagaaagccacuuuagacaucagcucgcuccaaacauuauuuuaaaucagugcccaggucuuucaguaauuugggaacuauugccuuugaacccagaaaaugucagugcacugagaacacagggaaaugguguuggcaugaacaaucguuggauguccuacccccuuguucaucuuuccggauugaaauauuuuccccugauuuaauucuuuucccuauucccuucagauuuaaauauuaaagaugugcuuaugggggcgaggaauaagguagggaugagugaggaaauuaaguugcaagcuuuauguaugucaaguacuccucaacaacgugauaaguacagggugccauugggaucugggcaguacaucaccuaaucucgcuaguccugaagaaggaagucauugguguauauuuuagcaccaaaccaacagaauucugagacuuaguaccacuugaacuuuugucuacaguaauuguuaaggcuuuaggcaucaccagaaauaggcugaaaaugagggaaaauucuccaaaaugacuuauccaaaacaacguaaguuugauugcucauucaguuacauuuguuuguuucuuaggaaugcaaauauauacaggucaugcaacacuucuaugaacaaaugucccauguccugcagauaagaguacacaaugccccccugucccacuggcccaccucagagauuccucugucuguacagaacuauaaagacuaugaacuguaacgcuaaugacuuaaagccagaugagcuaauggagcuacugggauggaauuuugggaccaagcaaaacaucuugcugucgggaagaucugcugagcgcaguuuggaggcuugucagagacaguucugaaaccaugcucuuugguccuguucaaauaaugacuuggaguauauuagaaguuuggugacaaauggaauaaaaaaaaaagugucauugucuguaaucuugcaaaucagaggcagcacuaggcgucugcuauccugauuuuagcacagaaccuggggcuuucuccaauaauguggcaucgauauaaugguuccuagggggauauuuagacaauauaaaacagggaagcuggaucaaguguuuauauuugugagagggcugcuuacaguucugaccauaccucucuucuucugaguuaugauuccauaguugcugcaucuccuuuccuuuuuuuuuucuaaccuucuauuaaacccaccucuaccuuuuguuacuguaaucaacuguccauaacuguucagaacaucaaauuccauaaggccaccaguuugugcucucuaaccccuucacaggacaauacggacagcuaagccauugcuuugugaggaggacaauguacucccaaggggcaaggaacgugccauugauuucacaguuauuuuauauaaccuuuggguuauauauuggugucuuaagaaauguuaauuucuuuuauaacaaauacaauugaauguuuacucauuuccuuucugggguggggggaggucuuuaaaaaaaaauacagacucucauggcauuccaggcuggccuccaacucaucauauuguugaggcuggucucaaacuccugauucuccugcuuuaacccccaaguguugggauuauaggcacaaaccauucugccuggcucuaacuaaugucuuuacacuugcuucuuaggcugcuuagacaguugcuaaagccucugauaauuacuaaagccaauaacucagguaguagcacagcgcccauugauucugugugaagaaguaccaauuacuaugugauucgggccuagauggauuuguuguccuaacuucucaaucacaauggcacuguauuuuucacuuuacuggugcauaguugacacacagaaagcauauucugcagccuaauuuggauauaaauacacagccauaaaaccauggccacaauuuauagcauaaauauauucauucuuucaaaagcuuuuucuacacucuuaguuuauugucauuuuauaauuaaaacgaaagaucuacuuucuuguugaguuucccuacaggcaguaugcuauauguuguauuccuaggauguuuuucaucuucuaugauugaaaguuuguacucuuuaaucaacgucccucuuuugcucucacccaggauaugacauccacaauucuacucucggcuucuaaaaauuugaccuguaaaaaagaucuuauuuauuuuaacauguaugaguguuuugcuugcccguacauugugaguacuuuguguguuucuggaugcccccaggaggccagaagagggcauuauauccccuuaaacuguaguuacaggcugcagugagccaucauaugaaucccaggaaccaaaucuugauccucugcaagaacaguaauguuuauagaauauaagggcaauuuucuaagggaaaauucuccaucucuuucccaagcucacagaaaagauguacaguuggcuuuuugauggcagcaauuuccagaagagccagggcuacacagagaaacccugucucgaaaaaccaacacccccccccccccaagugcuaccaaaucuggcuucaugugaguccuaggaaaucugaccucaaguccuuacgucugaguggcaagcacucucguauaucuuuaagaggcaguaauacguagugguuugguggcuagucucuggguucaagacugcaugaauucacaucucaccccuucuacuuaauucagcuuuuauguggcucaguuuucuuccauuagagaggagacagccguagacacuucuuauaagggaauuuugauaauaauaugaauuaauucauauaaaaugcuugcaaaagugucugacacaauaagugauccaagguugcuaguuccuuauuuauuauuccugaagcuuaccgucagggggcauggaaucuuuauccuugagggagaggaacauaaaguaacagcguuauacacauggccaagaguccuauguuccauuacugcuaccaugaaccccauagcuguauggcuuagauccagucuuaauuucagcuagcucaugugugaaauugggauaauaauguuucccuuggcuacauguaugcaccagugcacauacacacacuuaacuuucagcaaucgagaaggagggagaaaauuaaaacaguaccgauuuucaacaucugaaaggauaugugguacuuuacagauaugucaugguaacuuagcaaccuauauacucuguauauugaagcuaugaaagauucauagaacaaaguacacuuuucauauauacacagagcuuugugcucuucaacagagaugggcagagagauggcucagaggaccuggguuuuauucccagagcccacguggcagcucacgacugugcagaacuccagucccaguagaucugcuggccuuuucuggcauuuguaggaagcaggcauacauggagcacacacagacauacaugcaggcaaaccaucuauauacauaaaaaagaaaaauuguuuaaaagaacaagaaaaaguugcauaaaccauugacaguggaccuuccuuagaaugguaguucagugucuaagcaaguaaagaagaaaacagugcaaaacauacaugcuaauugaucuaacaucacagaagauccucuagguaguuugcucuuuaugucaauaauuuaaguuacauugagcagaaacagagauauucauuagcuaaagccacuaccagaaugcuuucaugccaaccuuuaaaugacacuacacccucuuaauggcacagaacauuucuucuuccccuaaaaggcaugucuuuauuuuucuaagcuuagguuagcaaguacuuaaagaaagaaacucuuuagcugugauucaugaaucaugauaauggaucauagagcaaaaucuucagaagucgaggugacaagaaccagaccuagaauaugacauaauugauuuuuuucguccaguuaacacauaauucauuuaguuguauccaacaguccauguggccugccauuauuucuggagaagggucuuuuccuuagagucuuuaagguaaugggucugugagcaggccuucaucguuuacuacgugaauucuugaagaaacuguaggacuuuacuucuguuuuaaagaaugaacugaaaguucggagaagaugccuuuugugccucuuuuagugagugucaugucuauacuguucuguccgguuucccaggaaugucuuaucccauaggaacauacacauuguuagcccuguugaagcuauucguacuaaacccuaucucauuuuaacguuguuagggacauuuaacuccaguuuuuaaguuguggguaacaucugcuaaugaguuccugaaagggcuccacucauuuauaagugggagggcuucuguaauugccagugcaguuaugagauuguaugauugcaacaauauuuuccaugcccuuauucacugacuuuuuuauuccucaggguuuuaaauguucuuuaagauuauccauaauaacugugagguacauuguaacuuaaguacccaggcacccucaagccaauggaaaauagagguagaaaagauggaguaagguuaugacacuaaacacaugacaugaaguuuauuaugcuugauagagagaggcuauaaauuuagcuguaagcuuucaagucauaaaugugaggagggaaaaauuaugaguuacaugacacacagaguccagaaggugaaagcaaacuaguuguucaggaaaacuaauggacaguaaaugauaagaacuaauuggacuaauggggcaaaaguguggucagcuguugcaggcucguaaauuuucuacuacagauuuucacuucuugccacuucuugcuucugaggacccuuguuauaaaucauuuuaagugucuucuggagucuguaauagccuuuaaaggaaauucuaucagucuaucuaucccuaucuaucuaucuaucuacccaucuaucuagucauacuccaccauucuuccaucuacuuauuugccuauccauucaucuauccauccauucauugcaucauuauccaucuguuuguuugucugucugccuaucuaaucuaucaaucuuucacuuaucucuaaugauacauucaaauauuucuuuuuuuuuuuccgagucaggguuucucuguguagcgcuggcuauccuggaacucacucucuagaccaggcuggccuugaacucagaaauccgccugccucugccucccaagugcugggauuaaaggcaugugccacccccgcccggcuucaaauauuucuuuacugcugguugaucucccucauauuuagaucccugcugugugaaagguaaaaacagagauuguguguguuuauaagcugcacaaauaaauaacauauuuaauagcaauuuauucuuaagcuuagucaguucugguuaaauuaaugugaauuguaaagcaccaggaaaauacaauagagcuauaggauuuagugucuucucuaugaacuauuuuuaaaaaacaaaaagccuuacuugcaacauaaacuuucuguuucucugugacugguuuucaaaaauaaaaaucauuuacuauucaaaaauaacugaaauguguuaccuguuuggguguuuugguccauaaacuuuuugcaguggguuuuccaacuaaaauuacaccgaugucauauggcaucuauugaaugcuaaaacuccuuuuuucaggaacaaaaugucagaccagauugaaggaaacaaagagggagugucuugacucuguucagugguucucaugacuacuuccaucaaagacugaguucuaaagugcuggcgcuuucaaaaauuaaugaccuuuauuucaaauaguuuuaaauuugaaagaaaacuuaaguagguaguaagggaagccuggucuuuggguaacaugauaaaauguuucguuuuuauaaggaacuaccuaucugucaucuaaaguuguuguaacaucuuguauuuccacuagauagccccguaucuguugaugcucuacagccuuauuuaguauugucaauuguaugacuuuuaaccauucucaugccugcgcaauagcaucucauucugacuguaauuuuuaauuuccuaaagauguaugguauugagaaucuuuguuuaagacuugugacucuuugugggggaggcagcuguucaguuauuuugccuuuuuuccaacaggguuguugguuuuauuacuguugaauuuuauuuuuauuuauauauucauuuaucuaugcauucacuuguucauuuaauugugcuuugaauuuaacccagucuggcaccucaggaguuuguaacuuguuugcguguauacauguaugaauuucugcuuuuaaauugaguccauggacuagaaauauuaccuguguggaccauaucaccucugagccucaguuuccuccccaguaaaauaaaauaaaacaugugcggccaugucacaguuaaaaggaggguagauuuaagcauguuuaccauggauucugcaggugccugggaagauuaauucucuuuuuccauccaaguaccuguacuugaaaguaaggcucgcuuuccauccaagccaucaugauguauucacccuuguaacauaaaaacggaaucucauaaagucgugccuauccuugcagugcugggaaaacugcuuugaaaaagaacagcuuucuauaacaauugcuuauucuccagaccuugaaagggauuccaugcuucauuuauuuuucuugucuuuuaaccccaaguauauucucauaugcccagcugucuaccaagaaggcaaauaaaagcccauuucuuuuaguguacaucugaauucaggaacaccauacacuaaggauagccaaucugcugcugugacagacuauauaucuuggggguacauaaguagaagaggguuuugaaccauuuaaagaaagucucuacacuucccccaugaaacuauaucuggagaacugugucugucauugugcaucaaaaguuaagaggaauacugauaacuaguaucuguggugaucaggauggugaugaaaaccuuuagaaaucuagggauugaacuggugagguuccuaagccucuugccaagccugaugacuugaguuugauguugauucccagaacucagaugguggaaugugagaacugauuccuauuaguuguccucugacuuccacaaacaugccacagcacauguguauacacacacaugcauauguaugcacaggaagucaauaaaaaugcaauaacaaaaggagaauggaaacuuuucuuuucuuggcauauuaucucaguuuauuaaauccauuuauuuccauccguagauuauaaagucgguggauguucuggggacaaauucuucaugauggcucugauuccacaagauuugcucuaguguucagugaacauaacucuucacuucauccaaggaaagagaaagagggaaaucaucucuagcuaaaguacacaugauuauuagacuauguugucaauggacuuacacuuccuugcauuuacauuccuacccuugacuuuauuucuugaacccucaagagacuuaagaaggccaagaaucacuuuucaccuagcauugcucccuaugaggccccgugaacccuuuucuugagccuguguauuuuggugauaaggaauugagagaacugggcaaaauccagagcugcgcgcuaaguuuguucugacauguagagucugcugucuacagcacucgaaagcuagauguucaguauggaccucagcccuuucccccugaaguauguguuguuguuucuguagaugaguucacgaucuucuguaauuuucuuuuucuauugauccugcaguaauggcaacagaccuuuuauugguaggagaaucuggggcuuuccuuccguguaucuuguauauuagagaaugaguguaucacaauucagguaaacuucgcuucccccagaauucauuucagaguggccuggaugauggagcucuuuagggguaaccugucugcaaagcagcuuucucccauuucuuacuuccugcugccccaaggcaaaggugaaagugcugcucgguuuuauuggucuucggguuucaauuucuucugguacauuuuuguucagagaugagugagucgaugggaaaaugaugaguugaaaauagaacuuaacuuucuacaacgauuuuugagaagguguuguagacucuuaaguuugagggcagcuagagaguacccaucacuuagagacacugguuggaacugauuaugucuaccuugcaacugugucaccuuggggaaauauguccauucuacugagacucaguuucauugucuauuaaaucgggguugauaauaccagauucagaagguuguuauuuuaaaaaaaaaaaagugaccaccaaaauguucuuuuaagugacuuuuaaucuucuauaucuccuguaaauguuucuuuuugagauaagggcucacuguguaaccuuggcuaaucugggauucccuguguagaucacacuggccuugaauuuggagcaguucugcagccucuauuucccaaauguuaaaagugagccacugugcuuggcuacuuguggauaauucugagacaagaaugguucaucagugaucugcccacagcaccuagcaagccuaauauguaaugcuauauuucuaccuaaaauuaaaaugaguaaauaauguagaauaucaaauuuucugaugguuuuaaacaauugagugacuggcccuuugcauugggcuaggugacuacauagcugcauucaacauauagauucaaggauggagaggaaaguaacaaguguagcuaggaagacuguuauaagguaaaguuucuccgaaucauuuacuucuaaacaaaagacagaaaacaagugagcauguagugauugauagcaaggaaauuuuugcuccagcaucacauaguugcaaaauggaagggaucaggaaacacuaguaccucucagugguacaaaagccguccucagaccaauagccaguccacauauucucagaaaccuuuguagauggcuaaguucuaauuuaaauucauuuuuggucucucguggcuuuggaaacucuuuagaauuacacuggcaacucuccaacagcgcugggcaugugaugagcuccagggaagaugguaaggaaugaguucuaccuugugagggaucuagggcagauggcagugguucagucuagagcucacuucugccacagaugacugaaauguugggcuaagugaucccaaggaauacagucucucuaguagucuggagguaguaauaauuugaauuuucaaggcucaugaauuggcaucauuuagaguacaucugucauggacccuugcauuuuagaaggaacuggauguacuaagguaaaauaucaggaaacucgacuaguuuuuuuuuuaacucuuucauuuguuuuuuaaaaaaucuuuuauugugauuauuuuuccuuuucacauauaauugugacacuccaguuauuugugaugacauguaucuagaauauuuugauuuggggaaaaugagauggcacauuacuacuuuauuuuucucaaagcagugacacuaauugggcuuuaugccauggggcugaagcagcagauguaaucuugaauuugaggucucuguagacuagcugaggcuuucaagccauguggaguugaacuuacgagaggagcuuagcgguuauccuuccagauguucagcuugcaguuacugucaguagcaaauguauagauaaguguauggauuguucuuuccagacagauacccauucagugaauaaacaccuuuuccaguccuggcaaucugucagauaacucccuuucaaguuguucggagaaagucuacccaaaauaauuaaauuuugguuaucuuuuguucuugucuaauaacuugcuucuccucugaguuugaacaggcuugaguuguuaagugaauuuauauaguguacguuccguuuugaaauauuuaucucugucuaaaaaugaaauguaauuaaauauaaucuuuuaacugagugaaucaaugaaagaaaaagaaaauuucucuuucagccaauuuuuaaucaauauuuucauguaaggccgaaauguuaacugaauccuggcaguugucauuugaaauacaguuuguauguuuaagaauuuauguguacaucaagguuuagacuucauacucagaaaggaaaauugacuuacaggagcaaggaacuauagaaauauaaguaauaccagcaauauaaguaauaccagcaaugaaugugagucaauuauuuaaggcaaauggaucuuaaucccaaaaacaacagagacauaucaaauucauuuacacccuggauuucaugguuuaauuuuggggcaugucuuuuucucuuauuuuacagaggccuuugaaauuguuguucgccaugccaagaacuacaccaacgccauguucaagaauaacuaccccagccugacuccacaagcuuuugaguuugucggugaauuuuucacagaugugucucucuacaucuuggguucugauaucaacguggaugauauggucaaugaauuguucgacagccucuuuccagucaucuacacccagaugaugaacccaggccugccugagucagucuuagacaucaacgagugccuccgaggagcaagacgugaccugaaaguauuuggcaguuuccccaagcuuauuaugacccagguuuccaagucacugcaagucacucgaaucuuccuucaagcccugaaucucggaauugaagucaucaacacuaccgaccaccucaaguuuaguaaggacuguggccguaugcucacccgaaugugguauugcucuuacugccagggacugaugaugguuaagccuugcggugguuauugcaauguggucaugcaaggcuguauggcuggugugguggagaucgacaaguacuggagagaauacauucugucucuugaagagcucgugaauggcauguacagaaucuacgacauggagaaugugcugcucggccucuuuucuaccauccaugauuccauccaguaugugcagaagaacggaggcaagcugaccaccaccguaaguaucagucuucagguuucaaaagaacuguccuucauuguggugguggguggggugaucucuccagcaacagauacugauagaaaaauagagaaaggaaaaacgacgagcaagugagaaugcagaugggcugaauguacucuccgagauagacagaauguuaaaacuacaggguauagaguuguaauacuagaucuagcuccacauacuucuuugcugccgaguauugggaacaaauuuuaucuuuaugaguuuuauguuuugaguucaugaaagaagaauagcuuguauuugagacauauagcaucugcgugguauaugguaagucuuuauuaaacauuagcuguuauuguuguuaucaggauccuuaugggaauauuuccucucucucuuauaaacaaggaaacugaagcuuaguggacuguauguugcacaggggcauccaguucuguaguuagcagaagagacaugauucggaaauugaauuuuugauuuaauuaucaucaccuucuauucugacuucacucuguggucuucaucacguacaucacauugccauucugaagggaaugcaaaauacaacuuaaagacaagagagucagugucuacugacuaaacccacaagagaacauaagaaaagcaucuguucuccgcauucauguuugcagccuuaauuauaccagucuacaccugaugggauuuguaaugggagaagggcaguuuugcaagugcaguagcagcuugcuuggcuuggaggauauucugucagagaaccacaagagaaaagcacuugugauguagaacagaacauacagccaagagcuuccagcuauguucuuuuaagacaaugauucucuacagcuuccagcuccauaggaagacaugccagagcaguacaauauacuacuaucguugagcuccugcucacaucuccaaugcgauauauauauauucauccauccaugagaugggucucgguaguguacccauugcauauaggagggaugaagauuagagaguguaaguacuuuccaagaucuccaaaaguuuucuaugguaggaguggugauucaaacccaggccuugcuggccuugcugacuccugcucuuaacuucccuccaguacauugcuguguagucugagcuauuaguuaaccagaauguugagagcagcaugggcuaguuagccuugucuuuaaacucggaagugcaagugauagggguaauugguuucuuuggugaauuaaacuaggagggaggacagaaaugauacaacccucagcauggccacuuacggagcuacucuaauugccccauucacaggguuggccauuuaaaacccauuugcugagaaaauauuuuauaguaaaaugaacagaaaugcccuaucuaacgaugguguucuucgauggcuaauuauucccuugacugcuuuauaauuugaggccauauucuggggucuuaugcaaaaguaaauugcacagaacuagaaaaaugaaaaguaagugcauucauauguucauucacuagcauugaucaagaguccacugugagucccaccccaaccaaaggcaucagggcgugaggauaucuacaauaagaggaaaauacgacuacuuuaauggcaagauguaugaguauuuaaagguuauccacguacauuuuuuuaacguagcaucuuccucccccaguacuuuuaaaaacaaaaagauaaaguuuugagugugcaagugacacaucccccuaguccucaaggacuagggcacgaggauugagaguuugaauagacuguccugacuaaucuuagacucagucuccaacaacaaacaaagagagaagaaaacaaaagaaaagagaagaaacaauugggaaacaaaacugugcacacuguuuuuaugaugucuaggcaugcagguuuguugagugaacauuuaucaacaucugcuuucugcaggaacuuuaucaggugcuagggauccauagccucccaagacaguucugaggacuugacauaucacaguuucacugguugauggaccugcaacugaauaaauuccacuauaaugaacauuuugcugugauaugaauguuggaaaggcagugugaaaauugagcuagucuaaucccauuucaaaaugaagaaauaaagucuccagaggcauauccaaaguuuuuuuagcuaagaaaagagccagaagcagaauccaagauauuuuucugcugcaaucuaauauucuuucugccauaucacucuguuccccaguagauccuuccagacuuuccuaaugguaaaaguaccauuaggauuuugcaaagacauaaauugcaugguuauuucaggcuuucagaccagcuacauuuuagguguguguacacauaagcgugugcucacacacauaccuaauauacaguagagggaguacauuuugugucauuaucguucaggaggaaaggccuuggcugucaggaggugcucagugaugcagucccuuucuguuuuggccauuaaggggcugauugcucccagcucccauauaguuaugagagcgugaagucugccauccccugggaaugcuugaacuaagccagaaagcauauguaugcugccucguugcuguuauaugaucaccaagucuaaguugucugcaucaccugguagcgauuagggaaucacuggcugggugugcuccagaccacacucuguacaagcuacaagcaggcagggcucuuuauuagggugaggagaacuauggguuugacagacugaagcacucuguucguguggacaaacccacagacagaaucccucaaaccaaaagcugguugaaaauuaaauguuaacaagauucugcaggagcacccucacuucguuguguuaacaagaugggacugucccacaguagaaccuugccuagggucaguugggcugagguuucucuuuagcaucgugccauuucugagcuguggggguggggcagcuuucuugacgagcuauauaagggauggcaugaggaguccauacaaggauguuguccaguuguguuggggguugguugcuaugauccaucucacauccugaagguggguuuggccuucuacauagguaugacaaucuuagacuuucguaaguauagauuguugguguuuuaguuccuccaagaaugauucucaguccuguagacuaccaggugaaggcauguggguaaauauuggggucuuauuacucacagcaccccugaauguagcaaauguucagcuccucaaauugacucaucuccaagucaaugggagaacuuguuugacauggcuggaguccaagcccagagauucugauaacacaacucuauggagucacuugccauuucaaugguguccuucuugauccugauggccccuuaggaacaucuggcuaucuuguuugaaagauaaaagaagauugagaaguuggcaagcggauaacccagauacuguaggcuagguuugacagagguagaaugauauguaucuaaaauggggccgccauaucagauguuaaaugaauuguuagguuuagaaaaaugcaaguacucacuaagccccaguccaaacugcuaaaagugcccagugaauaaugacuuuuccuuacaauuuuuaaagauuuguuuuuacuauuuuuaauggauauguguguucauguguauguauaugcaugugaaugcagguccccuuggaagauacacacaugggacccccuggagcuggaguuaaguguuuauguaggugcugggaacuaagagaacuaagguccucugaaagagcaccaaguacccuuaaccucugagcuuuuucuccaguccauuuauacuuuuaucuuuuauuacuggugaaugaacucaaagaaucacaugugccaagaaaauguucuaucacagagccauaacccccgcuccauacacucauuuuagaguaugauugacugauauuauuuuauugcaaauaaauugaauaaaaaugccaauaaaugauaaaagauaccuguaugcauauguacaugggccagggaaccaaaaguggaggaggcagaugucuguacugaaaauuucccuccaaaagguauuaauaauaauagcuccaauccgaucuucaaauggauugauuacauaucuuaccccaaagugagcacugauccuuugaguguacuuggguaaaauuugaucagcauguuauugaauuccacauuuuauaccucgaacuaaauauagaauguguuuacuuucagcacugcugauuaccauggcuucuuuuuuuucauaauacagagaauggaguccagcuuuguguacauguuaggcaaccacucuaccauucacagccccuguaaaacguauuuaaaacaucuauaguuuuugucucagagucaccuugauuaccauuaccauauaucuacauguagauuauguguauuucauguacaacucacucaucuguuauaugucuggcauuuauuccucucccagaauaguugccaaaauuuucuguagcuaaucucauugacugucuuuaguccacaauagaauugcucauauacucuuuuguuguuguuuauuuccaagaauguaauuuaauuacagcauuucucccuucccuuuccucccaccuaacccacccugcucucuauuaaguucacgcucuuacccucuugcuuggcugcuggcaguuuucuuuuuccauauuugcuaguguacuuugcugacucuccuuagcaugccccuggguuaggguuuccuggaccacaauuuuacuaccuugacuuagaccguuucacugaaaguuguacaaaauuucuuuguaucaccacccuuucucccuuucuucugucauugugacucacuuuggaacucccuggaagaguuucugcaaaugucuauuacacauuucaucaugcaagccaugugcuggacacugagcaucaucaagaggguagggaagcugagcauagaagauucuuuugcuccauuuagggggucacuaagccagcaggucucagaacucagauucagagcugggccugucugacucccaaguucuugcuuguuaccaugacucuauauugcucucucaaacacuuccauucucuauucacuagaaucuucguuccccaaacacagccuaaauugguuuuuuauuauauuauuuaauauccuguauuacucccuacuguuuuuccagcugcacaaucaauuuuugaauucauucucucuccauggagacucuugcucuacuauuucccaaugaagaacuaaaagacaugagguuguuuuuuuuccccuuuucucuuuuccuauuccuaacacuuaaaggaacagaauaguuucuaagagaauauuuguauaagcucuaccuguuaguguugucaauguugaaaacucuauuaaauuccacuugcacuguugaguccccacccacuggaacaacagagagccaucuugguuuuugcagcgauggaacucagggccuugugcauguuaaguguuugcuccgacacagagcugaaucaccagcuagccucaaagacaguuuucacgcuaucugguauuuauccugaauaucgaauuauauucagacgucuacuuuggucuuuccuuagguaguaacuuugucuacugaaagccuaaccuaugccaauaucugggcacacccauuucuuuggcuacaauguuugaagaagcaauacagucaguauuuaaucauggaugguaggaagcuuggaggcagauucucccuuugagcugcaauaauaauucacugucaaauucgugcauuuugcugucugugugagugacuguaagucaucagaauuuccaagauuagccuuaccuuucgucucugccuuugaaggcugaggccauuucucagaugucaguuuguccgagcuucucuccuuguccgcuaucacuguaccgucauuuuucagucucagacagagauaccuucucugaauucauagaagcugcucuccguuccgaagggauucagaagugauaaauccagcaacuaucucaguaccucauuagugucugcaggccagcaucggaaacugcaauaagcaauauuauucaaaugagguucguuucagacaugacagaaaauuuacauucugucaucuuuuuuuuuuuaacauucacaauaaaaauaguguuagugguugcuaucggacaaagguggugauuuggucucuuguucuguuuugaggauucuuucacagacuggcacugaacauaugguccuacugucucagccugagaaagguuaaacauagaugaccuaauuauugaaagacugacuacaaggaagaauugacgcuauugaguguuaauuucacaggaacuuuccaaaacuaaucauaugaagaaagcuuuugaauguuucauccugauguaaccaugcagauuuuacauuacuuuaggcaauaaaauaggcucucugcaaaucuagcauuguuugccuucaccuaggugagggacagcgugaugaugagaguugcucuuucgugcugucuucgggaauauguuucuaaaucucuuuuccaugaucaaugaacugauaagaugagaauaugcucucaacaacuguggaaagucugggauuucuccucaguuacaagcuaauacgucggucaacugccauuuuacggaagccaguuaaaggcaugaguuaagggcagaaccauugauuucucacagcaauggcgguaaccagaggaucagcauuugugucuaauucccuagccucaguugccauggggcaaggcagagagggcuggauaacaccugcaaaugcaaugcggugcuuuacuagagagcauuuucagccuagagaacucaaauguauccuuagcacuacaagaauaaaaccaagcaagagcgugaucucuuggucuaauggcuagauucucaacauugaaccuggguaacuuauuucccaucacugcuagugcucacuucucugaguggagacacuguagcauccaagcuacacagacacuacauaaagauacuuggaagagauaguuugcagcaaacaguggucaauguuuccauuuauugcuaccuuuggaugaugacaagacccucaaaaguucuugaugccuuuggaggaucaaaccaaggagauagaaacuaaagaacaacuaguucaacuuugucugguuagccauaaggcagcuuaugugcugccuguuggagcauagccaaagguacacacaaacaccuaaacuagugacaguguuagccauucagagaauacaaaaccuuucuaaaggagcacuugauauuguugcuucucauuagcaguaaaacucuauugcuuugaucuuccagcucucucucucucucucucccucucucucucucucucucucucucucucucucucucucucucucucccucucucucucucucucucugcaguuaucuuuuccuauccuguuuuuugaggauacaguguuauaaguuuucuauugcuacacaagcuggggaaguuauuucuuuuauugcacuuaaaagguggcagaugugauaaccacaggguaguuagcugacacuuauccaugucuccugguagugacagggagaacggauuuauucucaaaggauauucaguaaggguggauaauucaaggcccuuugcccaagagagcagaaguuaagaaagauacccccauggcccaacauuauaaggacccaugugcucccagggugacaaugaaugaguacaaacugccuauuucaaaugcuggcugcucagggagucagaggcuggugaaagcagccuuuacauuaugaaagcagaauagccucuggauauuuauucauuacaaaagccgaaaagccucagaauucacagugugguuccucugcuaugccuuuuccuuugccuggaguuaaagucugucuuggcaaauggagugccagucauucacuaaugaugcccccccaccccauccccuacacaagguaccuuggcccauuaaccucuuaggucugugcguuuuuugcuaucuugcucagguauucaggccaaaguucuuucuaccuuaacucucuucuccaaaaggcaagccucauccccccacccccacccucaaaauuggaaaacugaacaauucuggccauccuggaagcugguuuuaaacagguaggacaguagaugagucauuuccuuaagggagugagcaauugcaaugcuucaguuaaaaaaaaaaaaaaaaaaaaaaagcuacagagccaacaggaggugagucugcagcagaaucauccagugugcugcggccuucuggagaccaagugcaaccucguccuucucagcagcccagccuggcugagugcugagcagugcugugguccuuccuguuuucuguucuucuguguuguguguguguguguguuguggggguagcuaucaaugggguaaaacaagugaguuuuguuucugugaaaguacagauuucaucauauccuuucaacaaugucccuuugggaugugcaugauuccgcaaugcuguuuuccugcuuucuguggggucugaggugggggaaggaaagagccaaugcugcccccuuauuacccaauuuaguuccuuucugaagaauauucagaaagcgaauuaaguuugccuauucauuccacucagaaugccugaaccagauaaaauaggaagcagagucauuauauuugggugcugucuauuaucauuuaccgacucagagucuaucuaagccuuucugcuuuuugcagauaauuaauuuuguucuaaauggagggaagaaugauuguaaucaguauguuuguauuuucagcuacaaauagagccuaucaaaguuguguagaacaaauaaacccuauaaaauaugcagccccagcccugcuugaaguuaaugugcuaucucuuuuucaaaaggaaacauacguauacacacgcagacacaugcauagauacgauuuuugaaguucuucuugcuuuucuuucacaguuaguagguagggugcucuuuuuaaacucaagccugcgcuguaaauuuuauuuaucaucaaaucucauguggcagagcugaaggggacuuugauuuggugcagaaaucaaguugucaacauauacacauuucucaguuguagaugcgaauuucccuuauuauucucccaggaaacuaggagcggucagaucccacgagcacaguguuucugaaagaggaugcagugugcauuguucuccccauaucuccagcuaagcccuagucugagcccaucccuucucacccucuuuuaggauuauaucguacucgcaacucauucauucagucccuguccuguguuuaaaggggacccuauuucugcuucugcuaguauacuaguacauuuguucuauugaaaaacaaucucaaguguuaacuacuuuauucuucaaaauaaccuguuguuggaguuauggcucuaauaaacccauauacaauacauacccaaaaaagaaaagaaaagaaaaagaaacaaagaaaaacaaucuacgucucuugagaaauucuuuuuugccagaaaaaaaaaaaacuucuaaaaacggaaguaagguggcucucagccaauggcauccaguuguauggagaaucagcugagugguauccugcaccuuaugucuuaagucuccuacuaugagaaaugucagaucagaaaucagaguuuuuacauaggagcucagucuuguacugccauggucuuuuaaaaagcaacuucuuaguuucuaguucggaaugugugcaagaaagaagaauguggacagggcaggagggaugaggaggagacaacgauuauuagaacguguuguaugcuucauggagaucgaagcucuauccauggauggucuccuuugguuuaugguaaucacgagaagaggaggauuauggugauugccauuuuccugguaaaaggacagagguaaagagacuuggaaguaggugcuagcuguacagcugcuucagcuucuauguacagcaggaguccccaagguacaucccucaccucuggcgagaacccguuguaaaauauaugguaagggcuaggccuugguugugcacugacucuguuagugggaagaaggaaggaagggaagccagaaauugcucagggucuauuccuuccugccaacuuucucaguuauuauucauccuguuuucuacauacggccuugagaauugcaugggaacuuccaaugggccucacuucucuuccucauuuuuguauuaauuaauccuaauuagauuuuucaaagucugcuuagagcucaggcuuccccugggauugucgccuuuuuaauuuaccuuuuuaaaacagaaucuguucuugacgagcuuggguuuuuuuuuuuuuuuccuuaaugcuuuaaagguauauagcagcuauguucucucccuuucuguuaaaauauccauggugaaauaugaagcucuguggcuuucuuauuuugcacuaaaccuugaaauuaucuuuuuccaaauguggaaggagucgccuauuagguggguuuuggagggauucaacugcucauucccccugaacacguccuuauuguaaaaugaauggguaacuugucuauaaugaccuccuagcugacuucuuuuuaguugugagcauuuuaaaaucauuuuuaagcaaucuuuacaaguuuucuagacaugauguccuuuagacaaaauacuaggagccuaaacuagggcccucggucugauuaacaauugguguuaucaauccugacaggaacuggagaauccaugcuagguagcccgcuccucugaaaaugaugucaaccuuccuuggaucucagagggcaaaugaacacacuggaggaacucuuucccucacacaucuguguuuaucaagcuugaaagucuauuuccucccucgccauuucuccugaaucuguaaugcucugauuaagaaaaauuaauaugugacucaaagugcucucuauucugaaaggcuccauucagaacugucacagcucugguuauuauuggccagagacugugugagauaccaggaaugagaaauuacaacaaagcuucauuuuuuaaaauugauuucugaaauagaauuacaucauuucccccguccuuuccuccuuucccaguuacccucugucaaacuccucccaugccccuacucucaaguugauagccucuuauuuauuacacacacgcaugcacacacaaccacacacacacacacacacacacacacacacacucacucacucacacacucacucacucacucacauauccauuuuguuguuugugaguauaugguuucaaggcugagcacucugcacuggacagucuguauggaaacuuaucuauaggagaggcuaauucuccucccaguccauaguugcauguagguugaagguuuugaaauagcaaaaggaggcuauaccuaauaaaggcauacacucaguuuguccuugcauggaguacaguaagaaaaguguauaugacuuggaaggaauagcuugagcuucaggaguuacagagagaagucuuugcaucccugaauauguuuaaucuccacaaacuuuaauuguuucauauauacauuaagaauaaaaacacugacaaaaaugccuugcacuuaaaggcaaugggaaaccucuuaaauguaauauaugauucacuuuaccuacugugaaucaaagcagucuuuucucccuauguguuccuuugcaugguggaauauucuucuuuuggguccccauaguaccaguaccauauuuacugaguuccaaagguaaaguucuuuugcuggaagguaucaauauaaauaucaagaaucuguuuggggaugauaaaccaauugaccuguagaaguauuucuggauucuuuuccuaauguuacuauuguucuuucagauaaagaugcuugcccagguucuccacagguuuccuaaagacuuaaauuuucacuacuugcuacauuuagagcuugaugugucuuuaaaacaaauaucuuuagcuucuguagcuauagggcucuuccuauaccugccuaaccccuaccaagaagggcaaccauguuuucccaaauguuaaggucaauucccaaccaagcagaccaacuggaccaucuacaaauuugcuggaugcucacauaggucuucccagaggacugaugagaaaagggcagcaaaauguaccuggaucccuaauggggauuguuuguugguccauuagucuguuguuuaacauucaucuuuugcuguggcuuauugcugaaaucuucaagaauagggggaggacucaagcuguguuuauggcuccuuugauuugggaguguuauuuauguauuauaacgcuaaauugcuuuuuacuggguaccacuguuaaaugaugauuaaacuuagguugguauaaaaaugaauagaugucuauuauauaucucugggauaauuuauugauauccucuugguuucaaugcuaagcuuuuauucuauugcuaaaaugucuguucuuagccacucugcuugcauucuuuuccccuuuuauuacuuuucugacuuuugggguuuggguuaccauucuauucucugauaaaaagaaagauuagauaccggauucucuaccccaccccacccguggauacauugaaauauaggacagaaagaaaccaugccucucccacaauuaaaauguaaaaguuuugaugcuguaaaucucagguugaucccugucaaagaaaaaauaaagcaaaggaugaggagaaaaguaggaagauacagaaacaagagcagucugagccacugugggugauacugacuguguaaagaccuccuccuccuaaauggccuauucuuuuucauuugggggggggggauguugaaugcuggaagacaaugagaccagugcagucaucugcauauguucucugauaucucccuuuauuaauuuuucuuauuggacucaucauaaaauugauuaaauguuucuuaucacuugaaaauucauuagccuuaccuucauuuguuaaaauuccuuuuuuugagauuauaauacauugcaccauuuccuccuucugauugcucccuccaaacccucucauauacuucuccuugcucucuuucaaauucaugacccauuuuucauuaauuguuguuacauaaauuuauguacaugcauauuauauauauaugccuuuacuguuuaaagaauugucacuuguucuuucaucuaaguuuugcauuuucuuuuucccucaaucccauaacugcucuauuucgagcagcccguguguaccagucgcgaucucugacuuucuguuuugcucuugacucccuuuuccauuccuaaauuacauucucacccauuacugucugacuuuccuggugccuauggauucagcucccccucugauaauuccauaggccugucguagaaauuucagaggcuccucaccucuugcccagauuaggugauuagauucuuggucuaguguuaguuucagagauucuugucugggucccugaaccugcagguuuccccgaagcucuaucaugucucuguucccccuuucauuccucacaaacaucuuuugcuacaggaguuagaccucccagugccaagaaacaaccggaaucaucaccaacacccaacauagccagcucuccugguucuucaucuugaacguugaagagagaaugcaaaaggggaaaagaaagacucauuaaauguaauauucaagauaaaaugcaaauuucaagaggcugcaagugaggaugucuauuugggagcuuuacucugccaaaugaaagcagcuaguggauaaaaagaaaacaaaucuaucaguccggcagccaggaaggcuuaacagacaggaaagacauuuccuuguuuuaucuuuucaagccagaggaaggagauuuaauugguuaacggugggaaaacagccaacagucuaggaaggugagagcuaaaacauggggaacuaugcaaagggaguccaaaacuuucuguuccuguuggaaagacagaaaacaaaaaacaaauacaaaguagguaccuauguagcaucugugaguucuuggaucaaaggaaagaucuauaacuacuucaagauguuugcuuuguacugcuuggcuaauuggacaaaugagaaaucaacuuacaggggauugugaaacacuucaguguauaaauauagauaauaguacagccugaaauauauacagguguccauaaaauaagacacugauaacagacucagaacuuugcuuuucuggucugucucguggcauuuuuguaagcuccaguucuuuuccaucagagaugcuccaggaagcacuucccaauucccaaggaugccuucuaggcacuccagagggaaaugcuggccuuaagcugggacuuuuguguguuucuguuuuucuuucuguuaucaacuccauuuucuccugucugguccugcagccuaucccauucucuugaucguucuuuuuuucuuaccugcuauuaaaguguaaaguauuuuuuucuuauuuuucuucaaguggucuucuuccucuuacauuuaaaucagagagagauuuuggaaagaucucuaaagaucuagccuuguuucuucacuuuuaugaugaggaaacugaagcauaugaucagaagaaagguguuugcuaaagauguaucaguuuaaggcaaaccagggcaaaaaucucuggcuucugcccaucaguccaguauuguuugcgcuguaucacccaucucuuucaaugauucugucuccuucuaccuaaaauauucaagcuggcgucugaaguuacuuccugauuugcuuuguguucugauuguagaauucccagagaucacaauaggcacaucauuacuauagauuucagcacacugggcauuaugaguauuuuucugugaagaacagaaauaaaauaggcagaggaugaaauuucaugccaagauaguuuugcaucuguguugccugagaaauauuugaugaggagagaaucaaguauaaauacgcaauugaggcaaagauguggugguacuauucacgauagcaguggugaauagaaacuguuguaacagucugcucucucccucuuccaacuugugcacacaucuaagcauagcaaugaaaaacuguugcucaaaauguguuucaguuacagucaauuaaaggucagcaggcguaauuuacauguaauggauaagcaagaauaaaagcuaucuguugggucgugaggaauagauuccauuucauuugcaaugcaugcugcaagggcuuuugaaaaugcaugaugugagucacuguuguuauuuuuuagagagcauuuucccagguuuggugucucagccuguuacauucucuuguuugcaugcaugccauagucauuaguacaauugaauuauugaaugaccugcauugguacgcugguaggcugcuugauugagucuaucuuuauaauggaaaucagagaacacuuuuauccuuguuagaguuccacuguaucauugauuaauauauaaagaaagacauaaauuucacagugagcuauuuauuccuagacagucuugugaaagcaguuugggugauguuauagaaacuuucuucauaccuuugucaggcugacacuaaugaucgugauuauuucugagacuuucaaagugucaguguuaauuaaaugaaugcuuaaaauauagauagaaaugaacauuuaagugguuuucuuaaguguuugacaguguguaugaacauucuuuuguuaccuaguuacuuucagagaacagauuucauuugauaaggguuuuuccucuaguagcaaauacuuggcuaaguggaugagccaauguuaucaaggucacaauuucacacagauauucagugaguaucuuaauacguucuguaccaaguauuauggaucucuauaauagaagcggccaacaccuguucucaaaaagacuuucuaaucuagugagggauacagugaccaaaagagaaaucggucaaugcacaauauuacagcaacauagacagcaaugggcauuacccaaccacacuugagaaggucagaaaagguguccuaggggaguuguucaccacaacaacaagcaaagggucuuuaagaaauacauagcggguguuggaagacaacagaaccuuagggcuugacuagaaacuggggaauaauacuggaagaagguuuucuuucucugauucagggcccauucaauagcccugauaauauaucuuaagccacccagguccuggaacuuacaugaacucuggaaagaaaggcuuucuuucuuuuuuuuuuuuuccuuuaaaaaaaaaauguugccuuuucuccagcuacuuuggcagcaagaaguccccagcauggcuggaaagaucagccaacucucacugaaccugccuuguacauacagagggaguuugaggagaagggauuugaauguuugguagggccuagacuaguuauagaaaaucaagacaaaaaguaaaaccugguucuaaugaaaccaauucuauaaaaauguaucacugcuuuuagauugcuauuaguggaguguagaacucauuaagagaccugagcaucauuaauaauuuuccuacuugaguuuuaugaguacuguuuucuuuaaaagcucucaugaaagcccuguagaagagcuaauguggaguuuuucaauguauugcccuucgagucucagguucuaguuaagcauaaauugccuacaaauagcuaauugccagcuuccacaggaaaaugugcuuauugucucgggaugcauucacaauuuuaaaaaccaggcuauagccaaucauuauuuuugauaaacauugcuaagaaagauguuaauucaaagagaugacuaaauuguuucauaggcuuuaagguacuugggauagauuuggacaaacucacugaguggagcaagacaggggugcagggggugcuuagaggcaaacucaggaccuuguguuuccuagacaaauggcacaugccuuucucuggagaugguuuugaauaaacucacucauugucaguagcagagauucauauaaugaguucugguguacacuugaggguaguauauccuggaaggaaauuacuuauguuuccuauuuaaauagccccuucuaguacucuucuuuuucucugccuccacccuccuuucauugcuuuuuuucuuccucucucuucuucuccaucucugucccucaaggaaaaugcacaauggaagacagaugauucccauuucauuggacaggaaaagcugcuacuaagugguuugucucuagcaacagauguuuguuuguccaggaagugaagccaaagggaucucuauugccccacgggccacuguuugcauguggggagaacuggaggcaaccucacacuuuuccuuugccuuuaggagagguugcaggaaucaaaguggaaacgcaauaaaacuuucagaagccaauaaauagaaccuagaaggcguucuucucuggggaugggaaggcaccauaugucacuuucauguuuuuaaucuaaaggccaaggcuucacuagacuguaggaauaaggauuuucuuuguagagauuuucauugaaauggcaaaugucuuuuuuuaaacuauuucucaugcauugcccucugaucagaaaacaaauaaguacaaagcaaaaugcccuuaagaaauguuagaaaacauacuguuucuaagaagaaguaauacuuucagcacugggccccugggaaccacuagaacccaggcuauugguuacaacguuccuuucaagacccuuagaaauccuuaguauaaucccauuguuucaacaacaaggaaaugagaaguucagauagaguagaggagucaugagacagccacgacaucaaauaguugggagagaguuaguuaagaagugcccuaaugauuuuaguaaguuacaggauaggauguaguaaaaagaagagaccgugaaaagcaauggcugcuuauuaagugucuuuucuagguggcuucauuccuagcauuucuguguucuuucauguaaccuucaccuuagccucauagagcagagcugcucuccccaccccccgccccacuuuucuggaugagaugcagagaauuggaggaacaacguaauucuuccucuuuaacaagaagcaggagaagugagaccaaacagcaaucuuucuggagcuuaaguuagacaccuugcugccuguccacauuuccaaguauuuaaccuaggaaaaacuccaccaguauacauuuuagcuaugaaggcaauaaauacagagaucaggagauaaggaggcuagguguggagggagacucugacaaggagaacgugugcguaccuagcacagugguaaaguacaagcccauccagguagaaugugucuucuuuggauguauggugggagccagcagaaagauccaugaacauggagguagagggcuuggggaaagaagcuguauuugaacacagagaaucaaaaguaggaagguagagagaugacaggcauguggcagccugagagagagagagagagagagagagagagagagagagagagagagaaagagagagagagagagagauaucuauacacaagaugauggagggauuggggauuguauaucagaugaguagguuaggaaagugaaugacuaggcaauacagaaaacacacacacacacacacacacacacacacacacacacacacacacacacacacacacuccagagaguucuucccaaccugguucacuuucucgacauuuauaugagggauauuuuuaugacaugaucuagaugacugaauacuaauuccuugcugacauacauuguuucuucuuuuguaugucuuuacgaucuuuauugaauuccuugcuuuuugaauguuuaugaugacucauuaauuuggauucccuagccuggaguugauauuugaaacaguguccuaaggggcccuacccaguguccuuuugcauagcaguaauaaccugaaugcuacuguguucuuuuguuaccauacuggcaaauguucaaaucaaaaccauccauucucugauucauguauguuauuagcuccaguuggguggcaagacgugagucagauaccguuuuauauauuagugaagccuagauaagaaaacagagaaugaagagaucgccuuuauuagaaaaagacagcuuuuauuaugucucuuagcaccaugcagugagguuuuaauaaaacugaauggauagagcgcucaugugucuggcuuuagucccccucuuuuggugccagaugcaugugauuucauguuucuagcaagagagaugugaugcuuugucaguuaaucaaaaguuguuaaagaaaagucaauacaaaggaggcuaaucaucaagcugucuuuuccuugugacuguaggacuucugguguguggguuacuuguucucuguggcagcauuaccaacaguaguacuggugcccuuucaguaaauggugagaaucucauuuucuuucucuuccuugugauaaaagacuggagaccaacuccuuggaaaagcuggaagaauauuaacaccagcuauguguaggcaagcaucacuuuuucucccucucuucuuuagguauguucacaguaauucauuucuuugucacacuuguccuccuccaaacccaugucuuugaugccuugugcucauucccuauaaauugacuucaaaaugaaguaauuugauucugcaaguggagcaguggguuucaugugucccuaacccaaacgggccuuugcaaugccaucuaacccaugaaaccaugcuaacugugccuaucaaucuuuccuaaccaagggcacuuguuuggugcaagcaaccccuacaugaugcuaucggaaggauuugcuucuuuauugaauguaccuuuccucgggaagaaacuugcuuagaaaauucucguguaaaaggcuagaugauuugugcaaguugccacacugacauuauuucuagcugcaauauucuggccaucauuugaaaucaauagaagacuguacagccugaaucucacaucucacccagcuuccagaggugauguguucuccuaauacauugcagccccacugcucugauggggccucucaucccccucccccaggcauagauuccaaguugcuuauuuuacaauacugguuuucauguccaaauguucaauuaugaagccuuucuaagacuauagcccagagaacuaggucgcugugugggugucgcacauuuuauuauggcugcugaaauaucuccagagacaaaaauggcaggaugaugggaaaggguaacuugaaauuccuucccaguccuuuauaguuuugcucugagguccaucgaauuuuacgaugcugcaguuggaggggaucauuugauccaauccucuuugcuguauggcugacauaacugaggccuagagagcugggagugccccuagaagauuguaaucucacccuguagcuaugcucuuaauucuguacuucaaaaagaauaguaauuaacuugguucaaguuugcgacucauaagguacauuucacacaaaggcgccaucauucuucuagaaauuaaaaauaaaacaggcccuacuuuuuauauucuguucuguuaacuuauaucaauuaucuauaaugauaggugccacuaugauguuuucauacauaugaguaauauauuuugaucauguucacuguccuuauucacauaucuuguucucuuccugcuuccauuaauaccuuuuuucugcucaacucuuccccuuucuaguccccugugauuuuguguauauaugugaaccagcgaguuucaugaagguuguuuauaggagcacaugcggguguuaaguuuacaggaacacaugugccuugccaguaguuacacuauugaaaaacauugguccucuguccccgugugaaaacucaugcagcacagcugaaguuauguaacuacuuggguuaaaugacaagguuucaugaugguauccccucauuaagagacugggcaaagagagaaguaagucuuggguaugaggaaucaugacugacauuuaaggagcucaucggaagaagaaauuggagagugaaaauagcacacguagagaagcagagcuguaaugauaggaauguccagugcucggucacagagggacaugccuaagaugacgcagagggaucugcaggagaggagucucucagagcuauuucuguuccgaggucacaaugcugcucaauucaccugauuuucucacuccuuucaaucauguucuuuucagaacuuaucucacaagugguucugauuagaacuuuggcuaaaaccaaucagugaaggucuaucugcuguggagggcaaucagcaaaggcccaagguauuggucagcaaggaugucuucauuuagauggacaguggcuaaucagugugacugaagucacaaucagaacaaucuugcaacagcacugcugccuaucaggugcacugccauucauacaaucuuaggaauggugugugguugaauacaguagguuuuuauuauuuccuuacaaaaagauuaugaaaaugaucuaagguguguuuuaacauuuucccucuuaauucaucauuuuguauuccuucagccaguaagaauuuacuugcagugaagaaaauaagaagcaaaguugacugguccugacauccuggacucuguggugaugcccuuguagucugggaaggcagaaauguuacggaguuuggugauaagguugucuguaagauuacacaguacucugcucuaauuuuauaugccauggauuucuagaaacuuucaaaucagacucgagucuaaauuguguauaauuugaacaagcucaugaaaaguaagaaguuauaaaaaugaagcacaggcgcagaauuuguaccagggaagagacaaacaguaaagggcuucaucagacaguggccauguguguauuauuguuauuuuauuguuggguuacaagagcucucuauauaaucagagcaauagacccuuaucagauaaaugauuuuaaauuaugauuguagauugucuuuucauuuucuuacuugaacaauuugaagcauaaaagucuuuaauuugcauacauccacuugaucuguccucuacccuccuccccuuaguugccaucgauaaggaaauagugccagauuuaagacuacaaaaauuuagaucuauguguccucccacaguuuugauagagauuuugaacaauuaaaugugaguugauacugacuuugaguucauuguuauauauaauguguguuaguuagcuuuuugucacugugaccaaacacacgaacaaccuaaagggaggaguugucuaauuuugcugaugauuucagagguuucaggucauuucagugccugaggugagcaugauggagcagcaaugcuguguugaugguaccaggaagagagcagcuacaugcaguagcuguagauucaacuuggaggcucacaaccauguggagccucaguccagggaauccaauauccucugcuggucuucuugggcacuagacauguaagcagugugcagaugugcauccaaacaauacaucuauacaaauauaauaaguauuuaaagaauaccucacauguacucaauaguagguuuuguugugugcuguagaugucugugugaucuccuuagaauuuuguucuuccauuuccuuguugcuuuucugcuugguuacuccauccauuauuuaaggagauaauggaaaacuaaauauuacuguugaauugacucuuucucccuuaaaauuuaacaguuuuccuucacauaacuuagcuccaguacauauacgcuugcguuaucuuuuggaugaguugacacuuuaaucuuuuguugucucuccuaauaacuuccgucugucugaagaguaucuuauuuuauauuaccacagcuauuugcuuacagaugguaaugcuugaaucuuucccugucuuuuuacuuucaaugcaaauuguaucucuuuguaaaaauauagacuuauaccauguuguuuuggauucagaggauucaucucuaccuuuugauuggcacauucaaugcgcauaccauuaauauacuuacuggucaaauagaauuuguagcucucauuuugcaaacuguuuuucuaaaugcuuuauaccuuauuuauuucuuucgcuuuuaacuuuuaccuucuuucuguuaccaguuuguguucuauauuaauuuauauaaugaacauguucucuuauggaucuggcuauagcaugcagcuuuugcuuccaugugaucacuggcuggaaacgcuggcaagugcuuuccuuaaagggaggggcuugcacauucaguucugaggaaaugccugccaguauucaaguugaagacauucugugugccagccuuccaacuaaaaacaguguuccacaacaugaaucuuuaguucauaucauaacucaaugguacauguacguugccuccgguugacuaucauaccucaguaugugaugggaguacauugaauauacaucccauuucauuaugcauguaguauucaaaaagacauauagucaagggucaauugaguuuuacugccuguucaauuguauucuuaagugagacuggcuauuuuuuaaggauagugguuggcaguaaaacuacagugacuugcaguuucaugucaccaccuuuacacaagcuacagugccauuacuuuacccaucccccacccuagagcuugcaugcugucauugcagaaucauuugagggaacucugaaucuuaaacccguuucagugcuuuuggauacuucaauacuaguagugccuuauccuccccaccccaacacgcacaugaagauuucauauaauagaccuuggaagaucaauuacugcuguaaacaaauaaauagcaacaaaauaguaaccgcagcccacguuugcggguucauucauuugcagggugaaaguacacucuguggagaauauauuugcuucauuuuuacauuugcaguucagacuuuagucucucucucucuccuucaaaagcagcaagacuucaucuacugacuuuuuccugagcuggcauggagcagugugaacccugcugaguuuuauuaguuuuuccccuguuguguacacuguucuggcaaauauaacacagugaguuaucauuucagauauuucauugacuuuuacaacucuacuuugaaaacagugaacaguuuugacuuuuagaaagcucauaacauuuauuuuacauauugaauuccauuuucuuuaaacugagaaugauugaauucaagauaccccuacagcuuagcuuggaagguaauaccguucuuaaauguuuucuuauagaaaacauaauaacuucaauuacuuguauuuuaauauauguguuuauucuuugagaaucgaauacaauguauuuugaucauauucuuucccauccuacaacucucccuagucccucccccuccucccuacccagugaacuucauguucucucugucucccgucuccauacauccuguauucugaugaucaaaccuaguuauucauacuagaauaguggucuacuguggaccuacaucacucacccccauaacuuuguuucuuaauuauaauuguaaucaauauauuccucucuucuaugacaacuuuuuuuuuggauaaaggaacucaauauguaaccaugguugucuuacaacuuucuuuguaggccaaacucacuuugaaaucagagagaucuaccugcuucugccaccuaggugcucagaauaaaggcaugagccucuauaguaauguguuacagauacguuuuagaaauccaguauuauugaaaaauaaacuacagauguaugcauuuccacacagauaaacugaagguuauaaugaugacagccagacagugcuacacaccuuuaauucuuguauuuguaaggccaaugcaggagaauguugaguugaaggccagcacagaacauacaaauggccuguacaacaaguugugucugaguuugggaccucaaauuugcauuucacacaaguccaugaagacaacauugcuacuuguuuuaggaccacaacuuugagaaucucugguuaugggucuuguuacucaucuuagaccacagccuaagucuacugaauagacuucuaugugacuaaaauuccugaacgauuuauauuuauauuaaaguuuaagaaguacacuggaagcaauuuaaaagagacacaacaacacaccagguaugacuguaagaacuccucugaauggaauuaauaauagcuuuggauguacuugaccaucaaagccaggacuguggcacacugaggcaggcugccaaagguaaguaggcccaacuuacauaguagcuacacaauaaguuagucuagauaggaguggcauuaccuuuggauccauuguguuacuacauccuugucuugcagucaggcuuaggaggcauugccuuugccuccauuuuaaagaugcugaagcuaagagaugcaaggaaauuaaauaucuuuucugauguguugaaauggucagaggaugagcugugacuaaaaccccaggcguccugauuucaaauaguccuucuuacucuaauauggugauaugccucaaauuaaagacaaucugauccuuaggacauucagguuuuuuuucccuccucuuagauuccaauuucaagagaugacuuauauaaaauguucaacuaaugccaccugauuucuuaaaauagcucgauuccuaauacacugcaaauuauuagagagcuuuuacuuuaauggccuggcaauuaauaaugagucacaguaaaaugucugugggguaggggaaaaaaaaacacauuggcacuagggucuguucauuauccucucugcucuauauccagaucaaucaauaguuaauuaauaaugaugugcuuccucaaguacaagguuauaaauuaauuuaaugcucauaugcauaguuucuguacagaaaaugaaugggaaaaugccugucaugcccaucucguuguauaaaaaccguauguaacaauuacccacauauaauaagaaugguuggcuuagccaaauguuuguucuuuucuguucgucaggauucauuugagcuacuuccaugcaguuugcagaagcagugcaaucaguugaguagccuggcagauuuaaaucaguaauaaaagcccuggggaaauuaacaagacaaaacguuaaccacagacuaaacauuaacauacauuagcauuuuuauuauaccugcagaauuguuaaguagguaugguuaagacuauuuaaaaguugaucauuucaauguauauuuuguuugaaaccuuuuaagauuuaauuaaacauaaguguaccacaacacagaauauaguuuaugagaagaaagcuuaguguuuuaacuauaaacuuuuagaauucucauccucagucuaagauacccccaagcaaauuucauggacaauauuuguucaaaguaguucauaagagcccaguucauauuuaauauacauuauccuacaggaaaauucauuuugaguucuucuggcuucuaaugagucagccuauaagcaaagacuaaaguugacaaauauugagcaacaguucucagaaaauauucauugggaccacaguuaucagaccagcaaaaaaagguauucuauaagccacuaaaacugcagauaccuccagaggcuaaagagucaugguggccucagggacagcuccuuaaaaaagagauuacucugaucacagaguccagaacuauagccuucauccccuggcaaauucucagguuuccaagggcagugccauucagucacccauaaauuuuugaucucugcuuauuuuuucccucuucucucacauucuuuccuucuuuuauaaauuauuaucuaaguuagaacacauacauuuagacaacccauacacaucuauaucuuacauugcagauuuucugucuaggguggggcagaagugaacggcagauaucucccuuaauaguuugucaguuuaauuuuugagacaggaucucuuggugaguguacugcuccaucaguucaauuaggcugacuagccaaugggcuucagggauaugccugaguacaugucuucuaacucuggggaugcggucaacagguuucaugaggaugcuagguauccaugugucccuguucuugccaucacuggcacuuuagugauugagccaccucucuagcucccauuuaauuucuuaagaaauaaaaucuaaagguuccuuaggguuagugaagaaugagagacuguacuuagggaaaaaauagccuuaugcaacccauuaaaauaaaaccaaguggauucagggccagcaagauggcucaggggcaaagguucuugccucaccaacccccauaaccugaguugcaucucaagaaaccacuagacaaaaggggagaaauaacucucacaaguuguucuuaaaccuccacauaugugcugugucacaugcauacaacuucacuacacaaauaaauacucauguauaucugacuucaacaaagagaaggaggagcucgagaaauauauauauucaugucauaacagcauccuuagcuccaguuuuguacuuuagacuaugacaguuaaagcuucagucugcugacguuuuguuaucauagggugagcugggaaucuccauuugggauaaaucuacaggauacacuuuggccagauaucaggcuagaguaaguuaaaugauagaaauuuacaaaagauuuuuuuggcugaaucaagaaccuaauuucuucaagagcaaggguccagggacauacuggaggcagcagauggugccuucuugggagcugucucgucaauggaacuugacacccaaugcuuuaguauggcugcuaauugacucuuaccuggcaagccaaagagguuuuaaaucaucccacuauuagcuacuauuagaaaccuugccugagagcuagauuaaaauuggaugcccauuuucuguuugacuuaaauaacuguaccuuuuuuacuuuauuuuuuaauugguacucuucucacauuguggauaauuuuuuuuuacaagauaucaaucagauccugaccaaacccaauacugggauaccccugaaccuguguuguugaugagaacuuagggcacagaacaguccauggaaaauaaaaauauguuuugaagaaggaaaaaccaguguaaaaaaucccagcucugccuuuugcuagaacugucuuuaucaaaagccuaagaauuuaaaaucuuuuuguuuuuccugaaccuaaagcaaagucacagaauuuuuuuuaauuuuuaauuuuuauuuuuuaugugacuuugcuuuagguucagggaaaaacaaaaagguuuuaaauucuuagacuuuggguaaagacacccaccuauccaauaaauuuauuucaacuagccaaauguaaaaguggcagcauucucgaccaaguacauuacucaggggauagaaauuggauugcauuucuuauuuaagaguuuaaaacuccuaggcaggcuauugauuuccaaaacaccacuugagagccuggcuucuuucaugagugcagcucaagagugagaagcugaaaggccaucuuccaugggaaugccacaucucuuuaaguuaggauuucuguuagugucaguucucucaauaagcucaagauauuugccuccaaauuagagaguggagaugaaugaugguuuugguguaccuuaagugggagugggccaucccuggcaaggcaaaggcuuugugugagagaagaauuggcuucaugguagauugcuggaagaaaguacagccugccugauaagguaugguacaucuuaaauaggagcuagaggugucagcaagaauccaucauuugucuuuuaucccacacaaugccuuggggacucuuguugauaaugccagacugggaacuugggaggaaagaucagacuacugauuggauacuuuguucuuugugcuuaaacguccuacuuuugcuucaucugcuccacaugcuaguaggcuagaguccagagugggaauaaauacaaagucauguucugguccaauaaaaauucgaugauacaaaggaucaauauuccuuggaaagggucaucuuacagcuaaguuuuucaacuagacagcauaauguaauagauuuucauuuggguguuguaucuggcacacauauacuuaaagagaacccuggucugggcaccugaaugugauugauauuuugaacccauuaaaacagacccucacauugaucuaugcucaugacauaacauauaggcacuugaacccaaaaaaaaaaaaaaagguuuaccugcaguuuaaaaauaguaauaagcauguauuugccuauggacauaaacuuacaauguacagucugccaguuauuugugucuacagcauaugcuuucaaaaugaauagaaaccaaguccuaaguacaguuaggcagccccuagccuaaaacaccguaccagacucccgagguagaauggauucagagacuguagauucuuuacauagaguuagaauuagcccaagucaaauagcauggcauaggcacaugcaaagaugucaauaucugucaauaugucagauggaguacuuccuaggaucuucaguuuguuuuccagguuaggauaaaugauugaggagagccaguuugaacauaaauggaaguaauucugcugcucauuuaauauguuuucuaacucaagaauuugugugggaagccuuccauugcuaugcaaacuaaaugacauguaugcgucuuugcacacauagauaauccaguaaaugcuauugggccauccugaaauauccagaagccaggugacuacacagaagcgaugguuuagacugguauuugaggcuugguauaguaaauagaaaaucccuucaauucacuuaauuugccuacaagacuauaaagucaacucugugaaggcauggaagugacacacaaucuguuuucacaagaugcuuccaauacuuucccggaacuuuacagccuauacauucaccugagcuguguuagucggugaugugccauugaagguugguaaucuuuauuuccaaaauaaaauguaaacaaauaaauagcaggcaucauguuguagggaggcaguauuguguuaagguuagaagucagguuaaugguuucaaagguagucaaaagaauccgcugucuauuugcuuuaggcaagucucuuaaccuccuugagccucaauuucugcaucuacagaggugauauuauuuaacauagugccuggcacagggaguaauauaauaaagaugauauucauacuuauauauaugcaauuuauauggaaguuguuuuaggcauuagucugcaaguaauauaaucacagaaauaaguuagaauggagcuaagcaagcaaggaagcagguaucuuauuuuaaaauucuuugccauguaggugugaaggaaguauccaauaaauguuuuugaauggcugagugacaaguagcagaaaggaaggagggaaucuggcuuucuuaaguaccuuugcucuuuuaaucaaauccugcaguuauuuaggugauacacagcucacagcugaugauacugccuauggguggguuguugugcuugcuucccucauaccuuuguaggacaugcacaugaacaacuauacugacaguuuuccaaagacuuugagucuaauaagacacacuuguaagaacugggcacacucugugcccagaaggcugcucuucuaucaagaggccacucaaugccaccuccaaaaccauuccaucucccauuucagauggucucaauuuucuaaauugccuuuugugaacuucuacauacguacaaacaaacaacaagugccaucaaaagauaucagcagugucaggacuguguuuucccuuucuacuuaagcaucugaguagacugcacucagaaugguuccauuacucuucauccaucgagugccuucccuuccacuucugguucuuugcccuaaaacuuuauuucaugauuugacucuauuaaugacuguucucuuugaaaggaaauugagggaggaaauuguaguguauuuccaaaucuguuucugccaucauauccauggaaugauuguacuauuauauuacaucucucucucucucuuuucagauuggcaaguugugugcccacucccagcaacgccaauauagaucugcuuauuacccugaagaucuguuuauugacaagaagauauuaaaagucgcucaugucgaacaugaagaaaccuuauccagccgaagaaggugagagaauugccgcccgcccccccccccccgccgccgccgccauuucagcauacaauuagccauuggauuuucaggacaaaaaucauugaaguuucuuacauacaugauauuuaguuccucugaguaagaugcuuaauuaagaucuauaauuugucucuguuaaagaaaacugcuacugguaacuaaggcauauuuaaguguaaacuuuccagguauaaauaucuaguugggcaacaugggguagagugagcuucccuaaucaggaccccuuauuuauuuaaaaaaaaccaacauuuucuacuuacaagaucuuauaguucaaugaucuaucuuaugguuauucucauuauuaccaguaaguucaccagagggagguuagcgagacacuaugaacauacaugaaacauuuuacacagaacugagugugucuuucauaguucuuaaaacaucagucaggagccaaaaugcagguucucauccccuuucuucccauccauccccacccuuacucagguucucuccaacuauauucaagcuucucuggguuguaguuaagagguagaaaucacauuagaagccuagcacaacacuuaagaaaaucaugcuacccaaagaauuguccuuaggaccaacucuguuguuuagagcuguuuuugagcuugaaggcaacuuccaaauaaaugaaaugauaauaagagaaaaugaaaaagcuauagguuuggauuaauaacaagauucuuuggggugaauguuauuagaaggguuuccuuuggaagaauguuaguaccuguauacauuucuuacuaugaucaguucagcauuucauacgcucaagaaaaguggauccaaccuauggacagaagcagcugaccucugugguugaauuagggaaggcugaaagaagcugaggagaagggcaauccuguaggaggaccagcagacucaauuaaccuggaccccugagaucucucacacacuggaccaccaaacagacagcacacaccagcugauugaggccccaacacacauacuguagaggacuucugggucugcguucauucagagaugaugcaccuaauccucaagagacuggaggccucagagaguuuagaggucaugugggguugagggugaaggcauccacguggagacagagagguggugaggaggugugggauguggaaaguuggaggguggaggggggaauaaaauauggaguguaaaaaaauuaauuaauaaaaaggggaaaaaagacgggcgugguggcucacgccuuuaaucccagcacuugggaggcagaggcaggcggauuucugaguucuacagagugaguuccagggcagccagggcuauacugagaaacccugucucauaaaaccaaaaaaaggggguggaguaaaugugcucaucuaucagcuucaacacccauacccaagaucuaucaggcuuuacaaacagaacaauuagaagggaaugcuguuguaguguguguggaaguugcaagcaagcuaucugggucugauuauaaaucgaaaagaccuuugcuuuauuaaaguaacagcacacaaagaaacacaggauuccuuuggcaguauucagaaaucaucuguuuguuuugucugcccccaacuggguacuuugcagcacacaguuagucuuagaaauagcguagcucuauuuaaaggcaauuuuauacucgacugguggucuguguacaggaaugaaguuuucuuuaaggaauacauguugaaaauaucuguugagaaauuuagaccacggaaggcagaauacugugcacucauuaugcaucaaaauagaagcaaucugcucauuacagcccuuuccaccacugauauguucaaugcacuuggguuuucagucucucccucuuuguuccucuuaauuuguccaucaccuaccucacuugugauacugcauaccugguccuuugcauagccuagauacuguuugguauaacacaugaguaauaccuuuuacuuuucaaauccagaauugguaguugaauaguccacccagaacccucacaccaagcuucuggcgcaaaugucaaccugugguaaagccccuccacccuuguggaauucccuauaaauauuggagccuccugcuuccuguaauuuccaucugacuuagucugaagggucaauggauuaggaaccacuaguaagcuacacagggggaaaaaaguagaaggugaugucuccaugauccaaaccugaggcaaauuccugccuccucucagaccacugcucuaaguuuugguaggcagccuuguaaguucagguguaucuuucagucuccgcuggaagcaauagaauauauauugaaugagccaguauugaaugagacauuauccuaccccacauaagacuuuagaauaaaaagccuucaaccauaucuacguucaagugcaagacuuaggguaugaugaguaaaggaacccuacccaguccaguuaaggagacagacauacaaacuaauaaugucuuauauugaauuugagucaccuaacagaacuaccuagaagacaguaacauugucauagauggaaggauggaucacagccuuucugggaggaucaaaaauggcuacuuggaucggguagcuuuuaaaugcagccuaagagauaagcaggaauucaagugauaaaggacagaagggguguuucaggcaaagggaaugggaagagaggaagaaugauaguaucaguagcaacagaaagauguaguuuguggugaaaguggaaaagucucccuccauuagaauuaaguaugaucuugcaccauucaaauuugacuugguuugguuuuuguccuuuucugucuuuucaauuucaaaacaaaacaaugacaucguauuacuuuacauuaagaaaaaaaggaaccgggcuggagagauggcugagugguuaagagcacugucugcucuuccagaguuccugaguucaauucccagaagccacaugguggcucacaaccaucuguaaugagaucugacgccauucugguaugcaugaagacagcuauauaguguacucaaauaaauaaaaugaaucuuuaaaaagaagaaagagagagagagagagagagagagagagagagggagggagggagggagggagggagggagggagggaggaaggaaggaaggaaggaaggaaggaaggaaggaaggaaggaagaaagaaaggaagaaaggaagaaaggaagagaccuuacugagaagggggagguucagaaucugaggucggggaugaaaggcucuguuuaaauugcagugcuuuccaauuagcacugcuuugaugccugcccaaggagaucaaugugagaaagugaaggcagcccucuccuccacaucugaaauuggggaugcccucccuggaaugauggaugccccuuuggaaaaucacauucaccaagauccaauacuuucaaauggcucaggccugcaaaggaaccccauccuuuaguuccacauuucacacacuaaaugaaaauuucuaugaaaauaccauuuccuaagcugaaaugcuguaaguaaauguuggaguugucacacgugagagccauaagcuguacccuuucuaugucaaugacaugucauauuccuagauuagaaucaaaacacauuccuuugaagucaaauuauaucuccauucucagccgaacaggcugucuuaguucauaaguugucuguauggaguaccaacacaaagacaaaaaaucugagaaaauuaacaugccaccuaguuucaagggucuuucauuaaaaaugaaaaauaaaaauagucaacauauugucuuuuaaaauuauaugcaugaagaugcugugaagcuucauuuaagaaaagauaaaaauaaaguauacuuagcucucauacuagaacaaguuugagcagagguaacagaagacaaaggagaggagaaaugaaacacagcaaacaggagguaaaugaguccugccauacuuggcuaccaaggugucagaggacauuauuaccuguugucacuguucuuuggaagcucauugacucucccaguuuacagggucuuuuuucuaccuucaaaaguaguaugacugcaucuguuuucaaggucaaauuguuucuugggaaccauggugauacaaaagacauugcaaagcaauaauccaguacucuaacagugucuuuuggggcucugagggauuggucaguauaguauauguccuaaagacccagucuuaauucucuaaaagacagauagcauuuugucucacaaagcuagagagcagcuuuauuugagagcagcugauuugugacauuaaguucagggucuugcacauucuagguaggcgcucugauacugagccacaucccuagccucuguuucauaauuaugugauuucucuauaaacaaaaucuuagaauuuauacucuaagaaccagaaaaaaaccuaaugauaaaucaaccacgaacauaaggcaguauauccacguaucaacauaguaauaguaucucuagguaguagcucuaugauuuuuuuccuucuaccuucuuuuuguuuuugguuuuuugguuuuuguuuuuguuuuuguuuuuguuuuuguuuuuguuuuuguuuuucgagacaggguuucucuguauagcccuggcugaccuggaacucacuuuguagaccaggcuguccuugaacucagaaauccgccucccucugcuucccgagugcuaggauuaaaggcgugcaccaccaugcccagcccuucuaccuucuuuuauuuucuaaauuacucaaggugaacaugaguugcuuuuacaauaauaaaaucaaaagacuucauuuuaaaagaugaaggaagaaaaggacagaaguaaaguugaagcuuugccuguuaucucagcuacuaagcaggcuaaggcagaggcaucagaaguuuaagaccugcugggcaagauuuugcaccagucgggcagugguggcgcaugccuuuaaccucagcacuugggaggcagaggcaggcggauuucugaguuccaggccagccuggucuacagagugaguuccaggacagccagggcuauacagagaaacccugucucgaaaaaccaaaaaagaaaagaaguuuaagaccuguuuagagaauuuagugagacuuugucuaaaaagccaaaagagagugggcaugcagauuagugguagaacacuugcaaggcccuagauucaaucuccagugcccacccccaaauucuucucauuucagaaagaacuuacuuaugcuuaugaauaugcaccucaaaggacgugcggucuuaaaucauguugcacaaguguguuaccuggauguugaaguuuaaaaauuauaaaacuuauguagacuauaucauuucauauguaauacauagugucccucagauucaugauuauuggagaaugggucaugacuuacauuaugaagaugacugauuaugugugugggcacuguaguggugggaguuaacaagguaaucaacucacauucauuguccauugaaucaucacagcaaccuugugaccuagaugcuauuauuaccuucauuuuaugacaaaggaaaucaaagcucagacaaguuugggauguaccuaagguugcauuucugcguaaguaaaaccaaguuagcauuuaaaacucagguaggugagaugccaaaacccuagcgcugagcuacuacucauggaacauuggaagggacugcucugagaacccagacacaaugauaacaugguugcuuagugaaaugguguuccaaguugacaaugacuaauucuaaaggaaguuuuaaaaggccacucucaugugucccuccucguugaaagaagauauauggagcaagaugacuguuucucuucaagcuucaaaaccucucccucaguuccagaaaccaucuuagguuuucucuguguguguguguguauguguuugugugugugugugugugugucugucugucugucugucugucugucugucugucugucuuagguuuauugcagucccuugucccuuugacauuagguagaaccucaucuggaucuuccuccacuugucaguuaucuuuaugagcagcuaagaaagcuucaaggguugaaaggcaggggaaaagucaggaucccuucguuuucaacuucuagggauaucaaauuggaaggcccuggcauggguuccauuuuuauugcccuguuccauguuuguaagaguguguguagagguaggaagacgccuaaaggaaacucuuucauuaaaaaggacaucuuuuccccuagacugaugcccacguuccauuuccucauggaguaggggaaauuucucagccuuagccuuuagucuuugagcuuucacucucgggaacuggauuauuaccuuguaaaacagagcaucucuccuauuagccauuaauugaacccaucuuucuccucuugagaaacuguaguguugacuuuuauuuucagagcucuguauugagccucuuuuucuuggagauugacagugcucagauaucaggcauagccaggaugugagcaugcgcacagcaggaagcaaguauuggaguaucagucauuccuuaugucccauaagcucuucugguuguuauguccaucacucuggcuucccuuugacccaagcuuuugugggcauguacugaaaauuaucucuuccugucacacacacacacacacgauaaaauaauaguuuuaugguaaauacaaaaauaggaugaacugcaagaucauuuccccaagucuuccagucucagcuguaucugagaacauugcugggcucaugacuucuacuacccuucaaauggaagucacaccuguggauccuccuaaggccuaugcaucaggucacuccauucuuagccuguacagaguguugaauaauugcuccucugccagaaaaagaccaaacuuggacuuaaacagcauuguugcuuucuaucacaggccauuguuuugacuuuuuaaaaauguguguuuauucuaaguaucugggcuaauauccacuuaucagugaguacauaucaugugaguucuuuugugauuggauuaccucacucaggaugaugcccuccagguccauccauuugccuaggaauuucauaaauucauucuuuuuaauagcugcguaguacuccauuguguaaauguaccacauuuucuguauccauuccucuguugaggggcaucuguguucuuuccagcuucuggcuauuauaaauaaggcugcuaugaacauaguggagcauguguccuucuuaccgguuggaacaucuucuggauauauacccaggagagguauugcuggauccucagccaccaaaugcaaacacuauugcauacaccagcaagauuuugcugaaaggacccugauauagcugucucuugugaggcuuugccagugcuuggaaaacacagaaguggaugcucacagucagcuauuggauggaucacagggcccccaaugaaggagguagagaaaguacccaaggagcugaaggguucugcaacccuauagguggaagaacaauaugaacuaaccaguacccccagagcucaugucucuagcugcauauguagcagaagauggcguagucugccaucauugggaagagaggccccuuggucuugcaaacuuuauaugccccaguacaggggaaugccagggccaagaagugggaguggguggguaggggagcggggggggggggaggguauaggggacuuucgggauagcauuugaaauguaaaugaagaaaauaccuaauaaaaaauugggccgggcauaguggcgcaugccuuuaaucccagcacuugggaggcagaggcaggcagauuucugaguuugaggccagccuuguguacagagugaguuccaggacagccagggcuauacagagaaacccugucucgaaaaaccaaaaaaaaaaaaaauuggaaaaaauuuguggauaucuauuauaaaaauauuuaaguauauuucauaaguauauucauuuauauaguuugauaacauguuauauauucauguauagccgaaacaagauaauaggcaaaaagucuugcuauauuuuauuucuguauguuuaucuacuuuugcauauuauaugugcuccuuuuggcucacuuuuauuaucauaaacagcauagaaaugaaagcaaauaaaucauaauacauacuacuacagcccuuuccccuuugcucugugucacaagaaaaauaguauacagacaaaagaacaaagcaaccuucuuccucuuagcagaugggaguuucucuaacuguauaaucaggagaauuucauagagcuuauaguauucugagcacccuaccauuuggaucugcugccauuagccagagccuuuauggaaaggggccaucucuaggguaauagcauuguaaauuacaaucaauguacucaauuacgcucagaaaccaaaagcuauguagugcucuggugugccuuguaaucagcaccuuugagaauguagguaacagcauucugaauggggggaaaaaaaggaagcugcuguacgugugagaaaauggauguuggaauuauaucauccucuugauaggaacagcaucuucuguggaaggcaaccuucccccaccccuacuaucauuuuauugauuuuuuuaaagcuaaauuguggccuuguagcuaagaaugucuuuaaaaucauuuauugcucuaaucagccuggcagagcuuuucugucaugcugauaaggaaauuaaacuuuucucauacugugcucacuugccucugaugcacagauguuuuguuuuccuuucagggaacugauucagaaacugaagucuuucaucaacuucuauagcgcuuugccgggcuacaucugcagccauagccccguggccgaaaaugauacccugugcuggaacggacaagaacuuguggagagguaaucuuuugugaaaguuaguuauguguagcaacauuugacaacuaaucauauccgaagauugauuaaauugccuuccuucauuaacuucauaggaaaaauucuccacauaacauaccuauaagcauuuauuuaugaugguccaaaugcuguauauaacuuguagcucucagagaauuugcucauuuugaagcccaugaagaacugcauauucagggauauuugacaaaguauaaagcauauggugaacuuuucuccgucuucaguuauuuucaucuugucacuagguggaccauuauuccuucuauaugaaacaaucauauucaugcugacugcucucaguuauugggagugaacuuugcauuacacaccaugcuaaguaauuuguauauauuaacuuucuuugcaacaauccaauggaaugaaugcugaaaaugaagaaaacaagaaagggaggggaaauaggguaccauuugcugaaauguuugcucauuuaaggacuuuuaguauaaucuauaguaacugucauaucauuguuuauaaagaauuugcucaucacugacaagaaaagaauauauucauuuauuuagcaaauguugaacaccuuguuaagugccaggcaucuggaauugagcaauacagaugagcaucuagcaggucaaugguucuucaucuccagugugccauguauagaguacuagcuuguaauuagagugaaaucuacaugauagaaugcuuaggagccuacaaccugcuuuuaaagaugugcaaguuuuguaagcauacaaagaggagaguauaaaagagacuuggaauggaauucugagucuuugcccugacugguugcuuaacuuauagaaggcaaccugaucucccuaaaccagcaguucucaacgugugauucacaaccccuuugggggccaaauaucagauauuucugcauaucagauauuuacuuugauucaugacaguaggaaaguuacauuuaugaaguaacaaugaaauaaauuugugguagagggucacaugaagaacugauuuuaagugucacagcaucaggaaaguuccacuaguucugcguguuuuucuuucguuguucaguccuucauacacucaaaauuuauaauuuucuuugucuuugucuuugccuauuguuuaauuuuuaagaacuucaucuauccuucuccucuuccuucuccuuugcuaucuccuccuacguccaauuccuccucccaauuuuucacuuguuuuaucuauugauuuuuuauuaauuuuuauuuuaugugcaugaauguuuugccugcauguauaucugugugccacauauguucuugguacccauagaggacagaagaaggagucagaucucuuggaaguggaguuacagacaguugcgcacugccaugugggcucuaggaagugaaacuagguccucugaaagaacagcaaauucuuuuaaccacugaguuaucucuccagccuccucuucuuuaaguuuuauagguagguagguagguagguagguagauagauagauagauagauagauagauagauagauagauagauagauagauagauagauagauagauagauauuaaucugaucuggugcagcaagccucugaucuuagaugcucuggaguuugagacagaaagcucagcaccugccugaguuacagagacacuacauguuaaguacaaagcuagaugcuagggauacagguaaaagacaaauucauguuacuuccuuugaacagcuuacauuccaguggacucugacucagguuggugaauaaaauguauuuacaauauaguauaguauaacagacacgggaauauucuggcggcaaaggaacuuguuugcaucuuaguucuguguguugccuuggcacagucagguaaugcagaaggucuucagguccuuuucuguaagggaagggcauuuuacaagguuaccuugacgcuaaaguaaggugaagcuuguaaagugccccuuagaagacugguacguacugcaagcuccauucaugucucaucucuuuuucccugccuuuuuccucuaacucuuuucuuuacaaugcaagauaaaagacaugcccccaaacagcuuguuucucaucuaaguaauuuuucuaacaugagacaaaagaaggagauuucacgccacccuagaugauggacugaacuuguaugguguuagacuccuuggagaaaauaugaauggagcuagaaagauuagugacuccauguagcauccucaugcuggagaaacuauguuuauuugucaucuugaauggucaagaguauuaagcagaaucauaaacauguacuuaacuguuaugacaauuuuuaauugucaagaaaaaaaaggcaguugguauuggcuuuauaaaaagcuuauacuuuaacacacacacaaaaaaaauauauaguacuuagaaaauucccacaagccaaauacagcucuuaucuaaacuugaugagcaaacacccuagugacuuguuccacugcuaugauagcaugaaaagaaaaaaagaaaaugcauuccugaauaugugauaauaacaauggucccauauuaaaacaggcauuuuaauuuaaaguauauuuaguaaugugccaguucauucauuuuacucuaaugugugagcaccuccuauauaucaagucccaauauuguuuucuucauuauuauaauuuuuaaagugcauguaacugcaccacaugugucuucuaauguuucaaggaaauaauuagaaggucuagucugaacuuauucaaaacaguacauuuccaagguguuugaauaagcagaauauuuuuguuguguccugaucauauuaacuacuuucauagaugguagacacuuaugaaggaugcugccuucaaaucaagaaaguaaaaagaaauuuuuguaguuuucauuuuaagcuuuagguggguuuuuuaacaugugcauguuucauuagcuuuucuguugcuuuuaucuuauacgaaugaguaugaaaacuaggcgaacacauuuuugugggguuagcuuguuuugcguagugcugguuaccuggcacucauuuuguagauuagacuggacgggaauucaagagaaaucauccugccccccccccacccccgaaugcugagauuaaaggcauaggccgcaccaccuguccauuuuaagaagucugucaacugaaaacaauugcaguccagaggcuaggacucagagccucauguaugugaggcaaacauuuuaccacugaguucaaauaccaagcucuuguuaguugaaaauauuuucauugaguuuucuuuccuuuaaugccuucauguauuagaauaaaauaaacacuugaauauggagaaaaguuacucuaaauucuuauuuuuacaucugaaauauuuuuuuucuggucacagcuuuugugucagacuaucuaggaacaaaagauaaaaaggaaggggggaagaaauaacauauuugcagacagaauaaggcuaauauaaaccaggaagcaacucaucuuugguuaguaaccucgggugauaauuaaccuguucuuguaucagugaccuaaugcgaugaugagacuagggaauagugccgaagucaauuuuuuaaaaaacuccucagaaauguacacuuaaugauauaaaguucuuuagcccgaagacaugugugcccucuauuuaugucauuuguaaagauuagcuuuucacuccugucucaucugcagugagaauaucuuuuacggaguuucuuauuuaauuuagucuucaguagaagucuccacuuauaguaccacugcuaucuuuauagauucgguuucuauuccuuagaaacgauuuuacuuuuaggcaagagaauuuaugaaaaugaaaaggccugacagagaaugagacuuggucauuggagaaucauuggagaaucauugaucaaauggaaaauauagaugcuggauauccugagcaaugguucugucugcugaggagucagugcuccuaacuuuccgggcauagccaccucuccccuucucaagaauuaagggagucguuuucucugcagauuccuuucuguuuuuaucuccugaaugcaaucaauggaaggaauguuuucccagacccagucucagugaggggcccuuuacaccuaucauucguucuucuuacuucuccaauuuaucuuuauauaacaugagauuucaggauuaaacugagaagucuuugaauuaacaaccuuggcccaguugagccaccuauaauugcagaaagcagaauucuuccagcuuuugucuuugugagacagaauuacaauuagggacucacggagacucagagaaaaaauaaacaaccccaccaaauuaacccugggauuagcaacagauaacucugggguucuacugcauugucccugaaaauacauaaauggagagccaaauuguccagucaaccugucugaguaauugccugacaucuucauucuuuuucuggagacuuugucccacguaagcccaguuucacuguuuaauugcagcgaucuuuaauguauuguaacgugggccagcaagguggcucagugggucaaaacacuugcuguucuagccuuacaacuugagaggccauaguggaagugaagaaccaaccccgaaaaguaguucucugagcucacauauguacccacacucauucagccaacuuccucauugaccucauugaccaacaacauguccauguuuuguugcaguuguucucucccaagucuuuucuucucagcccuggguauaaaaucaguuugcuuuuuuuaauaguuagcauugcuccuagaaacguggaggauaaccaacagcgcggagauagccacuugaauuuuaucgugggugcugcucacuuugauuuugcccuagaugccccuauugcuccuuugugacguagcugggcuggauggaccucagaccaggugucaguuccaggaaugaucuuuuaucuuuucuggcugagaguuuguuacuucuguuuaugggaaaucuguauucaucuugcagccugaauggcauagacucucacuuggggcaucccacauuucagagcaaacucuuugagaucuacagagagcuaauuacagugaaggugccucuucuccauguuuugcaaucuuucuuugcauuucaacugagaaauuauauaugcacgugcacugugaauucucuuucugauuuccagccaucagccaaaccuucucauguuuauaaugccuugccaagauuucucugaaaauuggaaaggcagaaguagggauaugcaaaacaacuccuuuaguccucaaaaacuuguuucuugucuuaaaaccuuauggguguuucaaaauggaauaaggagacauuuuaaguuuugaaguuuggggagggaggaaggcacgcaugugugcgcgcacacacaaguaccuguguuugugugugugugugugugugugugugcgcgcgcgcgcgugugguguaugcacaugagcauguagauaaacacaaccauggacaaguaugaggaggccgguagagguugggugucuuccucuauugcuuucuaccguguugccuuaagacaaugacuugugcugaaucaggaacucaccauugcacucaggcuggccggccagugcgcuccuaugguccacuuggcucuguucuccgaugcuggagcuuauagucauguacagccaggcuuggccuuuuacaugggugcuggacuccaauucagauuuguuuucugcuugcagagcaagaacacauaccuucugugccaucuccugaccccugaaguuuucuuuucuucucugcuagguuacagggcuaaacugugacauaucagcaaguaggaaugaauggaaggaacuuuaccaaccaguuccugacagauacugcaaaauacuuuucaaaaauagguuaauaaaauaguuuauuuucuuccaugaucuaggaaaggcuguggagaagacagccuugauccugucuuuauacugcuaguuuaagaggaaaaaaaagucuuuugaggacuuuggugugcgaauagacuucuagcacugucaacuaucaagucucucauugguuuauauagcaagcagucaucaaaggaaugaaggaaggaccucaugccauaguaugugcauauuuucugucugucugucugucugucugucucucucucuuucacacacacacacacacacacacacacacacacacacacacacacacacacacacacaauguucaucucauuccagcugcaugagaacaggccaauagaagggagcagauacuauacauagcucccacgcucuuguuuuaaaauagacuguuuauuuuuugauguuugggcuuauuuuuagguuuauaguguggcuuuuauccaaagaacccaaagcagcaugcaugcugcuuuaaauauaggacugccaaugaagcagcagugugggaacccugggguguaaauaaauggaagagccagcaauugccuagcaugugugagaaccugaguuucaguccauguacugcccaaaaaaggacaauagggaagcaaauugauaggacagaauuuagagccaacaggaagggaggacaagagaaaauuaaauucuuggaauauggaaauggaacuaguuggguugaguugggccauuugguucagagcucccucaguagcacccuaagagaacucuaagagcucccuaauagcacaguguagcuaauacuuacucaguagcuagcccaauaucauuugagacuuagaaaugaagguuuacccuuuaacucucuggcucugucuuuucacuuaugcuucaucaguuucuucuuguucuucuguuuaugaauggauggauagcggguaggagagcaaacauggcauuuuuuauuugguuuauugcuagcucuguccacaauucuaagucucucucgaacuuccuuggauuucauucaucaguucuccaggaagcagaaucaggacccucuguucauuccaaccugaugaacugcuauguauaucuuagaauaaaagcauggagggauccagcuguuugcuaguguagcaguuuacauguuugauaucauccuagagcgcuaagucaauacuguuugugaaaaagcguugagagacaaaugcauuacacagaaaauuacuuaauuugccaccaugaaauauuauugauggcugcuaagaauuuuuuuuaaaaaaaauuaugcuagaacaagacagauaugucuggaguguacgcauguguaaugauccaucuaggggauuagauugcuauauuuuucaucauagauuuaucucaaacauaguccuuagcgacagcuauuuaucaggacucacuccaugacaauauaguaacauuuaucccuuaagauuauuuuauggugccacacacaguagcuuuaccuucaaaacugaaugagaaaaaaaaaugggucauccuguugacugauggcuuaguccccucccugugccucacacaaagcacacugccuuugguuggaugucauguuuuaaauguuaggagaagacauccucaugcaggguauggcugugccuguggaccaucuguugaagguuggaugguuuaguauuuucagcagaguauguuuguccuuggauuacacagugccagcaguccauggacuccgaucauuuuguuauacagagagcauuugagugucuucuugguagguccccaucauauauguguccucgauaaauaucauuucuucuucaucaagauucaaaaagaagagucuucucucaccgccacugcaccuggaaaggugaagcagcggaggcaugaagggaaaugacuacuuucaaagaaauuauuaaagugacauaugugagcuccugugucuucaaagggcaaaguaggaacuuuguagguuacagacugauuucguugguguucuccauccucccaauauuauuuuugcaucaucuuuugaaagagaccugcagugggaagaugaaucucaggcagcggauugucacugguacaugcuaaggguucuaguacuaagaaccugagacguuaggaaacaugacccagguaagggagguauuuugaagaaaguacagucuuuagaaugauccagauagaucucucaacucucauucaaacaugagcucuaugcugugguggggcauuuaacaccaaguuacuugaaagaugggaugcuggugccuccuucccaguucagagaugucuucuggaauguaagcacaaccauuggcaccacccuuaccauucauagcauaguagagaggaccgugcaaaagucaguaacaaggacaacauuuaugggccaucuucuucccuaauagguaaacuggauuuggguuuuguuguuauuguuguguuguguuguuuuguuuuguuuucuaaugcuuaugaguuuugggaaacggaacuguugaaugggauuacugaccaagcaggcuuguaucuuuuggggcccacuuagucugagagggugaaauaauggagcuguuuguguuucggacacuagcuuucaaugagcuuuccaaagaagaauucuuagaaugguucuagugauauccguaugaauggaccagcaggccuggggccauauacauucugguagcuaauccacaaauuaaaaugcaccccucagagagcuuguaaauuagguaaagaacugauucaaucuugggugcuggauaagucuucucaccuuuccugauaagucagauagucaguuuccuuuaucaccucauuagaauacuucugaccuucccaaauaacaaagccuccgaaauacuuuucuaauuacuucugguagucagcccaugagugucaaagaaaauggagucuuuggacuuggagugccaagcauagagagaaguauuuuuaaggaagccauuuuccucgcgauggcuugccauuagagccuaccuggucggugugauggcugucauugugguucugggguuggaauggaaaugguuggcaguacccauucuuuauacuuacugaccccacguuuugccucgggguacaaaccuuuggugguuuucuuaaaagaaaaugacguaucugauuauuuguauugcuauagauacaaacaguugacaauuaaagaaaaguaacaaugaauuuccaaaacaaacagaaaaccggagacacauuugaaagguacgugguaccaugaagcagggcuauugaggcauuuuuggagucaacaugucuaggguugaauuucuauuccauauaucucagcuuguuuucuucuccaagucccagcuuccccacuugaaaauaaagguaauuguucacuuagaagauugcuaaugacuuuaacaauauuguuaaaaugugccaucaaaaauauuagcuauuguugcuguuaaagccguuaaucaagacaucuuuugauuccaggguguggcucagggacagaauaagcauuugccuagcauauagaaaacccuagaaucaauccucagcagagaaaaaaguaagcacauuuauacaaacgucacuaggccuggaugcagcagcuccccuugaggacccauuucucaggaagagcgugaccugccuccacucuuuuuuuuuuuuaaaucuuaucucuucugcaaaacgugaauucucuguucuugugcugagugauaguccacagccaguuuagaaaccagaauaggguuaguuagcaguucagagcaauugcuuaccacucugaacuucuuccugucaccuuucacuaaacaguuguggaagaggagacagaucauuaacgucuggcaugacuucccaauuuuucaagccagugaacuuuauaguuuuacacaaggcuagcuucgauccuuggguuugucuccuuuauuucugggcgaagggaaugcaccuccauuuguagcucgggagucagggcagcuuuccuacuguuucccuguaaucucagugagccacguggggagauggaacuuuaaaauaauaauaauaauaaugaugaugaugaugaugaacucuucuugucuuuucuuacuuuuguuuugaggcgggguugcacagccuauacaaccuacuauguugcugagaaugccaaugaaaguaugauccucuugccucugcuuccgaugugcuaggauuacaucguguaugcuacaauagccuguuuauguugugcuggggagugaacccagggcuuccugccauccaggcucuaugcucaacccucuucuuguuuugagcacuucaucaccucuuucuuagcuucuaggugccauucugggaucaaagcuuggacuggucccuguucacaggaacuagacuaaugugucccauucgagauaaaagcuuggaguuagaggggcauauauccgguuaugcucuguaaauauucauacuaaagugcuaauuuucaaaaucuauuauggaaaacuaagacaaggacuguccuagaagggcuuagaauuucaaagcuguagggcuggcccaccucuauuuauccugaacucugaauccucugccccaugccuuaguguccuuacaucucagguuccuuuagcauguucccaguugcccugcccagaaauccuuuacauggcugugucuaauuucucacuauguacuuaaagauaguaucguguguucuguucguaugugucaacgucccguuguaccuggugcacucuaugccccauugugggggaaugcaggagugggugggauggggagcagggggaagggggagaggauggggagaggguguuuuucagaggggaaaccagaaaaaggggauaacauuugaaauguaaauaaaguauccaacaacaauaauaauaaaagggugaagcaacacauuggcuuuugugaggagcaggcuugaggacuagaccuagcauccccuuggggacacugcauccauuccucgggcaggucaccugaacuuucucuuuaaucucuuaagggguuguggugagcccccaauaaaaucaugcacaugaaauggauuuggaaguugaaagcaccuuucauauacuagauuuuaauguggaagagcaggucugauacagggagaacacugcccugaguaaauggggcugcacacuagauggugagcacagcaucacuggcuucucuuugcaagcacgcccuccucaagcagccucccgagcagcucucucugugcauaucucuaaauuuauuuuuuuuuucuuuaagcaaauuaccuggccccacagauuucuauuuuuaaacaagucagcccguggucuugaauaaagcaaucggucccggauuggaagcuccucagagacuggaggugucaguuguaaagaacaaaaagucugaguaacaucauuucaaagaaggagcacuuauauuacucucaaacgcaaguaauaauaguguuggggacggaacuugaagcacggaugagcuaauggaauaaacaaaugagaaucauugauaaugaggcuauuguuguguuacuguccugcgaaggaacagcauuuucagacugauuaucaugcccccugggaagccuauuuaagauauucuucuuccuuccuggacacaaagaauuugccaguuuaaaaaaaauccauauccauggauacugacugauagcucagcuuuucucaaugacggcggacagcaccuagcaacaaugcacugugcuuugguuauuaaaauauaaaaauaauaaagcaauuuggggggggcagaauuugauccucagcacugcauaaauugagcaugggaacacagagcuccauuuuugggcacugggaagguagaacaaggaaagucauccuuggcuacauagcaagucuggguuagccugggcuacauaaacccugucucaagacaaacuaauucacccugagcaacaaauguuucaggugccaacaguguuaaguuugccagucuaguucaccugggacuuucuacuuuuuaacauagaaguucgcagguuccacaaaucccuucaguuuugggcaaauugccaauagcuagucaccuuuaggcuccuaugucucuagcaucuacuaaauauggaaaaaaaugucauuccaaugaggacuuugcuuccucguucuguugguuugucggcuuuuccucuuuuaacaccucugaccuuccccugccugaaggauucccaaacgcugcuaucuuuacuccuacauccuuuccaaguuugacacuucacaaagcaggacucacccaguagacaugguuagggaugauaauagcucccuuugcuagcaugcucgccaucugccaggcccugugugcuauguacuuuguggacauucauuaucccaacagccuuuguggugggcuguaccauuuccccuccucuucccauuuuuacugauauaacuaaguguauauuaccagaggaugcugugcuaauaaaguggaugaaauucaaagccagccagccagccagccagcucaugccuucauccacucuacugcucuggcuggaagaagcuuggcucuucuuugggguucagaacuuuaugcuuucuucuucuugauagaaucucuaaccuaaguuugcuuucguuguuaguccacuaaggaugagugcucugugcagguaaaucuaguccuuucuuugcuccucgcccuacccuaaguuccaaacaagguccaucaggccuuuccaaucucuccaguuuuuuuuguuuguuuguuuuguuuuguuuuguuuuaaacaaaauagagagcucuuugcccuacagcuacuccagugcccagcuagagggcgcccuuugcuugccuuugcucguucuuccuucaaccucuuuuagacagguaacuuucuuuauucuuuuuuuuuuuuaaaugacauggggccuaggcugguuuauggggguagugggugggaggauuugggagggaacugggaauuugaaaagaagaaugccaugcagccaccugagugacuuugaauuucuacuucuguuuguccuuugauggcuucccagauaguccacaucgaggguaguuaaacagagccccgagguauaaucagucucauuaggaacucggugaguucuucauuucagccuuccagcagcuaacaggggagcaggcaggccagcugucugagauguugucacagucauuuucagguucugauccuggagaguuuggggugggauucaaguaauuaaaucuuaaagaaaucggcucccuuagaggaccacacagcucugacgggguuucugagcagaaagaaaugcaauucaaucacuguugcucugaauaauacaacugcucggaaugaaaaucagacacccucuagccacagagccagaucagugaccagagagcucuaucuagagaggugccaaggccugaagggcagguaagaguggaggaauacaaaguggccuagcaaccagaggguggaagacaauuuucacucucucuaagaacuucucagcuagagagcuuggguaguuucugacccaguuguccuugugugaauugcugcaugcuuuuuuaaaguauuuaugcggcacuuuauauuuuaccaagugcuuuacagucacuuuuauuuggcuuaguaaaguuuuccuggacucccaucugcucuaggcucacucaggagacucauuuuguuguuguuugcuuagcaccgccacgccugcagccucacacaaugaguggcuuguucugguggcagagcaggugcaaacugcuggggacaccugagcgagcagcuuggggagucggaguggacccgguucacgcuggagcucucacccacuuucccucuguuauucuucgacucgacucucguugauggcuggugacuagaaggugccagcgccgggcccaagaguugggcuagucugaucaggagccgcuggcggugacaagcucuuugucuagacugguugucaccucucucugugcucuacauugucacuaguccgccagaugaagacucacugaguguccuuucucccugcugcuuucggaugucgguucaggaauugaaacacugauguuaagagaaggcaaugacagaguagucccgcagugugugauaacucaggguucugggcccagguucacacuggcucccucacccuugcuagccccuuucccgcugugagaagcacacuauuccaguccgccggaugcugcgcuauagaaaccuuuaucuuuuaguacuucacaaugugaacacuaaaauucccaaguccugccucagcauccggagcuuccugaugcuugauaggaugccagcauuggaagcauuccaccccugaccucacgugaugggucacagccaaaauguagguacacuacaaauaccccauaccccuaggugguuugaauuauguagauaaagaauauaggaaacaagaagaaauuuuaugugagucucaucuacaggauaucuuauuaaacaccagacaauaucccaaaauugggggauggggugcggggaaauccaaacacuuccaguccugagcauuuuggacaaaagauccuccaccuguaauaaguagaguuauacccuccaucacauguugacagcggaagucccagaugugucagauuuguaucacaaccaccuuuuaaguggcacaaaccucccauugcuguuugaacucaagauguucuauggcuagcagguuuggaagcccagugaguagucugaagggauggacaugaggcuggaaggagugggcugugggcugugggcuguggccaucucucuggcuagucugaccaagugguaugugccauaccacuugaaugguaacauuuaguaaggcauagaaaaguaggucuggggcuggugagauggcucaguggguaagagcacccgacugcucuuccgaaggucaggaguucaaaucccagcaaccacauggugacucacaaccaucuguaacaagaucugacucccucuucuggagugucugaggacagcuacaguguacuuauaauaaauaaauaaauaaaucuuuaaaaaaaaaaaaaaaaaagaaaaguaggucugucguggagaaagcgacgaaucacuaaaguagggugacuugauagguggaagagacuggcugggagaccagaaggccagucaguguaaggcaggcccccagucaaagacugcagauccagcaagacuguuugauuagaacuauaaacugagcuuuguuggggggaggcccuccaccucgaaucagccccacagaccucucuacugaggcccuaaugucugcccggaaacgaaguagaggcauagguggauggauacaagugagggaaaugggagagaguucaggucagagagcccagagaaauaugaagcagugcuaggcaagaggaagucgugccugaacacccagggcucacuccaagagcaugaaagaauggcuuugaggaacaaggcggaauuccaaagccuggggcuugccaggugagucagcuaagcuaacaccuuuagcagcucuguuuccucuggcccaagaccuggagcagaggugggagaguggagguggaggggcaauaacccugcagguaaaaggguuugagaccugcccguaacuguagcuaagggaacggaggcuuccaaacgauaacaggaauguuuaucuuguaaaggaucucagcaguucccauugcuauggagucagucugcccuuugcucuagaucucuggcaauucauuuggacauucaaaacaacaugaugaaguaugaagcacuugacauuccuggccaacagguucuuccuugauagacacugucccuuggauagguuuggguauuuagugccugucgcuuagccaucagaguucaagugcaaaggcaaacaaagaaaacucuucaguguucuuuuaccuugauccuauguucuggcccuauagaaccagacugaagacaacugaaguguuggguuucucucagugugggcguggggaaguugaaacuucuccuaaguauuguucucaagguucauuugggugcucucaggaaguucuuugcaaauguuuguugaaggucuacuaucugucuaguacugucuuucauacuuucaaaagagcucuccacuaaaacauuccguguucuaggcacaguuggaagcacauagccuauauaaucucaacucaauagcauuugucauaucaacuagucccccacaacaugcuagugacauuauuccuuaccuguuugaaggagagccaguuuuauuuuuauuuggggacugaaccauacaugcuaggcaagugccuuaccagcccucuuuuuuuuuuuuuuuaucauuuuugagaccuggugucccuaaauugcccaggcuggucuuuaauucaccuggaauuccagacaggcuuugaaccuacagucuuccugccucagccuuuagaguaccaaagauuucaggccuauauccccaagcccagcucaaaccaauauuugaaucuauaucuuugaauauaagcccaauuuucuuucuaccacaugacuuggcccuuuuguaaacauguuauauagggggagggauguauagugcuugccuguaauccuagcacuugggagguagguuuccuugucacuguccuggauccuuugauggcuagacugagguacagguggugcugucccugucucuaucauccccucucugcugagccaacugcuucucccagccacagacucuaauggauaauaucaauuucuucaccggcuagaaacuauucacugcaucucuggauuuaagucauugauauuccaagaguaaucuuuuagcccuuucucaagugagguuuaaaacaaggauagaaaugaauugacacucacuuacucuccuaccauguuaaugucuucuaaaaugagauguaaauggcuuugcauucuucugauuccuuccacagcauuuucuuucuugcuacuaaaaucucuguaauuucugaaaggcaauugugugaaaacacagguauuucuuggaauaucguggaugagugugcuguuagcauugaaaauuugcccugacguuguuuauaacuguuguguugcaguuagaaaaaaaugaaagugaugaaauauuucucuuugacuauauccaccaaaaucuagguuuaaugcuugcaaucaguauagggccagcuuaauguacauacugcaagucccaggguaaccagggguaaaaacuauuaccuaaacauaaauaaaaaaauguccacaaaucacuaggaaaaauugucacuuucuuuauuaaacacauuuaaaaucucagcuaacuucaucuuuacuuuuauuuuuguguauuuaugcaauuaaggcugcaucuccaacagaaaacaguuuuuucuuaaagccucuuaauaaguugcuuuuugcuacucuguguucuagguuuuuuuuuuuuuaagcuauuuguucucuuuaaauuuuaccauuuuccccuagugcuuguaagccagaauauuuuucaaggaugacagaccauuuauugucaugccacaguuucuccauaagauggugcucugagcaugcaugaucuauagcuuuuuuuuuuuuccuugcuugcuuuuucuuuuucuuuuauuuuuucuuucucuuuuucuuuuuucuuuuucuuuuuucucccagccacaaucaggcagcaauugaauguaaacuuuugugaaaucaaauccuuuuagccaggagucaguccuucugagauuuguucacaaacccuuaccaccauucuaaugccuagggcaagaaggaaagugaagucucuagcaagccccuugcccuaaaucagaaccagcaggguuaggaaugcacgggauauguuugagggaccucuaaagaaaagaguuuuauucugaguaugaaacuuguaguauucgcgguuugaaaagucccuugcugagucuguuucuucacguacauggcaaggggguuggacccgcuggucugugaaggcacuuccaucuccagcguucuccauuugcaucugcugauugccucagccagugcagauuuaggaagaaaagcucgcccauuuuacgcuuguuugacucuauuccucuuuuacaagugcucucuuugcuucaacugucccaggacaagcaugcccagauguccuguuuuaauuagguuccuuuucucuuuaaggcuuuuacacagguuuccucccccccccccuuccccuccaggccuuaaccaaucugccugaaagggagaaacauucuccuuuucagugcacaaauaggguuuucuuaguaucacggcagucauuuuugugcugaauagauccaaacaggaggggggggggauacugcacgaagugcuuaaagguaacaccucuaacaucaugcuaaauauauacagccaagaaagcacccuguuucgguggaggugggcauuucuauucuuuuauugccagaagcauauuaaaacuucugggaagaggcaguugugaaaggaggaggacaauuaaucaagccacagaaaaguauugcuaaccagauaacgcaccaugaaaaucccccgaggcuaaugaguguuccugucucuggcauccccuaagaauugaguggggcagaugaauuggggcuaugauggcucaaccucauucaaagacuaucaugaacugcaggcaucagcagcacugcggagacccauggaagugaaaugcugaaugaauucauuaacugcaaacuccagagacaucccuagcugauucccuuugggcuuugacccucagaguacacaugucccaugaaauacccugagaacacaccaucugugucccuuugcuauugcagggaggcacaugugcuuaaaguaaacacagucaauuuuuuuuaaguuauugaacaaaagaaaugauggagugaaguaauggauagauuaaacuggcuuuagaaaucguucacuagauauacacauaucugagcaucacaguguacaugauaaauacauucaaauuuugucaaucaugguuacaaacgcugaaaaaaacugaaguuaacugugaugugcaauuccauuuauuuuuuuuuuaaaucuaauaguuacauagguuuagaaagcucacaggagggacugaggaugugacacaauagcaaaggacuucuccaguaugagcaaggcccuagguucaguugucagcaccacacagagaaacaaaaauccaugguauaaaauacagaagauaaaucaaguuguaaaauacauaagcaagucuugcccagcacuuauugaaaguaacagcugccacuacuuucuuguuuucuguacauauuugagcaguuuuauaacacaugagaguacagguguucuccuuuuguaaaagauggauccuaggaccccugguugguuccuuaaaagaaugauaguacugaaccccacaugaauagucaucucucuauguccaaggauucaaucaaacacaguuuggaaacacaauuaggaggagaagauuggcaauauagguuugaccucaugcuuagcaggcagaagguccuaacuuugaucuuugauaggaugagggaaagaaaggaaauguuggucagugggagaacccuugccugauaugccugaggcccagcacugaaaagaaaacgaacagacaacuauuacaaaguuuaguuuagaaauuagacaugaacagauuaauaaucauaucauaaaacaauucuagcuguguauuacaguaaaaguuuuaugaucucuccaucacucugaagucaaucugacaacuuagacuuguugaacacagaaauaauuuauauccuaggcaugaaugaguggaugguauagguuuuaucauacuuaaaacaaaacucaauuuaaaacuuaugaauuaaugauuucuguaguuuuucacuuaauguugucagucuauugcuauugcugugugccagccagugauucuauagaaggggaagcuguagacagguggaaaaagccuauuauaaugucuguacaaacccauuuuuaucacaaauagacccacacuggacauucucaacuugugaggucuuuguuguuuuaauguaucuuggccuuucuucucuaucagugcauacagaucuacuaugcucuuuuaauguaugcuucauauuccauuaugacagucauuacuuuuaaaaucugguucaguguuuuuuuuuuuucccaagcuaagguagaaagaaaggauagagagauaagauacaggaaaagaugugaggcagaagaguguaccgaguaccuacaggagaguauaaaaacagaguauuuaaauagcgucacugaauuuuagcaaccaugagcaacaguuggaugaguacauuugccuagugcuuuguacagaaaugagauaaaggagagcuuuaugucuaaaccacaagccagcccuucccaacacuucuguaaccagaaaccaugcuucauuuacucgagcuccuggaggauuuaaauagcacgugauacagugcaacagugaacgcuguuucaacugucagaacaaaauaaaagagaagagggagcuuuuaggugcgcugccuuuuuuuuuuuaauugagucaccaugggauuguggagcaguguugagcuggccauguuuaguucuaauucaugacuagaaaaugagagaugagaaaagaaaggagaacuagaggagaggcagagaacccuccuacaagagaaucaccaagggaucagcuaugagguucauuagauuuaauauucauaauagcuuuagaaugggaguccaggaccaaauugcuaagcuuccaugucuuucuccaauucuggugaggauaaugagcuucaggaaaauguuuguuuuguaggaaggcacaaaaaugugcuuggcgagcuuugguauggacaaguccauggagggaucuuuaaaaacacauuccugagguucauuucugaauuaauccuacaucuucaucugugcauaggggcucuuccuuaggcaauagcaggaggaaagaaagaagucggaauugguaucaucagggaagaagcacauuugcacagcacucuacggacacaaaagggguggcuaauacugagugcacuguuugauaaagauuccaugaaggcaguuggcucggugaucugacaauucagugguugccuuuucauucggugccaggaaacuacaaagccucuaggagcugaccauauguauacgauggauucucucucucucucucucucucucucucucucucucucucucucucucucucucucucucuuucucccucccucccccuuucccucccccccucugucucucucucucugucucucucucucuuucucccucccucacccucucccucccccccucucugucucucucucucucucucugucucucuuucucagcaggaauaaacucaacuguaagugcuguacaaaaaguauaacaacuuuaaauccgcacacaaggcuauucuuugcagcauuguuuguauuaucaaaguuuuuacaaauaauuuaguuuaucaguaggagauuggacaaauaaauuaugauacagucaugcagcauaauaagaacaaagcagcucaguauauucugaaauggaaauguucacaguauagauauuaggacagaaaaugaugcaaaucaggauguaugacaggauucuaguucggguuaaaauuaagaucuggaacuguggguacagaaaaauguccaaucaagugggaaucacugucccgguugaagccagaaaagccugacacuggggauaaagguagaaugaauggcuuuggauuacaaaucaucccccugcuccuccugaugaggacauccguagagaccuuaauacauccuucagcucuaaagccaagccugugauuccccaugcaggacaaugucaacaagccucucccgagccaugacuuucucuuccguggaggcaagcuagcaggcauaauguaugcugcaucggguugaaaaagcucccugaacagaaaaacaguuccugugggggccacaggaaauuaugagacgagggguaugaggggaaggcagagguaaagagcaugggagggucuuucuccuucaaaugagugggaagcacaggcagagcuagucuuuaaugguguuuuucacugaccgugaccuugagcguccccgggcacagugcuuucuagucggccgucucauguucuaaaaggcaggagaaaauuuauagucaguugcacuguugguacccaauggagucagucucguugauugggacucucauugucaaacuuucucuuucccuuccucucuauagauacagccagaaggcggcaaggaacgggaugaagaaucaguuuaaccuccaugagcugaaaaugaagggcccugagccggugguuagccagaucauugacaaacugaagcacauuaaccagguaugugucauagccaacagaaguggaacugcaaaagaaaucaauaugaggcagaugauuuucauugcugaaacuaauauuuaggcagguggggaagcagcaauuauucauguucuucaaugauuuuaccugcuaaaauugacaucuuucacuccauuuuuaaucauugugauauugcaguaagagagaaaucauacugguaucaccacaaugccuggcuucauaauuuuuuuuuagucauacuacacugacaacacauucucgugcuccuauuaaucauuugcuguggccaaguaacauucuguugucuguucaucaugauugauagacauccuaaaugauuccaguuucauuccaucacugagcugccucuuucucucuagcaccgucucuugaucagagaugauuuucuuacaagccugugcuguugcauuaaggggugugaauauuuccagugagagugugucaguuuucacuaccaccagcaagaucuuggagacccugcuucacagccccuuugccaaauucugacucaucccucucauuuccuugaccuauacacauacuuucccccucuuguagggaguuuuacaagucacaaauagaaguaugguuguaccaucugcuugugauugcuuuguggccacauacuuuuaaaaaaaagccaccagaaaggccaccauaugccacagugacaguguuucugggccaugccauguuccaugacugggagggcccagguacugggcuacuauuuguagcuugggaagaauugaaugggacuaaaauguuugugcacgggcagaggguucugugugaagacacaagccuaauuuuauuuucugugugaacauuagugaauuuuuagcauucugagaaaauuguuugcaagggcuuucuaaugauagcauauuucacuuggauugcaucaugagcauacugaaagcacacuuggaggaacucuuccagugucuccuaaagugcucugagcucagugagcacuuaauaaaugcuugcuacugcugcugagcacauggccacagcagugugauuuuuuuuuuccaaaugugucucaaaggauacugaggcaaagacaaugugaccacuuccccuaggagugaaggcagaauuggucuucagacuauuuauaaugaccccaacuaacuguaucugggugagacuacucaguuagaauccugcauuuggugagaccaaaacuucagggcccaucacugugccucuacuccugaguauagaugucaacagacuuuaaggcauaccugguauauauguguucuccugggucccagagacuucugagauugaaaagaaauguaguacucuguuuuaacagccucccuggaugagaacccaagcauaaacaucucaagaaagauaaagugugauaggcgauaaagcgcguagagagaugcugcucacacuaguuuagggugaccuggcagaaacacagaguaagcuaggcuagggggaagagccuuaaguggaacaaauguuaagagcugcuauaaaccaugugcaagggaggacuauguaaagagaaguagagaggggcagccauaaagcaauuucagacaaagaccuguggacugaauccacuugaaaaggggaaaaguugagaagauacaggcuuaaauaugaucuaguaauuaccaagaugcuuacagcaagccuuuuuguaaaggcuucaguuacaguuaaagaauaugaauuugcuuccauauugggucugaauuauguauuuuaauauauauguauauauuauaaguacaugcauauauaugugcuuauguauauaaauuaaauguauauaaauauaaaauaaauuaaauauacaugaauaaauauauacauaaacauacauacaauauuuauaaauauauauuuauauuuauguauauacuauauauguauuuuuaauauauaaccuuaggcaaaucagugcuuucauuaucccaucagugguacuccugagguaguaguagcauauucacaaauauacauaugcauaaauacaaugguuuuugcacgccaggccuuuauuaaaugguuguuccagagcugcuguuuaggcuuuucccuguaggcgggacuuaccuucgaaagggagcaucgguacuuuagccacugaguuuuaugugagugcagauuccuuuguuacuuugcuucuguucgcucuuaaauuuuuuucuuucaucuaacuuucagccacaaaacacaaacuaauccauggagagguugagguaaacaaagagagggcaaauucaccaucagcauuccuuucuucucccuccuugcagaacagugguacacauucuccguuucuauacaaauacuauugaacaauugauugucauugauagaccaguuuuaccuguuaacauuggucuggcuccaaacauccacacugacuuucuuuuauucucaccuguguugcuuuauaugcauaaaacacaucuuuuccauccuuagcuaaaacucaccuuuuggccauuauucagugugaaagugagauucuuugggaaaaugacaaaagaacagaguuuugauugggaugauaaagauguuaacacugauaaugcauuagcuuucuauagcacuuaacauuauuucagucacggcauguucucaagacuaguuguuuagggguaggggaauccaaccuggaauuguaugagauauaauacucucauaaaaguauucuuuucaagaauucauuacccuuaaagauuuuuaucauccucaccaagugauaaauguuuauccccucuuuauagcuagagaaacugaggcaaggagccauuagaggcggugcaggcaugcugccaagcaucuagugaguauaguugaaaauucaaucaauuauccagauguuguuucuuauauacugccaaacaucuggauucagugaaugccuggcuaaauuggccuaaacuuuuggcagugaggagguagaaucaaguuaacuugccuauguuugcaugugaauggagaauccagguaauguuacuuuccaucguuucugucuauaaaugcagagaugucuuccuaucugggcuuguguguccauccuguugaauuagagcauuuaugagcaucucccagaguaacucaacuucucuuccacagacauucucagcugccuccuuucagauuaugguucuguugauagagcggaaauacuauacucacuaagggaauaaaguaacauuauuucuacauuaacagucccauaguguaaccuugaggggauagguucaggcucaguccugggcccauuuccugggaaggggcacagguguguaauauacucccucuuccucauaagccacauaguucauguguaagauucccacgauugaaaauaagguccuuuuuauuucuuuuucaguuucuaauuuaugugagcauuuauuaguuuuuguuaggggaggaauugaaccacucuugguucucaguauuaguucuggaauuuacuaggcuauauuuuuuaaaccaacuuuuguuucugcuccagacuccuauguggagcgaagacuucacaaauaccaagaauguucauaauaccucccuacccagaugacgcugugggaaacugauucucuagcuuaguuuugucacuagcauuuuuucuguuuuaaguguauuuauaaguuacaacuaauuuugcuguucugaaacuaccacagaaguuuuuguccucaaggaaauacuaguaauuuaucguguugcccauuucaguaaagguucaaaugaaauuccagaaauuguuuuccugccuguuguaaagaguugaggccagagcagucaauaccugcccauuuggugucaagaauuucucauucaaaguaggauaaagucucaucuguuuaggaugguguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuauuccucguacaauugcaaacgcauuuguaaauuuacaauggggcauucauauuacuuuauaauccucguuucugcaacugguuacguggccuuaauugguauucauaacuaccuuccucuacuacccauucuguauuuccuucuccuucagccagcaccucagcaggucuuggcucuuuuccuggaggauugacccauaccuucauuccugaugggucuguguccuuugucauccugcuuggauuaggcuguuguaguuucccauugacuuuaaucacaggacaugguaguacuaagagacgcccuaagggaucuccuacacuccagacauaaucuugcuuaccaccauugugaagagguaauccaauuuccccaugguaaucuggaucuaucaccccuccuaacacuguuauuccuuuuuuagccuguugguguaagggcauuagaagcccaaaaugaccagggggaagucugagcuuccaguucaauggaauguuuguuguagcuccugguaggagcacuccccucucuggagccaaaacuucuaggccagcagaaccuagaguuauggggacaggaagcaaaaauuuuccuagagggucacuaggagugauaguaaguggaacuauuccauuuuccaccccuugauuccuggacccaugaauccuggcuaugggugaaacuguaccauauaucgagcgcugauucaaagcauauacugccuucugaagaacucuaccccagccuuccaagcuguuaccaccuaauuggcgcuguaacugcgucuucaaaaggccauuccaucuuucuaucagaccagcugcuucaggaugauggggaaugugguaagaccagugaauuccaugaucgugggcccacugucguacuucucuggcugugaaaugaguuccuuggucagaagcaauacuguguggaauaccaugacgauagaugaggcauucugucaauccaugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucugggacucaguguugguuucugcuguuggcagaucuggcaaucagcagcagcuguagccaggucagcuuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugaaucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggccugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaaggaaacuacaucugguacagcagcugcaauuggaguuacuaccugauuuaguuuucgguaaucaacugucauucuccaugauccaucuguuuucugcacuggccagauaggagaguuaaauggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaauuaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagaggaaccuggccaccccuucauucaagggguuccggaucugcaaacugucucaagucuggaaauugauucacuggccgagauugcuguuuaccacgaucuaauguagccuuucuuucauuuguuugagaauuuuucugcuuauacagaucaaacaaauaugcaguaggcuuccuauguauuucauuccuggaaacaccaugauugauuagccaguaccaaagguccaagcgagucaugccauuauaaauuucaccucuccugugcugaccauuacuggguauguuauuauaaacauucuuuugucuacgcuguccauuauaauaacuaggaucaccuugucuccggcgauucaaugcugccaccuggcccuuguuaccucgggauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuauacuuucuaccuccccucuaggagccuguuuugcuuugagucugguuacaggucuagaagaaacuauuggugggccguaagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauauuugaaagugcugguggaucaacaagccaauuccaguauuuuaaaagauucauccuuguacuucuguuacucuagaaccacuccugguaccaacuucuguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacagauggcuacaauguccugcugaauggcgggggaguagacgagauggccucuuaagauuccuuccagccgugugauucugugauuugugacucaaggucaggcuuuaacccaguacccucuugugaacaagucuugugacuuuauucucugcucugcacucuuuuuaaaauacccuguucccaggucaccccuuuccacuuuguaaccugucauccuuucagaggcuguucccuucccaccagccuuccaauauaggcagauggaacuucaacuugcccuucccccuauccaguucuucuguucuucugucuucuuuucaucaggcuauaaaacauuaagugguuaaaaaaaaacaccauuuuggcauuuaucgcuccuacuauguauggauccauuccccagggccagauauuugaccugucuuugaaucauguuaaccauguaacucuaaaugauaauucagccauacauuugcacaacacagaucagucuguaggcauacucuuauguacauuagauaaacaaaugcauuggcucugagaggaaacaagaugggcucugguauuugcauuuacaagaagaagaaacucuaaugcuccacugagacccaaacuccaaggcuaccagcuuuacucucagcuuuccuucuacuugucuaucuaucuaaugaagagaagaagaagaaaguacuguuaggaucccuguauaaaagguggggaggaguacaaauaucugaagccccuuacuuuggggauuaacaguuuucaagggccaaauauagacauuucuauagucuacggcuuuauaaagucuucaacaaagaaagacaaaucauguuuuacagaaucacaauuggggcaaucauuagaaaacugccuaccacguuauaugaugaacaaauaaaggugcuuuguaggauaggugagucugugaacuaucauaaaaaaucccuaaauaauagaccaaaggaaaaacucaaauguacaacagagagugaaauaucccuacuucuaucacuuucuggaaauaguggcaaacuauuuuuaagaugcuugauagagucugguacaaaugaagacacuuguugucgaaauagaauguuaaauauuuaauaaguuaauuuguaaaguugaugaguaacagagaaggcacauuccuuagagugcaguuuuuccaaaucuuugaguuggcucuuaguuaugguagaaacacaucaaguaacuuuuucauagucuucucauaaaaacuaauaauaguuggaaaucacugacccgagccagugcuuucuagaaaaacuagucuuaaacaugaauuuuaagaagcuuucuaaaaaaucaaauuuaaauaaaaggucuuccucaaauguugcuauaucccaaugucuuggauacgucuuuacuuacaaauggugcuguagaacaauaguuacuuccauuucccuauagaggcagacuggguuagugggacaggagacaagguaucugcaacagccaaugaagaggcuucuccgucacaaaaggacaguguaaaguagucauuagguaucagcugcuagacucuguggagcaaaacauuacuucacaaaguaacaggaauuagcugaaacauuccaaaacacauuuaucauuuaaaaaaucauuugucuuucuguuuaauagcuugaaauauaauuacaaugucugguggcuuugggcagcauguguuuuuaauaucuuaauuacuauguacaguuuaauaacauugcaccaaagagaauucucaaauauuuuagauuaaauuucuugaaaaggaacuacuugcuauauuuagaauauacagcauuaaauuuauuuaaauugggucauguauuuuaguccuugcauauuaauuaaacuauucaaaacuggaagauaagucaggaauggugagcagcauaguauugguagcacuaucaugauaaccuugauugagcaacagagagagagacauuuuuuuucuucauuacuauauuuuacuguauuugauuuuucuauagauuuuaauucauuuuauuuauuaucauuugucaguguuguugugcguauacucuaguuugccccuaaagucuuuucuaauaugaauaugaaugcacaugugcaggcauguuuucuuauauagaauguacuucaggucauggcaggaggucauacuucagcaguucaucuuugaaacaaaaaagccccguggccugaggcaugagcuugcuaauuauuuaucuccuguggacauuauuaacuagcuuuguucauaacaaguacaccucauuacccaccaccucacucauuaaaccaguugaauaguuaauacacugaguggagguggucucuguggggagggauuacugaacccaaagcaggcagagccacgagaaccuauugugcaggcguugggccuucucccagaggcugacuccauucuacauccagaaucagucaucuuuauacuccaaugcccuggaucucaguucuaucuuccaggauacauuaacaauucaagauuugccucccccuucuaaggaugagaaaauuaacaucauauuagucaguagauuuaaaugucaaauaacucaguuauuuuagggcagugcauucagauucuguuccauggugaaugugggagguucucauucuuauuucaaccaagaaaugcuaguuguaaacuucuucuuauauagauauugaucuucugaauaaaacaauaaaaaucucaggcugcucuuaaaacucuugaacauuuaauccagugugaacacuaccucauuauacagagcaucuacaacacacaaggaaaucagugcaugugcuguugagcaaguuccuaaacuuaacuggugguaaaaauggaggucaggcaagagaauaugcauggcuugguggcaacauuauuacuuuuagaaaugauaaaugaaaucccauguuuguguguuaaugagcuaaagugucuuucuucaaagcugaugagcaacacuuccaaaauuuccuugccugugucauuagaauucugacaaaaaacaauagaaauaaagaguacuaugcuaucuuguuuagaaggaucuuuuccauagucucaaccccagagaaaaucccauguuagcugucccaacaaaauaccuggccauaguccagcccaccuacaguuauuuguuuuguuuuguuuuguuuuaagauggggccuuucccaugguuaguugagucugaucauugcauuuuaagugcauugacacaugagcagacauggauccauauucuauaugagcucacuguugguauuuaguggaaaugaagucuuaauaaugucaauccuguaucucuaauuauagcgucuccuuaggcagcaaccacagugauuuuuacauagcaacugaaaaguagaguuuuuccacuagacucccaucuaauauacaagaugaaaaucacaccauuguuuaaugcacuggauuucaguuguuuuuuuuuuaagaguuuuaacauguggucucuuuuucuccuuaauaaguugaucuauacacuuucuugugacccauauuuucaguuguuucucaaacauuaugcaguaugagcaagucugugacaagauuuuuuuuaaaaaaagcuaaaauagcuauuuuguguuaugucaugaaaaugaugcuuaaguucaggucacuuacaugccagggcacugaagagucuuagaauaauuaugcuggcuaaacuuuggacuagcacaacaaauggaggaagagucacacuuuaagaggcagaaaugggauuguggaaaucacaagcaagagagccuaacaucacaucuuagcaaaguucuagaucaaucucuuggauagugugaguucuccauaauaauuaugaacuagaagccacuguggacucucucacacaaaaucaugacauuuccucuuacagcuaugucauugaacauguguugcuggucuauaggucuggcauagacaugguuuaagaaagaaaugauaacuaugaguuccuuuucaacaagugacaagaaauguuggugaagagauaaccugcuuuagucaauguguagcuaauuaauuauuagaccuaaagaauauuuucuuagcaaauugaugucagccuggagagaggucuuugcugcuuugcuuugaacuuaacuuugacagaaaccuuuaaaaaaaaaaacaaaaaaaaaaacaaaugagcuaagacagaggagcaagccaugucauuaauauucagucacagcacgcaggaagauaauauuaacuauuauaucaauauugucauugggauccaaauauaucuuaacagacuagaugacaagagaaagcuagagaguugaaaaguuccagggauaaauauacauucuuuugggauucccaaacacaagugugcaagugauagggaaacugacuuuguagacaucauugguuuuggugauaauggaaauagcaacaaggagcagucccuagcaaguacauuagaugguguggucuguauuggcagggaagacuuguauaugagcauagguacugaaaaggucagcuuaagaacuuggggaaggucauaaaacacuugcccuccggaagggagaggcuaauuagcauuucucagaccacagggugggaacugaccugcggguggggacacauuccgcaggacugacuguugcccaccuucagacaagggaaguccuugucaccucauucucuaaagaccaaucgauuuaaaaggugcgcuguuccaccaaucauauugugccuaguugcugaugcucuauucugccccuggaaaccauauaaaaccucacagacccgguucugggagugggggggucgcugccucuccuuugggucugggaugacccuaaugcacuggaacaauaaauuccucuuucuuuuugccaacuccacaugguucacucaggggguccccaguaagcuaaggcucccuggagccuuacaguacauuggaaugggaaaaaugagagagacuaggaaaauuuucuucacucuaauuaaagguuuaaaaagauucuuugaugacugcaaggucacugcucuaccugagagacugguuuauugguucgguauauguuaaggcuuuuuauuuuuuauuaagauauuauuuuuguuaauuauuuggaacuuucacauaguacacuccagucauauucacuucccagucuucucaggcccacccccaacccuugugaccaccacaaaagaaaaggaggagaaggaagaggagaaggaggaaaggacaaaagaaaaaaagggaaaaaaacaaguuuuuauuacagcaguaccugccauuauuguaaaacuuuauugguacaguauuaaaauuacagugagaagauugaaaccacaacauuuguguauuuacuucagcauaaagcaaaaggggguuggagccaaauugaccugugcucagcugccagucauguucuuuuugaauucuuuaacuucugguuguuucaguuuccuaauaccuaggaaauggguauacuaucaucugucuugaauaaucaggauaaagauaagaugcaauguacacguaaauuggagcuacuaucuccuuucauauuauuauaguaugaaguguccgcagaagggaaagucaagcuauuugagucuuugugcagggcugcaggaacugugucuuuucuaguuuggaauguuucugugaucuuaaaauuuuaaauacaauaaucuagauucuaaagauucuuggaaacaauguaucuagccaacagauuuuuuaacuguugaaaauuuaguuuggcucaaagugcuugaagagaaaaugaagcugauaaaugaaauauagacgguaucugcaugcaugaugcguguguguguguguguguguguguguguguguguguuuaaaucaguucuuuagauuucccccaaguuugaacucugcccuaaauuagauacucuauuaauaggcaagcuaccuuccgagugcagcuuagggaucuuaguacaugauccagaagucucauuuugaucuucauccuaccagggccuuucauggaacaguaguaucaaauagacuucagagcuauaaaguucauggcaaguuaaucugcauuccuuuugcauuuuguucucuggcugaagauguugagagguuccuauauuuaaaauguggcugccaugggauccuuauuggcagaugucuaccaggagguauuuagaaugguuuggaaaagcauacaacguauuugugagugugugugcauuucacaugccagcagagcagaaagaauuuacaaggcuuggggcuacugagcuuuccuuaagacaccaucacucucagcuguuggggugaugucagagaugccgggaacacugcuuaaggcccgaauuccugagcucuauuugaauugcagagaagcucuguuuugcauugcagagcuuagagcaggccggacccauucugugggcucuaccuucaaagaccuacggaauuuguuaacuacagacagagacuagugagcacuuguuaucaggcaaaaggaaagcugcccccugcugccugagucuuugucucugccugggauaccauggaaaauggggaaggaauccagacucauuaaugagcuaauacaaaagccuaagccaagcuagaggcaguucguuauugcugcguauggauucuugaaggagguggagagcugaaagauguccagcccagaagcaggaagcggugaucuuacugcugauaucuuuuuauuuauguugguuucuggacuauuguguggcaaauugguugaucaauacuugccaucagauaacuuccugugcaaauuguugaagcuacggguuuucacucuaagagguuaagauucaacaucgaaaugaacuucuccuugggugcauggacucuguucuucccugucauucuuggaagucacuuaagcgguaaucauuucuuugagacccuuucaaaaugaagccuauaaggcagaacauauaguaaagugugguuauacauacaggcugucauauuaggaguuauuuuauguauuagguaucuguguuuuauguggugcuaaguuugauuggcuauauauguacauuaauaaggauauacagaauccacucuacauacacaucugucaucucauguagauauaucaucuuuuggauccauucauccaacacugagcaacuauaugccagcacuaugagcauauggauaccacuugagcgugaucucuuucaagguagaugaugagacauaucuucaauccuacuauccuagccuuguauuagugaagcauaaauaagguccugcuaacccugagaagggaaggauucauuucuacugagagaauuagacaggacuucaaaaauagguagccuuuaaaccaggcuuugaaagacaaggagaauuuuggcagauaaugauugcaagggaggaucuucccagcagaggaaugugguaugagcaguggcucaaagacaugaaaguacaucaguagacauguggcuagagagcugaggccacaagcuggaguagcagagagguggggagugaaagaugagacuuaaaaggugugucaaaaaugccaggggcuauagauagcauaagaaggaauccagaguuguacucuuuugacagugacagccacugaagggauaggaacaugagaaagauauggacagggaucaggguuuuguaauguccauucuugaguguaggugagaagguggggguuagagggcagaaauugguagcaagcaauccagcuaaucuugcaagaguuuccaaggaaaggaagugaagccugccaugaaaauuuauuaaaccuuccagucuacugccugguggaauagccuagggaaugagaacugcuuugucucuaaauuuggcccugucacuuuuuaccuguuagccaggacauaaggauuggaauaggcagugcugugggucucagaagaauguaguauaugucauaacccacucaaaccagaccaguagcuguuccaggucccacaguuaaaaggaaacccuaguaccuguaaacauuuaucccucauugaaccuuaagaaguuuucacaaugagguauuuagauucccugaugaauguguuaacuauuacucuuuaaucaauuuguuacacguuuuuuuuuuagucaauaucccaauuaaaaguggcuccuuggauguugaauguugagugucauccauucacugaagucucaaaaauuaccaaaacugugagaaagaucgggagagauuaucguguuuuucuucagcugccacugugggagcuuagauguguuggagagacuacuguguuucgugacagccucacaaagaggcguggggaaccagagggaagcagugacuguuugccuucuccauaccuuuuuagaacaaauuuccuuauuugaaagcaaguccuguguuuuucuaauuauagcagcuacuuguaguuugcucuguuucccuagcaugguauacagcaccuugccuguuguuuuauucaagcauaugcagacagcaagccaaccuaaccugacuuuucaccaaacacucaggcucucucuucucucugccucagcacacacuugugcccugcugaucagaucugaugcuaagaaggccaacaaaguauuugggauggguagcaggggagcuggauuacagccuuuccguaaggguggagauuuguccuccuacucagcacugggcugugugcuccuaaaacacauaguagggugacacauauuuguaugaauaagugaauuauuuuguucuaguuuugacccaccgauuucccuguuuggacaaaaugucucugucuaacaccugcccugcuaucauauucugaaaauggaucauguuaucugcuuuucgaagcacacagaucuugcccuaugaugucguguauuuaaucucauccaucuuugaguuagaugauauaauuuucaauugaugggagcuaauggcacuugagauuauuuggaguuagaguugaugcaguuaaaaaacauugagacaagguggauauauuuugcacauggaaaaauaguaaauuugggguaaggaaauguauagacauguucagagaggaagagaacacauagggaacccuuuuugccauuaaaaauuaagaacuggccgggccugguggcgcacgccuuuaaucccagcacucaggaggcagaggcaggcggauuucugaguucgaggccagccuggucuacaaagugagcuccaggacagccagggcuauacagagaaacccugucucgauaaacaaaaaaccaaaaaacaaaaaacaacaacaacaaaaacacaaaauuaagaacuguuuacauugggcauuuuaaaguugauauauagaauauucuaggucuuuccaaaggccaucuagaaagccaggugugguagcacacgcuuguaaccccagcacuuggaagguagaagcaggaggauccaaaguucaaguucauucuugguuacacagggaguucaagaccagccuuggacugcgaaaacugucucaauuagcaacaacaauaauaaagucaucuagaguacuccuuuuuucacuuucuuaagaaauauucuagaauaguaccauguccuccuugugaguucccuguucuauuuguucagaaucucuuuaacucaguaaggacuggaaaacccacagucuucucuccccucucucuguucugacucucacuuggagaaugcaugcugguucuuauuuuugacagagacaucaagccauguccuacgccuucuucucucuccuguucuaucacuuucaaauaugauaccaagcaaccuacucugucugucaaagcccgaguacuaggcacuuucauuuucuuggcuccuuugcacuucaagcuuaacuuguugaggcuugaacagcugagaugaaacagaacuucaugcacccuuuugauuucuaagacucuggucuuccuggguccugaagaccuggggugacucaugccucauguguagauagguagaaauugagaagcauucuuauuuguaaguacauaaaaccuugggcacacccucccuuauugcacagauuucucaugcuugcuacaggguauaguauccaugaaggacagcuuguccuguaauaauuccugcaaccuaggaccuacucugucccacucacauuaaaucaucauuuaugucacuagcccuauacucuauccucuguagccagucaccaaaugcuuuaaaguuauucucgguaacacugucuuuuugagauacuguuaugucccugugccauuuaugcacaugcaggcuugcuuuuuuucaccaagagucccauguugggcacaaagacuagaaaacccccuaagucagccccaccuuuggcuucuagaaaccuacauucuuucuccccuuucuuuacuuuuagcacgauaaacaccaaccugacuucuauucuuaguuugcuuuauguauuuucuuuuguguguguguguguguguguguguguguguguguguguaaaacuucuuucucugguacaaaaagucauagagguuuugcguugccuugauuccuaccuucucuagcuaaaagugcuuuuccacaucuccuccguuuuuuuauuguuuugguuguuuuguguacguguguuuuguuuuguuugucucguauccaccuacucccaucuuuuaaauaauauaggaauuucuuaugcagauuaaaaugcccuuuugagagaggguauacuggcuugccuggaacucuuuuugaagaccuggcuagccuuaaaccuagagauauaugugccuugacuuccugaaugcuaggauuaaagacauguaucaccaggccaaggcuaaguuaaaguuuuuguguggaugugugucuucugacucuacauuuaauagaaaaugguaaauaaaauaaauaaccuagagaaaggcaacugucagaaccaaauaguguguacuaugugccugcucuacaauugguuuaugccucacaaccucuaagaaagcaugccuugcuuguugaaugcuucauuuucaauaaaagaauccuuaaucuagaaaugcuuuuggcuagcaaugaugaacagcagcaguuuaaaaaaauuuuuuccaaagcaaaagcaccagaaguuuggaaaggaauugcaaguuguguuauaaugcaacugaucucuuucuuccugagaaaguuggucucucgccagaguguucacuucagacccacacacucuggguauauuuauagagggcccaaugaggaagaagaaaagaacaugaucagcuuugcuucccagcacagcagacaaugacaaauacucaccaggugauguucugcacuuaagaacuuuagggggucaaaugucaucgaaguaugugacagccagacgugcacuggguugaaagacccugcuccccgccauauacacaacccaacuugaaacagcugcagaauugaaucuaggaauccagaaguauugcuggaugcuauugggcagccuucuuggaaacagggacauauaggcgacuaaagcugcucuuuaauucuuauuguuauggaaauuguaauggagauugcugaagagcucaagcuggucuuaaacucacauuucccaucuuugccgcucaagugcuagaauucuggguaugcaccauuaugcuuacagcugcuuaugaaaucuuaacaauauauagauguuaauaaaaauaugcaccacugugguuaaauguuuauuuucaauaccacauuuacaucuaucccaugaucuagcuaucacuaacauauuauuguccuauuuuacagaugagaaaacuaauauucagguuauaaaugggccaaaaguuaaauuugaacuuguuucccugucuuuuuacacugaauuccaugggauaagagguaauaagaaucguuagagggcuggugagauggcucagcaguuaagagcacugacugcucuucugaaggucaggagcucaaaucccagcaaccacacgguggcucucaaccauccguaaugugaucugacgcccucuucuggugcaucugaagaaagcaacaguguacuuacauaaaauaauaaaauaaaucuuuaaaaaaaaagaauccuuagaauaauaaugccauugccuaagaagucaguugaaguagccugcaacuagccgcuccauuuacaaucauuucucccuaagaaagucuauuacaguccacaagauauauaaggauauggcacugucauuguuggugaauagcgaaaaaaacccaacgacaacaacaaaaaaaaccucacauaaacaaaaaaaaacuguaaaaguaauuaaacaguccaucaaauagauccuuguuaugugagcuauacugcuucuauacaauagaguaaaauacagcuaucaaaaaguauuuuuucaaaagcauuauuauccuuagaaagauauccauuacacuuauugcugcguaugaaaggggagaauaaccaaguaugguaguacccauuuauaaucuuggaauuugggaaacugagacagguagaugucaugaaaaggugugacuuguuaguucccguguccagagccuauguucuccuccucaccacuguauggacuucuguagugggaacugaagucaaggagacuuaagucaaggucuugcucaugcuaggcacacucuagacagcacuguucuauggagcuauaggcccaauucauucacaauuuuuauuuugagucaggucuucucuaaauugcuccagcuggccucagauucacuguguaacccaagcaagucuugaacugccuaccuuccuguagcuaggauuccaaguaugaagaaacaguuuuguuuuaguuugguuuucuaucaaagguaguuagcccagcaaagguuguauuucuuaagccuucccuucuccucuacacugguuggcaaaugucagauugugaaguugugcuccagccaaugaguugaggcaaagcaguaaccgaugucacaaauagagcagaauccaucuuggccaaaugcucuugguagccugguuuggauucuaauacacccuuaucucagggaaaaaaaaaaugcagcugggcgugguggcacacgccuuuauucccagcacucgggaggcagaggcaggcggauuucugcauuugaggccagccuggucuacagagugaguuccaggacagccagggcuacacagaaaaacccugucucgaaaaaaaaaugccuugcugagcuacuuuuacuuuguuucuguaguccuuugugacacaccaagacuggccuuuguuuccaauacaagcaugcaccacccuggcagcuugucguucucauucauauuuuccccuucagcagucagcuuuucagacuccauaggcuaauggucuguccuuccaugggucacccuaguuuccaucccucauucuuuuauuccucuucucuugacauugcccuauuccauugcuguccugugacuguucagacggcauuauggaagacugaauauucuggguccaagguacaguagcguaugugcacagcucucaaguuagcauagcagcuugaaagcaacaucuuugucagugggcagucauucagaaguucaguguccaacagcaaaggagccauugaagagcugugcuuguuggaugcugcuuuccuuaaugcgcucuccaccuuauauugucuaauaugcuagcauccaaacuuaggaugcaaaguaagugaggacaggggcuucaaaucaaugaaauucaugcuuucauaacauaaugugcaagcucuaaggaauaagaaagugcuaaucucucaaaggcuaaagauaaggccauccgacagcuuugcaacgucagggacuuuagucacccuuuacacagucuuuacacacgugucaaaccuucagacggucuugagaaaauaaccuuuauuuuuuuuuuuuuaaaaaaaagagagauggcuuugaaguuugaaaaucaaagcaaaugaaagcaaggcagcuguuucucaguguagaaaggaccguuccuaaacugugagaaaguuaauaaggauuucaaagggcagugauaacuuauauucuaaugggggcagcacggggaacuccagguuggagacaaguggugaagacaacuacaccugaacauggaggcuuauacggcuuccuguguauaccccacuguucaucuuucacuauuucugggucucuuucucucuauucccucuucaucauagcguucucaauuccucucugugucacaaucuuuuucuuuuaaacacauuccuaaaagugggauagcauagaccuggagucuuuuuuuuuauuauuauuauuucuuccaucuuuuaaauggaguucugcuuuccucuucuucuuuuuuucacccuaaaauacacauuuuuuuucuuccacaaaacaaacuaaagugaguccagcagcuuuuuacuuguguguggccccaauugaucacccccccccccgugggucaguggcccuugaaaaaaaaaaaaagguccccacccuuguacuaaagggucuugccaauuuaauucuucuucagaaaaggagaugaauaacaguauggacaauuaguuacugugggugggagaaggaauuuggcuggaggcaauuuucuuuggaaagagauaggccagcacaagagguugaaauagcugcacuugugaaaaauagaggguaugaaauaacuugguggaaaguucagcugagaacaggaacaucuggggcuuauucaugcuuuuuuuuuuuaaaaagaaguuuuugaagcuuuuuuauuagcugacuugaccucagauugaagaggagauuuuucaaauguuaaacaguuuuuuuuucuuuugcauuccuaaagucauauuguguucagcuuguuaauaucugcacagggggccuucagcagacugcugccagagcagcgugcuuuggggacauaguuccagauagcugguauuucccuuucuugugggggauuugcaugugucccuuucauccaugcauauagcagauucauccguaaauaauugcauuugacaucacaguuguuagagaaaacacagggagaggggagagaaaaaaaaaagauccccauuucccccacauaagacagcuggagagaagcagauuagacagggaaauacauaaacauacguggaauguagcagguaacuuugucuguguuagucaugauaauaacuuacauguuggaauaccuauggcauacauuccaagaugcguaggacucagaaaaaugcaaacacacacacaccacgaaucaacacuuuguauccuggggauggauuuaugaugucugacaggagacgcauugucucagucuuccaaggugcuuucccuuguuuuucuggacaaggauuucagguaauucuggaguuucugauggcagccacaagggcaucuggcagggaaacacccaaucugccuugugguagacuggcugggaggguaggagguugucuguuugcagugugcuagaaauuccuauugcuggaacccucagaaggacaggcgcucuaaugauguucagaaugcgggcaguuagucugucuacugaaaguguaagcagaaauaacuuucugcuuuagacauuaacugccuaaacagaagcucucauucuuaauggucugcaacauguucuguggcugaagcucuuggagguaagucagugauuuggaguuuauuuucuugcuaacugcuagaccuacaaagguuccaugcaagcaaaagaauucaaaccaaucuccaaaacuuugacauuaaaaauguuuggaguuauuccagcacagauguugugcauucuguauugcguuuguggcccaugccagguuccuugauuaacagcuagaacacauacagacaguucaguaaauuaacacauaauacuugaacucugccucaaaauguuuguuuguuuggccacugagugccaguacucuguuagguccugggaaucuugagaagcacaaagaugaaucaaacacacuucugcccuugaaaacccuugggcuucauaggggugacagauagacacaagcccccacaauauuagguuguugcaauuugaggacaaguccuucugaagaaaguguagugagaacacagaagaaacaauuagaaucaacuccaggaaucaggaaaggauguguggaggaagugauauuugagaugauucuuugagaaugaacagugugucaacagggaagaucacacaaggcuaagagaacagccuggacaaggugcacagguauggaaugguauggagagcauuggagaacauugaugagaaggagguacaugaagagucuuaugggauaguaagggcaagcauaccagaauuuaaauuaagaccuuugaauuaagagcccaaggaucaaguccagacauagaaacuuucuuuaaaaguguaaagaggaauugggccaggguagaaagaaucucuuugggaguggcacaacucaauuagaggcaaggcacucauauacuuuagaaaagagaauggccuacgcaguacagugcaguacacaugaguaccaaccgaggggugggugcgggagagcacagggccaucuauagaggugagucacuuuucaggccaaauugggaaccuugguaccccaccuauccucuucaaaugucacagccuuccuaaauaaaaccugcuauaaacuagaauccuauuucaugugucaauaccaagugacuggcugaggagacagcugauagagcagaaaggauugacagacgauucaucuuuagucuggagaauaugaaauuuaacugaucauagaaaucuagguaacuggauuguucuuguuuuguugugaacauaauaccuuuuuagguuuuuuuguuuugguuuguuuuuuuguuugucuguuuguuuguuuuugucuugaaagcaacaccuagugauguagaaugaaauaaaauaaaccacauuuuuucuuggcuuucuuguuuuuguuuuguuugguuugcuucuuuguuuugugaagaaaguuuucucaguguagcccuggcuauccuagaaccugcucuauagaccaggcuggccuggaacucagagaucugccugccucugucuucugagugcugggauuaaaggcuugugcuuuuugccuuuguagggcaugagaaaugcagauuuuucuuaccaaaaugugggguucaagggucacaagcuuucucaucguagaugaacauaugaaggucauugacacuuucugcugcuuggaaaagagauuaaauucaagugguuagcgguggcucaucuuaaauacuagaugcuuauaugccaugauuuuugucauaaguauaaaugaucauggguugaguaacucaguguuuccccaaauuggguucccuucuggauaauauuaugcaaauccuagagguggucuuggaagggaauugggugagaugacuaaaagagaacuucuaguucucccuuugaaucugguugaugaaggcaucuguugccuuuuaaaaagcauccuucuccccaguucauuuccaucaccauguaacacaaggagcagugcaccugcccuguauuggaaaggaaauaagugucaaagugaggacagaauaagaacaauuggcucauuccacgucucugugggacuggaaaauaaucacucuucccacuguguuaaggggaagggcaaggcagccucacuggaagcaaguguuaaauuguggcuuguguauauaucuacuucagcuaucauuccuuuaaaucacccuaaaauaauggcaagcucuuauaugaaauaaguuuuccagaaagccuacuuuuugaguagcagggagaucuacuagggaaaccacauguuguacccgucccccacaguaaaaguggauccauacuacagcacauugucggagcccuagaggauuacauuucuaguaagaugugaugccaagauugcuaugacuuuggggcauuaaagauccugaagcacuucuuaaaaagaguguuuucucugaccuucuuggccaaaguucacaucugguaauugcaucuguugacacuggcuucccuuguccuuucagcugcauacaauauuccugucuugcauccugucuaaacuguugucuugcuaugugcuaugaaacagcaaucauguuguacucagcaggaauacauguggaaagccuuugggaguagcaagcuauagaaagguugauuugacaacauuuuuuuuuguaagccagaaaguagaaauguaugaaucagauucaaauacuauucaggauaacuguuaaugugugcagcagaguaaacaguagucauaugcagguaugucaagguaucaacaaggccuauuagaguuagggaaauaaaaacagaauggguuuuugguuguaauucugaaagguaacuuguaauuucagaacauguaaggaauucuagagucugcugaaagggagacucuuuauguggguuuuugcagcuuccaaacauacaaaugcauuucaauuucccaacccugggagguguaggcauaacuuagcuugauguuauaauguagaaaacuaggaaugaguuuauuuccuggaucugcuuaaggucucacucuagcaagugcaagaaacaaaaggauuuggagccaggucaguugacucccuuggcuucacucuagagcacaaugaaacugcagaguggugccauggcuguuggugguuugaagaaugaaagguggguguuauauuaaacacuaagaugcuggaauucuuggggagucuggaagggccaggcgucucucucuuucuaaaccuuggaaaccuuuuuaaauacacauguucuuaccuugucauauaauugcauuguucucuacauauuuuagguugucuacauuuagcuuugucccagacaccucccgacagcaugugauaacucaaauaagugcucuauuuucacuucugucuucuuagauaaauaauaauaauaauuaauaauuaaaaauucccaaaaccaagucauuuacucaucaaaugaggacuguuucacuacagauacauuguacauuuuuuuuuuaaaaaauuacucuguguguguguguauguguguguguguguguguguguguguguguguguguguguauguuuugugccauggcauaccuauggaggucagaggauaacuugugggagccaggucucuccuucccacacauagguugcagagggaaaacucagguuaucaaauuaaugaaaagaagcuuuaccugcugagccaucucucuggcccagacacauuguuauuaaauauugucuguggaauccaugggguagaauuaggcaagagcaaaaaagcagaaacauacuauuaaaggaaaaaaauaaaacauguaagcauguuuucuugaggacaaggggaaauagcacaaacauuaggaaaugggagugagauggaaaugagauuucauaagaguaguaauagagucuuauuuaaaagugucaacuugagcuucauguagcuaaugugacuccaggcuaaugggauaauuacaggugguugaguguuggagcaggaaagaagacaucacuggcuaaaagagagcuagcuuccuacugaguuggacugcaggggcugguauuuuaauccaggcuugagcucuucacuuaucacguugacuagcauaagcucucccuuuuggcaaagauauuuuaauuacuugauugaaguauaacuuacauuuuauaaauucacccauucuaaguggacaaucuaaagaguuuaacgaaauucuacacaguuaggcaaguauuagcccaguccauuuuguucuagcacccuaacaaguucaccuucuucaaccuauuuuuccaccucagucuuggucagccacuacuuucuguuccuguacauuugcaucuucugagcauuucauauaaaugaacuuauacaagaugugugagggguguguguguguguguguguguguguguguguguguguguguuuggcuucuuucacuuagcacaauguuuugaauauugaccuguauugaaacauguaucugucccuuguuguuguuguuuuuaauuacuaaauaguacucuuugucuagcuauacuacauaucauuuuuucagucaccaauugguggacauuuggauuaguucccaguuuagacuugugugaauaaugcugcuaagaacauucacauacaaaccuuuguguagacagaugguuuugauucuuuuggguagauuccuuaggaauaaaaugacaggggcauaugauaaauaugcacuuaauuucuugagaaacugcucaaguauuuuccaaagugguuguaccaucuuguuuucccaccaccaauguaugaaguucuaguugguccauuugcuuuuugauauuuacucuuaucacucuuugauuagacuuucuagcugcuuuuauuaguaucucucugugguuuuaauucccauauccuugugagugaugauguuaagaaucucuucauagacaguuggccacuuauauguaucuucuuggauggacuguccauucaaauaauucuuauggcuaucuuauaguuugcauaggaaagagaaaugaaaguaugugaaugugccaggacauagcuugcccucccuucugugaagcacccaucagcuuuuggcucucuuuguauuuguuuaggagaaguauuuauuugcuuaugugcuuguuuguuuuuuuauuuugcuuugucuugaacuaaagcacuguaacuacccaucaucuucagggauacugauaaucauuuagguggggcaagacugacuacacugcuugggguaagauauuacaagguguguuuguauguauuaucucaucgaaucuucagagauguuccaugagguauauaugccauugccucuuuuuacacaugaaacuaugauuggauaaugcacacaaagggaaucaagugacaaaauaguacaaccaagucuuuuuguuuuaaauuuggguguuggggauguaaucuaaacauuuucccacugaacuauauaucucagcccccuguauuuagucuugauacuaggucuuuuuaucuucuauucuuuccaguguuguggcaaguggucacacuugaagguacauuuuaaaaugucaugcuuuagaauuucagcaaagcccagaccagcaccuuuaggauauaaaguaggaauguuuuuagggcaagcuuucaggaagcauuuccucccuaaccugauuaaaaugaauuggcccauuuucucuuggcccagaugucugaaucucuguauuauagacaaccugauuguaaucuggaaacaauacagacucagaacaucugcugagagaaggaaauccaauggaugagguggcauauucugaauggagauuauuuuaggaagaaaacaguuuacuuaagccaacaacacaaugugucaauugacaaugugcuaaguuguaggccaaaauauuguuaaaauuaaauguauaaauaaaaauauuaauauauuuaaaauguauuguauucaguugucccuaacguuuuaaagaaauuuuaucugaaggaguaggcaagaaaauaacaguuuugugucauugagaggcacaguuuaaaagauuuuaucauauuaacuucauaaaucauuagaaauguauguuucaauauuuaaugucugugaaacuuccagauuaccuuaaauacucaguccaacagacacacauacacacacacacacuucauuagauuagauguuuugguuaguguuggcaacuauggccuuuauuucuacaauauacaagagaaaugugaggcauuguugccuuucccuaaaacucugcaaacuuuggcgcaguacugaaucacccaaaacaaaacaaugaaauucuaagcaccaacuaaaucaaauaaagaaccaauaagaauugugagacagaagagauaucuggaaacugaucaaccgucccuucaccuggggagcaaucuugcuguccccaaaauaguaaauauuaaguguucacaagcuaaacaaaaacuccuuuauccugaaaauggauuuauaauuacccauuugccccagagccauguauuaaauaucauccauagacuuuuuauuccugugacuuuugaaauuauuccuccagaaagcauaaggaagaaauugcuaaaaauaucauuaaucggaaaaccaccaugaaauggacccucauaccccuuauguuuuacuaaaacaaaacaacaaaaagccuacauacacaaaauauaaagucuuaguguuaaugagggaagggaagaauuuaaacuuuguauacuguugguaggaaaccuucaugaaaaccagucugacaguuguuccucauaauguuaacaaugacauuaugauaugaucuagcaaucaugcuucugguuauuacaucgaaaagaaucaaaagcuagggauauuugcacaucugugcauagaagagcauuauuccccauagcuaagauaagagcaagguuucuccaucagcugauggaugcgcaugauguugagaagauaguggaguauuacucaacuuaaaaagaugguucuuucacauugcuagaacaugggagaaucuugaaggcaucauaguaaguccaucaccaaaugucaacgacuucaucacuccacuggcaucuagaaugguuacauuacaaacacaaaagagaacggugccuuucaggauuuuugagaagaaaauaauggguugucauuacaucuauagaggugagauuacaagaugaagaaguucuugagauuggcuguauaauucugugaacauaauuaacacuacugaaauagacaguuaagacagcuuuggcacuugccuucaagccugacaacggaaguucaaucccuggcacccacguaguggaaguagagaacuaacuucuaagagcuguccucugaacuuuauuacccauguaccauagcaugugccccucccaaacacaaauaaauugaaguguaacauauauuuuuaaaagauaaugaacuuuuuuaucaugugcaauguagcacaaauaacuuuuaaauguguuucguauucugaaauaacaaaacgguacucuaagccaaaugccauucauuuauagaaaacuuuaccauaauguacacuaugccuuuguaagaaggcacauaguauaugacauuuucucaacuuguauggcuguggaucuauguuuccaaugcacuaugcaacuugcccaauguauucaugagugcauuuuacaaaaugguacuguauaaacugcuagugauuuaaggucuuacuccucuaccagacauuuuauuucaaagagauaccugcacuaauuaaugcuuaugcaaaagaaaugugucucuaaagauagaauguuaauccuugcaaaugccuaagguuuagggcauccggccaccuaccaucucucggaucugugcuugccaacagccaaccucuucugccugcuugcaaggucagccuggcauuuugacaaugcugagaguaggccauuagauuuaguagucauaccuaagagagacccaucuucacuauguaugugaucccagagcugcaugacuuccuuaagccaucgaguccuucuaauacagagagccagcauuuccaaggaagaacuuuaaugcugugcagaaaccuguggauagagagaauucagaucaaaaaaaaaaaaaaaaaaaaaaaaaaggaaaacuuacuuggguugaaugucgucguguguaauucaaaaccggaagguugccuguagguuuauauaugcuguaguuguuuuaaaggacaaugacaugguuaaaagccaagaauuuccuccaugagcaggugaaaaaacagcugacauucuccauuguuuuucugagggcuucgaauggcuuuuccagaccuguaacuuguaagcauuuuaguaacauuugauuagcaguuaugccuuacugugucaaaccuaaaauuagaaucugauuuccugacauugucccucccccaaauaaagccuccaauaauucuguauuucuuccaauuggggggugggugggugguaccuuucagugguagcacaggacuucaaucccaacaguggggaggcagaggugcauagaucucugaggcugaggccagcuugaucuacagagugaguucuaggacagccagagcuacccagaaaaacucucucucaacaaacaaacaaacaaacaaacaaaaucaguccaaaauuauuuccccuuuccucuucugagaacucucaacaauacacugucagagcugaaaaaaagacuuaggguucaugugacccagcuuccuuucuggacauuaggaaaaacaaaguccagagagauuuuuuuuaaaaagaggcccaccaagaugcaaaugcugacagagcugagaaaauaugacugcuucucuggggcucauucuggcauacugcgauaccucauuacaauuugauaggcgggagcuggauggauuugugacucuaggucaaauuuguuuauaguuuauuggaccagcaaauaacagggguuuuauuugaaugccagaauaugauuucuccuagguaauacaauuuguaaacugagugugaaauuuaaaaccugaaauaaaucagucucacagcauguaagcauguacaguaaacuguagucuaacauuuuguuuuaugugcaaaccuauaacaauuaggcuacauguauccacugaaauuacuugguaguuuugauuugcaucaguauuacagcagauucugaagagaauuuuuauuaggaauuaucuggcuuuacuaugcaugauauauccuauuuguaagugauauaaauacuguggagcuaaaugaaaaccagaaaauagcuggcuugauaggaaagguugucuagaguauaauggaaauaaaaugcaugaugccugagaauaaagaagucucugcaguugugcuaucuccuggcugauuacuauauugcuaugcaugugguuaaggccacauaucauauacuagcuucaaauccauuagcaaucaacuaguuagggugagagacccgaaccaaacuagagucucauuuccuaguucucuuaggagguucuuggagcguagacuaguuacuuugcacucuacugguuuugauagucaacuuggaaggugccacuaacccaguaaacaacacuacugguuucugaaugcaaacacugacauagguagagugugauuauuuuaggauaguuaagcaguagccuuuauauggagagcuuacaaaaauuaauaacagcaggaaaaagaacaaaucugaucaucauuaaaacacuuauacucuagggcaccaggcacacacaugauacacauaugcauauaugcaggccagacacgucuacacauaaaauuaaucaaucuaaauguuuuagaagacuuuuaugccuguauugauugaucuguguuuuuuauaauguuugguuuuaguaugcuggcuccauagaaaaagaugggaauuuuucuuuuucucccauuuuuauagaaauaauguuauuguccaacaauugguguaauuuuuuuuuacuuaucacuuagggaauuugaauucauguugaaaagcagaaguagacaacugucagugugucauggacauccagagauguuucacccacaccaagacaugucuuccucuuuauuuccuuccaucucuucagggagccacucuucccauaaaguccgguguuaaggccacaguuuaucagagaagagccagaucuaaagcuucaagauuaaccgcuaucaaccaagaaaucuagcauugacuggggucuguuguguucccguguauaucaaauuauuucuuugugauaggcuauguaaggccacugguauaaucaccauucaguaaaugcagaggcgaguacuuggaaacuuuaaccaugaagaagaccuugagugaauuuaaagauaggcuuugguagaguggaggaucugguguaugaccauugcaccccaguuacacaagugcauugacaggcugaauauucaaggagcagcugggacaaacuggauccucuagagagaagacuaaccauguccaguuguaagcauuguuucuuuguuauuuuccagucagcuagccaaaguuauaaaaauguucuaugaauuacaaggauguagugaaacagggacaugagaaaucauggacauguauaacucuuucccauagaguuaggaagggaaauuucacagagccauacaguguuuaggugugguuuucugaaaguaagguaauguuucuaaauauacagguuugacccauauaaaaaugcuaaugccuaaaugcuucaagcgaaggaacaguuuucccaguugaauuaauggaaacgaaauuuuauuccuggcucauaugcuuaggaaaaagaaacagaugucagacugggguagggugaggcaggggcauguaucaggcuggugaaggacuugguuaguaacauucgccuucucuaaacucuugugaaguuucgagaaguuugacauuacuuuuacuaaauuuaguaguugccacuaaucaagggaucuguguaggcaugaauauuucugccuauggauuucuggccauucucucccugguguugggggagggugugcuugucucuguacggucacuucacaugauuaucugagaauguaguuugaacuuguggagucauuacagacaauuuuaccaaugcuuacaguauguaugucacugccucuuuucagaaaccaaaacguuaacuagcaaccaucugagauguuaaaguaaguccuuaaauagaguaaggaaagcaggaaauaaagcauaauuguauucaauuaaauacauauguaaggauucauuauaauuaagacucgcugaaguguuugaaaagacaaauaggagggagaaaaggaaaugguuaguuauuuuggcagauugacuuagccagcucauuaggacuagauaaaaaugaagacuuggaagaauauagaagcuaaugacuuaaguauaaaaaaauuacaaauccucuuuguacaccauguuggauuuguguguugccuuagaaaagacaaacacaaaaaaaguuucuuuuuuauauguauuugucuuuguucuugagaguuuuauaccugcauauaauuaaauacagucauacacauacucgauuucccuucuccaagccccagaucaccucugaauuugaacucaguggucaucaaaaaaaaucugcaucugaccuaguuuuaguccauuacauuuccacacauacuaggcaaaaccuucuggggaacuauauauuucuuaaugacaggcuguguguugccuugcauuugccuacccaugccgggucaccaugucgccagccccuuugcuggugauauugcuguguuuugcaaagaguauagaaaggagaacuuccuuccccucuuaggauauuuaaacucauuuuguagcuuuugagucccuuugccucuuuuucaccaaccuggguugaauuccccauacuaucuccaaggauacagcagacaucuagcauucuucauagaaucuaagucuaaaaagccaguugugugguuggaccaugcuauuucuguugcccauaaugauuugcuguccucaucuguaaaaucaggggguuggaucuggacuguguaaucacccaaauccuuuugaagucaacacuccuuguucauccccuuaguaagguguugcauauaauacugaccacuucuguguguucaaaacaucuaaugaauccuuuuguacacaauaagugucauccucucagaggugacuacacugguuuucacccugcuguaccuaauuaaggacacucaauuuauaucuuuuuuuaaagauuuauuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagcucccaauuuauaucuucaaagauaaaauaguacucucuucaaaugaaaucauuaagugagcacaaugcuuggaauguguuuauguuacccauuauaagguuaaauguuaugggaaaggggaaaagauguuaauugaguaugacugccaguaaucucagaggaugguggggaaacccaugucagaacuggucaagacauucuuccauauugagcucagugaagggaaacaaagaaagguggaaccauaaauacauguuggcuauaauuuguuguauaaguuuuccuuuuccccucccacacuugcauucucuuauuccugccaccaucauccccaaaucacuuugagggauagggaaagaguccagguaagauacccagcuaaguacuuuagucucagaaauaagcaaaaugugcaucccauagccaccagagagugccaacgaaacaaugaauuuaccgucaucuucaccaacauguaccuaaaaaacaguauaagaucgaacucuccccaauaccgaguauacauuggcuggucuuagccacauagugcucuucccagaguuugcaguuaaauucuaguaagccuuuugggaaaaucaaagggccugucucuggaaugaagucacaggcagcuccagcaggagaaaugguugaugugguuuagaauugaauaagaagaagaaaugacaaaagaguuacugucagaaaagggaaagaguauauuuguaauagacuccaauccuauucauacuucagagaaguaaaauuaaucccaagaccaaaauaccccauaugagcgaguucuuagcuuagggacugaaaggugaaugugaagguugguuuaggcaagugauaaauaacauauuuuuguaaagguuaguuuggguaaacauuaagucaaaaauaugucuuaggcuuaaaaucaaccaggcagaaaguauuacugcuuuaaaauccugccuaaauauauauggaauuuacuagacugaaaugguauaaugucugccaauaucaauacauaauaaaugcaaagugacuagauuuugcuaaaagacuguuuaguagaggauuccaacaagauaaugauucauucagugucuuacugguuaagcuuuauuugaaguguauugcucauaauauucuuuuaaaguguucugagcaagggcuauugguaucaucagggguggaguacaugcacagaacccuaguucagcugcuaguucugaaaaggggggggggggaggugccuaaguaguuaccaaaagcagaguucaaauuccuucucuauugaaaaaugccagaaguuccauuucacauuccuucauccccuaguugaccuugccauucaaaccuguuaaaauacagaaagaaaaaaaaaugccauaaggcaguagucaaucauuugguagaugcugaacccaacuaagcaugccagggggcacacugaagaguccagugcuuaaguguucuucugggaccaaaaucuuauaaaaucaugguggugaauucugaagaggcagccauuucagcaucuuuaaugcucuauuuaccgagcaaugcacugucauuucuauuuaaaauaauuauccaagucgcuaaguuagcuuuuacuuaaggaagguugaaagauagaagaacacucuucuugguuucuucucuuucagccuguaaauauguuugaugaaaugugaauauuguaaugcuucuuucugccccuguucucugcuucaagugagagcccacuucccaggacuaaauucccugaccuccaaggaaacuaaaaccccaguauaguuuuucaucaggucccaucucauuugcuuguaccaguugcccugagucauuucuuuuccuucaagaugcuauagugcuaccuucauuauuagaaagacuucagaauugguauuuuucacauggcaugccaaggagaaaaacuaguuuuaacuuuuaaaaaaaaaucuaucaauaaagccugauuuugacuuguucuuacaaagaaggaggaaucuuugauagggaaacuagagacaucuuguuaacucucaguggaccagaggcccuuaggaagaguagugaagcaucauccccccucagucguugagguugacucuucaaacccaaugccugaugacuuggcugcugugguucauacauagaggcuauuuuuagaggcaagaauugucauuucccaaaaguauaaccacaagaugucuauuuagaauggaucacauuuaugcccucagacaguaggaaaugcucuacucaugucuggguacccucaguucccuggggaaauauguaauaucuugguauacucucaccccaggacccuuugccuccugucaauggcccucaucucgauggggcaauuccuucggaaagcaagcaguggcaugaggguucacagaggccuuugaagcugguuuuccuuccagaaaaagauaaaaugauaugucauccuuauagcauuucacagugguuuaaagcugauacagggacaagcaugcuuguaaucuuuagugagagagaugcucugggucaguggccuccagaggaaagcuugacuugcugaccugccuuucuguuauauucccaggcuugcagugggaugagcaucuugguuuaucuuuucuuauaacugcaacucuuuggggucuuuaguuucuaaaacagaggcuuauucaaguaaagcuggagacccuugagggaguuauacagcccaucauuaacagacuggcagacuaaccuaacagaaaaguguuuggcuauggauugcaagaagcucccugguuggcuaugggaaccucaugaaaccauuuagguuaccauauccucuuguguuaguugucucauuuauuuaaggaaaucgauugucuccucuccucuuugguuugacuucacuuugccggagauaaaggauccagaaucuggagauaaauauggcaucugccucugagugucacccaauaaagugaagaguggcccuuagucacucucccuaucuaugcaucugaucuagcuguuuaggcucugcauacaaagccuuucugggaaugagcugcuaggauaccagggcaagcacagcaggaagagauagaggccaggaaacauaaaguugagugcauacaguuuuuauuccauuuguuaacccauuaguuuauccauuacuuuccauucugguccagauccuauguuuauuacaaguuaaggcuagaguaguaagugccucuuuuuggcaccauuccaaacccuaucuaaaucuuacuguaaauagcuuuucauaaaguuuucauuuuuguuuucagagauagaaucucacuaucuauaccaggcuggccucaaacuuuaauucuucugacucagccuccugaaugcugggauuauggguaagcaccaccauguccagccuuuuuacaagcauuuaggcuaaaaacagacauguugccuaauaucucuccccaguccaacauauugcuuuuuuuaaaauaaagcuaaugaugcucugcuguugccucuuaugguucuagagaggauugacugagaagacagauaaggaagugguuuuaauuauuaaaauaaugcuaguaguaaucuaagaauagguaacaguaaaggguuauucuucuguacuuagccuauaccuaaaacaagcauucauucuguucucuauaaauauguaguauuuaauauauaacuguaauguguuauugugugaacugugccacauacuaagcucagugcucuauucaauuuccauaguuacacagcgugagagacaaguagggguauuaccaugccuaucucagagauaagaaacauaaagcuuagagaagucaaaugauuuguuuacaguccuaaggcugcuagacaauauguccagauuuggagccaaguuuucugacuccagaguauaagccuuuagccccuuaugguauaucucugcucuaagaaagacuaaagggcuguacaguuuuaagauaccaacugaaaacccuuaaucuggucauuugaaacccaaaugcuccgaaauccaaaaccauuugagugccaaccugaagccaugaguacaaaacucuauagcaugauagauuguuuaaugcacaaaaguaguaaaaacucuguucgagcuguguauacaagguaaauaugagagagaaauggauuuuauauuuaaacuuggguccuauccuuaggacaccucuucauguauuugaacacaucccaaagccccuuaucccaaacauuucaguuaagguaaacucaaccuguauugguaacauuacuggaaauuuucuaagauaguaaauggcuuccucaaacuauggagagcugucaucucaaaugguuugaauuccauagauuccauccucggugcuucuuucacauuccaguuugccuuacuauccagacauggguucaguggagagccuugucuucauacacuucaguguuucuuacccauggaagcuacaaguggcgaggggagagagagaauagaugugaagucugagagauggguguggaagagaguuucaccaagaggcaccuauggaagcacagcgucuggcaagcagucccccuacugcucccucaacuaaacauccuuggcgcacagaccuuuccuugccuuacugggaacauucaaauggguuuucucacacuugaaaagaucugagccggaugauuuucugggaccucguuguguggccaaagcacuuuccuugaccuugcugaugaggccuauucaacaagcccuucaccucuguugguguggugggggcugauggcccuucucccccgcuuuuucuucuucuuugagaucauuaucauuauccugaacagcauaguucacaugucagagaacuuagccaccuugucaggaaauacauuaagcacaauguauguauuuuuucuaugugcauucauccaccuaaugaacauuuauugaauaauaccuuuacuuugugacaaaugccaugccagccacagguaaucaaggcagacugcgucacuucuuuagucuauuacaaaugcaacagggaaauguauaauugcaaauugcagaaaauucugugagaggaacauccacaggaaucuaaaauguaaauucuggaacuuuuuuuuuuauagacuuaauaguacuagcccccauuuuuacagguaagaaagcugaagcucagcaagagugacuuauacagcaucacacagguagugaacuggcuggguagagauuuaaauccaugcuggucauauuccaaagcucacacucuuaacugcuaugcagcaugaccugcucgcuguguaaaguacauauauagccauuaauucuagccuugugcauuugagguucuggcuucaucucaaaagugcagaguuuccaauuguuuccaauuacuuguggcugugguuuggugcauuuguucaaagaaagugugcaugcaaagcgggggucacaugcaaggccucguggauguacacaauguguaaaucguauuggcauuccaaaaaguccaagauucauuggaguuaccacauuuguuucucauuagauuaugcuacucaaagacaaacaguaaagcauguguuuacauuacuguggacauggagagccaugcccccaaaacauuccuugcagguuguauaaagcuaagcacccaaacaauuccaaaucaguuuuugugagcccagcuuaauagcuuuaaaauguaaccuggauuccccaccccuccccccaaaaauugccuagaagacaugugagcagccaaagagacaucagcucaauacccaaacuauguaucaaaccccguauuuccaguaucuauuuuguuaguuauucuuuauuauuuuguaaauguuaaggugauuagagucaagaaaacucuuagcuguauagcaacaggaauggcauuauugauuccauccuaacuggcuguccaaagccuaucaaaacaaacccauucaugaugagaugguuugguuauguaagacacaguagaugcaaagcaagacaggggcauccaguguuauuaagagcauagcguuguugccccuucuugguuuuguuuuguuuuguuuuguuuuacuuuugaaacaggggucucacuaugaagccucugcuacucuggaacucccuaagcagaccaugcaagccucuaacucacagagauccaguuacccaccucucucugcuagggugcuggaauuaaggcgugcaccaccacaccuacuuuuauugcccugucuuuacuuuccuacccaauaguaaaagucuuucccaucaaguuguaguuaacaccuagccuccaagagaacgucauagaguaggaaguuaccagaaaucaaggcaaccgaauuaaaaaaggguaacugaaagucucaguuauagaugucuuuaccuaacuaguacguuucuuagagcacuugggacuuaaggacuuaaugauuuuuuuuuuuuacuaagaucuuuaucaaucacccaguaaggucuuauauacucucugaggcucagaguguucccuugaugaagaaacugggaauggcagacuucccugccgcaaaaauucgagggcugcauuccaaaggacuuugugaguaugugagaggacaugugcucagucccagcucagugugaggcugauaagacucuugcccuuacaaucaggacaguaacaagaggcgcauugucuguaccauguagacagaucaagagggguuucucccaugggccucauugcagcauauuugaucccuguaagaacaagaaguauauuauucagaucuuuguucucuugucaaccaagcaugaaaagaacguugaccaaauuguguugucccauguuguagugccccuuuguggauauguauuuaagaauaugaaauugauauauucuagaaagccugguuuuuuuuuccugcacccugauucuaauuuucuuacauaauuaugucaggguuuuguuuccuuuuauugcaugaaccugaguacccguuucuaugcuuacuuuucaguguuugccuuucugaucaaaugaagucaaucaccuuuauagaagaggcuuuucauucuccuuacaaggggauuuuuauuaacuaugauggcaaaaggucaugauggccauaccucaggaaaaagaaaaaugucauugucuucuacucucuucacaaacugguuugaagaguaauaacaaggauuccagcaagcauaauaauaauaaucacauacaucuggcuagcaccauucaaguccaaagccagcuccagagaguuucuaagaagcaggguaauagugugaaaccuuuauuagagugugacauaaaccuuaaaucucaguuacuuaggaagcugaggcaggagaauaucuuugaacucuuaagugugagaccagccugagaacauucuagaaccugacccccccccaaaaaaaacacaaacaaauaacaaaaguaccucaucugggguuuagucacauuaagacucuggaagacagguguauuuagaaaugcagauguguuuugucuuugagauguuaugaauccagcuuaggaccucauaccuaccaaacucucuggaacuuaccacugagcuacauccccagccuagggagccucauuuccaacaagcaucuuagauaacuuuuauacaaguuuuauucucauuuccaugguugucuauggauucggaguacacucucuuuaaucuagcaauccuacuaaaggaaaugauaaaaaaugugaggugauaugaaaacacuugaugagaauaacuaugugugggaagucagacauaacuauaaugcaaacauuggaugcugaaaagugguuaaggaaauuuugauaaauuccuuuauugcuguauguuuuuaccacaguucaaauacuauaguuuucuuauucauuauaagacuucuaugaggcaaacacuauuucucacauuuuauuuuagagagauuaagcagcuucucugaaaauaaauguguaauugcucgggaaacuaggauuacaaccuaaguaugcaugauuagaaaauucaagauuuacuauauaaaagucaucaauuuaaagccuuauuuuaaaaaaaaacauaaacaaaauagagucuuuccuuuuacuuuuccauauauauauauauauauauauauauauauauauauguuguauuaaucagcuuucuguuguuaugacaaagucccugagauaguuaacaaauaaagacaaaggguuuuuuuuucccuacucaugguuucacagguuccagaccauggucuguugcuuuugugccguggagaagcagaacaacauggcaaugaguacauugaagaggggcugccucccccacuucauggaagccaagaaggagguuaagcgcaagcuuagaacccaaugucuucuuuaaaggcacaagcccagugacuuaacuucuuuccacuagaugccaccuccuuccuuauacuuuuguccucucccaauaaggccguuuuuucuggagacuaaaccuuuacuauaugaacauggggugggggaguauuuaagauucaaacucugccaauagugugauacaugacaguguguuaugagaucaagaacaaccugaccuauguaguaagauucuaucuuagaagacaaagugaaaaagauagaugaagaacauaacaugguacuuuacacauuacaaaaaaaaaaguucuaaaauaaaaucaagacuuagauaugguggcauauuccuauagucucagcacuccagagaucgggguaggagaauuccaaauuugaggccaaaucugggauacauagcaagaccuuaugucaaauccaauguauaaauauguauugacaauaugcuuagccaacuguaaccaugguucagacagcugagcagaggguagcagcuauagaaaaugcuggguuaugaauggucuuucccacucugcauaugugaauccaugugugacaggcagaugcuucagguuuagagcccggcuguguggacaguggaugaaacagucagauuuguguuuuaauauuugacauugcuaaucacuauucugagccacaggcuuauuuuuuaaagcugacaggauaguauccuuugcaaaugacaaacaguucaucaacaacacuaagcccuuuguguuaccugugcuuguguaccggucucuccuaaucuucuuuuuuauaaaguaaauacuaagucugagagauauuguaaauagugagagaacaaaagagcuauagugugaaauggaauuagccugauuggauuucugagggaaagucaaugcugcacuaaauccauauccauuuauuggcaauucuuccucagacccauugucuuucuuucaacccucuucuucauucucuuccaaagcaauaguuuuccugguuugaauuuguuuuguuagugugugaggacgagacuccucaggagcuguccaugugaaauuacuaggaaaccugucacaaucaccuuuccaugcuggguuucucuccaaaaugaacauaauugaagaccuaaagugcuagcuaccuccuuggcaaaauuuuacagccuguuuugcaaggcucaccuuaguuuagcagggcuauccaauaacacuggagacauuuaugaagggucagaaauggccucucgaaauaagcuacugaucuuaaccagggucauccaaaagaguuucagcagggcuggagagauggcucauuugguaagaacacuugcuacucuuucagagggucuagauccaguucucaacaccaacacaaugucucacaaccacaauagcuccaauuuuaggauaucaggagccaucuacuggccucugcaggcaccaagcaugcacgugcugcacauagacacaugcaucuacaaaaaauaaaaauaguuuuuuaaaaggggguuuugcuacucauuucuaaguucuucuacaauuaauccuggcuuugaguuuucuuuuuccuuuucucucugguuauggaaguaacuuuaaaggucuaccaugccacuucauuuuguuucuucuguuccagagcacauguauugaguaucaaguauaugccaaauaguuccuuaaaugcugugggguucaaaaacacauaagaugaaaacccuagcagcuccagucuaguaguggagaagaucauaaguauacauaaguaaugccagauuacaucuagaaagugccauuuaggggguagagauaaaagaaacacucaugggagauggaggagaauuguaaugccaagaaggcuuuauuaaggccaugacacuuggacuuggcuugaaaaccuggaagccuuucaauagacaaaaaugaacaacagcccauaguauguucuuaguuaaugcuuacugaagguauuaauaaaaagcucaaaugugagaugugcuuagaaaauagcaaguucacuaauagauaccuaaccacaaaaucuccucauguaaaaaauucuaaugcaaacaguccguguuauacacaaaggaugcauucuugaaaauuaacacgaaaugcuuaugucaaaagcaauuuucccauaugaaauaaugguuaaggauagauuugaaguuuuaguuaaacuauagugaugcuuguuauagcagggacucaccauucucagagaauggucuguggacucuagaagucccugaaauccagagagccacaagaucgaaacuacuuucacaacaauacuaaaaauuuauuuguuguuuuuacuguguugauaucuaccaaaggacugacuagggaaaguguuggcaccacuguguaaauaaaagcagugacacuaaaaugcaguugucacaaacucaucauuccauauguuggcaggaaaguggcagucaccuaagaguacuguugcugaagcuguggaaauuacugaauuuauuaaacgucaacccuuaaaugcaauuucuuauuaguuugagcuaugaacugaaaguacacaaaguaugugugccucagcuauaugucagugugcaucucaaggaaacacucuugggagauuagugaugugaccuacauuuagcccccuuuuaucauuuguguuuuugaauuccauaguaguuuggguuaggaagcgggaggaaguacacauagugugcuuccauuguacaccaauguacauuucaaggaacucuacuuauauaucauugucuugacaaggaacaaagagaggcugucagcaugaggaaaauaacuacacauacuuauugcuaaugauaaaacucuagcuuuuacgagaagacuaagggucagcaagagcuggccacacuguauccauagucccaaagcacaauaggagaucgcagcuugcucucuccuuguuauccagccugggacuccaaccauucgaugguggcaucugcaguuaggguagaucuuucuaccucuacuagccuaaucuaaaaaauccuucccaggcaugcccagggacuucccuccaugcucauucuaaaucuugucaaguugaugaucaagauaaaucaucaccaacuugcacuugaaaaacaaaggguggcaccucgaggaccaaaaaugggugacaagacagcaauuggagcaggaauugaggcuaauagcauaaagccuuagagagagauaacaaggaaaauaaaaugaaccuucauucauugccaguaugggucuguuaguggagagacauugggaugauaggagucccacaaaacaaagccacaugacuaaaaagcuaugccccaaagaucgaaagaagcaugucccuuaauaaguauauuagcuaugauaaagcagaaugauuuaaaaagcaccuuacuuacugaaaacuugcagaagaaagaucuguuuacauuuuuuucaauuggucaaaauaugggauaugacaauuguaaguaauccuuuaaauugagugcuguuccuuuaagagacuguuaugucuuuauuccauuagaaacagguguugaagguaaauuccauucuaguacacuuucauagggaauuuuuuccugaucuugguaaccuaauagacuauacauauacuucaccugucaaggaacuuagauacaauguuacagaaauguaaaaugugguguauccccugacuucagugugguuuaaguagacuggaagcauaaagaauccugucaaaugcuguaaaauuguccagaaguaugaagcucuaaaguauauaagcaacucacacauaguuaaauuugaagaugauuuuuuuaauggagucuugcuauguuacacaaacugguguugaacucuggaccuaagcaaucuuccugcuucaaccucuuucauagcuagagcuccuaguguacguuacuaugucuggccuguugaaaggaguuguuuaaaguuguacacuucaugguaacacauucuucgaacccuaccaggaaaaaaaaaacaaggagaguuucuauagaccuauucuucucuuccagcuccugagaaccaugucugugcccaaggguaaaguucuggauaaaagccuggaugaagaaggacuugaaaguggagacugcggugaugaugaagaugaaugcauuggaagcucuggugacgggauggugaaagugaagaaucaacugcgcuuccuugcagguaacuggcugaaaagguugcucaauugcuuucuagacuacugcuaaaaucucugcaguacacaaugccauaaacucucauaggaaaguugauccucuuaaaaggugaagcuuucagguagguuuucuaccccaaacccucaucucuaacccuggguagaccagaaaggcauugucccauuuuuccuugucuaaaagcaaauuggcugaucaguugguucugucuucccacugaagcuguccuugggccuucuugguuauacaaagaaaugcugccuugggaaucuugugcaaaccuacaaugaaucuuggcguuguagugggguauaucuccuguguaagguauuagguuuaaucccccacaccacaaaaaaaggaagcagaccaacaaugaaauaacuuuaaagaaagaacuaugggcugaccuuuccuucuucaaacaacaugucuauuuucuuuucucaaagcagucugguauaguuacaacauaucacuauauugcuacuuaaacacaauaacaauagaaaaaagaaauggcagggaugcuggagucaaucgggaaaugcaaaaccaaaaccaauaacaaaccuacucguauuuguugugucuccgaguuucuaaguccuuccauguugacaugcauucuuccauuauaaauccuuccuaauaaagcugggcucagagaaguaaugagauuucucuacaugcgaaauggacuuucacuaccaagccuuuuccuccucagcacauugcuucugccugugucccaggccauccauuucucucguagccucauucccuuaacuaacugcuaucuaaccugaucuggcccuaaaagaugguugccagccagaggucucauuuuuagccucuucuucccucuucuuuagagagaacacacacaucauauccacucucccucuuuaaaugcuuucuuggaaucaauucuauuucaaugaaaucuugcuucuuaagaaaauuuuaugugcacuguaggcaucauuaauuagguccaauuuggccaagagcagauguccagcauuuuccaucuugcauguccaaagcacucugcccauugaacagcaccuccucauuuuccccagacacuccccagcccuggaaaacaguauuuuccuuuguggcuucugaguuucacugcuucagaacucauauaaaguagaauuguacacugaauacccuucucugauucucuuaauauaauguccucaagcuucucucguguggaggguaugguggcaugauucccucuuccuccauuucuuggauuguauuuuguuuuuugagucaacauccuagaauaaccucaaacuuaagacguagcugagauuggccuugaacugcugauccuccugccuccaacaccccuaguacaggcaugcaccacuguacguacacacacauacacacucacacacacacacacacacucacacacacucucacacacacacguacagacaaacacacaccuuguacuuuuuaauccauuuuccuucuguacagauuuagguuaguucaucuuuuuguuguuauuguuugcuacuguagagaugacauaaaaucauuacuaucaguaucaacuguucucccaagcuaccaggccacaccuccauugggucacuaauguuuuauaucugacuuucucaccauuaucucugguuugaugugucagaaaucaaacuuaugaaaugauuaucucuaacugguucuccuuuaauaagcucucuuucugaaugccuccacacuucucuuggucauugagacuuaaccuaaagucaucuuugguucuuuuuuucuuccuugucccucauaugcaguugcucacugaauccauguugauucuuugucacuuuuucuguuucuaucacugcuuccugucauucccuccucccagccuccugcauguugcaaucaaauccaguguucuccaggauuccaggguaaggcaggaggauggugagccuuaggugaaccaauuagcaagcaaagaauuacagacccagccagaggauuccaacaaucugucaugcgcagaugacauguuaaucuuucugaagcaucuucuccucucccuagcucagcugccuucguccuguccccauugcuuugaagauaaagcucugauccuccacagaauucuaagagacuuguagucuagcccuaacuaaccuucuggccauauuuccuaccauuagccauauauacacucuuuacuucagcuuuaaaagcuguauuugugcccccaugaaccccauaaacaugcugugcugguuucuaucuucauaccauugcccauguuuaugucuauaaagauaagccucuuuucuuccuucuuaaaucauaccugaccccccacagugcauuucauauaugcuucagggacaagaaaguuaguuuuugcuauagagugagcauauauuugacuucuucuuccauguuagugugacuuaggaaaaauuucccuaaguuuuaucauuuccuuucuaauacuccaacucuucacucaccaaaugaggcucauacccuaacuccauggcucuauugcaggaacaugucaagggaacaguugacagcaugggccgcuaggugcucugugauuguuagcuuccguccuaaacucuuuugacaccgauggauauauggaaaacaauucucugaaauauugaaagaagcucugccaaugcuuucaaaauauacucuacagugaguucccaguucuacggggggcagauucaggacugauagucaggcagucugauuucagagacuaccacucuacucaaaugguuucuuugcuccucaggguaaccaugaaaauaugaaaauggguuuuguauuauacuagaaauuaaacauacuuugaaggccccaaaugcaaaacacuauaaaauucaaaccuucugagagccaccacgaugcucaagcuguuucaaauauuuagaaacgaucaaccaguaaagaucacauaaacauuguauaaucugaaaaauaaucaucaaaaccugaagcacuuuugguccuaggcccccaaccuguguuuagcaacucuugugaccauauacacuauaaagauuuuccagacaacucaccaaaauguuaacuaguuccaacauugguccucagcucacaacacugcucauuucaacucaggauuuccugccuguaagccuugucucgauccauuuuuuaaaauguucuauaguuccaaggcgaccuaccuuuuguaggcaguacuuggggaggggccuugugaaggacuuugucaaauguacuuagauugaauccuugguuucccauuuuuuauaugcacauugauccucucaaaggacucuagucaguuuguaaggcaugguuaacuuaagggcuuuguaaacuauaauacacuaugcagaagguaguuaauuuaauucacagggaaaaugaugcccugccucuuaaaguacuacaugugccuacccugaucagugauucuaccagccugugguuccuugggucuccuuuaaaacaauucuuguggagaagaaacucacugccaaucugucacgcucaaggcacaauagcuauuuggaacaacaggcuauauacacauugguuagcuguuauauaauuucaccgaaaaucuggguggaugccaugugguccuggugauucaucuucauccauuuauuuagucaacuugauuuggaacaugaugugcauuuaccauuucauuuaguacugcaaauugccuccuccagaaagcaacuugggaauaaagagcauggcuuagagucuguucaguucucuuguaucuuccuuuugucccugaacagacuuuuuacauacaucacaaccagugagugauccuauuggcugaauuuccuggcucacuucuuccuuucuuuugauauacugcauguaauacaguucuauucuugggcuuuguuucuaacuccccuguguccuaaugaaagucccuuucacuauuuaggagacaauuucuccaucuguaacauaaaggcaaugccuaaacaauucuuacagacuugucuacugccaacagucugugaucauuucuuuggcuguggcuccugccaagacacuuacaagagucuuugggggauaccuuuuuaugcauuuccaccaaacuagcagguucucuguucucgucugugauauauugccccuauucuaaccacucugacauuuccaaucaggaaacugagccuucuuacaaagaacugccugcaccuagucaucagcacauucguauaacaggauauuaccuagaagaguuuauauguguccaagcuuucugggauauauucacuuuuaaaauucauccgaaauuuuguuaaaugcuucuuuuuuuaauguuccugccuccauccuuuccuucuuucauuccauuuguuucuuuuuguguugugauuuuauuuuguucuuggaugggcgugauauugauguuucgaugauguauuugguuugggggggugguugauaacaaaguuuuacagcauaccccaggguggccuugaacaggccccaaauucuccugcugcagcugggauuguagacauggaccaccaagcccaaugugcagcacgucuuauuucugcauuaaaaauagcaauuuuggggguuucuacucuuuucugacuguugccuuaauuuuuuuuuuuuuuuuuuuuuuuuuuuuuuuuuuuuuuuuuuuuuuuuuuuuuuuuggugauggcuguaaagcaauaucucacccacaguuacacaguuaucuuuacccauggcuugccaacaguauugugcuuuccucuugaugagugucuuagcccauuuaugcugcuguuaacaaauacuuuaaacugggugauuuauaaagaacagcaauuaauuucucacaguccuggcagcuaggaagucuaacaucaaagcaucaucaucugccagaguccuugaugcauucuuagauggcggaagaugcaaaugcugauuccuuauuugguagaagagauggaaaggcaaaaaugagcaaguuuuguauucucccugcaguaagggacuaaucugcugcauggaagcagagcucacacaucguuaucaccugccaacaucccacuaccacaauacuguugcauggggaacugaguuucagggugaauuuuggggugugcaugagcuuucaaaucacaucacucauguacuucuucucuccccuccugcuuccacaucugagaauugggauagcauuaggucuuauuauagagcuuuguggauauuucaaaaaagauacauguaaagcauagagcucaguccccaguacuccaacacucaaacccagauaccugcuaugaagagugcuguccuuuuguuucucuggaugcugauaugaucucaacgagcuuauggauauaaaccagcacugucuuagaaacccacuagaguaauaaauucaucgcaucuaucacuucagagguagagacaugaucagaaauucaagguuauuuucuacuacacaggcuacacagcaaguuugagaccagccugggccacaugaaaacuugucugaaaauaaagaacugguuuuuuuguuugucuguuuauucaaaacacaugacagaccauuuaaaucaagcaacuagccugcagcuauauauacugaccucuuccuauucaacuugacuucaaagcuuuaaccaguauuaaaaccaaugcaguacuuuguauccacagauauuucuucucaaaaaugcuugaucuguagaacuuccagucucucggauaugcauguggggacugcaaaugaaaccuguucuuuguucauuagauagacaaguuugaagaugaaaccuaggcccaugcaggucccuuuuaccauucuucucuguugggguuagguugugagcuaaucuuguuagcucaccuccuccuaguagucuuguagaaaugacuaugggguuucucaacaauagaaccaguaguuccuuaucaaauauucuuucucugcgguuaguuuauauuugaaagguaaaaugacaacuucaaauaaauauugauuaggaacuauuuuaaagccacuuacuuuuauuuuuacuucuauuuuuuucuugagauaaaauuucaugugccucugguuggucuucaacuuaguauguagccuagaaucagaaucgccuuaaauuucugauuuuuuaaaaagauuuauuuauuacuauaucuaaguacacuguagcuguuuucagaugcaccagaagauggcgucagaucgcauuauggguaguugugagccaucaugugguugcuggaauuugaacucaggaucuucagaagagcaggcagugcucuuaaccuaagucaucucuccagccccaaauuucugauuuuuuuaaaaaucuacuucccaaaugauaagaggacagauauguaugugucaucacacucggccucuuuuccgugcuuuuuuuaauaaucaaguacaaccaacaagcuuguggcauaauaaagggauggacauuucaaugauguauucuucuaaacugucaagucaaauccucacaaaugugagcugguaagcacuguguauuaagaaauucauugauggguuggacuugugaaagggauaaagccagcgaaggaacuuuaugauaggccuuuuaucccaggugacaucugcagacagagagcuuuuggaggaaugaacggcccgggcuguuguuuuaaugggugacauguugaguccagugcugagcucaaaauacauuagaagcaauaccauaucuaucuaccuugaccaguuggcaacaaguucagucauaaacuacaguaguuucccaaaauggauucugcaguuugagcaaguuuuaccuucucugugcucuuugggaacauaccauacagagcuuugacacuuaaguugcagguugcaucuugcuaaauaaucuauguuucgaacucucaggcaagaucuuauauuucuuaguauaucagucccuugaauacauggcuucaaugcaaaaggagccaaucuaucuucuaggaaguggauccuaucuaaugagaaccgggacagucucaauacauagggcauugaagucucacauuaaaaacaucauguaguccagugucagggaagcuagaccugcuauaaaugcgguaacuuuuagaaaacaucccuuagcuccacaaaacuucaguuucugcauuugugaacguguugauagcaugccuaccaauguucauuaguugcugaaccacaggugaugguggauagaaacauauuuauaaaauuauagagcagaguucucauuuuaacuaaucugacuaucauuuaguacuaucugguucuaaauaauuuuuuauuugcaaaagccuucaacuaaaauggaaaagguccaaauguucuguccaguaauguucauuauacguguauucucuucgccauuccuaaaaagggggcauucgauuacucuuuaauuuguuuuuaacccagaguggucuauaguaagaaaguauuugaacaaugacaacuaugucuguugaguugugcaaauaaccacagaaucgaaacaguaguagguaccuacaucuugaaagacucacagcuagcuaugguuuguuuucuuuggugggaguauggcaguaagggcggggggggggggguggacagcuuguuggggagggucaagaaagagcccuugaugcuuuccauuauaccuuggccuuagcuacaaacagccugcuuucaugucuaggucuuugcuuuuauguaguuaauaccuuggggaagccaaaggaagcaaagcucacuauaauaacgcucuucccacauacagaucaggugcuucuugcuaauagauugacaagacagccaaucucaacucucccuaagagcuuuguucagcuucuacagcucacgaggaaagacuuagaugugagcuuuagcggugauauuaccugaaaauugagacauaugccaagaaaggagccuuccaaaugucuuaguguugacuagggaguuaccaaaaguaagcuggugauaaaugagaagaagaaaaguagaaaucuuuuuauaaagucaccacaguucagcauguuuucaggaguuuguuauuuggcuaagauuauucugacguuugauuuuuccaagucucuaccuucugaaacugcaccauaggaccuuuaggguaugaugccuuuauauccagagaaauugugaggguuuuguuuguuuguuauuugugguuucaguuugguugguugguugguugguugguuguugguugguuggaugguugguuuggcuuuuugagacaggcuuucucuguguguccgcccuggcuguccuggaacucuuuagaccaggcuggccuugaacucagagaucuacuuagcucugccuccugaaugcugggauuaaagaugugugccacccaagcccagcaucaaggauaauuacugauaauauuaugguuaauaugaacaacuuaagauuauuacguuugcaagcacgauucaacuaaaauauuaauuaagaauuuggcuaccuggguuauaauugcuuuccucuguguguguguguguguguguguguguguguguguguagagggggaacaaugcugaccaauucagugacagccucaaguaaacuuuguaagaauagauagaaaggaaugggagagcuagggacagugcucagcuuguagaugaauagaagaaggaccagucagaaaguggcaaugucagagcuuccagcugugcuggcacacagaagagaagacauuccuguggacuaauauccuugaggggucugggacaaugaguuguagugccauuaaaugggauggucucaccugcucaaaaauacaucagaaagaaaaacguggauuucuaccuaaaucaauguugcuguuggaaauuucccugaaaaaaaaaaugauagugaucuggcaagaugaucuuugaguuuuucucaauuuacguuuuuuucuaauuuuauagauuuuuuguuuaguuuguuguugucguggacauuguuguuuguuuugagacacgguuauauacuguagccuauacucacuucaaacccaugacaguccuccgugccucagccucuccaagggcugggcuuacaaaugugaaccaccauguucaguuguuuuuaaacucauagugcugauaauuuccaaauauacugaguuuuaucuuugauuuaaaaaaaaauccuaauguacguggcugauuuuaagccuuuaagguaagaacgggagugcuagcauagacucucuucauuuguaacuuguggguggacuuaagcagugauauaauuaccaaguacauaaaaacagaguggagguugcccuacaaaugcgaauaucugcaggcagccugugugugagagcagggggaaaucucauuagcaccuucaggaugguuuucugaguaaagugauuuguccaaguacccaugagcuccugggagaauuucaagcauguuuuuuucauccuauaucuacacuuuuuauccugaaggugcuaaugagauuucuuccugcucgcagacuaucccagacaccagaauuuggaggaaagccucuacuacacuuuuauuugcuuaguaauuauauugcucaugaagucuaucaaugagcuacaaauuaggaaagucuguuuaugcuggguccuuccccccauuuuuacccuaaggacucagcugucagucgccaagcucaccacccccacccaccacauacacacacauacgagcuuaguagaugucauuuaagaaacauuucaggacuggggcagaaagcucacugguagaaugcuuaccuacuaugugggaagcccuggguuuuauccccaguaucacaaaguaaacagauauuuuaauuauccaugugcagugcugguaugauuuuuuuaacaguacugaggacuucaugcuugccaaguaagcaccuugccacugagccacauuccgaacccuguguguaauauuugcuuacuuucuccccauauuuggcaggguagcaaagugcccccacucugacugacuuaugaacugacuccuccuuccaaggccccucuagggucccacagcuggaccuaugaggacuggaauaagagauuccuguccuaguccucaaaggugacucagucaagcaggcaagucaggcaggacaggcacucaaugagcaucuguaagcaaagagcaucaagaggaggggaggaaguacaaggaagaauuugagaggugacaaugguaagacagugcaauuaagugucaguguucggucuacaugagaugaggauuuggaagaugugcgcaugucuaugguuuagcggucugauacaugggagauaagaguagaaccagaagcaaagcugaugggaggaugggcuuuccuacccuuucggcaauuccucaguggaaugaaugacuugcauuaggaaauagucagcuccugacuguaggggagugugggcaguguucauuaaacaaaauauauuugaaagauucgucuaaugggcauaaagugaguguggacuaauaccucagucaucuccauuuccaagacauugaaaagcucugacguggcaugguuggacguaaguagagcaaaagaaaaugaugguagaacaaaauagcuuuucaaccuagaagaaugaaagaagaauggagaacagaaucucugguuauuuguauuugagcacauguccccaauuacaauuuucuauaacuauuuuuucuaagcaaauggcuccuuaagaguggcacagauuuuaccagagaauucuuucagcauccucugucacucacagccuguggaguugucuuucuucuaugagacaauagaucuuauuuuucuuccugauuauuuauacucuuguggccuuccugccguuguguuagaagacggacuuggaauagagcccccuccgccccagccucaagcaauuagccuaaauggcuaaauuaucaagaucuagguuaucugguucacgcucauuuccuacgcugcccucuccaaucugcuuuuuguucagagaauaaaguaguauaucuugaguaaucuaugauccagaacucccucuaccaaagcaaucauggacccauacuuuuguagaauauaauaaagauacauuacuagaaaaaggaaauaacaaagaggcccgccaaagauaaaaaccacgauuuuuaauuaagagauucaacagaccagaguaucugucgagaugcuauaaaaguuuaagugcugacuuucaguuucuguuaucuucuuacagaucagcaauaaagagcagaguagcagaguucacuuugagcaggaaaaaguagcucguccuguguguaugucugcuuggcaucccuucuuaccuuggugggaucuacucaaaagcacucugaauaggaggagggcagugguuuuacuugaguuguguggcauguaucauaaaagccaguuguuagauuuucagaauuucugugagccacuuagauguauccauuauuaauagaguaaacauuauaaaucugugauaaaauaaauucuauucaaagaaggaugauucuccaaagucauccuaugcuaauuacacugucccguugucuaacuguguccguuguaucugggaggcagaaauacuguauacuuuucccagucagcaucaagcgccagcacauuuguagcugugauggcaguaguuacuccuuuagaagucagcaaacgcaguaagucggggcuugaguuauuguuguauugauugccuagaauugagacucaaggaagugacugggagaaugugaguaguguaaccugcacuucuaauugugcucuauguguagccaccacaucuugaauagcacgcuguuugagggaauauucucugaaaauuugaaaacuauuaucuaacaguaaauaucucacucuggucacugauguagugaagucucaccggauacuguguuucuucacuucugagagcuuccuuaauguaagccaguauagcaacucauauucuuguagaaacuguauuuguuaaucaguugcaauguaguuuaguuauagaggcaaacuucuggcaaaggaaaggucaaugaaagcauucuguaaaaaccauucccaauaugaaauuuauuauaaauaguaucaucuauuuuaucuauaaaucauuugcugcacauccuuuauuccaauaaaacuuaaaauaaaaggacauacauauuucuuguucugagagccaguuguuaaauauuuacuggcauaccacuggagugaggaggugcauuggaaagauuuauuuucucugcuucauccuucuuucauccuucagggcucuuagcuuaaagcaguagcucuuuccaccauggagagaaguuccugucuuucaaaauuaugcuaacaaaugaaagagcuucucauuuuuagucacuuugacuucuaggaauccuaggcuuggagacuuucuuagcucugagacuacuaaccagauccauaaacuugcucuuucccaaagcucuuuuuuccuuauugaguuugacaggcuccuucugaagucucccuuagccaauagaaaucucaucaguuccauccucaaucuggccgagagucuugauaggucagcucacagaggcaucgaggcaaggaccacuuggaggguuucgccucucuaucagaacaaaugaauccugugugcugcuauuagcucugguuucacagagacuggaacuccuaauaucagauuacacuuuguuggcuugcugaucauuuuuuuuuaaaaaaccaucaaccauauggguagagguuggaaagaaagcuaaauuuggaacacacccccacucuucuguucagcauuucuuucuuguuugugcagggaggcaaugcauugcucauacucauguaccccaccaauacucacacucauguaccccaccagcuaauaaaacuaagaaaugggauucucccucccucaauguggucaaauaacuggcuguuuucuacauaugcaagcagcugcacguuuaaaauggccaggcucuguuccugcccauuucugaaucugccugagagacacacacugaaagacuaaauccauagugaaaagaagcccagggauuuugugacgguuaguucauaaguucaggaucauucguagucuacaucugagacacugccuucugagucagagauuuuuagacuggagagccaugacuuucucucucuaucccuuccuuucuggucugucuuuacuucucccccacaugucacuucaucuggaaugacagcuggagcaagaaagacaaacugggaagauggacaaugaugaugauuugggcaguggcuauggagucaugcagauuguauucuagcccuuucuaagucuaauuacagaaaccauaauuuagcuccagauugcuaaaagggaguuuggaaucagguuuaguuaaggaguaaaaguugguaugccuucccucaagaagaggcuaaaaccuucucaguauccagcuaagagucuaaaagauguccuccuugcuaucccuagauuccagggaggaaugaaugacagugaagcuaaacacuuuaaccuacccuuccuuaucuggcuccaaccaucucuagccccagcucccauuaaccccuaccccauccuauaguccagcuauucacaaaaaacccuaccccgcccuauaguccaguucucacaaaaggucauuuuagucauucaagccugucugggacuuuguaaaguccucuguaacacacauaaagcacuuaguccagugccuuuucuuugauagguuucaauaagaagugacuguuaauauucugaacaggccgaacucuuagaccauaauuauuuccccuucugagucuuuuaaacucacuucagaagcaccucucccuccugggaagcuucucccuaggcagagugcuuuguuaauauucuuccuggcagcuugaggucagguaacucccagggccuagcucauaauuagugcucaauuaggguccguuauauggcccugaccaugccaaaaaaaaaaaaaaaugggcacaauaccugcugguaucauaugguugggacugagggaagaaaagaaagcaacagaaaaggcguacacaccuagccaaaaaauuagacuguacuacuguuuaaguacuuaucauagcaugcacaguguguuguauaaacacagacagauacuacugugauuuccuggugaaagaguuuaagugugugugugugugugugugugugugugugugugugcacgcccgcaccuugaugaugagaagguggugagagaauacaagugauuagaaaaaaagcagugagcaaggcagugguggugcaugccuuuaaucccagcacucgggaggcagaggcaguuggauuucugaguucgaggccagccuggucuacagagugaguuccaggacagccagggcuacacagaaacccugucucggaaaaaaaaaaagaaaagaaaagaaaaggaaaggaaaggaaaggaaaggaaaggaaaggaaaggaaaggaaaggaaaagaaagaaagaaagaaagaaagaagaaagcacuggucaggauucaaaugggggggggaugaagauguaccaacaaggccuacuuauucagcuguggcaaaauagugaagaaggaauaggcaaggaaaaagucagugguccuacuuuggaagaugagcagacauccaaguuauucagcagagagaacaugaaggagguaaugcuggguuacguauaacacuaauagaccacagguuuuuagaauuuguaauacauuuauucauucagugagagagagagggagagggagagggagagggagagggagagggagagggagagggagagggagagggagagggagagagagagagagagagagagagagagagagagagagagagaauguagacauguggagaucagaagacaauuugcagaagucaguucucucuccuuccucucuguagguguaaccuggugguucucacccuuccuaaugcugggacacuuaaauacaguuccucuguuguggugaccccaaccauaacauuguuuuguuuuguugcuacuucacuacugucauuuugcuacuguuguaaguuaugauguaacuauuuuuagggauagaaauuuacccaaggguggcaacccagagguugagaacugcuuuucuaggaaaucgaacucaagucaucugguaagcaccuuuacacaaugagcuaucuugccagccuaguagcucacauuuuggaauacuuacugcaugauuuuaagcaacugauguaaaucagaccguuuuacucucucaacguggcuguagaguagaggcuauuauuauuucugucuugcagcugaaaguauacaaagaaguguagcauauugaaaaacaagcacaaucaaggacacaaaugggaacauuuuagaaaaagggaaacuaaaaaccaucucugcaucguuuaaauuaauauggauggagccaacuaggucaccagguacccaaccaugaagggguuuaucaguucaucucuaauguuuuagaaaccagaggauuuacaguucuuggaaaaggggcugcuucaaugugcaugaauccacccuaccauccacaucuguucuacuuccaaagacaaacacuaguaggacuagaauuaaaacaagucuauccaaaugaugaccuaaauggcuuccaaaugaagcuucagauauaaaauacauguccuacucugaaaagaaaaaggaauagagguugaggucuggcuagcuucccagcaucccauguuagcaaaguuauaaugaaaacaagucugcccugagaaacaaaugaaaagggcaagguuaggaaggguauugaauuaaaaaaaaauacaucacaugaagcucuguuguuuuuuccagugauuaaucuuuucuuauuucaauaauugugcuaugugcgucuguguauauaaauauuuaugcuugugccauuuguaaaacaacuucauauuuuccaaagcacuuucucuuggucauuugaauauuauaggagaccaauugcuuuaaggaccuggauguuccaguagcuaguugaaguguuguauuuucauguuaguuucccaucugguccucuuaacuagcugggcuauguugggauugcaguggcaaacacuugcaagagucagaugccacagucaggagagagcaaacauuuaugcccuauugcuugagccuggagguuguguucagggcugagcaccugggguuuuuuucccaccuuuaagccagguggaagauuaacuuacggcucugaaagcuucaugaucaauguaguugacuauaacucuaagcuucccucaaagcagcgcuuuucccugucugguaaaauuuucuauguuguaucuucauuuuaacuucucucaaaagauuuuccacuguccucucucuggauucuucuuugacucggauugugcuggguaauucucagauguuggugaauuugacaaacagucuucuguuacagauuccuaauuucuuucuucccauggugcuugguagaaucccuuguguuuguuguucuguucuuuacuuuucaguacugaggcuuaaacccagggccuugaggaugcuaggcaaacacaguaccagaaagcuacaucccugacccuuucuaagcuuucauuugagcuagaaucucgcuaaguuuucugaucuggacccuaucuuaggauccauuagccucagcuucccaaguaacuauaauuuagcuguguguugcuaugcuacaagcucuguagauaauauacuuuauuugcuauucauguuuuuacauuuauuguggcuguuuuauggcuacccagucuguuauagagaaaauucuauaugcauuuaacaaguauguaugaauuacuuuguacuagccugucuuguggcaagauuaauguaaacguguaaagugauuuuuuuccaguaucaacuucauauugaaaaucaagcuuucuuccauaucccuuuucuguggcuuuuagaaaggaacaugugaauugacaguagaccaacagaaaaaccucugcucgccauugcaacacccccagccuuugagaaccacauuggaagcacuuaacuauccacaugauacuucauuuucugucuuaacagaaauaaccuaccauucucaaaccuacugccaugugccuuaguacagaccacugauauaagcuggcacaaaagauagggauguuuaaauaucagagcauggcaguuuguuagcuugccacuaaaaucauagggacucagugugcuuuguuuuuguuguuuucuuuuguucuaaaacacuaguguugcuaggcuucuuggugacauacuagcucuauaaaauaccuauucagaacacugagcaaaguagcuaagcucaaauguacaaagcaccgugccugagcgugagugcuuugcuaaagucaacugugaugcuuaaacucucuguugauaucauucauggcauuuaaaaaaaaccagcugugccucaaaaauaaguucuggcauuaauuuccuauuuuaaauggcauucaguauugccuuuugucggagaaaccauucucacuuguagauuuauaagguaauacaaauacacaucaaagaaauaaaaauauuauggucaaccaauauguugguugguuuaaagacaaaaagaaagaaauaucuguucccuuuucaugcuucaaaauucuagugauacuuaugccauacacguguguaaauuuauaaagcuauacaauaaaaucacaguagguagguuuaagauucagacacaggagaacuauauuuucuaugauuuuuuuuuuuuuuaguucuuauauaaguacucuuaaaauucagcaaaaauauacccugccucuaaguaauacaauuggguacaguggcuauagcaauagaaaaauggccaaggaccagcaagaaauggugaaucacuuuaagcaauuggccaugggacuaaacaccgggcucucagaccuacgcuguguaucuaagucuacuuaguaaaucaagguagugaaggcacuggaucucaugcugagaaaagaggaagguccaagucaaaggccccugauucugcggcgaguuuggagaauggaugcuuuuaaggaaauuauuuuuuuuucaacucagaaugagucaucuccagaugugcccauuucaucucugauuuguuaauaccucuguuuuaaaauguucucuuccaauucaaauguguuaaggcugauguuucuagcguaaccaaaauuuguauaaucuagaaaugaauuccaucugcugauacucauuaugcaauauggaaauugcucuuaagagcuugcuguuuauaucuacagggacacuacauggauagguguuuauuaccacaugugucucacauuuaaccauaaaauagauaccaacauccauucagcacggagagauuuaaaaugcaacauuuaauugccaaauguuaguuuugcucacaaaaauagauggccuuucugguuagaggaaaacaaaaaagccacagaguggugcuuuaaggcaauuuuaagucaaguuguaccuuuacuucaguucaaauucccguggaccauaaugaggagaaaguggauucaggguuggagagauugcucacugguuagagcaauugccacagaagccugaaccagaguuaagauccccagagcccacauaaaaugauaggggagagcauggcagcccaccugcaauuccacauccacauugacuuuaaauuaaacaauguuccuauauauguuuuuuuuuuaaagauuuauuuauuauuauauguaaguacacuguagcugucuucagacacaccagaagagggagucagaucuuguuacagaugguugugagccaccaugugguugcugggauuugaacucuggaccuucggaagagcagucaggugcucuuacccacugagccaucucaccagcccccuauauauguuuuaaaaaauaaaaauccuagguguggcuggucuuuggcuccuuuguagguuucuuuuuccuaucuuucuccaccccuuuucuucuacccuuucaacccucaaacacuagcuaaaagacaaaaaaaaaugauaaagaggaaagguaagagauagcugaauaaagucaggggucacuaagggguaacauuuaucguuagauuacuuccuauugauuagggacaccaaguuucuugggggcaaguuugaucuucucuuaucaggaugucuaauuucuucuucugguuucuucuucgugcacaacuacuuaacaaacugcaaacaacaaacaacuaccaaucaaccccaccucuuggaccccuagcauuuauauaccuucugaagucuccagaauuccaaaagucacacaauugcagaaacuaucugcugcaggcaaaaucacaccccugucagagcaugaggcaaaucauaaucagauguuguagacaauccaaaccagcccuauaucucacaccugggauuaaaaugaaaacauucuuauaauauuucuguuuuuuaaggaaaccaaaauugucacuaugccuaagagaaaggagagggauggaggguaugaccgaccauucaguagugaagacauuguccaaaagaauucaaccacauuuuuaagagauaaggauaaacucacaaaucaaugaacacaaauuuaauaagaaaaguaaccagcagaggugugccuuagaccguugucuuaucugccaaagauuuuaugauuaaguaaaugguccuuugcagacaaaaaaacauuuugcuguacuagcauguuuuggaaaguguuauucauuggaauaagauugguuaucuuuggaaaguuaaccauaauuguuaauguuauuuguucauauguuuucauagccaacaauuugguauuggcuaaauaauuucugugcucuucccugagaaagacuauuucuccuacuuucagcaauccuuaguugccuguauuucucuguguaggguugaagccuugugguccuucccccaucccaucugcuuuagcauauuuauuauuguccuuguucaucuuaaguuuagacagucauguuagugagaccuuauggcuauagcuccuaacauuccuaggaaacauaacacgaaaugaaauaugaaaagccaaaauaagccccuaguccugaguccauuauagaguacuaacauaccaauugggucuaauauauccucucucugauccuuuucucuaccuccugaauucuggaauuacaaguaugagacaucaugccugguuuaugaagugcuggguaugaaacccagggcuuuauuccugcuucaucauucacuccagaacccucaaugguauuuccuggucuguguuucuaaauccuucacuaucuccccauggcuccugcaucucauaaaaauggucuauccaucaucuugcuagaaaacaaagcaucauccaaacaaauggcagucucuggagaaacacaugguccagcauugcacauugguggugggaagggugucagggcagaauuugaaaaugucaauguggaaaguuccacuauaacuaaaacaaaacuuguauagcccaccaagcucugggacaaacugcuuuuuuuuuuuuaaacaaaagaaaaaaaauagaaucaccuauacacacacaaaaaugggauauguauguacucaguuaacagaguccuugccuagcugacaugaagcucugagcuucauagcaccacuguauaaaccagauguugugaccccagaacucaggagguugaggcaagaggaucaggaguucagucauccuugcauacauagggaguuugagacuuuggucacaugacauccugucucuuaaaaaaugaauuauaauaaaaaauaaauuauagucauucucauuuccuuauuacucagaauuauuucaugguuucccaaauuccacguuacacuaguaacuggcauacacagugaaagugaccuucuuaaugacacagggauaacuguugaguugggaggccacaaggaaggaagaaauuaucaaagagaacugauucaguucagucagucauuuagguucaacuuguagauauucacagagcaucuuguuugugccuaauucuguuagguacaauauuagaaugugacuguacuugcucuguaaaaggaggguaaacucaagagggucaaagugaucaggcuucauucuguguauauaacgaugaggcaugugucgccuaugagcauacuuguggcaacuguucccaauaugccuuuauuuauuuucacaucauuacuaggggagggggucaagagagagcagggggaacaugagacagugauuacugaaaaucuuuacuauguuacacagggauauuaaugccaugacagugucugcaucucugccuagcaccuucuguaaaugugaacucccacaguuuaaugaaaagaauauaaaccaaccaucugcagcaacauauuuguuuaaaaaggaaacaccagcaugaagacuuagcaacuuugaaccaguugaaagaugagcaucugccugauauucucauagugguucuauuaauuguucaucuuccauucuucuuaugguuucuguuacuagcauauuuauauugguuccgccggaauccuuuuaaaaggaauuugugaauuguuacuuuggggagauuaaaaucuauaagggaauuaaagcuccugggaugcacaauuagagcacauaauguucuauccaucuugaaggccauccuucccaucccuauucacuuuuccuggagugcuuacauucaucucuuuccuauuauguagcaaaccacacuaaagucuuuaacguguacucacagcaaucucaauuuguaguaaagaaauuauaguccauaaaaguaauaugaauauccaagacaauacggaguguguaguacuuacagcuacauuuauuuggcuccaagucuaggauucuacaacacuaggauucuacccccacucggguguguugcauacugucugagucaccaggaaguaaccagaguuucugacuuguucauaaagaccgauugccucuuaaaccaaacacuggcccugcaaaaaugaggcucagacugcauuugacaugggagaggauugagugaaucagauacuuaguagugcuaaaccaguaagauuguccuagucagcuauaaaacaucacaaagucaacaaaucucucuuuagaagacaaagagaagacaaagagaaacuacaauagaaaugccaacaauggugaauuaaagcuaccuuguccuucuucaaaauguguuuauaaagauaggauuuaagaaaucccaggcuggucauugacuuacuauguagccaaggaugaccuuaaauucuugacucucuugccacuaccuacuccaauaguaggcuuauaggugugcaugcccaacaguguuugucuauuagacaagcucccaaucaacaaccauauccucaggccccuacuuuacaauguccacacuaggacuguaaaaagagaaggcaggaaauguggcucagagguugaaaacacacauugcucuugcagaggaccugagcugaguguccagcaaucauguaaggugccuccuaacugccuaaaauuccaguuucagggagaugugauaccuccaaccuccaugggcacauaccuacacagauacacaccauaugcauauaaucaagauaauaagauaaacauuuaaaaauaaauacaaaaagaucaucagauuucuugguggggacaaauuccugucaccccuguggaucuacuuaggaguucuaggugguaaauagaccuagcccaaacugacaguggcaauucacuccagagugggccugaaucacagauuugaguauuugaccccuuucaauuuuguaacaaauugaaguuguggcguuguaacuuggagugguccuaaccucucuagcauacucucucccuacauucaacuuugggguaggaaaugaggcccugguuaaagcccaaccacuuccaacacugaaaaugcaaaguaacauuguguccaauugaguuaaauagucauuaaugccugggacugugguccuucauauggauuaaaaguuagaacaaucuugucagaaaauaaagaaccaaguagccugaccugucucaaaagaaaagagccaguauuugaacuuucuuauuucaaaauuucaucgucuacaucaguaacaagguuauaauaauuugauuucuaccuuaaaaucuaggauuuggcauuuuaauguaguugcuguaacuuaaauaaaauaccauauucccugacaucagauuuagcuaguacccauaaccagcucuuuuauuggcuauuuugagcagaauuaugauucugauuauuuuaacauuuuuaaaugcuaacacaacuaugcugaauucuaacucaauauaaccaucuagaugcaaaccaguuggauugguuuccuuuaaaaaagggggugggucugaagagauagcucaguuguauaugcauggagaccagauguguaccuggaaacaaagauuuuugcucagccaggcaagcuagaaauagcagugcuagugaaauucagugacagugucaaaaauaagguggaaccuggguauggcaacacauaacuuuaaucccagcaccaaggaggcagaagcaggcagauguaucagaguucaaagucagccuauucuacauagcugcuuccaagcuagucagagcuagaucaugagaccuuauuucaaacaaaaaaaaaugagagaggaaaaggaaaggaaaggaaaggaaaggaaaggaaaggaaaggaaaggaaaggaaaggaaaggaaaggaaaggaaaggaaaggaaagguaaggaaaggaaaggaaaggaaaggaaaggaaaggaaaggaaaggaaaggaaaggaaaaagauagugauaaaagauacuuagcauugaccucuagucucuauacacacauacacacacacacacacacacacagagagagagagagagagagagagagagagagagagagagagagagagaaagagaaagagagagagagaaguugaauucaacagugcacucucccuucugucuuguagacauaacauuacuugcuuccuugucccaaaaguagagucaugacucaguuucaauuauuacacuaauuuuaaauauaccugaacugaacuuugcauaauucuccccuaagcccuauucugaaacagcagcauauuucaauuagccuuuaacuuucuccuuauucaugacccuuuccaucucuuugguccacgaacugggauacagauaguaucucaauucacucccucuauaauccugugaugaaauaucuuauugccauuaguguucagauuggcaaucagaagcucagauuugaaggaccguggucauguagguuguaggugacaugugagaugcagucuuucuaauugucucuguucucucagauuccuacugguagguaguucugugaaauccuauuucuaaguagccccauacaaccagauuagcauuuuaucaccauagaccugcccaugucuaauucuaccuaagucuuacugucccagaauaaaacuacaucaaagaauggagaaugagacauggacauuuacuaauucauucuucaguuuuuuuuuguuccuuuuucuuuugguccuaggaaugaaacaagggcuucauauaugcgaggauaaugcaaugcuguuuugcuuuauuuuggauacaguacagaaugaggccuaggcuguccuuaaauuccuuguguagcugaggcuggccuugaccugauauucuuaaguacauuuacuucauacugggguuagagacauacagcaccacacccagguuuccauucuuaaucuuggcaaaacuaaguaggagaacuuaguaccucuaaggagaauggggccaguccuucuccuuacuuuaauguugcuuggaaaaauacucgugacuccuucgccuuuuauaguccacauaaauauuccaagcuccucaaacauuuugaaggcacuguuuucaucuuuuuauuccucuuaaaguugaaacagaaagccucuauguguacgcauccacauguuuuagaacugugugcuucaugugcugugacuugaaauccuuccaugucauuuugauuuaauaaauauuuucauaaucacccaaaugguacaguucaugcuuuugucaucaaauauaaacuaauguccucaagggggggguggaaaaaaugcaauuguucuggcacugugccaaaaauggcccaaagaagauacuggaagcuuggcuucuaacauaucugcccugauaaguuagcaaagguucaaugaaaacuacagagcugguuuuuaauuccuauugaaaucacugcaagugcuccaaguuuuaucacucauaauuaacauaaagaaauuaaugucuuaagagccucaauauuggaagcccuaugaguccugaggauauuuaaagggagaugcaaaguaaauaggaugaaauucuuaagcaagauuccugauaugacagcacuaaagagcuuaggagugugaaaagugccucuuuucuucccuugaauaaguccauuacuugcacuugggcguauuuuaagguccuuuucaugcugaaucuagacuugagcaugcuuugcauuucaagcuuugucuaucaaucaguagaagccaaaguuauuucugcuuuaaaauaacaggagccaggaacagcuaaucucuuuucauucugaguuccuuacauuauauuaccaggacaaaguuuguguuggcuacaaaacaggccauucacaacauccaggagaaggaauuuagguaagaaugaagagagauuguaggauguauaaagacucccucuccugaggccauuaagaaauuccaaauuggcaagguuuugaauagugacauugcauuagccuugcuaauuucaguaauucaagcugauagucucucuuuaagggggaggggauggggggacucguccuugaaagcagcccaucaccucugcaccauuucucagcuaaggugaggugguauuuuaagacacgugaucaagaggggggacuauaaccagcacaaggaaaccuuagucagaaacucuuuagaaagcaaucuaagcagucuuuuucuaaccaggaaugagucuacaagacaggcaacauuugucacucugucagcuccuugcaucugaccccuuugaugauuucugucuggcuccuuaauuguguuccuuucaauaauugggaaaagcaaagaaaaccuuccaaggcuuucuuuucauuuuaacuuuaauuaacagauaaugcauauguuuacgagauacauugugauguuuucauguauguucauaauguagagugauuggaauuuuuuucauaaugggagcauauuugaucuucauuuuauaaaaugugcaaggaaacagauagacaaaaaugguaaaaaaaaaaaaacucucaacuaaccgucauugugugugcuggccaaauguacagaggguaaucuucagagccucacaagugaagaaaguaggacaguggccgaguguuugaaaggguuuaagguuucaucugaagaagagcuguacccuacugugcuuguagccggauauaccaaacaccagacaccagcaagccaaacagaccuuggaaguagucccaagugcagcgauagcagaagccuuggaugccaaggcacccuggcaacccaggccuucugcacauccagcccaagguuguugacuuagcuuuguuuuuagucaugcagugaugaagaccaaagcacgagagcuuugucggaaugcuuuauuagccaauaaaguauaaaaacagaggaaacuaggaaaaaaggggguggauguaaaagaggggagagaaacaugugaauauaugaauggccuuggggacaaaaauauuucacaagaaauauucaguuagaccauauaaguaacaucuugcuggguaugguggugaacauuuguuaaucccaacgcuggggaaguugaggcaggaggaucaguacagccuggggcauauauccagagacacucuuucaaagcacuagggccaaaaaaugaacuguaugcuuguuaagguuuaccaauauuuccauacccugugccauuguuacuugagaagugagaugaauucuuacaagcagagcgguaagggaauuggcuagucuccccaggguuucuucuuagacccucugcaugcucugcucccacucagauuccccgggcucuuugcucgugccucucuuguggcacuuaacacauucuaacucagaggacaaguuauuuuugggacucaaaucaucugccucauaagagagaauuccaggaggccaagacuugaguuuucuucugccauagcacuuggcaccaugcccagcaaaugaaaaucaugccugcucacugccgccucaucucacaccugcucaagggcagccugggcuacauaagcgguguggggggggggaaucaacuguaugcauuucugacuccugguacauagagagcucuugagaauagacucuaugaguuaucuaguguccucaaggccugucugucugguuccuaguacauuacuaaguguuccuaccucucaagaaauguuuagugaauuaauuuaauagacuuaaaauacacccuucuguucaucuauggcugcuacccuauuuauccauuugaagacaugguuaaugaucacacauguaagcacauguuuauauggacucaggcaaugguaacaggaauguaguucaucugcacucuauguauucgcaucacuguucucccugagaaacagaagugcucugaguuggaaauggguuuagggagagaaacugugcggacaaggagaaaaagcaggacgguaaagacggcagagaaagauugguaggugaagaauuccaccugucuguugugagggcucugaaccuucuugcugccugccugccugccugccugccugccugccuggggcaggaaaaagauaaccccccccccaaaaaaaaagcuaaaguagaaaagggggccucuuaaacuugguguuagucuuaauaauaagggaaaaaacuuggauuacuuaccuuguuguuagucaaaagggggcuucagauuucuccauugggugaccuaaacuguaaucugucucuauagcccucuguuaauacuucuugcauuugugaggaaauuauagugacuagaggggcuccauuuacuuccucuaaucucuugguggagaaauuaaaaagacaaccagauauugugguaugacuggaauucuccauggccuagggagagccgauugggacaaaucgauugaagagaacaaucuuuauuuaaggguccugcaucuuuaaucucggcaaucccuuuggcaaauugcuuuuucugguggcauugcauaccuaauuacagugugcucauuucaguuuucuccuugcacauugcuugcuguuugugcauuguggguuuucaggcugagcagcaaacugaguaccagcuuuaaauccucaucaccaaaaaugcccuaaaggucucgggaccacauugucaccacuuugggaagaaaaucagaagucacuagacaaauacauuuuucuuuagcacuuccucagaagacccauuuucuaucauguuaaugaauugaaugaaugcucuucucuaccagauauuuucaacaucuuaauaauugugacaauaaaaaagauauuguaugugggcccaaccaauggccauggaaguaguuuacaugcugggauuucauccaccaaccaauagauguacccuagagacauguugguaugcuuaaugaaagcacucuguugucuagccauagucaguaauaggugagcgugacucacaguuuaucuuccacaauuccguacagccagauguuuucguaucuugaaauugcaggguuuuaagugaaugguuacaggaguauuuuuguuuguuuguuuguuuguuuuauuugguucuuugagauggaauaauguuuuacuguauugcccaggcuacacucaaagugaaauuuuucauucaugucugaaccuaccaagaagcugaaauuauagauguacacuacuaugucugacuccagauauguuuaaaauaucuccuacauuauaguaaucuuguuauaaggugauuuccaucacaauuccuuaacauuauaauauucccuugauaaauacucuacuuuaucuuuuuuuagaauaaaaaaggcauuaacccuccuuucaaaauucuuuuuucuaaucagucuguacugcuuucugcucuguuguucugcaacuugaccauauuuggccaucauuccuacaugcuagaaugaaauagaccucauggacauaaaucacaugacaaaggcauauaucaaaggaaauucacugaagcaauuuuuuauaaaggagaaaucagaaacaacccaaaugccuagccgugggaaugucucguuauuauguucacuguauggaauuucuugcagugguucaaaagaaugaggucauucugcaaauauuaauaacaaagauuuauaagaugugagaaucuguguccaugcuugcauauaaaacacauucaccaguaaucaucacugagaaguugucagaggaaauagugagauggaaaguaugugugugcaugugcauuuguguguuuagauaagauauuguugguauuguuugaaucuuuaaucucaagaauauauucauagaaauaacauuuugagguguugccaaaaaaggcaaaaaaaaacaaaacaaaaaaaaaaacaaaaaaaaaaaaaaaccacacacacacaccagaaagaaugagaaaaaagagagccuaagaugagucuggguaaagcgcuugccacacaaacucaagggugggaguccccaaaacacacggguuccccugaagagaugggagauggagacaggagagucccaagaaucuggcaggccagcuagccuggcaucuacaguggcaaaaaaaauaaaaauaggaagugaaaucugcuuccaagauuguuguuucacuagcauauaugaaucauagcaaguaugagccugaauucccacauaugaacauagaugcgcacacacacacacacucauagacacaucuaucacacacauagaaaaauuaaaauaaaaauggagaguuaaaaguaagaagcacaaaugguguuugaggaguaaacaguaagacaguggaaaugcugauggaagaugaagggggaaaaaaacagaaccuggcuuagacaguggggaagaccaaaaaaaaaaaaagcauguuuauuauucagauccuagaaccagaaguguagcuuagugguagaacucuaacuagcauucuucagguccuggguucacuccucaguacucaagggagaugagggaaaacaacaaaagauaacuucugaaccaggcgguaguggcgcacgacuuuaaucccagcacuugggaggcagaggcaggcggauuucugaguucggggcuagccuggucuacagagugaguuccaggacagccagggcuacacagagaaaccuugucucaacccccccccccaaaaaaaaagauaacuucuguuucucuaaaacauaccuggguaugauagcucacaucuauagccccagcgccagaaaaugaggcgggugaaucaaagcaaguucagggauggcccuaagcuacagagugagacucugucucaaaaauuguuuaaaguaaaaauuuauccagugauuccaacuuggccuuugccgaaggaucuguuaaaagaauccgauggagacaagagaaagagagacagagagauguuugauagagaaagcuaugaucagaccagauagaaaacaauaauuggauuacagaaaguuguuuagagagaaauggaaagagaaaaagaagugaauugagaaguggaaagggggcaugaaagcauagaacuuccagguuaagguauugcacucguucuuguaccagcaugcaauuguauuucacuggcacucauucauuccauggaccucugcaauaagaaagggaugcuggcaggugguacugagaggauugaaguccuguugcuuuguuugaucacugauaagcagaggacuucauuagcaaggcuauacuuugauguuccagagacaggcauugagauuuuagucccacagcuucuacacuuaggaaucaaugguagggagaggggugaaguguggcccagggaugaguagauugggaggcagggacagaggccaaaaguuugggaacacagucauccagguugcaaaugagacaugaauggaaccuacucacuagaaaagcuguuuccugcucuguaugucacacacaaugcuggcaugugucagcugcuugcauagcauggcaucaaguuccagacaacaaaagcaaauacaaaaauaaucuuuguggauuccauugacacugagcacacaguaaacucaugcuccggcucauacacacuggcuacugcuuagcggugccugcuuagcggugccuaggaaucuaaggaccaugcuuugaauucugccauuuucuuccugagauucccuccauuggcccuacgaauguguuaucuucagcaugugucaguggugacucuuucccuugaggaaaucagaaacaucagucccugaaagauggguuccuugcaaggaaauugccccuugacuacauacucccaauaggcuugaaauggguauccauuugagcauuuguucauccaggcaacaagcguguguuuaaguucucuaauaaucaaauccugugugggggcuaugagcacaauaaaaaucauuucuuacuucaccaaagucaaccuaguugagaaggagacccuggaaaugacuaacuuuacuaugacacaaauggaaauuugugcuauaauagaaguccaauucaguucuuacuacagagagcuacucauuugggccaaagcgagaagaguagacuuccuagaagauaugguauguguauguuaaagcuuggaagauguaauuguggauagaagagguggaauggggcggggagaaaagaaaagauggagcucccaagagcuggggagaaagaggagggagaagagacagacaucagccugaucuaaggaaacagcuugaaaagacuucaaguccuuggcauuuucaacauugcuagggacuacaguauauaaugccuugaaaaaauauauaggcaguuuuccaguuacaaagcaaagaaacaugagccauagaaacugcuaaggacuuaggacucuuucccauaugcaucaaaguauugugaggcagggagaaaugugcucccacauguguuuuuaggaauagaacgcugucuuauuucuagcugucacaaaagauaacauuccuuccuggagcgaaaaggaaaaaaggggagggucauuggagaggaacagguaucuuacacuacugcgccauuaaggacugcaucaagaguguuggcuaaagcagaggaaaagcagccagcaggcagacuuacaggggagaggugccugugugagagggagugagcacugucugacaguccagauccacaggcagaaugggaaggggauggagccaagacgccagugugugcauucaaguaaagcaagagaaaagauagacuugguuccccacauccuguggaugauaagggagggauguuacaguugcugagcauuuaaugaacaacacucagauggaacaacuuagagaaggguuucagcuguccuuuaugaggacaccugccugcuguugauuuccagccugaugcucccacaccagcucugagggcuuuuagagacauucuuuugugccgccccccucccaacccccggauggagugcaaggcuguuuucuuacuauugggcauggccaggacacuggacgcauauugauccucggguacucccuccccaacccuaccccacagauccuccaguacucaaaaaggaaaaaaauggaagcugaccagaguuuucccaccaaaacaaagccucauguauuugauggacuccuaauauuguugacucugaggaaguacaugagcacuuccuuauucccaugagcccucaguagucauuggauuuggcugcaauaagugacaguuuguguuuucuacauucuucaagcccagagaugcaugccucugugacugugucaugcccacaauugauguuacaaucagagcuucguggaucuaaaccauuaauuuuuaaauuuaugaggagagacuccuuguauuuauuguuuuucucaaaauauaauuuaagcuuagcaucauuuguguaaguuucaaaagacagcaaguguaaguuucuugagauugcauaaacuugcucauuaaacauuagcuuccaauuaaaaucugucagucccuccccuugaaacauccucuuuccuuuucccuguugaggggccuuacaugcauuucauggugauagugaagagccugacauuuuuauuguugugcacaacuuggccugaguuucaagacacuggaaaggagccauuuagugugugugugcgcgcgccuuggaguugggcucauuuacagcccuccacaugguaagauacuagacuagcaacacccuugcacuggggaguagggagucuguaucccaaaugccauuaccucuugcuuucugguauacgaucacuuauuauuuaguuguagauagggccucacauagccaucuccuugaacucaaauuauaguuaaggaggcauagagagacaagcaggcaggcacacacacaaaauaaaaaaauaaagagagcuaaaagaauuguugcaaacguuuucuucugagagagucauaguaauuaaugauaacaguaauaggaacaauaacuguaaaaggccucucuucuucaccugucucuugguccugucacuuccugaggauaaauuaaguucucccugugaaggaaauguuuugaugaacugauucuuccagggcuuuaggcacucuuggggaagggacagccacugagaagaguguaguaauaccauuccugaggaaggaagguagugacagggcuucugagauuggugagggauagccagcaccugcucuuacucuccagguauccagugucgagcuagucuccuuuuggggauaugacuugauucauaacacaugcaaauaaguauaauaauggccuauguuauaauagauuauguaacaaaaccauuugcuguuuucuaaaagauuaagcgauuucuuaauugccaaacaauaauaaagcacaguugguguuucaaauuccuggcaacaauuuuauauuagaaaccuaaacagccugagccauaguugagagccacuggugugcucuccugacaagggagucaccauagaagagaauguauugagucagcuuuggaauuugagucagaauguuguuugguagcaggugacuugggucaccuaacagugccuuuaagaccuuuccaccguaugcgcuucaaagagcaccaucaaaccucugccugugaggauauggaaccuaauuugaagggcuaucucagucagcaauguuugaugaaguuuucaggacacccuuacuccaucauacaaucuuaccuguucuuuaaaagguaauuuuuuagguucauuaauguauuugugugugugugugugugugugugugugugugugugugugugugugugguguaugcaugcacgcgagagcauuccugccucaauauauagauauagauuuauaauguacauacaaaagcccaaagaagccucaagaguguaucagagucauccuagaaucagaguuagaguguguuguuagcugccauauauguacugagaaccaaacccagguccucugcaagaacaaaaaguguuccuaaugacugagccaucucuccagccccagccuugaauguuuuacuauaaagcaguguacuuuuauucugcuacaucccugggaaguauguccauagcccagugcaguguaaccugaagauauuguaccccagcuugaaaaauaggccuaugaugagagagaccaugccucccugaauggggacaaucuacuguauucucucaacaccccacuguuguagcugaggaugcuugcaggcuggaguuagcaauagaacaugaaguggagacuuaacugccuaacccuguuccagaagaggccaugagaucacugccagguuuuauagucaguuaucaaguaggcaaacuagacagcucacuuauuauagacagcucauaguguagucaauaagauacacugugaaaugugccuguucuuaacggggucccauuuaagaauuaaaagccaaaggccugaaguaugccuguuuacccacaucugaagaagaaaaugcagaccuccagagagccuggcuucauuugcagagccacuugcuucugcuuucaagucccaaguacccauuucacuccugaaaguucauaaaggagguggaguuacuguggcaggaagggggcuuuuguugugguucagaagacaaggaaaccaagaucuguuugggaaucagaaaccaauggcagagccccaggaugcccaugugaaugggcagcaaagugagcaguguugcaaugagugccguuuccuuggagauugcccccaguuuuauccucugggguaugccaggcaauguccugagguuucacauacucaugucuuaacuguacacagcaaauggaaaacacagggauggauggcaguguuguucuguugcuauauuagggccagauugaagccaucugcuggaacaggcuuggcaaggaagaaacccccaugcuuggcuuagcaguagcauccucuuuccugccauuuuuaucuuuaagacagggucuucagccaaagacgaccuugaacuucugaucuuccugcuuccaccucccaagugcugagauuccagucaucggccaccacacccaguuuacacagggcuagagacugugugcuugagaccagcauuuucacaacugagccucauucuuagccuccuccccuuccauuucuaaaaaagaauuuauuuuauuuuaugugcuuuggugugagaguauuagauccccuggaacuggaguuacagacaguugugagcugccaugugggugcugggaauugaaccgggucuuuuggaagaacaacuggugcucuuuaccacugauacaucuuuccagcccuacucccucccccuccauuuugagggcaaccagagcugcccuguaccgucaguguaagugacguucccauagcaacuucuugaugcccauuuccucagaggaugagcauuuccucauuguuauaugcucaagcccucggaggcauugaaagaaucccaagacugaccuucuuggccaccaaaucccucuccuccacugccugugcaagcuugaggggcucuccuucaaacccagcaacuuuucccccaaagcuuugugggcaguggcuuuagugggggguguuauaccaugaguuaaaaacaaaccuagaacagugcaucauggauuuguuuauugccagggucucucauccaagacuaggacacucaagaggccagagcuuccguagcugaugauugcuagagaaauauccacggugaaauaacugauugacccugcuauggggaagcucuguuggaagaggccgccuuggcucuuaagaauaaaggaaugauuccagccugcaacagacuauacuccuuuuccaggucccaagggccucgaaaccagaaaaauaaaacuggaaggaaauguacgggucaccaguucagcaccgugauuugacauauagggcaacugaagcuuuaaguaggaaaugccuugucagaggugaagugggaaggccuggaaucuagaguuccagaccccaggggauaguaaagacuccuuggggauuccaggaggagauuuucaauaaccaggaauagaggacucuccuuucagagcuuugcccagugcagaaaagcuuuccaacacaaacaacaggcagccccuaaugacugacuguuauuuuaaauggaucaucuaaucuacaacacaaaggccacugaggcaaaauaagaguccuggcugaguguguaauuaguacagauaguugggucuacccccugggcaucguuaaacugauuacaaauagaaacagauuuuuagaugaagcuggggggguggggggagucuccuugcuggcccaaaagguucucacagaagaaccacuccaagagaaaagcaauuuaugaucccuucaaaacauacacuuaacaugaugaaaaaauaggcugaaaaaaaucacugaaaaauaugagugauuucaaauaaaauaguuugugguguuucucagaauauguuugguuuaucguaaaaccuaguuguuucccuuugguguagguuugguuuuucguagacuuuuuuuuuuuuuuaaauaugugcuauucacugauccccagcuccuguucccacaggcuucuuauuucgucaggacaagauaucugagucauucuggcuuagggcugugcuucacacugauaacugggaucuuucuaagcacagagaucaaauuguacagguucugccuuagaaacugugggacggcccuuccugcugcauucacaauuguuguugcauuccuaagccacauggucuuacugaaaauccacugccuccaaucucaguucuugagcccugcugugggucaucacacaucuccuaauggagauagccaaguuggcuuaagaaaucauccuagcuacuucccuuuagguuuguuaucgauccucuugguaauuugcuacugucuuccuaugaacccucucugugaucuaaggaaugucuaucugguuuaucuauggguguggugcucuugccgaaguaugggauuccuugaaggacuagcuaaaucuuccuuccuucuuuugcuaacuccuggggacaccauacauaagauagcauuguuguuaaaugaaauuggauucuguuucuugccuccaggaauguccuuauuuaucugugaccaagauccuauuuucucugucucccauaauacuuccuuauucuucucagauaccucuuucagcucuaauccuuguggcaguggcccuagcacagagugugccuuugcugggcuuccugucaguuuacaccucaggcaccgcacugagggauugagugauagacaucucuuccugccgaaaggagagcuucgaacaaucucuagccauaauuuagauaaggauguuccuggaggccauuugguggccuaaauguacgccugggaucucauggccuuagccaucauuacucauuucuugggaaacagaacugauaauuuccaugucagcucccuaaaucaagaacucccugcaauauccuauagaguuuaacaagguuucuuaaucagacacauggugaacuuguggaaacuaugccucuugucaugcuuuggaaguucccuuuugugauauauacucaacaauugagguuuuugguuugguuugguuugguuugguuuuuagugagaaucuauuacuccuuuguccugccacauauuugguauccagaguuuuucaagaagcaguaggguggguuaaagagaugacucggcaauaagagcucuuguucuuucagaggacuuggauucaauucccaguacccacauagcacuucauaaccauccauaacuccaguuucaggggauccaaucacuucuucuaaccuccauagcaccaagcauucaugugacacacacauauauauguauguauguauguguguauauauauauauauauauauauauacacacaaaacauugauaccuaaaauauaaaacaaaaugaauacaucuaaucaaaacuuuuuaaaauaaagaaaaguagcaacauggcuuccuaagagguguacaguuagaugcuggauucagauaguacagcuauugguugccauggaaauauagaccaaaagcauuacccugaacuugagcuuccuuguuccuaaaauaggaauugcaauaccuacuucauaagguggugggaaacauuaaaauuaaugagauaaauagcacauugccugguauacaugggcauucaaugguuuacuucgaggucccuauuaucauguccaugcauaagauccaaagaaaacguuuauagggcugaggacacacuugcugcacaagccugaguuuaguccccuaguuuccacguaaaagaaaagaagcuacuccggagaguugcuuucugacuucccucuauacaucuacccucacauggugcacacacacacacacacacacacacacacacuagauagauagauagauagauagauagauagauagauagauagauagauagauagauagauagacaaauguaaaguacagcuuuagaaagucuccuggguugaacagaguguuacaccugcuguagcugcuccaguccucaaagcuguuuaguguuggcggauuauuugaagagcagagcuaacagagcaggagcgaaguggaaacauuaauagauauuguuucaucuugauguuggguaagaguauccuccagaaaagaaaugugaaagcaauguggagagcuuucucauucaggucaacccuaaaaauauccccucuuugcuuaaguggagaagcugccgugggacccaaggcuuggcuuucaacagaucagccauaugggcucucugcuuuagugaaaucugaucacgaccuaagccugcgcuauccuugccgacugacagcugaccccugccuucuugugcgccgcacauaguucaccuuucagagaaagaggucucaucuccaaguugaguguuucucuuuguucuuuucccccuuuuauuuugucugucugucugucugucugucugucuguacugagggggaucuggauuacagccugcuaaauuacuuuucccaaguaacagaguucccugcaaaacaagcuuugaauuacugucagcacuugggcaaaagaaacuugcuccaauuuuagaugaguaaaauagaaucaaauuuauacauauuaaaaucuccaucauccucucuuugggacacagagauagagaauuauaauaaauugcaagaucaaaaauacuugguuuugguuaauauaagcaaauggucuaauauaauauauauuauucaaauuaauaggaaaaauauccguacccaucacacuaaaaggcagauaauauggaacccauugagaaauauaauuaguaagccaaagcacagaaaaaaacuugaucuacacuggugaccaaguguaugcaaauuaaguaaaccuugugauaaaacaucuuguuucuucaggugaggcauauuaaaauugguucucucaucaucccugguagcauaauagaaugcaauauccuuuuuggaagguagggucacagccuaugaaaucagacccccugacuuugaucuccuugacuuugcuuccuguacuaacccaugccagccucagaucugccuggucuuggacccugcucugcgugucuucuggaccaguugaguccccacacuuguuuccugggacuuacugaguauuuucaugaccuguaauaagagcucuuccuuccucuccuugccuucauuggguagaaucccagccauuuccuccuagcccccggcaauagggcaguugguugguuguuaagucgcucacaucaccuucacaagauacugaaauagaaacuguagccauggagucauguaagggggcaggggguggaguggguggauuggaucugaaaaugcaaauuugcaagaaucugaccccuggacuggugaucuugaauuucacacagaaaccucaaucugcuuagauuugcuuucuaggggacuuuuguuucagaccaaaucacagacauuuuaggguuuuuuuggggggggggguuguggaguuuuuguuuguuuuuuuguuucagcaucauguacacaucucauacauaacaggcaaagaaugcaagacuuuuacccaugagccucucuuagccuuccuucacuuggcaucagauucuauccagguuuucagaagccucaugcaccccaagauagcuagaaauguaccccaacacaaauucagaaacuuacuuaaaacauuaggagaguuugggguagcuuuuucuggaggaagagaauaccuugcuucauuaauucucaaaugggaacuuuguaggugacagcgcuguaucacagacuggaccagcuuucuuugauagaugugacuuuuuggugugguuuuauugauuuuuuuuuuugugggggagaaaacuguauaaaagaggaaguacuuggggaaaaauaaaacagcuuucaacagcaaacuacccuguccuucaacaugaacucaacaaagucccugggauaagaauauccaguccacuguaagggguuaagggaaaguacaauuccuacucaccagucacccuccuucccuuccccaacacacaaggacagauuaguucaccaaauagcacauuuugauguaagcucuaaugaaacugaccuucaauucaaggguccauauuugcccggggagauguugcaaggggccaaaaaacauccuguuguguuggcggagcagagacggaagugcugacugacucacucccgguugcugugcucuacaaaacagcgcuucuggucaucucuuccaguccaugcguuccaaacacacccucuccuucccaccucugggaauccuggcuuuccaaacaaaaggaaagucgaacugggaguuccucaccaggccagacaggccagaagcugugaaugguauagaccugaugugagagaaagguccugcaacucaaauccucuuucucuuuugacagaacuggccuaugaucuggauguggacgaugcuccggggaacaagcagcauggaaaucagaaggacaacgagaucaccaccucucacagcguggggaacaugccguccccacugaagauccucaucaguguggccaucuauguggcgugcuuuuuuuuccuggugcacugacuugccagcguccagugccugugcugcccugcagcaccuguggucccuacagaaagggagccaccuucuuuuuuuuuucuuuuuuuuuuuuuuuuuaucuuuuaugccuccucccaccaccauuaaguaggagacuaaccgcguguuauguuuucgaaaaucaaaugguaucuuuaugaggaugguaaauuuuagugguaggauagauugucuuuuugcaaagaaaaaaaaaaccuucaaguugugccaaauuauuuucuuacauuugacuguuggaacaugguugucauguuucccucuuuucucuuucucugcauggauuucuuugacaaaaaaaaauaaauaaacauucaaauaaau

SEQ ID NO: 9491 - RNA, 37501 nt, Mus musculus
uaguguuggcaacuauggccuuuauuucuacaauauacaagagaaaugugaggcauuguugccuuucccuaaaacucugcaaacuuuggcgcaguacugaaucacccaaaacaaaacaaugaaauucuaagcaccaacuaaaucaaauaaagaaccaauaagaauugugagacagaagagauaucuggaaacugaucaaccgucccuucaccuggggagcaaucuugcuguccccaaaauaguaaauauuaaguguucacaagcuaaacaaaaacuccuuuauccugaaaauggauuuauaauuacccauuugccccagagccauguauuaaauaucauccauagacuuuuuauuccugugacuuuugaaauuauuccuccagaaagcauaaggaagaaauugcuaaaaauaucauuaaucggaaaaccaccaugaaauggacccucauaccccuuauguuuuacuaaaacaaaacaacaaaaagccuacauacacaaaauauaaagucuuaguguuaaugagggaagggaagaauuuaaacuuuguauacuguugguaggaaaccuucaugaaaaccagucugacaguuguuccucauaauguuaacaaugacauuaugauaugaucuagcaaucaugcuucugguuauuacaucgaaaagaaucaaaagcuagggauauuugcacaucugugcauagaagagcauuauuccccauagcuaagauaagagcaagguuucuccaucagcugauggaugcgcaugauguugagaagauaguggaguauuacucaacuuaaaaagaugguucuuucacauugcuagaacaugggagaaucuugaaggcaucauaguaaguccaucaccaaaugucaacgacuucaucacuccacuggcaucuagaaugguuacauuacaaacacaaaagagaacggugccuuucaggauuuuugagaagaaaauaauggguugucauuacaucuauagaggugagauuacaagaugaagaaguucuugagauuggcuguauaauucugugaacauaauuaacacuacugaaauagacaguuaagacagcuuuggcacuugccuucaagccugacaacggaaguucaaucccuggcacccacguaguggaaguagagaacuaacuucuaagagcuguccucugaacuuuauuacccauguaccauagcaugugccccucccaaacacaaauaaauugaaguguaacauauauuuuuaaaagauaaugaacuuuuuuaucaugugcaauguagcacaaauaacuuuuaaauguguuucguauucugaaauaacaaaacgguacucuaagccaaaugccauucauuuauagaaaacuuuaccauaauguacacuaugccuuuguaagaaggcacauaguauaugacauuuucucaacuuguauggcuguggaucuauguuuccaaugcacuaugcaacuugcccaauguauucaugagugcauuuuacaaaaugguacuguauaaacugcuagugauuuaaggucuuacuccucuaccagacauuuuauuucaaagagauaccugcacuaauuaaugcuuaugcaaaagaaaugugucucuaaagauagaauguuaauccuugcaaaugccuaagguuuagggcauccggccaccuaccaucucucggaucugugcuugccaacagccaaccucuucugccugcuugcaaggucagccuggcauuuugacaaugcugagaguaggccauuagauuuaguagucauaccuaagagagacccaucuucacuauguaugugaucccagagcugcaugacuuccuuaagccaucgaguccuucuaauacagagagccagcauuuccaaggaagaacuuuaaugcugugcagaaaccuguggauagagagaauucagaucaaaaaaaaaaaaaaaaaaaaaaaaaaggaaaacuuacuuggguugaaugucgucguguguaauucaaaaccggaagguugccuguagguuuauauaugcuguaguuguuuuaaaggacaaugacaugguuaaaagccaagaauuuccuccaugagcaggugaaaaaacagcugacauucuccauuguuuuucugagggcuucgaauggcuuuuccagaccuguaacuuguaagcauuuuaguaacauuugauuagcaguuaugccuuacugugucaaaccuaaaauuagaaucugauuuccugacauugucccucccccaaauaaagccuccaauaauucuguauuucuuccaauuggggggugggugggugguaccuuucagugguagcacaggacuucaaucccaacaguggggaggcagaggugcauagaucucugaggcugaggccagcuugaucuacagagugaguucuaggacagccagagcuacccagaaaaacucucucucaacaaacaaacaaacaaacaaacaaaaucaguccaaaauuauuuccccuuuccucuucugagaacucucaacaauacacugucagagcugaaaaaaagacuuaggguucaugugacccagcuuccuuucuggacauuaggaaaaacaaaguccagagagauuuuuuuuaaaaagaggcccaccaagaugcaaaugcugacagagcugagaaaauaugacugcuucucuggggcucauucuggcauacugcgauaccucauuacaauuugauaggcgggagcuggauggauuugugacucuaggucaaauuuguuuauaguuuauuggaccagcaaauaacagggguuuuauuugaaugccagaauaugauuucuccuagguaauacaauuuguaaacugagugugaaauuuaaaaccugaaauaaaucagucucacagcauguaagcauguacaguaaacuguagucuaacauuuuguuuuaugugcaaaccuauaacaauuaggcuacauguauccacugaaauuacuugguaguuuugauuugcaucaguauuacagcagauucugaagagaauuuuuauuaggaauuaucuggcuuuacuaugcaugauauauccuauuuguaagugauauaaauacuguggagcuaaaugaaaaccagaaaauagcuggcuugauaggaaagguugucuagaguauaauggaaauaaaaugcaugaugccugagaauaaagaagucucugcaguugugcuaucuccuggcugauuacuauauugcuaugcaugugguuaaggccacauaucauauacuagcuucaaauccauuagcaaucaacuaguuagggugagagacccgaaccaaacuagagucucauuuccuaguucucuuaggagguucuuggagcguagacuaguuacuuugcacucuacugguuuugauagucaacuuggaaggugccacuaacccaguaaacaacacuacugguuucugaaugcaaacacugacauagguagagugugauuauuuuaggauaguuaagcaguagccuuuauauggagagcuuacaaaaauuaauaacagcaggaaaaagaacaaaucugaucaucauuaaaacacuuauacucuagggcaccaggcacacacaugauacacauaugcauauaugcaggccagacacgucuacacauaaaauuaaucaaucuaaauguuuuagaagacuuuuaugccuguauugauugaucuguguuuuuuauaauguuugguuuuaguaugcuggcuccauagaaaaagaugggaauuuuucuuuuucucccauuuuuauagaaauaauguuauuguccaacaauugguguaauuuuuuuuuacuuaucacuuagggaauuugaauucauguugaaaagcagaaguagacaacugucagugugucauggacauccagagauguuucacccacaccaagacaugucuuccucuuuauuuccuuccaucucuucagggagccacucuucccauaaaguccgguguuaaggccacaguuuaucagagaagagccagaucuaaagcuucaagauuaaccgcuaucaaccaagaaaucuagcauugacuggggucuguuguguucccguguauaucaaauuauuucuuugugauaggcuauguaaggccacugguauaaucaccauucaguaaaugcagaggcgaguacuuggaaacuuuaaccaugaagaagaccuugagugaauuuaaagauaggcuuugguagaguggaggaucugguguaugaccauugcaccccaguuacacaagugcauugacaggcugaauauucaaggagcagcugggacaaacuggauccucuagagagaagacuaaccauguccaguuguaagcauuguuucuuuguuauuuuccagucagcuagccaaaguuauaaaaauguucuaugaauuacaaggauguagugaaacagggacaugagaaaucauggacauguauaacucuuucccauagaguuaggaagggaaauuucacagagccauacaguguuuaggugugguuuucugaaaguaagguaauguuucuaaauauacagguuugacccauauaaaaaugcuaaugccuaaaugcuucaagcgaaggaacaguuuucccaguugaauuaauggaaacgaaauuuuauuccuggcucauaugcuuaggaaaaagaaacagaugucagacugggguagggugaggcaggggcauguaucaggcuggugaaggacuugguuaguaacauucgccuucucuaaacucuugugaaguuucgagaaguuugacauuacuuuuacuaaauuuaguaguugccacuaaucaagggaucuguguaggcaugaauauuucugccuauggauuucuggccauucucucccugguguugggggagggugugcuugucucuguacggucacuucacaugauuaucugagaauguaguuugaacuuguggagucauuacagacaauuuuaccaaugcuuacaguauguaugucacugccucuuuucagaaaccaaaacguuaacuagcaaccaucugagauguuaaaguaaguccuuaaauagaguaaggaaagcaggaaauaaagcauaauuguauucaauuaaauacauauguaaggauucauuauaauuaagacucgcugaaguguuugaaaagacaaauaggagggagaaaaggaaaugguuaguuauuuuggcagauugacuuagccagcucauuaggacuagauaaaaaugaagacuuggaagaauauagaagcuaaugacuuaaguauaaaaaaauuacaaauccucuuuguacaccauguuggauuuguguguugccuuagaaaagacaaacacaaaaaaaguuucuuuuuuauauguauuugucuuuguucuugagaguuuuauaccugcauauaauuaaauacagucauacacauacucgauuucccuucuccaagccccagaucaccucugaauuugaacucaguggucaucaaaaaaaaucugcaucugaccuaguuuuaguccauuacauuuccacacauacuaggcaaaaccuucuggggaacuauauauuucuuaaugacaggcuguguguugccuugcauuugccuacccaugccgggucaccaugucgccagccccuuugcuggugauauugcuguguuuugcaaagaguauagaaaggagaacuuccuuccccucuuaggauauuuaaacucauuuuguagcuuuugagucccuuugccucuuuuucaccaaccuggguugaauuccccauacuaucuccaaggauacagcagacaucuagcauucuucauagaaucuaagucuaaaaagccaguugugugguuggaccaugcuauuucuguugcccauaaugauuugcuguccucaucuguaaaaucaggggguuggaucuggacuguguaaucacccaaauccuuuugaagucaacacuccuuguucauccccuuaguaagguguugcauauaauacugaccacuucuguguguucaaaacaucuaaugaauccuuuuguacacaauaagugucauccucucagaggugacuacacugguuuucacccugcuguaccuaauuaaggacacucaauuuauaucuuuuuuuaaagauuuauuuauuuauuauauguaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagcucccaauuuauaucuucaaagauaaaauaguacucucuucaaaugaaaucauuaagugagcacaaugcuuggaauguguuuauguuacccauuauaagguuaaauguuaugggaaaggggaaaagauguuaauugaguaugacugccaguaaucucagaggaugguggggaaacccaugucagaacuggucaagacauucuuccauauugagcucagugaagggaaacaaagaaagguggaaccauaaauacauguuggcuauaauuuguuguauaaguuuuccuuuuccccucccacacuugcauucucuuauuccugccaccaucauccccaaaucacuuugagggauagggaaagaguccagguaagauacccagcuaaguacuuuagucucagaaauaagcaaaaugugcaucccauagccaccagagagugccaacgaaacaaugaauuuaccgucaucuucaccaacauguaccuaaaaaacaguauaagaucgaacucuccccaauaccgaguauacauuggcuggucuuagccacauagugcucuucccagaguuugcaguuaaauucuaguaagccuuuugggaaaaucaaagggccugucucuggaaugaagucacaggcagcuccagcaggagaaaugguugaugugguuuagaauugaauaagaagaagaaaugacaaaagaguuacugucagaaaagggaaagaguauauuuguaauagacuccaauccuauucauacuucagagaaguaaaauuaaucccaagaccaaaauaccccauaugagcgaguucuuagcuuagggacugaaaggugaaugugaagguugguuuaggcaagugauaaauaacauauuuuuguaaagguuaguuuggguaaacauuaagucaaaaauaugucuuaggcuuaaaaucaaccaggcagaaaguauuacugcuuuaaaauccugccuaaauauauauggaauuuacuagacugaaaugguauaaugucugccaauaucaauacauaauaaaugcaaagugacuagauuuugcuaaaagacuguuuaguagaggauuccaacaagauaaugauucauucagugucuuacugguuaagcuuuauuugaaguguauugcucauaauauucuuuuaaaguguucugagcaagggcuauugguaucaucagggguggaguacaugcacagaacccuaguucagcugcuaguucugaaaaggggggggggggaggugccuaaguaguuaccaaaagcagaguucaaauuccuucucuauugaaaaaugccagaaguuccauuucacauuccuucauccccuaguugaccuugccauucaaaccuguuaaaauacagaaagaaaaaaaaaugccauaaggcaguagucaaucauuugguagaugcugaacccaacuaagcaugccagggggcacacugaagaguccagugcuuaaguguucuucugggaccaaaaucuuauaaaaucaugguggugaauucugaagaggcagccauuucagcaucuuuaaugcucuauuuaccgagcaaugcacugucauuucuauuuaaaauaauuauccaagucgcuaaguuagcuuuuacuuaaggaagguugaaagauagaagaacacucuucuugguuucuucucuuucagccuguaaauauguuugaugaaaugugaauauuguaaugcuucuuucugccccuguucucugcuucaagugagagcccacuucccaggacuaaauucccugaccuccaaggaaacuaaaaccccaguauaguuuuucaucaggucccaucucauuugcuuguaccaguugcccugagucauuucuuuuccuucaagaugcuauagugcuaccuucauuauuagaaagacuucagaauugguauuuuucacauggcaugccaaggagaaaaacuaguuuuaacuuuuaaaaaaaaaucuaucaauaaagccugauuuugacuuguucuuacaaagaaggaggaaucuuugauagggaaacuagagacaucuuguuaacucucaguggaccagaggcccuuaggaagaguagugaagcaucauccccccucagucguugagguugacucuucaaacccaaugccugaugacuuggcugcugugguucauacauagaggcuauuuuuagaggcaagaauugucauuucccaaaaguauaaccacaagaugucuauuuagaauggaucacauuuaugcccucagacaguaggaaaugcucuacucaugucuggguacccucaguucccuggggaaauauguaauaucuugguauacucucaccccaggacccuuugccuccugucaauggcccucaucucgauggggcaauuccuucggaaagcaagcaguggcaugaggguucacagaggccuuugaagcugguuuuccuuccagaaaaagauaaaaugauaugucauccuuauagcauuucacagugguuuaaagcugauacagggacaagcaugcuuguaaucuuuagugagagagaugcucugggucaguggccuccagaggaaagcuugacuugcugaccugccuuucuguuauauucccaggcuugcagugggaugagcaucuugguuuaucuuuucuuauaacugcaacucuuuggggucuuuaguuucuaaaacagaggcuuauucaaguaaagcuggagacccuugagggaguuauacagcccaucauuaacagacuggcagacuaaccuaacagaaaaguguuuggcuauggauugcaagaagcucccugguuggcuaugggaaccucaugaaaccauuuagguuaccauauccucuuguguuaguugucucauuuauuuaaggaaaucgauugucuccucuccucuuugguuugacuucacuuugccggagauaaaggauccagaaucuggagauaaauauggcaucugccucugagugucacccaauaaagugaagaguggcccuuagucacucucccuaucuaugcaucugaucuagcuguuuaggcucugcauacaaagccuuucugggaaugagcugcuaggauaccagggcaagcacagcaggaagagauagaggccaggaaacauaaaguugagugcauacaguuuuuauuccauuuguuaacccauuaguuuauccauuacuuuccauucugguccagauccuauguuuauuacaaguuaaggcuagaguaguaagugccucuuuuuggcaccauuccaaacccuaucuaaaucuuacuguaaauagcuuuucauaaaguuuucauuuuuguuuucagagauagaaucucacuaucuauaccaggcuggccucaaacuuuaauucuucugacucagccuccugaaugcugggauuauggguaagcaccaccauguccagccuuuuuacaagcauuuaggcuaaaaacagacauguugccuaauaucucuccccaguccaacauauugcuuuuuuuaaaauaaagcuaaugaugcucugcuguugccucuuaugguucuagagaggauugacugagaagacagauaaggaagugguuuuaauuauuaaaauaaugcuaguaguaaucuaagaauagguaacaguaaaggguuauucuucuguacuuagccuauaccuaaaacaagcauucauucuguucucuauaaauauguaguauuuaauauauaacuguaauguguuauugugugaacugugccacauacuaagcucagugcucuauucaauuuccauaguuacacagcgugagagacaaguagggguauuaccaugccuaucucagagauaagaaacauaaagcuuagagaagucaaaugauuuguuuacaguccuaaggcugcuagacaauauguccagauuuggagccaaguuuucugacuccagaguauaagccuuuagccccuuaugguauaucucugcucuaagaaagacuaaagggcuguacaguuuuaagauaccaacugaaaacccuuaaucuggucauuugaaacccaaaugcuccgaaauccaaaaccauuugagugccaaccugaagccaugaguacaaaacucuauagcaugauagauuguuuaaugcacaaaaguaguaaaaacucuguucgagcuguguauacaagguaaauaugagagagaaauggauuuuauauuuaaacuuggguccuauccuuaggacaccucuucauguauuugaacacaucccaaagccccuuaucccaaacauuucaguuaagguaaacucaaccuguauugguaacauuacuggaaauuuucuaagauaguaaauggcuuccucaaacuauggagagcugucaucucaaaugguuugaauuccauagauuccauccucggugcuucuuucacauuccaguuugccuuacuauccagacauggguucaguggagagccuugucuucauacacuucaguguuucuuacccauggaagcuacaaguggcgaggggagagagagaauagaugugaagucugagagauggguguggaagagaguuucaccaagaggcaccuauggaagcacagcgucuggcaagcagucccccuacugcucccucaacuaaacauccuuggcgcacagaccuuuccuugccuuacugggaacauucaaauggguuuucucacacuugaaaagaucugagccggaugauuuucugggaccucguuguguggccaaagcacuuuccuugaccuugcugaugaggccuauucaacaagcccuucaccucuguugguguggugggggcugauggcccuucucccccgcuuuuucuucuucuuugagaucauuaucauuauccugaacagcauaguucacaugucagagaacuuagccaccuugucaggaaauacauuaagcacaauguauguauuuuuucuaugugcauucauccaccuaaugaacauuuauugaauaauaccuuuacuuugugacaaaugccaugccagccacagguaaucaaggcagacugcgucacuucuuuagucuauuacaaaugcaacagggaaauguauaauugcaaauugcagaaaauucugugagaggaacauccacaggaaucuaaaauguaaauucuggaacuuuuuuuuuuauagacuuaauaguacuagcccccauuuuuacagguaagaaagcugaagcucagcaagagugacuuauacagcaucacacagguagugaacuggcuggguagagauuuaaauccaugcuggucauauuccaaagcucacacucuuaacugcuaugcagcaugaccugcucgcuguguaaaguacauauauagccauuaauucuagccuugugcauuugagguucuggcuucaucucaaaagugcagaguuuccaauuguuuccaauuacuuguggcugugguuuggugcauuuguucaaagaaagugugcaugcaaagcgggggucacaugcaaggccucguggauguacacaauguguaaaucguauuggcauuccaaaaaguccaagauucauuggaguuaccacauuuguuucucauuagauuaugcuacucaaagacaaacaguaaagcauguguuuacauuacuguggacauggagagccaugcccccaaaacauuccuugcagguuguauaaagcuaagcacccaaacaauuccaaaucaguuuuugugagcccagcuuaauagcuuuaaaauguaaccuggauuccccaccccuccccccaaaaauugccuagaagacaugugagcagccaaagagacaucagcucaauacccaaacuauguaucaaaccccguauuuccaguaucuauuuuguuaguuauucuuuauuauuuuguaaauguuaaggugauuagagucaagaaaacucuuagcuguauagcaacaggaauggcauuauugauuccauccuaacuggcuguccaaagccuaucaaaacaaacccauucaugaugagaugguuugguuauguaagacacaguagaugcaaagcaagacaggggcauccaguguuauuaagagcauagcguuguugccccuucuugguuuuguuuuguuuuguuuuguuuuacuuuugaaacaggggucucacuaugaagccucugcuacucuggaacucccuaagcagaccaugcaagccucuaacucacagagauccaguuacccaccucucucugcuagggugcuggaauuaaggcgugcaccaccacaccuacuuuuauugcccugucuuuacuuuccuacccaauaguaaaagucuuucccaucaaguuguaguuaacaccuagccuccaagagaacgucauagaguaggaaguuaccagaaaucaaggcaaccgaauuaaaaaaggguaacugaaagucucaguuauagaugucuuuaccuaacuaguacguuucuuagagcacuugggacuuaaggacuuaaugauuuuuuuuuuuuacuaagaucuuuaucaaucacccaguaaggucuuauauacucucugaggcucagaguguucccuugaugaagaaacugggaauggcagacuucccugccgcaaaaauucgagggcugcauuccaaaggacuuugugaguaugugagaggacaugugcucagucccagcucagugugaggcugauaagacucuugcccuuacaaucaggacaguaacaagaggcgcauugucuguaccauguagacagaucaagagggguuucucccaugggccucauugcagcauauuugaucccuguaagaacaagaaguauauuauucagaucuuuguucucuugucaaccaagcaugaaaagaacguugaccaaauuguguugucccauguuguagugccccuuuguggauauguauuuaagaauaugaaauugauauauucuagaaagccugguuuuuuuuuccugcacccugauucuaauuuucuuacauaauuaugucaggguuuuguuuccuuuuauugcaugaaccugaguacccguuucuaugcuuacuuuucaguguuugccuuucugaucaaaugaagucaaucaccuuuauagaagaggcuuuucauucuccuuacaaggggauuuuuauuaacuaugauggcaaaaggucaugauggccauaccucaggaaaaagaaaaaugucauugucuucuacucucuucacaaacugguuugaagaguaauaacaaggauuccagcaagcauaauaauaauaaucacauacaucuggcuagcaccauucaaguccaaagccagcuccagagaguuucuaagaagcaggguaauagugugaaaccuuuauuagagugugacauaaaccuuaaaucucaguuacuuaggaagcugaggcaggagaauaucuuugaacucuuaagugugagaccagccugagaacauucuagaaccugacccccccccaaaaaaaacacaaacaaauaacaaaaguaccucaucugggguuuagucacauuaagacucuggaagacagguguauuuagaaaugcagauguguuuugucuuugagauguuaugaauccagcuuaggaccucauaccuaccaaacucucuggaacuuaccacugagcuacauccccagccuagggagccucauuuccaacaagcaucuuagauaacuuuuauacaaguuuuauucucauuuccaugguugucuauggauucggaguacacucucuuuaaucuagcaauccuacuaaaggaaaugauaaaaaaugugaggugauaugaaaacacuugaugagaauaacuaugugugggaagucagacauaacuauaaugcaaacauuggaugcugaaaagugguuaaggaaauuuugauaaauuccuuuauugcuguauguuuuuaccacaguucaaauacuauaguuuucuuauucauuauaagacuucuaugaggcaaacacuauuucucacauuuuauuuuagagagauuaagcagcuucucugaaaauaaauguguaauugcucgggaaacuaggauuacaaccuaaguaugcaugauuagaaaauucaagauuuacuauauaaaagucaucaauuuaaagccuuauuuuaaaaaaaaacauaaacaaaauagagucuuuccuuuuacuuuuccauauauauauauauauauauauauauauauauauauguuguauuaaucagcuuucuguuguuaugacaaagucccugagauaguuaacaaauaaagacaaaggguuuuuuuuucccuacucaugguuucacagguuccagaccauggucuguugcuuuugugccguggagaagcagaacaacauggcaaugaguacauugaagaggggcugccucccccacuucauggaagccaagaaggagguuaagcgcaagcuuagaacccaaugucuucuuuaaaggcacaagcccagugacuuaacuucuuuccacuagaugccaccuccuuccuuauacuuuuguccucucccaauaaggccguuuuuucuggagacuaaaccuuuacuauaugaacauggggugggggaguauuuaagauucaaacucugccaauagugugauacaugacaguguguuaugagaucaagaacaaccugaccuauguaguaagauucuaucuuagaagacaaagugaaaaagauagaugaagaacauaacaugguacuuuacacauuacaaaaaaaaaaguucuaaaauaaaaucaagacuuagauaugguggcauauuccuauagucucagcacuccagagaucgggguaggagaauuccaaauuugaggccaaaucugggauacauagcaagaccuuaugucaaauccaauguauaaauauguauugacaauaugcuuagccaacuguaaccaugguucagacagcugagcagaggguagcagcuauagaaaaugcuggguuaugaauggucuuucccacucugcauaugugaauccaugugugacaggcagaugcuucagguuuagagcccggcuguguggacaguggaugaaacagucagauuuguguuuuaauauuugacauugcuaaucacuauucugagccacaggcuuauuuuuuaaagcugacaggauaguauccuuugcaaaugacaaacaguucaucaacaacacuaagcccuuuguguuaccugugcuuguguaccggucucuccuaaucuucuuuuuuauaaaguaaauacuaagucugagagauauuguaaauagugagagaacaaaagagcuauagugugaaauggaauuagccugauuggauuucugagggaaagucaaugcugcacuaaauccauauccauuuauuggcaauucuuccucagacccauugucuuucuuucaacccucuucuucauucucuuccaaagcaauaguuuuccugguuugaauuuguuuuguuagugugugaggacgagacuccucaggagcuguccaugugaaauuacuaggaaaccugucacaaucaccuuuccaugcuggguuucucuccaaaaugaacauaauugaagaccuaaagugcuagcuaccuccuuggcaaaauuuuacagccuguuuugcaaggcucaccuuaguuuagcagggcuauccaauaacacuggagacauuuaugaagggucagaaauggccucucgaaauaagcuacugaucuuaaccagggucauccaaaagaguuucagcagggcuggagagauggcucauuugguaagaacacuugcuacucuuucagagggucuagauccaguucucaacaccaacacaaugucucacaaccacaauagcuccaauuuuaggauaucaggagccaucuacuggccucugcaggcaccaagcaugcacgugcugcacauagacacaugcaucuacaaaaaauaaaaauaguuuuuuaaaaggggguuuugcuacucauuucuaaguucuucuacaauuaauccuggcuuugaguuuucuuuuuccuuuucucucugguuauggaaguaacuuuaaaggucuaccaugccacuucauuuuguuucuucuguuccagagcacauguauugaguaucaaguauaugccaaauaguuccuuaaaugcugugggguucaaaaacacauaagaugaaaacccuagcagcuccagucuaguaguggagaagaucauaaguauacauaaguaaugccagauuacaucuagaaagugccauuuaggggguagagauaaaagaaacacucaugggagauggaggagaauuguaaugccaagaaggcuuuauuaaggccaugacacuuggacuuggcuugaaaaccuggaagccuuucaauagacaaaaaugaacaacagcccauaguauguucuuaguuaaugcuuacugaagguauuaauaaaaagcucaaaugugagaugugcuuagaaaauagcaaguucacuaauagauaccuaaccacaaaaucuccucauguaaaaaauucuaaugcaaacaguccguguuauacacaaaggaugcauucuugaaaauuaacacgaaaugcuuaugucaaaagcaauuuucccauaugaaauaaugguuaaggauagauuugaaguuuuaguuaaacuauagugaugcuuguuauagcagggacucaccauucucagagaauggucuguggacucuagaagucccugaaauccagagagccacaagaucgaaacuacuuucacaacaauacuaaaaauuuauuuguuguuuuuacuguguugauaucuaccaaaggacugacuagggaaaguguuggcaccacuguguaaauaaaagcagugacacuaaaaugcaguugucacaaacucaucauuccauauguuggcaggaaaguggcagucaccuaagaguacuguugcugaagcuguggaaauuacugaauuuauuaaacgucaacccuuaaaugcaauuucuuauuaguuugagcuaugaacugaaaguacacaaaguaugugugccucagcuauaugucagugugcaucucaaggaaacacucuugggagauuagugaugugaccuacauuuagcccccuuuuaucauuuguguuuuugaauuccauaguaguuuggguuaggaagcgggaggaaguacacauagugugcuuccauuguacaccaauguacauuucaaggaacucuacuuauauaucauugucuugacaaggaacaaagagaggcugucagcaugaggaaaauaacuacacauacuuauugcuaaugauaaaacucuagcuuuuacgagaagacuaagggucagcaagagcuggccacacuguauccauagucccaaagcacaauaggagaucgcagcuugcucucuccuuguuauccagccugggacuccaaccauucgaugguggcaucugcaguuaggguagaucuuucuaccucuacuagccuaaucuaaaaaauccuucccaggcaugcccagggacuucccuccaugcucauucuaaaucuugucaaguugaugaucaagauaaaucaucaccaacuugcacuugaaaaacaaaggguggcaccucgaggaccaaaaaugggugacaagacagcaauuggagcaggaauugaggcuaauagcauaaagccuuagagagagauaacaaggaaaauaaaaugaaccuucauucauugccaguaugggucuguuaguggagagacauugggaugauaggagucccacaaaacaaagccacaugacuaaaaagcuaugccccaaagaucgaaagaagcaugucccuuaauaaguauauuagcuaugauaaagcagaaugauuuaaaaagcaccuuacuuacugaaaacuugcagaagaaagaucuguuuacauuuuuuucaauuggucaaaauaugggauaugacaauuguaaguaauccuuuaaauugagugcuguuccuuuaagagacuguuaugucuuuauuccauuagaaacagguguugaagguaaauuccauucuaguacacuuucauagggaauuuuuuccugaucuugguaaccuaauagacuauacauauacuucaccugucaaggaacuuagauacaauguuacagaaauguaaaaugugguguauccccugacuucagugugguuuaaguagacuggaagcauaaagaauccugucaaaugcuguaaaauuguccagaaguaugaagcucuaaaguauauaagcaacucacacauaguuaaauuugaagaugauuuuuuuaauggagucuugcuauguuacacaaacugguguugaacucuggaccuaagcaaucuuccugcuucaaccucuuucauagcuagagcuccuaguguacguuacuaugucuggccuguugaaaggaguuguuuaaaguuguacacuucaugguaacacauucuucgaacccuaccaggaaaaaaaaaacaaggagaguuucuauagaccuauucuucucuuccagcuccugagaaccaugucugugcccaaggguaaaguucuggauaaaagccuggaugaagaaggacuugaaaguggagacugcggugaugaugaagaugaaugcauuggaagcucuggugacgggauggugaaagugaagaaucaacugcgcuuccuugcagguaacuggcugaaaagguugcucaauugcuuucuagacuacugcuaaaaucucugcaguacacaaugccauaaacucucauaggaaaguugauccucuuaaaaggugaagcuuucagguagguuuucuaccccaaacccucaucucuaacccuggguagaccagaaaggcauugucccauuuuuccuugucuaaaagcaaauuggcugaucaguugguucugucuucccacugaagcuguccuugggccuucuugguuauacaaagaaaugcugccuugggaaucuugugcaaaccuacaaugaaucuuggcguuguagugggguauaucuccuguguaagguauuagguuuaaucccccacaccacaaaaaaaggaagcagaccaacaaugaaauaacuuuaaagaaagaacuaugggcugaccuuuccuucuucaaacaacaugucuauuuucuuuucucaaagcagucugguauaguuacaacauaucacuauauugcuacuuaaacacaauaacaauagaaaaaagaaauggcagggaugcuggagucaaucgggaaaugcaaaaccaaaaccaauaacaaaccuacucguauuuguugugucuccgaguuucuaaguccuuccauguugacaugcauucuuccauuauaaauccuuccuaauaaagcugggcucagagaaguaaugagauuucucuacaugcgaaauggacuuucacuaccaagccuuuuccuccucagcacauugcuucugccugugucccaggccauccauuucucucguagccucauucccuuaacuaacugcuaucuaaccugaucuggcccuaaaagaugguugccagccagaggucucauuuuuagccucuucuucccucuucuuuagagagaacacacacaucauauccacucucccucuuuaaaugcuuucuuggaaucaauucuauuucaaugaaaucuugcuucuuaagaaaauuuuaugugcacuguaggcaucauuaauuagguccaauuuggccaagagcagauguccagcauuuuccaucuugcauguccaaagcacucugcccauugaacagcaccuccucauuuuccccagacacuccccagcccuggaaaacaguauuuuccuuuguggcuucugaguuucacugcuucagaacucauauaaaguagaauuguacacugaauacccuucucugauucucuuaauauaauguccucaagcuucucucguguggaggguaugguggcaugauucccucuuccuccauuucuuggauuguauuuuguuuuuugagucaacauccuagaauaaccucaaacuuaagacguagcugagauuggccuugaacugcugauccuccugccuccaacaccccuaguacaggcaugcaccacuguacguacacacacauacacacucacacacacacacacacacucacacacacucucacacacacacguacagacaaacacacaccuuguacuuuuuaauccauuuuccuucuguacagauuuagguuaguucaucuuuuuguuguuauuguuugcuacuguagagaugacauaaaaucauuacuaucaguaucaacuguucucccaagcuaccaggccacaccuccauugggucacuaauguuuuauaucugacuuucucaccauuaucucugguuugaugugucagaaaucaaacuuaugaaaugauuaucucuaacugguucuccuuuaauaagcucucuuucugaaugccuccacacuucucuuggucauugagacuuaaccuaaagucaucuuugguucuuuuuuucuuccuugucccucauaugcaguugcucacugaauccauguugauucuuugucacuuuuucuguuucuaucacugcuuccugucauucccuccucccagccuccugcauguugcaaucaaauccaguguucuccaggauuccaggguaaggcaggaggauggugagccuuaggugaaccaauuagcaagcaaagaauuacagacccagccagaggauuccaacaaucugucaugcgcagaugacauguuaaucuuucugaagcaucuucuccucucccuagcucagcugccuucguccuguccccauugcuuugaagauaaagcucugauccuccacagaauucuaagagacuuguagucuagcccuaacuaaccuucuggccauauuuccuaccauuagccauauauacacucuuuacuucagcuuuaaaagcuguauuugugcccccaugaaccccauaaacaugcugugcugguuucuaucuucauaccauugcccauguuuaugucuauaaagauaagccucuuuucuuccuucuuaaaucauaccugaccccccacagugcauuucauauaugcuucagggacaagaaaguuaguuuuugcuauagagugagcauauauuugacuucuucuuccauguuagugugacuuaggaaaaauuucccuaaguuuuaucauuuccuuucuaauacuccaacucuucacucaccaaaugaggcucauacccuaacuccauggcucuauugcaggaacaugucaagggaacaguugacagcaugggccgcuaggugcucugugauuguuagcuuccguccuaaacucuuuugacaccgauggauauauggaaaacaauucucugaaauauugaaagaagcucugccaaugcuuucaaaauauacucuacagugaguucccaguucuacggggggcagauucaggacugauagucaggcagucugauuucagagacuaccacucuacucaaaugguuucuuugcuccucaggguaaccaugaaaauaugaaaauggguuuuguauuauacuagaaauuaaacauacuuugaaggccccaaaugcaaaacacuauaaaauucaaaccuucugagagccaccacgaugcucaagcuguuucaaauauuuagaaacgaucaaccaguaaagaucacauaaacauuguauaaucugaaaaauaaucaucaaaaccugaagcacuuuugguccuaggcccccaaccuguguuuagcaacucuugugaccauauacacuauaaagauuuuccagacaacucaccaaaauguuaacuaguuccaacauugguccucagcucacaacacugcucauuucaacucaggauuuccugccuguaagccuugucucgauccauuuuuuaaaauguucuauaguuccaaggcgaccuaccuuuuguaggcaguacuuggggaggggccuugugaaggacuuugucaaauguacuuagauugaauccuugguuucccauuuuuuauaugcacauugauccucucaaaggacucuagucaguuuguaaggcaugguuaacuuaagggcuuuguaaacuauaauacacuaugcagaagguaguuaauuuaauucacagggaaaaugaugcccugccucuuaaaguacuacaugugccuacccugaucagugauucuaccagccugugguuccuugggucuccuuuaaaacaauucuuguggagaagaaacucacugccaaucugucacgcucaaggcacaauagcuauuuggaacaacaggcuauauacacauugguuagcuguuauauaauuucaccgaaaaucuggguggaugccaugugguccuggugauucaucuucauccauuuauuuagucaacuugauuuggaacaugaugugcauuuaccauuucauuuaguacugcaaauugccuccuccagaaagcaacuugggaauaaagagcauggcuuagagucuguucaguucucuuguaucuuccuuuugucccugaacagacuuuuuacauacaucacaaccagugagugauccuauuggcugaauuuccuggcucacuucuuccuuucuuuugauauacugcauguaauacaguucuauucuugggcuuuguuucuaacuccccuguguccuaaugaaagucccuuucacuauuuaggagacaauuucuccaucuguaacauaaaggcaaugccuaaacaauucuuacagacuugucuacugccaacagucugugaucauuucuuuggcuguggcuccugccaagacacuuacaagagucuuugggggauaccuuuuuaugcauuuccaccaaacuagcagguucucuguucucgucugugauauauugccccuauucuaaccacucugacauuuccaaucaggaaacugagccuucuuacaaagaacugccugcaccuagucaucagcacauucguauaacaggauauuaccuagaagaguuuauauguguccaagcuuucugggauauauucacuuuuaaaauucauccgaaauuuuguuaaaugcuucuuuuuuuaauguuccugccuccauccuuuccuucuuucauuccauuuguuucuuuuuguguugugauuuuauuuuguucuuggaugggcgugauauugauguuucgaugauguauuugguuugggggggugguugauaacaaaguuuuacagcauaccccaggguggccuugaacaggccccaaauucuccugcugcagcugggauuguagacauggaccaccaagcccaaugugcagcacgucuuauuucugcauuaaaaauagcaauuuuggggguuucuacucuuuucugacuguugccuuaauuuuuuuuuuuuuuuuuuuuuuuuuuuuuuuuuuuuuuuuuuuuuuuuuuuuuuuuggugauggcuguaaagcaauaucucacccacaguuacacaguuaucuuuacccauggcuugccaacaguauugugcuuuccucuugaugagugucuuagcccauuuaugcugcuguuaacaaauacuuuaaacugggugauuuauaaagaacagcaauuaauuucucacaguccuggcagcuaggaagucuaacaucaaagcaucaucaucugccagaguccuugaugcauucuuagauggcggaagaugcaaaugcugauuccuuauuugguagaagagauggaaaggcaaaaaugagcaaguuuuguauucucccugcaguaagggacuaaucugcugcauggaagcagagcucacacaucguuaucaccugccaacaucccacuaccacaauacuguugcauggggaacugaguuucagggugaauuuuggggugugcaugagcuuucaaaucacaucacucauguacuucuucucuccccuccugcuuccacaucugagaauugggauagcauuaggucuuauuauagagcuuuguggauauuucaaaaaagauacauguaaagcauagagcucaguccccaguacuccaacacucaaacccagauaccugcuaugaagagugcuguccuuuuguuucucuggaugcugauaugaucucaacgagcuuauggauauaaaccagcacugucuuagaaacccacuagaguaauaaauucaucgcaucuaucacuucagagguagagacaugaucagaaauucaagguuauuuucuacuacacaggcuacacagcaaguuugagaccagccugggccacaugaaaacuugucugaaaauaaagaacugguuuuuuuguuugucuguuuauucaaaacacaugacagaccauuuaaaucaagcaacuagccugcagcuauauauacugaccucuuccuauucaacuugacuucaaagcuuuaaccaguauuaaaaccaaugcaguacuuuguauccacagauauuucuucucaaaaaugcuugaucuguagaacuuccagucucucggauaugcauguggggacugcaaaugaaaccuguucuuuguucauuagauagacaaguuugaagaugaaaccuaggcccaugcaggucccuuuuaccauucuucucuguugggguuagguugugagcuaaucuuguuagcucaccuccuccuaguagucuuguagaaaugacuaugggguuucucaacaauagaaccaguaguuccuuaucaaauauucuuucucugcgguuaguuuauauuugaaagguaaaaugacaacuucaaauaaauauugauuaggaacuauuuuaaagccacuuacuuuuauuuuuacuucuauuuuuuucuugagauaaaauuucaugugccucugguuggucuucaacuuaguauguagccuagaaucagaaucgccuuaaauuucugauuuuuuaaaaagauuuauuuauuacuauaucuaaguacacuguagcuguuuucagaugcaccagaagauggcgucagaucgcauuauggguaguugugagccaucaugugguugcuggaauuugaacucaggaucuucagaagagcaggcagugcucuuaaccuaagucaucucuccagccccaaauuucugauuuuuuuaaaaaucuacuucccaaaugauaagaggacagauauguaugugucaucacacucggccucuuuuccgugcuuuuuuuaauaaucaaguacaaccaacaagcuuguggcauaauaaagggauggacauuucaaugauguauucuucuaaacugucaagucaaauccucacaaaugugagcugguaagcacuguguauuaagaaauucauugauggguuggacuugugaaagggauaaagccagcgaaggaacuuuaugauaggccuuuuaucccaggugacaucugcagacagagagcuuuuggaggaaugaacggcccgggcuguuguuuuaaugggugacauguugaguccagugcugagcucaaaauacauuagaagcaauaccauaucuaucuaccuugaccaguuggcaacaaguucagucauaaacuacaguaguuucccaaaauggauucugcaguuugagcaaguuuuaccuucucugugcucuuugggaacauaccauacagagcuuugacacuuaaguugcagguugcaucuugcuaaauaaucuauguuucgaacucucaggcaagaucuuauauuucuuaguauaucagucccuugaauacauggcuucaaugcaaaaggagccaaucuaucuucuaggaaguggauccuaucuaaugagaaccgggacagucucaauacauagggcauugaagucucacauuaaaaacaucauguaguccagugucagggaagcuagaccugcuauaaaugcgguaacuuuuagaaaacaucccuuagcuccacaaaacuucaguuucugcauuugugaacguguugauagcaugccuaccaauguucauuaguugcugaaccacaggugaugguggauagaaacauauuuauaaaauuauagagcagaguucucauuuuaacuaaucugacuaucauuuaguacuaucugguucuaaauaauuuuuuauuugcaaaagccuucaacuaaaauggaaaagguccaaauguucuguccaguaauguucauuauacguguauucucuucgccauuccuaaaaagggggcauucgauuacucuuuaauuuguuuuuaacccagaguggucuauaguaagaaaguauuugaacaaugacaacuaugucuguugaguugugcaaauaaccacagaaucgaaacaguaguagguaccuacaucuugaaagacucacagcuagcuaugguuuguuuucuuuggugggaguauggcaguaagggcggggggggggggguggacagcuuguuggggagggucaagaaagagcccuugaugcuuuccauuauaccuuggccuuagcuacaaacagccugcuuucaugucuaggucuuugcuuuuauguaguuaauaccuuggggaagccaaaggaagcaaagcucacuauaauaacgcucuucccacauacagaucaggugcuucuugcuaauagauugacaagacagccaaucucaacucucccuaagagcuuuguucagcuucuacagcucacgaggaaagacuuagaugugagcuuuagcggugauauuaccugaaaauugagacauaugccaagaaaggagccuuccaaaugucuuaguguugacuagggaguuaccaaaaguaagcuggugauaaaugagaagaagaaaaguagaaaucuuuuuauaaagucaccacaguucagcauguuuucaggaguuuguuauuuggcuaagauuauucugacguuugauuuuuccaagucucuaccuucugaaacugcaccauaggaccuuuaggguaugaugccuuuauauccagagaaauugugaggguuuuguuuguuuguuauuugugguuucaguuugguugguugguugguugguugguuguugguugguuggaugguugguuuggcuuuuugagacaggcuuucucuguguguccgcccuggcuguccuggaacucuuuagaccaggcuggccuugaacucagagaucuacuuagcucugccuccugaaugcugggauuaaagaugugugccacccaagcccagcaucaaggauaauuacugauaauauuaugguuaauaugaacaacuuaagauuauuacguuugcaagcacgauucaacuaaaauauuaauuaagaauuuggcuaccuggguuauaauugcuuuccucuguguguguguguguguguguguguguguguguguguagagggggaacaaugcugaccaauucagugacagccucaaguaaacuuuguaagaauagauagaaaggaaugggagagcuagggacagugcucagcuuguagaugaauagaagaaggaccagucagaaaguggcaaugucagagcuuccagcugugcuggcacacagaagagaagacauuccuguggacuaauauccuugaggggucugggacaaugaguuguagugccauuaaaugggauggucucaccugcucaaaaauacaucagaaagaaaaacguggauuucuaccuaaaucaauguugcuguuggaaauuucccugaaaaaaaaaaugauagugaucuggcaagaugaucuuugaguuuuucucaauuuacguuuuuuucuaauuuuauagauuuuuuguuuaguuuguuguugucguggacauuguuguuuguuuugagacacgguuauauacuguagccuauacucacuucaaacccaugacaguccuccgugccucagccucuccaagggcugggcuuacaaaugugaaccaccauguucaguuguuuuuaaacucauagugcugauaauuuccaaauauacugaguuuuaucuuugauuuaaaaaaaaauccuaauguacguggcugauuuuaagccuuuaagguaagaacgggagugcuagcauagacucucuucauuuguaacuuguggguggacuuaagcagugauauaauuaccaaguacauaaaaacagaguggagguugcccuacaaaugcgaauaucugcaggcagccugugugugagagcagggggaaaucucauuagcaccuucaggaugguuuucugaguaaagugauuuguccaaguacccaugagcuccugggagaauuucaagcauguuuuuuucauccuauaucuacacuuuuuauccugaaggugcuaaugagauuucuuccugcucgcagacuaucccagacaccagaauuuggaggaaagccucuacuacacuuuuauuugcuuaguaauuauauugcucaugaagucuaucaaugagcuacaaauuaggaaagucuguuuaugcuggguccuuccccccauuuuuacccuaaggacucagcugucagucgccaagcucaccacccccacccaccacauacacacacauacgagcuuaguagaugucauuuaagaaacauuucaggacuggggcagaaagcucacugguagaaugcuuaccuacuaugugggaagcccuggguuuuauccccaguaucacaaaguaaacagauauuuuaauuauccaugugcagugcugguaugauuuuuuuaacaguacugaggacuucaugcuugccaaguaagcaccuugccacugagccacauuccgaacccuguguguaauauuugcuuacuuucuccccauauuuggcaggguagcaaagugcccccacucugacugacuuaugaacugacuccuccuuccaaggccccucuagggucccacagcuggaccuaugaggacuggaauaagagauuccuguccuaguccucaaaggugacucagucaagcaggcaagucaggcaggacaggcacucaaugagcaucuguaagcaaagagcaucaagaggaggggaggaaguacaaggaagaauuugagaggugacaaugguaagacagugcaauuaagugucaguguucggucuacaugagaugaggauuuggaagaugugcgcaugucuaugguuuagcggucugauacaugggagauaagaguagaaccagaagcaaagcugaugggaggaugggcuuuccuacccuuucggcaauuccucaguggaaugaaugacuugcauuaggaaauagucagcuccugacuguaggggagugugggcaguguucauuaaacaaaauauauuugaaagauucgucuaaugggcauaaagugaguguggacuaauaccucagucaucuccauuuccaagacauugaaaagcucugacguggcaugguuggacguaaguagagcaaaagaaaaugaugguagaacaaaauagcuuuucaaccuagaagaaugaaagaagaauggagaacagaaucucugguuauuuguauuugagcacauguccccaauuacaauuuucuauaacuauuuuuucuaagcaaauggcuccuuaagaguggcacagauuuuaccagagaauucuuucagcauccucugucacucacagccuguggaguugucuuucuucuaugagacaauagaucuuauuuuucuuccugauuauuuauacucuuguggccuuccugccguuguguuagaagacggacuuggaauagagcccccuccgccccagccucaagcaauuagccuaaauggcuaaauuaucaagaucuagguuaucugguucacgcucauuuccuacgcugcccucuccaaucugcuuuuuguucagagaauaaaguaguauaucuugaguaaucuaugauccagaacucccucuaccaaagcaaucauggacccauacuuuuguagaauauaauaaagauacauuacuagaaaaaggaaauaacaaagaggcccgccaaagauaaaaaccacgauuuuuaauuaagagauucaacagaccagaguaucugucgagaugcuauaaaaguuuaagugcugacuuucaguuucuguuaucuucuuacagaucagcaauaaagagcagaguagcagaguucacuuugagcaggaaaaaguagcucguccuguguguaugucugcuuggcaucccuucuuaccuuggugggaucuacucaaaagcacucugaauaggaggagggcagugguuuuacuugaguuguguggcauguaucauaaaagccaguuguuagauuuucagaauuucugugagccacuuagauguauccauuauuaauagaguaaacauuauaaaucugugauaaaauaaauucuauucaaagaaggaugauucuccaaagucauccuaugcuaauuacacugucccguugucuaacuguguccguuguaucugggaggcagaaauacuguauacuuuucccagucagcaucaagcgccagcacauuuguagcugugauggcaguaguuacuccuuuagaagucagcaaacgcaguaagucggggcuugaguuauuguuguauugauugccuagaauugagacucaaggaagugacugggagaaugugaguaguguaaccugcacuucuaauugugcucuauguguagccaccacaucuugaauagcacgcuguuugagggaauauucucugaaaauuugaaaacuauuaucuaacaguaaauaucucacucuggucacugauguagugaagucucaccggauacuguguuucuucacuucugagagcuuccuuaauguaagccaguauagcaacucauauucuuguagaaacuguauuuguuaaucaguugcaauguaguuuaguuauagaggcaaacuucuggcaaaggaaaggucaaugaaagcauucuguaaaaaccauucccaauaugaaauuuauuauaaauaguaucaucuauuuuaucuauaaaucauuugcugcacauccuuuauuccaauaaaacuuaaaauaaaaggacauacauauuucuuguucugagagccaguuguuaaauauuuacuggcauaccacuggagugaggaggugcauuggaaagauuuauuuucucugcuucauccuucuuucauccuucagggcucuuagcuuaaagcaguagcucuuuccaccauggagagaaguuccugucuuucaaaauuaugcuaacaaaugaaagagcuucucauuuuuagucacuuugacuucuaggaauccuaggcuuggagacuuucuuagcucugagacuacuaaccagauccauaaacuugcucuuucccaaagcucuuuuuuccuuauugaguuugacaggcuccuucugaagucucccuuagccaauagaaaucucaucaguuccauccucaaucuggccgagagucuugauaggucagcucacagaggcaucgaggcaaggaccacuuggaggguuucgccucucuaucagaacaaaugaauccugugugcugcuauuagcucugguuucacagagacuggaacuccuaauaucagauuacacuuuguuggcuugcugaucauuuuuuuuuaaaaaaccaucaaccauauggguagagguuggaaagaaagcuaaauuuggaacacacccccacucuucuguucagcauuucuuucuuguuugugcagggaggcaaugcauugcucauacucauguaccccaccaauacucacacucauguaccccaccagcuaauaaaacuaagaaaugggauucucccucccucaauguggucaaauaacuggcuguuuucuacauaugcaagcagcugcacguuuaaaauggccaggcucuguuccugcccauuucugaaucugccugagagacacacacugaaagacuaaauccauagugaaaagaagcccagggauuuugugacgguuaguucauaaguucaggaucauucguagucuacaucugagacacugccuucugagucagagauuuuuagacuggagagccaugacuuucucucucuaucccuuccuuucuggucugucuuuacuucucccccacaugucacuucaucuggaaugacagcuggagcaagaaagacaaacugggaagauggacaaugaugaugauuugggcaguggcuauggagucaugcagauuguauucuagcccuuucuaagucuaauuacagaaaccauaauuuagcuccagauugcuaaaagggaguuuggaaucagguuuaguuaaggaguaaaaguugguaugccuucccucaagaagaggcuaaaaccuucucaguauccagcuaagagucuaaaagauguccuccuugcuaucccuagauuccagggaggaaugaaugacagugaagcuaaacacuuuaaccuacccuuccuuaucuggcuccaaccaucucuagccccagcucccauuaaccccuaccccauccuauaguccagcuauucacaaaaaacccuaccccgcccuauaguccaguucucacaaaaggucauuuuagucauucaagccugucugggacuuuguaaaguccucuguaacacacauaaagcacuuaguccagugccuuuucuuugauagguuucaauaagaagugacuguuaauauucugaacaggccgaacucuuagaccauaauuauuuccccuucugagucuuuuaaacucacuucagaagcaccucucccuccugggaagcuucucccuaggcagagugcuuuguuaauauucuuccuggcagcuugaggucagguaacucccagggccuagcucauaauuagugcucaauuaggguccguuauauggcccugaccaugccaaaaaaaaaaaaaaaugggcacaauaccugcugguaucauaugguugggacugagggaagaaaagaaagcaacagaaaaggcguacacaccuagccaaaaaauuagacuguacuacuguuuaaguacuuaucauagcaugcacaguguguuguauaaacacagacagauacuacugugauuuccuggugaaagaguuuaagugugugugugugugugugugugugugugugugugugcacgcccgcaccuugaugaugagaagguggugagagaauacaagugauuagaaaaaaagcagugagcaaggcagugguggugcaugccuuuaaucccagcacucgggaggcagaggcaguuggauuucugaguucgaggccagccuggucuacagagugaguuccaggacagccagggcuacacagaaacccugucucggaaaaaaaaaaagaaaagaaaagaaaaggaaaggaaaggaaaggaaaggaaaggaaaggaaaggaaaggaaaggaaaagaaagaaagaaagaaagaaagaagaaagcacuggucaggauucaaaugggggggggaugaagauguaccaacaaggccuacuuauucagcuguggcaaaauagugaagaaggaauaggcaaggaaaaagucagugguccuacuuuggaagaugagcagacauccaaguuauucagcagagagaacaugaaggagguaaugcuggguuacguauaacacuaauagaccacagguuuuuagaauuuguaauacauuuauucauucagugagagagagagggagagggagagggagagggagagggagagggagagggagagggagagggagagggagagggagagagagagagagagagagagagagagagagagagagagagaauguagacauguggagaucagaagacaauuugcagaagucaguucucucuccuuccucucuguagguguaaccuggugguucucacccuuccuaaugcugggacacuuaaauacaguuccucuguuguggugaccccaaccauaacauuguuuuguuuuguugcuacuucacuacugucauuuugcuacuguuguaaguuaugauguaacuauuuuuagggauagaaauuuacccaaggguggcaacccagagguugagaacugcuuuucuaggaaaucgaacucaagucaucugguaagcaccuuuacacaaugagcuaucuugccagccuaguagcucacauuuuggaauacuuacugcaugauuuuaagcaacugauguaaaucagaccguuuuacucucucaacguggcuguagaguagaggcuauuauuauuucugucuugcagcugaaaguauacaaagaaguguagcauauugaaaaacaagcacaaucaaggacacaaaugggaacauuuuagaaaaagggaaacuaaaaaccaucucugcaucguuuaaauuaauauggauggagccaacuaggucaccagguacccaaccaugaagggguuuaucaguucaucucuaauguuuuagaaaccagaggauuuacaguucuuggaaaaggggcugcuucaaugugcaugaauccacccuaccauccacaucuguucuacuuccaaagacaaacacuaguaggacuagaauuaaaacaagucuauccaaaugaugaccuaaauggcuuccaaaugaagcuucagauauaaaauacauguccuacucugaaaagaaaaaggaauagagguugaggucuggcuagcuucccagcaucccauguuagcaaaguuauaaugaaaacaagucugcccugagaaacaaaugaaaagggcaagguuaggaaggguauugaauuaaaaaaaaauacaucacaugaagcucuguuguuuuuuccagugauuaaucuuuucuuauuucaauaauugugcuaugugcgucuguguauauaaauauuuaugcuugugccauuuguaaaacaacuucauauuuuccaaagcacuuucucuuggucauuugaauauuauaggagaccaauugcuuuaaggaccuggauguuccaguagcuaguugaaguguuguauuuucauguuaguuucccaucugguccucuuaacuagcugggcuauguugggauugcaguggcaaacacuugcaagagucagaugccacagucaggagagagcaaacauuuaugcccuauugcuugagccuggagguuguguucagggcugagcaccugggguuuuuuucccaccuuuaagccagguggaagauuaacuuacggcucugaaagcuucaugaucaauguaguugacuauaacucuaagcuucccucaaagcagcgcuuuucccugucugguaaaauuuucuauguuguaucuucauuuuaacuucucucaaaagauuuuccacuguccucucucuggauucuucuuugacucggauugugcuggguaauucucagauguuggugaauuugacaaacagucuucuguuacagauuccuaauuucuuucuucccauggugcuugguagaaucccuuguguuuguuguucuguucuuuacuuuucaguacugaggcuuaaacccagggccuugaggaugcuaggcaaacacaguaccagaaagcuacaucccugacccuuucuaagcuuucauuugagcuagaaucucgcuaaguuuucugaucuggacccuaucuuaggauccauuagccucagcuucccaaguaacuauaauuuagcuguguguugcuaugcuacaagcucuguagauaauauacuuuauuugcuauucauguuuuuacauuuauuguggcuguuuuauggcuacccagucuguuauagagaaaauucuauaugcauuuaacaaguauguaugaauuacuuuguacuagccugucuuguggcaagauuaauguaaacguguaaagugauuuuuuuccaguaucaacuucauauugaaaaucaagcuuucuuccauaucccuuuucuguggcuuuuagaaaggaacaugugaauugacaguagaccaacagaaaaaccucugcucgccauugcaacacccccagccuuugagaaccacauuggaagcacuuaacuauccacaugauacuucauuuucugucuuaacagaaauaaccuaccauucucaaaccuacugccaugugccuuaguacagaccacugauauaagcuggcacaaaagauagggauguuuaaauaucagagcauggcaguuuguuagcuugccacuaaaaucauagggacucagugugcuuuguuuuuguuguuuucuuuuguucuaaaacacuaguguugcuaggcuucuuggugacauacuagcucuauaaaauaccuauucagaacacugagcaaaguagcuaagcucaaauguacaaagcaccgugccugagcgugagugcuuugcuaaagucaacugugaugcuuaaacucucuguugauaucauucauggcauuuaaaaaaaaccagcugugccucaaaaauaaguucuggcauuaauuuccuauuuuaaauggcauucaguauugccuuuugucggagaaaccauucucacuuguagauuuauaagguaauacaaauacacaucaaagaaauaaaaauauuauggucaaccaauauguugguugguuuaaagacaaaaagaaagaaauaucuguucccuuuucaugcuucaaaauucuagugauacuuaugccauacacguguguaaauuuauaaagcuauacaauaaaaucacaguagguagguuuaagauucagacacaggagaacuauauuuucuaugauuuuuuuuuuuuuuaguucuuauauaaguacucuuaaaauucagcaaaaauauacccugccucuaaguaauacaauuggguacaguggcuauagcaauagaaaaauggccaaggaccagcaagaaauggugaaucacuuuaagcaauuggccaugggacuaaacaccgggcucucagaccuacgcuguguaucuaagucuacuuaguaaaucaagguagugaaggcacuggaucucaugcugagaaaagaggaagguccaagucaaaggccccugauucugcggcgaguuuggagaauggaugcuuuuaaggaaauuauuuuuuuuucaacucagaaugagucaucuccagaugugcccauuucaucucugauuuguuaauaccucuguuuuaaaauguucucuuccaauucaaauguguuaaggcugauguuucuagcguaaccaaaauuuguauaaucuagaaaugaauuccaucugcugauacucauuaugcaauauggaaauugcucuuaagagcuugcuguuuauaucuacagggacacuacauggauagguguuuauuaccacaugugucucacauuuaaccauaaaauagauaccaacauccauucagcacggagagauuuaaaaugcaacauuuaauugccaaauguuaguuuugcucacaaaaauagauggccuuucugguuagaggaaaacaaaaaagccacagaguggugcuuuaaggcaauuuuaagucaaguuguaccuuuacuucaguucaaauucccguggaccauaaugaggagaaaguggauucaggguuggagagauugcucacugguua

SEQ ID NO: 9492 - RNA, 44215 nt, Mus musculus
augcaaacaaaacacaauagaauauuucuuuauuuguaguaaucaacaugaugucccaaauaaaagaauucucuauuuuuuuuuuauuuucaaaacuuggaugcugacuuauaagaauuucaguaaacuuuguggauuuagugagggcagagcauagucucaagucugaagugagguuagcccuccacaacucacaaugcaagcaucccagucacaucuauuaauuuuccacauacauggagccaaauucugccugagauuauuaugcaauuuucaaaauggcuuuaagucuuucaacuuacaaaguuaccauuuacauugcacuggccugcuggcugcgauggaugaaugaacacucuuucccaaaggacuauaauucauccucugaucauagcuuauacaucugggagaauugggaucagugugccuggcgccuccccuucccucuggcccacaaaggacucauacagugcaagggaagaggagacaaaguggcugugugccaucuagcucagagguguggcacaagagguguugacugugagcagcaagcagccuaacauauaagcaacugucuacaugaugugauuucaggugcaccaaaaaaggccucauugccccucaguuuaaacacucccuucccacuggcggaugccuggaauuccagaguuuuuagagcucuguuccuuugguuuaaagcuuugaucccuguugaaauacuuauaccccugggugggcagcccccauuacauccuaucaaccagauacauugagauaggaugaguuugucagcuucuucccugacagcaaguucgagagugagguuaagagcagaagacacuguguaccugagagggauggaaaaaggagaacaacaccuggggggcaaaggaacugggcccaagacaaauaauguguguguguguggccaugugcauggcuguguaugcgcuccucccauggcggcagcuguugaacacccuuucuuaacccucucccagaaaucuugauuuaugcugcuuuuggagccauggaaccagacucuccucccugcuacagcaagauaauagcugcuggcuacagcugggaauucucgaauucuuucaaacuggaguccaggagcaaaaggugaagaaaaguucuucugggcaugcugggcuagauagccuuccccugggguccaaaggagaaaaggggguccagccaugcuaucuaaacacuuucaacugggucugagagcacagagccaugauuguccaaggcgaacgaacacucuuucaaucagcauguccuuuuguagccccacacugauuaccucucugcuucucuuacugaagaguucagaggaaucacugacaaaaacggagcacgaggaagggagcuugucucgaaugaggcgagacaguugcuucuguaaaagagaaaauagaauuuuugucaacacacacacacacacacacacacacacacacacguguuuucuguuuauuguuuuugagacaaggucucccugugucucucuggcugguccugaacauccaggcuuaaugcaugcuucuaccucagccuggggagggauggcuggcccuacacacacacucuaccuuucuuugcuaggaaauacaaccuuaauuauuacccaucucuguagcaugcaguagagaguuuacacauuaguaaaugaguuuccuuccuuccuguuuuccuuccuuuucuuguuuuucaggacaagacuuugugcaagcuaggcuuuaccacgugcuguaccgcaauucacauuccccagccucuggcuaaagauuauccggaguaaacuuuuucaacacugacugacuaagcaguggagauggcugccugugacauuucuggaaguguuucugacaaagaagccuaucccacaaaguccauuucagugccugaaauuccacugugagagucaucacuugggggauugggaagguuagaagccuuugagaggcacuuauaaaaauggaagcacuucuucugcuaggcaagguuguuuuuuuuuuuuuuuuuaacucuucccuuugcuuggcuaaaagcucugaaguaggugcuuggagugagagcagaaacuuccaggcuaaaaaauaguucuucaaacuucagagccagucugucucugacuuagcucaaacccuagggacccacggaccacccuauuugguucaauguauuuccuauuuccaauaccacuuaauguuaucuucaaacuaccucauauuuugcugaacuggauacuuagcuuuguuuugauaaagcuuaugaggggaaugcacucauuauauguacaguuuguaacccacugaaauaaaguucuugacaauaaacccaaguuuguggguccacugcauugaauccagggauccacacuucauuuuguaaacagugcuuuaguuuaugcauagcauguucuauauuaaaagcacagauugaaaaggaggcauagccacguuuuucccuagguauuucauacccaguaguugaaaacaacuguugccuuuguaguucguugcaugagcucuggaagaucaugaauuuaugggaggucaugucuuccucugcgaggucgugaaauucaaucaaugcuugccuuccaauuugcccuuuggucacagggcuccacagguggaacauaucaaacucaccagccaaauuaggacucuuaauugguguuucuuuuaaaguggcuaugucauuugucaaauguucaaugcaggcgcaggccuagccccaggcggaauuaugaaguagaagaaugccagauacauaggcagcacucaaauguuuguugaaaagugggggugacuaagcccucuguccuugacuccuucucacccaacccccauaggcacuggaucagcaugcacuuuuaauucuaucuucuaaauaucucugggacaguuuuccccuuucaaaacuccuuugucacaagccuuugucauuucuucugggcauuaauuucagggccucuuagcuggucuucuugcuuccaaucuuuugccuucuucaaaccauucucugaaacacuguugcggauaucuuuuaauaagacaaaucugaucaugucaccccuaugcucagaauuuccuuaagugguuccacagacuccucugcaggcuucuacacugcacaaucuggcccuugcuucgccucucccuccugccuuaguucuuuuaacuccucagccugaaaucauuacuugcaccuccuacucuccaaaugggccaugccagggccucucuucuuuguucaccccguuuccuugccagggcacccuucccccagucuuuucucaccucagccccuacugggcuuucaaguccgaguuuaggccaucagcauuucugggacacuuucucugaucccuccgcucagcccucagaacuccaucuucccucuuaacacauaauguguuaacauuucacuuuguuggcuccccauuagauuugaaacucucugaggucagguacuacagaauggguuucgugucucuguuuucucuuuguaucccacagagucaagcacauaguaagaauuccaauaaugguuauugaaugaacaaaugaagacuugaauaaauugcucaguugccuucauauugcuuucucuuucuucauagcccccuauucaagacacagccccccuccagcuguguuuaucuaugucuccaagcauacuucugucuaguuaaaaaaaagaacacaaucagacaacaagcuaguuuacaccgagauaucaaauucauuaauuguagaaauacugagcuccuacuacauacaagacacugggcuaaaguugucuacgugugcacaugaguggagucacaaagagaaccaaucugauggaaugauucaauuucuguagagcauagauaaugauuauaugcuuuuucuucucaaaggggcauuugauucucaaagaaaugucuuuccauuggugagaauuaaguagaagaaacguggauugacauccaggaaaucuucuaaauagggcucuacuccagguaugaaacagacuaaccaugacuuaaugaauuucaucuguaaaaugauuuccugaaugaguuacucucaccagcuacacuuugcuuuaugagggucgcccgugauuauccuguagaugauaugauucaccuaggaaucaggaucaagugccuaaauucacacacacacacacacacacacacacacacacacacacacacacacacaugcacacauuuacuuugugugguucuauugaaugagacccagcaagcuacacgggcuuccagaccuuuuagguacaaagaugagccaggcugugaaauccagagguccccagcgcucuggaacgugacuauuuguggguaggcuuugagggcuuggccacagcugcauugggaaaggguucccaagaaaccuuucucagaaaacagcaaggagagggauuuugugcuuaggaaaccuugugugggcucugguggccagaaggagccagaucugggugggagaaggccuagggucgagucggguguguguguguguguguguguguguguguguguguguguguaccuaaaccgcagaccuccacuccacuccaaggaagauggagagcuugcaaaggcugaaaaggaaaagcccucccggcuguaggccaaagggaggcggaaaggaggagugaggcuggggaacuucucccagagccagucagaggggacugcugcugggaagccaaucagcgugccugagccugcagccccucugcaguaguuaugccagagcgcccaguguagagcagcggcgagcgagugucagggcaggauugccgggagccaccgcacacgcuccuuauccucuucccgcgccucucccaccaaggcuugcccgccaccuugguaaacccaaucucccagcuaagcuccuugccacgccccgcaucccgcaggccagcagcuacacgaccccacgccguccuccaggcagcgcggcucgccuugccucgccccgccccgucccuccucgccacgcccacaaggcuccgccccgggccgccccgcaccgccaagcuguucccgcccucgcccagcgcccagguagcugcgaggaaacuuuugcggcggcuggguagcggcuccucucuugcucugucgggcuacugccagacuugcugagucucgggaccgcuccggcucuuauugccacucucucgugcucuccucgcucccccaagaagcaggauggccgggaccgugcgcaccgcgugcuugcugguggcgaugcugcuaggcuugggcugccugggacaggcgcagcccccgccgccuccagacgccaccugucaccagguccguucuuucuuccagagacugcagcccggacucaaauggguuccagaaaccccuguaccaggugaguaggggucccuugagcauuccccgcgcacaguggaaagccaaggcgcgcgugguggcucuucccagagcgcgcuagccugguggggccgcagcggccgugcucucugcugcaggauaccugggaaugguugcugugccuggggccuggaccaucuaccaagggagggaagcacaguaugggacucuguccacaugccccgggcucacgcugcugucaggaacugugcaagccagagcgaggaacagcagagaucgccuuucuagcgcccauuuuuuuugggggggggagggcgggaaggugggagcuggcuccccucugcucuuagcaaaccggcuucacaacgugaagacugugacucgggaauuuaucucccuuacuagcacgucugccuuagcuggacccguaguucuggccacacuuuauccaccguguguccccccaugcuuuccguuccccagucuggguucccgaggcuggccgggcccaagugcaggcaaaguugagcacaaaucuuugaauccucagaggcuagagaagacacagugaaggaaacuuuugaguaggaggguccuccaaaacgugcaagacugagccuuucccuucaaaacagcuucccuuaucuagguuggcaaaucucuuuaaaaaucggcggugcuuggccuacggagcacgaauccaaaaaggauuugacuccucccccgcccaaauucaucugccuugacaggcuggaccccgaagaggagaagauuuuaggcagaggaaaguuucagagcgccugccuuuuguucugcacaaucagaucauuuuguaggggcauauuuuaaccuuagcucagggcugccgcugucaacagaugaauauuaauugccuugugugauugacuguccagcgguugggcgcuuaacgccugccuuagaauccaaucagggcaaguugcuauacuaacaauacgugcaggaagaauggguuucgaaaagauuaauuuuucagaggugcgcuuggaagaaagcagccagccguauuugcacacagacguuuguggcuuccaggcucuccuuccgaagacucgugcauccagcuaggcgcucaucccgcgcuugggagacauugggaacaagccucgccacaacuuggcugguggcucucaacaagucagggaggcgggccggaucguuggaccaaguugugaaugcguaugcgcgccuugugggcgcugccagggagcguucacuggcaggagguuaccuaggcagccagcgcgcccucagccuuuucuuuagguugaugaaaagaggcuagugagccugcuguuuaguugcaaagguaauuggucacccuuuuuuggugacugaaaugcacuugcgcauauguuaaauauugccuugcaggauaucgcucuaagggaggguagaacuaccucuuccacuguuaagucuuaauaacguaccacgugggcgugugcaagagcuguaaggggcaaccuaugaaucaguucugcagagcugaaacaacgggcgaaucucucuccccuggaagugccaugguaauuagauugcuaaggcuagagaacacgcuuuuguugauaauauaaaaauugguccuuacaggcugagcccccacaagaugaauugguccaggguugggguugggcaguauuuggcugaugcaaagggaaguaaaauggugcuuaaagaaggggguaccgagaaaaguucaucuagauaguuauuagcaauccucuuacacacacacacacacacacacacacacacacacacacacacacagagagagagagagagagggagagagagagagagagaggcgcgcguuagcuugcuagucucucuccuucccccagcucucuggcugccugccucuuugcuacaucuguauaaaaguauugggaaggcccacacacugugucuaugagaguuggcuagggcuuguuuccugccucgcgugcuuccagccuaagaaugaucauacuuauagagagacuuauuugucuuagagaauuuuuccuguauuauuucucaaacucuaggaggaagcacuuuucuauuuguuuccauauaaacccagcacaauucauuaaaaaaaaauuaaguugugccccgcaccuuuagauggcaaacauggaaaacaagucccaaauucaaauaucgugauaaccauccagcuaccauguacuguggcagcacaggccuggaccaaacccauuuguccugaauuuuagucggcuaacgauggacgauguagguauagaaaauaugguaaagauccuaauguucaugugcacaaggagcucaucagaguuucagagaagagaugguaauggcagaccgaauacaauggcaagugcauaauuucaaagcgaauaaauguguaauuugcugcuguuucucacugguuagaaauugaaagagagcugcaaauuauuugauaguuaugaaccaucgcgaugaccgcuugacucccccucccgcaucgccaucuacagcuuaagccauguucaguuugucugcuacacuguguuaacugcauuaaugcuuucuuugucccagauaaaaugagauucgguccccacucaggaaauauccucaagaauguccuguuucacguaaggggcgcauuugggauugacugcuaacuuuggccauuagcagaauuggguuagcgugaauaagguacauuucuuaugcuaauauggaugagacuaauggcauuugaaaucagccagccuaaaaaauaaaucacugguuugcugaaggacuaccccagacuucuacaaagcugaucuaaacccuuccaaucgcauguuucauuucuuuuagaguguucaaaggcacuggacagccauuccaaauagcauguuccccaaauccaugaaucucuucagaccccacuuuuuuuuuuaaaaggauuuguaacuuggaaagcacuacagauggaaaccaggcacacagaguuagcauuuggcagggaaauccauauaacugacuuucaguacagcucuuuugcccuuauuuaauuuagaaaaauucagaaaaaagccaaugagcucauaagucuagauguuuauuuuguuuugcuuaaccuacccacaggcgcaaucaagaauggauacaauuuuaggcaagggaagugagcuaguaaucagacaaugauguuuccaauugucucaagggaauguuacagaagucugaaaaaaaauuccucuaaacaaaaaucaaguguaauucacuuuaugaaugccauacaccacuuuugugggggguggaaguugcaggggucggaugggaaugagaaaaaucaaacaaaccaugguaguguuacaacuccccuaagauggagagaucuugucuuggagagggccuuggaaagcacuagaauggaugcagaaggcugaaugcaccuauguguaaaaggcagccuccaaggaccaaaaucacucgcaguugcuggaaauugaugaaagaaaaaaaaauuccaaaggaaaauucuugaaacaaagaguuuguuuuuaaaugugaguguguuugugugugugugagugugcaugcacucugaaaacuagcaaaccuaucuguguugccagcuguggguccccaauuauuuugaaacaacuaaguccaaauguugggagagacaaugagaaccgagguaugggagaauuuuuuuucucuccucugagauuucacuagacauuuagaagagcaggugauuugucaaaacuuuucaaaaguuguacuguccugugcuaacuuugaggaguuuggaaaauucuuuuagaugugcucugaauguauuuagugcauaaauccuuacugagaaguuauuuagaaggagccaucauucugauggagauggcggaugauugguggggcuccuuggcaggcuugcuuuaggugcugggggugccgagaggaguaagaugcaguccccuuugucaaggagcuugcaguagagugggggagcacacgaguaaacaagcuucccaggaaacuuguaggauuaaagagggugaaagaggcuagaaaagaccuccaggaaauuggcuggaauggucacaauaggcagccugggcaagggaaaagaacagaagagaugaagugggagauagggagaagucucuuaauagagccuccaucuuaaaaagacacagaagaagguuuugauggaugcuagaugacacagauggugucaguuuugcaauguguuuuuuuuuuuccuuaugggcugguagauuguauccaauauuuugaugcaauauuuuugagcauucuguugcuuccaucuuuagaguugcaauguuugcuguucacuguagccuaggaaaagacugcuuauuaccaaccugggagaagaguccuggauuuuucuccuaugagacaagacagaaaauauguuuucucuuuacauggcagcuaucaaugaccaugccaacuuuaguguuugaugccuauacaaaagcaugggucuuaagaaggauuuuauuacucauuucuaagaaaauugaagauaaucacuuauaacuugugcacacgauacaucauuuggaaagaauuucacuggggaucauguugcucaacugaaaaguuuuggcgugcugaauuuguacauuuuuugugaaugcuuccuuuuacucugaucucuagcuuuuuuucugcauaugguuauuuguauguuuuagauuauaagcuucuuaaagggaaagcucuuugagcaguguugagcacagugcuaauagugccaugcggcauuuggcugauaauuaacaagaaagaauuucuagaucaguaaguauuuuauaugaacuuucgaauacuuucucaagcuuauuuuaaaagcuuaagcccaaugcuauggcacacucuuaggguguguagauaaacuuuguagucuuuauguauuuuggcuguagacagauccaggcuuauuucaguuaucugcugacucuuaauaacugguagggcuuauuaauauugaauacccaaagaacaaauugaagucagcagcauuguuaugccuggauuaguauaguuaaagaucaacaauuauuauagcacauaaaucaaaggaccucuccuaaaucaaguccuguuugauuuaaugucaaguagacguuuuucuaauguugguguugccauauuuggaagucaagcuaggagacaugcacagaucuguuguaguaccucauggguuuuuguaaccugggaucagaauuccuguacaggcucaacucaagagacuguuccaacagccaacaucuguugaacccuagccaaucuuguaaauggguuugauguauuugguaagcuaggcuauaaccggaaguaugggcaaaaaaaucccguaauuauuugcccauauuuagcagcaugucugaccugaaacaggaucucuagcacuccauuaagaaaugaacaucagaguuggagaaauggcucaguagauuagaguacuggcugcucuuccagagguccugaguucaauuuccagcaaccacaugguggcucccgaccaucuauaaugugaucugaugcccucuucugguguguguaagcacucauacaacaaacaaacaaacacaucuuuuaaaaagagaaaugaauaucagaaaaucgaauccaagccaugguuccccagauuggcuuuagacagcguuaagugagugggaauuuaccucuugagcuaugauggcagagagaacaugauucagaaagcagugcaacaauggccauaucagcagagaaaaugcauuuugaaauucugugugugaguggcgaggcacccacuggaacaucucaggcccaugcagagaccuuuuugaauaaacaaggaaagaagcuuuacuccucuacuuuaaauuaggacaauuaaauauuauauacacacaugcuaauuaucaaaauucuugucauuuaaaaaccaccacuacccccacgaacaaacauaaacccaaagugguuacaaagaaagacauuuuucacuuuggcuucucuuugugugaagauugucgaagccacauuugagaauuugcaucucuaguguucugaacaguuaauuacuucuaggagcugaaauuguauuuauaugccagauuaggaaaucuacucagcucuuugaagugugcuuaauaggcuuauauugauaaauaauugauaagaaaggagauaaaauauaggugaaaauggcgauaagaggggacagggaagucaaagccauuauaaaagaaacuucuauccauugcaugcauucaugcacuguaagaugaaaacuguucauuuuucaacaaaggcuagaguacuuaaaucuauuuuuuuuuaaguuuccacaaugaagcacguuuuguuauaaacugagaagguggcacaguuuuagggcaaaacuuucauugauccuuugaagucuuccuuuugaaaauaacuugaaauccugguuacaguaaccacaagguacaguuucacaguuauuccuaucacaagccugguaucucccuuagguuagggauaauaugguauucauuuuuuaugucuacauuuagugugaacaauagguacuaguauguauuuacugaccaaaugaaugcagauagaauguacuagaaacauacaauuucaauaaaguuaauauuuaggaguugauuuaauuuuacugggauuuuaaaaaaggagucaccuuuucagguuaaaaaaaauccaucuguuaccuauagguaaguaaaaagaguauugcuuuaauucaguugcuugugccuucauucccuggaagaaguagacuauccaagucuuacaagagggguaaguauuuuguucuuguuuccaaggcaauucuaaguaauuuaaagguaagguuauacacaucgaaacauucaugcauuuucuuuacuauauagaucuuuugaauuuugguuuaugacaauauugcucccaaguuucaguaaagaugugcaguucccuagcugcugcucaacauaccacuuucuuauagcauacucauuaagcuguccuuccuaaagcaaacugauuggaaccaagcuccuccucaguguuuacaauuucuuacuuaugccacuaagauugauguuguguuuaaaaggacauauuccgaaauauguuugcaggacaagaaauuuuauaugguaggauaaaauaauuugcauaguuccuuuuuuuaauuccaguucuguccccucuccaaccacugcuuauuuaguauugauaacuauguuuuaggaaauccugagacucuccauugcucuuuacaaaccuggcuuugccuaagugaagcugaagggaaaguggugaagggguagaguuagaaugacagacguggggaggacauuaagagcucacauucugguacauaacagaauauuaacuagcauagaacagacagagaggacuggcaaacaucucaacauggacuuuugcaaguccaugcauucagggauaauacagagagacaacugcaccacaagugcauuuguugcccagaauauuuuacccguacgucuugcuuugcauccaugauuuuaaaauauauagggaagucacaaccucauccaaaccuauuguucacugaaugcaagagccauauuugaauccugaucuccucuagacuggugaguacagugacuuguacagaaugaugauuauaauuuauuacauaguuaaccaacauuugaagagggauucuuaaggacuugacuauuguccagugaaagcuugggaugacauguaacuaggagaugcuucccugagugcuugguucucuaaacugguuugcagcagagaaugaagaaaggaugguggaguugaaacacuggcccugggaguccuguuggccuaagaagauugaagaggaggugacacagagauuuucuuaugguguuauuuaaauggugguauuugaauauguauaugcauauauauucauacauuacacacuuauauccauacaguauuauuuugauagucacaguuaauuacacauauuguuucagcucaaauuuguuguuacucuuaacaguggguagacuuucacagucacaguuuauauuugugauuugaaagcugugcuuuaauauuugucucugcagcacaguuacucauaaagugucugccgcuucucaguuccagggaugggccugguuccaacaugcauguacgugcaugugugucgaguguauucugcauacacacagauaauacagcuacaacacaagcaggguguguccaaucuguugcuugugggucacacacaccuauggccuaguuuagcuaugaauacagcucaacacaaaauuguaaaauuauucaaaaucauuaugagauuucuuuuucauaacuugauuguuugaaucuugagcaugaauucuguaaaugaugacauuuugucaaaacauccaaagguuggagaugucugauggagggugagccuaacucucaguggaaagaacuaaaggauacagcauuccacugaacuagggaaauauguuuuacauacguuggcuccaaauugcugcuguacugguugccacugauauaagagaccuacugcuuaguuaucagguuucaucauuuccccaaguguggagauguaauucucauuaaguaacuacagucagcccauacuaugacccuggaccauucuggaggaccgcuucuaguauuuuaaguauuaagcggguaguauuuuaagugaauggggcgccaaaggcacuuuccaaucucgauuucugaaacaauuaauauauaaaaaagugcuguugugugaggcaugagagaaguaaaggcuuaugacaaaaugaagggcuggagaguuagcucauugggccaagugcuugcccugcaagugugagggccuaaguucaaauccucaggacccauguaaagccagcauaauaacaugcagacucaauuccagcacuccuauggcaacauaggagauaacccugguagcccaagggccaacuagcuuggagcuguugacaacaaagguacugucucaaaccaagguggaagaaaagaaauggcaccugaggcuguccucuacuacacacaagccuuuacucacacuugcuaggugugcuugauggcuuggguucaaucccuggaacccaaagaaagauaggccagaaccaaaugcacaaagcaugucuuccagccguggccuaugucacauguucacacccauuuaucauggacccacacaucauagugaagugggagaggcuacauauguaggauguaucaguauauggaugguaauugaaguccugggagcuuaccaggaaaguguggaguguggaugaagcauaguugagacucaucaguauauaggcucaagugguucuauggguguggaugguauuuuccaggccucuucauuggacaugucuuaaaauauauuuugccaacaucuggugauauuuuaaaaacccagcaaaucuuucaagagcuuucuggauuaagaggaaguaugagucuauguugucauagucuaagcuagaagguaccaaacacccaaauguacauacacauggagaggggaagaggguuagacugaucgagagagagggaggaauauauaucuuuaucucucucuaucauuuaucuaucuaucuaucuaucuaucuaucuaucuaucuaucuaucuaucuaaucuuucacaaccccacuuugccauuugaaagccuuguuuccauuuaucucaucaaacaccuucuuucauuccaauaucguggcauuuugcuccuccccaaguggggacgccacuacucuauaagaugaaaguuguuacacuguuuuugggagaucuggcugagauugcaugcaggcuagccucugagacaugugguucuaagcaaagucuaguaauacuuguaaaacuagggugaucuuucuuucuuucuuucuuucuuucuuucuuucuuucuuucuuucuuucuuuaagauuuguuuaugucuaugaguacacuguugcugucuucaugcacaccagaagagggcaucagaucccauuacagaugcuugugagccaccaugugguugcugggaauuaggaccucuggaagagcaguuaguguucuuaagugucuucagaguuuuguuucugggugaggaaaaagugaggugucuuuaaugucucuauuguuuaacagguugccuucaccaggguuucuauuuucauuuuuaaagauugcuauuuuauuaauucguccaauuauaugucugcacguguuauguaugcgcuugcccucacaugccacaagagggcguccagacugucuggagcugaaauuacaggcaccaugagccaccugaugggggugcugggaauugaacucuaguaccagacaaaaacaccagguucucuuaacuaugccuaguucuacuuucuuuuaacacauacuugaaaacuccuuuguuucuaguagauuggggggggguguaucauuuuuagguugguuggauaguucccccauaugggacuauuguagaaacuaccuacccaguacuuacuguaugccacuugcaaucuggguaauuaaucacaauauauaaagccaaccugaaaaggagguggugcaugcccauuuuauaguuggaaaaacugagacccagaaagguuuacuuucccaccguuuguguaaaugguggcagcaggacugaaaucuagauuuguuuuacuccaugucuaauguucuuuccacuguaucccuauccuuuggaccgugaggaaaauaauauaauguccauggaaaucuuuggucugaauugucauguuccuuugucuuuugagauacuguacauucuaggucuucuacuugauucugccuuugcuuguccagucuguucaugguaaccuuugucagaugugggugcucagugccauguguccucugugcuucuccauugucuuugcuuacucauguaccuagucccauggcuuggcuaucauguuucaaugguuucuacaucuuuuaaucugccaucuccuuaacuguccaauucagaaucucacaauugccugcuaaauaucuccaucaggaaguccuuagugcuucaccuaugacagagccaaaacuuacucgccccaucacuuucauuuccuauuuccacuaaccucuucauaaacuucuacauuucuggugauggcuuuccuuuuugaugcaaagacuugaaaccuugacaucaucuuuaauuucucacacccuuugucauaccauguaugcccucuauuuguagaaacuggauucugaaccauuacugaaacacugcugcaguugucuguuggcuaaaucuuauagaccccuccccugucuacccaucaucgcugcacaauguggucuuaucuaaccuuguuuuuuuaugaacaaccccccccccgcccgagauguaauuguuccuuguuaguaccacgcuaucuucuaacuggauuaaaaucugcacucucagcaaggucucccagugauuuguauguguguuaaaaguuugagaaaagcuuccaagugcaaguuagaugagggucagaacugugcaguacuuguuagaaacauacauuaacaucuuaaacauaaauuaacauccuugucauuuuucacaucugugcuuugcccauucauucacugaaguggccuuggggaccuauaaauaagguauacaugacggagcggggaaagaagaguggaggaaggagagaggaauggggaugaccgauaagaggagagggaaugaaggaaggagaggagggagaaaggcuaaaggauaaaugaugaugggguaaugaacuagccauagagagaaguggggagagccaaacuugcaggagcaucucugaguagcugguaacuuugugacuacuuugggaaacaccuccuucaugguaaaagugcuguagccagggacaaauaucuccacucaugauauugcuucucuagggggauggaaugggugaaugguuucuuagggggauggaaugggugaaugguuucuugcuuuuucuuuugcuggcuuucugaggucuaucuuuucuggucauuuccauaagucacuguacaacuugaaaggucucaaagagucauggaggacugcauucaguguuuccaacagacccuucuauuuucagaaacaguucugcuuuguuuucaagcaucaguuuauuucugaaauaaagguuuauuuuccccacuguauucugaaggguuucuacaaauguuaauuucucaaguuuaagucacuucuugccuuugaaauuucagugcugugggucaauuuaauaacguuaacuaaaguggguuuuuuuuuggggggggguggugggacacuucaaaagccgccagauugguguuucuuuguucuuugaggaaguaaguuugccucauucacaaaaccugaaggugacagacucuggaauccagucauuuagagucuuccuucaacagcauccaguuuuauuuucaaguuugguccuaauagcacugacuaccaacugucacucagggguaaaauuccugaaaaucucaccaacacuucauagaucugugcuaaugagcagcccaaguuacuuagcuaacaccccauggcuaagggagacaagggacuuuacacaccuccagaucauaagggcccuccuucaucugucuccauuccucugcuucccuuccauccucacauccucccucaacggcuuauaauuuaaaacagaagguguuuuaugguuugcuauauuuauugaaugguuuuguguuucuuguucuccuaaaaaagagcugaguauaauguuuuguauuuuccucugcguuuuuguuuuaaauuguauuuccuuuuccuauagugauuuuucucccuccucucucccucucuuuguguccucugccuccuucucaucugccuuugcccagagauucugccccaucacugggcacuggguaccugguuacuuacuucucuugggauauugugaaauucuguuccuuauuuaguuuggaagugaagcacucuaaaaugucccucuuucuaagaauugugaguauuuaaaaugcuuuuuguauagacagaacaagguuauggauauuugacaaguagcucaugacuuaguguauacuugacauuaucucuaacuuuaucauaauccucagugaaggugguuugcaucuuuguuccugggacucccucuuucagggcuggagagauggcucacugguuaagaacccccccccccacacacacauacacaaugccuuuucuuuuucucuaaagauaagggagcccccuugaaauccugcuaacaucuguuggaacuaacaccuaucuuguagguuaaccaaauuacagucugcuucucucugaugaccucaccacauuucagggacccuguuuuacuugugggguuccauuguuccagucucaacccucacuucagguuugagauuuuguuccaacccgacugcucagugauucuguuucuuugucuuuauacuuaugggcaucuuuuguaugucuugugucuauuaucucuuccaagcuuggccaagguuaugaggugaugcacuauauguauaaauauuuaauaagauaaguuagacaaaaugugcuugaagaaauuuccgucuuucuccugucccccuccccacagcuugcagcuagcuuggucucucucucucucucucucucucucucucucucucucucucucucucucucucucucuuucuguauguguguguguagagucaacaacaguugcuuuaucucagauguuuagauuuggagaacauuccuuugcacuuugcuugauggacacaguggaaugcaagcuuucgagucaaccaggaccaucaaaaugcuagcgccaugucacagauaacauuagucucuuguccuauuuuuuuucuaacugguucccuaaauuccccuaagccagaagguuugagguaugagauuguguguuuuuaaagaaaauauuauggauaaagacuaauguucucaaggcaggaagaacaauuaguaccauucauuaaucagggaccauguuuugacucuggguccuggcuaggaaauauaaacugugaaagucacacauauauaugaaccucaggcaaauuuaugacuugucagccuuuuaagguuaaauucuuaaccccaaaucagggcuggcuuuauauguggacucuagcacauuccucugggccacugagcccgccccuccccagcccuuugcuuaacagcagcucuaggccuaaugagcaagaaggauuucugucucuuaucagcugccuaaagagcaacauuaagacugauguacagaguuuaggucaaaacuugaauucuugaacugaaaaacuacaaggucaguuaaaagcccccagaauugcgguaucucuuuagucaucaauaccugucaaguaaagcaggcagacacuugaguucaaacaaauaguaauaguugccaaagccaugaacagucuaauuaaguuuccuaauaguuccuuccuucuuuguuuaguucuucuauaaauagccuuccuauauucuuuaaugagcuuucagugugugccuggagguuguuauggucaugugggaguuuuugauugucagauggugaagaugaugaagguaagaauauuuauaauuuuggcucagauuuuuagaagggccugccagaggaaggcaaguagacaccuacuacuuacugccuuuguuucuuucugaaauggauuuuugaauggcugugaagucaacuugcuaugaaaucagagaagucuuugugccuccucauauuguacucacauuugaaaaaggagagaaaguuccugguucugaaaucugcuuggaauccaggcucagacucacacagaauaacuauuuuaggauauucacuacacaucauagugacuuucaucuucuguguuugcauuuuuuucagauacaauaaugaaaacauuuuuuuuagauuccguuuuguuauugaaaauccuauuuacauaaacaggcauuguuguggcuuagagaagaauguggggucccauucuuuagcuccuuguauaucuuugcuaaggcuugucuaaauagaaguaaugauguuuuagucuaagcagcuuuucucauuuagguaagcagggugguuugaaaucucaguuuacuagauaauugagucucuucuuaauuauuucaggcaugcagguugcucucuuuauaguaaagacccuaaaaaucuaguaaucuccucaggcauccauuugguaauaaaaucuagugcguuuucagggguuaauuuucauuacaauugcauguuguuucccuacccccaugcuggaacaaauucugcuaucuuuuagaguccaguuuccucacacugcaaaaucacacuuaaaaaaaaacaucuaagaguccuacuggaaacacuaagucuagaggaaauuuaaauggauucauauucaugcucauuacacaacuuucauuuagaguuuuuaauagccuugucauauuucuugaaaaaucauauggccgacuuugccagauuuggguuucugcuuugaaugaggaaaaaaagauugagaacuaaagugaagccuaaguauccuuaauuuguccauuucacacacacacacacacacacacacacacacacacacacacacauaaauaaaauaaaauaaaauaaaauaaaauaaaauaaaauaaaauaaaauaaaauaccaaagcucccaauccagucacccagccuaaaucccucagaagucaucuggugcauagcuagguggggaaaaguuugaaaaaaacagagaaagaaagaaagagagaaagagagaaagagagaaagagagaaagagagaaagaaagaaagaaagaaagaaagaaagaaagaaagaaagaagaaaagaaaagacccaggucucuuucacaucugcuagucauucaacuggugugacuucaauucagcaaguuuuuauuggacaccugugguggggguggugcuaauaaucauuaacauuuauugagccaggcacugugcuaagccuuuuaugggcagcaucucacuuaauccucccaacagcacuaccaggugguacaucuuuucccuccauuucacagaugaggaaaccaaggguuagagaggguuagcuccuugucuuugaucaaguaggagcacaaugaaguaaauccagugcucuuuuacuccagaaucccaucccugccuuuauugucauugucaugauagguugagcauuuuuagaaaacucauuuugaaaacugaauaugucugagaugcuaaggauucgaugucaaauacucuauuaucccugcuuuugacagggaaaggagauguauagauagaugcagcucucuuccuguugaaggaaaggagugcauagaaagaccaguggcuggaacucuuggaauguugccuucugaauacacucuuguagccuagggccauaggcaucucuuuccugcuuagugaaagugguucuuccccaggugccaaccucuuuccaucugugccucagcccacucaagccuuagcuaucuugaaaccaucacuccuuagauaugcaugguugggggcguugccccuaucuuuuccaugucacucucucuccuuuauuuccaauuucauugcaagcaaggcuaaaauuaaauaagacagauuauuccugaaccagaucacuguaucucaagagcuggaggcaaguccuaagaguggcaauccgagggagacuguggguccagacaaguguauucaacuagaucuggacucccaagagcucuauuucugacucacccacaguuugauaagagagucaacuucccacugggauaauuuuugagauuuucaguaaaauuauggcaauggaaaggaaaagccccaaguucccuguauggauaauuuauuuuguuuucauaguuucuaaagaaagcaauaaagaaaaaagaaaagacucuuacacuuuccucaguuuuagaaaauauuugguucaggcgaaaaugaauucaguucucucucucucucucucucucucucucucucucucucucucucucucucacuuuuccucucccccacuuccccccucucucuaugugugugugugugugcguguuugugugcuugaaaccauauucuuuggcuucagaucucagcuuaccaaaacccaugucucuagucuucuuguagucagucggcaauguuuuccuugucaacuccuuucuccaacacuuucuccucuaucaaaucucuuccauacaaaggggauaucaccagguuugcacuucaguaaaaugccugagggugaccaacuggugagaauuuugauuccuauuacuugggugaguguggggagguagaaacgauuuccauccccgcccuuuagguucuuaaguucuagcacaacacugugguggagacugauaacauuacuggagcauuuacccaguuauuccccaagauggcauaaacaccacagcacuggagcacgcacacccagucauucagauaaguugaaagaugagaaaaaugaaugauugauagcagcacuucucgcauaggguuagagagaccauuuggguuucuuuugguugcugucuucuuagaugcagugugugugcugcacuaacaaggcaaccgacuccccccaccccacccccacuucccacagucucuauccuagggaaagacgaaagauauaauagaggccgcagauuauuuacaguggcugagaauguaauuacaaggugcaauggcuugaaacugaaauguagguuagccauuagagcugggaaaagcaucuucacgguaaggacaauugggcauuggaaagauuugccagcgagcugguuaaauagcaucuccagaaaugcuaaggaguagggcagggggaugugaagaaaaauccaaauucaguguugggcucagguccagacucaugggcagcuuucauuacugcccagcuucccuucugauuauuuaauugcuaaucucuugaaagagauuuuuuccauguauccaaaacaagccuaauuuguuaagcacuagauaacaaaugccuuugagcacugagaaggaggcauugggauuggucccaacagccuccuauuggacuuucuggaauaugggccaacaacugaggcaguguuguuguuuuuauuauuucacuuacgcagggcuucuaaauccuuauauuauguaaguauugcaguuaaaggacaauuuguguuauacuaguauuauuuaucuugggggugaccucaaacaaaauuuggguuugguccauguuccauuuucaucuuuuacuuggucuuuacuuucuuuguuguugauuaaugcauccccuuuccugucccuuauauccuccgucucccuaccuccuggucuaugcuggaggagguucuuaagcagcaaggucauauucuggaguguugcauaucaggacagcacuugaaaugaauggcagaacacccucaggaugaaacauuuagacaacauuagguugacauuuuccuuuaggugagguagaaggggagauggcauauguguccuagggcugccacaacauguugccuucaauuugauggccgaaaacaaugggcccuguucccccaaaccugacaguucuggagaucagaaauccaaaggaaggcuauuaggcagcauugccuuucuaaagacucugggggaggauuuuuuucuuugcccuuuugagcuuccaguggcuccuuuucuguggcuauaucccucccaccucugccuccgucuucacauguccuucucuuaucaugugccuuuacaaagaugccuguuauuggauuuagacuccaccaagauaauccagaauaaccccaucuccagauucuuaauuauaucuuugaagacccaccccccuuuuuuuuucuccaaauaaggucacaaugacaaguuccaggagcuggacauagacauaucuuuuuaagaaauaacacucaacaaucuguagaugugggcuuucuaggcccucuugaaucacaucaucguaugggcuccugauacucaaagggaauuuguucaaggaauguuuaaaguagguugucagaugucaggguuuucccaagugggaugugcauaguaccugcuguuaacccauuuuuuuucacaugauuaaacugaggacauggggagucaaaaagucauuuuggaucaaaagaaaagaguuuugaagcacaauaggcuaccauguuauucagcauagauuuuugucuuaugacuuuggauuuuuuccuugaaaaagucuauuuucuuuccuaaacacuuuagccacaggaaagcaauuacugcuuauuaccaaccugaaaagccuuuucacaggaucugcgggaucaaggugauggugcacuuuuggugugcugcagcuucccaccucuuugugauuugcugcaauacuagcaacagggagauuuguaagccagaaacaucugugaaacaaaagacugccuuuuuagguacaggcucaaaauacagacauggccugcauacacagcgguuaauauaguuugugcagaugagcguuccacuguagaaacaguuucauauuuguuaugacaaagggacaaguugaaacauuccuggcuuaggaauacauacauacaucuauuuuucuucugaugggggaaaacuuagguguguaauaugacgaggaaguauagagagaucaccagaaugucaccuacugcagaguugcuucagugaucucugauaugacuauucaaauuguguuuggaugcuucaagagacaggagucccauuguugacuguucccaaguccaauagucagcauuuguaugaaccauagaccaggcuccuuuccauugcuuugcaacaaucccguuggcaaaauucugucuccaaaaauauuugcauuauaauccuuaacaguagcaaaauuacaguuaugaaguagcaacaaaaacaauuuuguggcuggaggucaccaccacaugaagaacuguauuaaagggucacagcauuuggagguuugagaacaacugcucuagaccaugacaagaaaugcagacaucgucaagauaaaguucuggcccauggacuugcacagcucauagcaggaauaagacaagaacaucaaugugugcagagcuuuucagcuugcaaaauauacuaucagauagacgcaaaguguauugaaacaaaucagagcuaucauaccuccuaggguuuauuuggagggaagggaaacauuuuaugaaagauguacaugagggagacuugguggauaaacuuuuaauagcugaaacagaggggguaacaaccaaagaaccaaaaugagcaacaugaggaagcagggcaugcauggagacauccauuuuggaaaucuuaaagacaaggcuauaacacaacagccacuggccacuaaagagccuugcaugggaccuugagcaggucacuucgucucuaaagcucagaugcaugccauccucuaaggaagcugacugucaggagauggcuucuggaaauacagauccuuaguccuugcaagcaaguugacauggagcuguugccuaccuuuuagaaaagauaaaaaucugggguuuagagaauggagaauauaaucugcugcuucuuuuuguguccucucaguaccccaucuugugcaguuagugaacacuggcuauucugugcuugcaaaauaucagcucucaaggccagacccuuagagaaaaaccaggcccagguuuguaaaggcaacuugccuaacucacagcucauuuugcaacagagcagaugauaacacuugaucccugaugugaaagacucucuuccccaacggugugaucucauugugauuucauagagaaggaagagcugagcccuuagguuuagacuaggauauugaaauucucugcuaucacucuggcucacgugcuugaagauugcaucucaaaaauuaaaaagaaaaauuauccaucuuuugaaagacaggaucucaaauacuuaccuguguaguauaauaauuagggagucacuaggggagacggugaaauuaccuuagcuaaauuccucuggaagaaaucuaaacuaaaagaauauucugcauucaacuccagagugacugccacaguucuucaguccaacucuagcuucauucuccaauucaauuuucauuacauuaagggcuuugcuaccauuuacauagccauggauguguguguguaugaauccuuucauuauuguaaaauuuauccuaguauuaucaaugaaucugacccauuucuuuucaacagaagucuccugacauucuggcauuaccuccacgugaaagggaagggcuucaaaccacaaucagucccuugagguacaaacaugagucagugaaaagucuuucccucaaggaacuaaaguccacagaaggcagauaaauauaacugugaguccaguuagaaugugagaaguaucaauaaaaggugggacugugucauguaaauucaaaggucuaaaacuuuuggagucuuuuucuuuaaugauucauauaugugagugaguacauuguugcugucuucagacacaccagaagagggcaucagaucccauuauacaugguugugagccaccaugugguugcugggaauugaucugaggacccuuagaaggguagacagugcuuuuaaccacugagccaucucuccagccccuggagucuguauuuuucugcucacaagaacauucucuaccaugggacuccagucuaaagacaacuagggauaaugguccuacaugacuccgccuuagcucuccuuuccauucuagucuugccagguucccuagagugccgaacauuccaccuacuuagagaucccccaauccuuugcuccauuuucuuggagaauuugaaagaaauagaaugauuugacuagaaauggauuguagaaaugucucugaccaauuaagugaagaaagagauaggcgccagaaguccacuuuggagguugugaggugaugagguagcaaugggaagaggagacucagggacauuuaaaaagcaggaacaggagcaggagcucagaguugagagcacaaacugcuguugcauaggaugagaauucaguucccagaacaugucuaaugccugacaguugacuguuuacaccaagucuagcgggucugacacccucuucuggccacugugggcacugcacuccuauaaacacacaccccuccggcuauuauauauacagauggagaaagucuaaagcagaauccguugaauaucacaauauuuggcuauagcagaugaagaugaacuaagauaucuagagugaucagaggucuaguuaggaauccuuagaauaaucuaugaacucuagggcagggacugugucuugcaacauuguauugcauugggcaugguucuuggcacaaaguuggcauucugugaaugcuggaagaaugacuuuuucaacagguggucagauugaauauaggccaugacuuugucuuuccagagugcaugucuauugaugguuggguaugugguccagaaagaaccacuuuguaaggaguguguuguaugugucugugugcaugcacgcgcacaugugggcaugcacacagaaaucugaggauuuaacuuuuccugggcauaaaaugauaggcagauaguuggcaguuggcaguacagauaaagguaguucauccuuuaauucucaagccuagagaauagcuuaucucuaggguugcuuuaaacuuccaaugcuccaguguaguagcgacauuuuggccugccuuuuauagaagcugagucuauggcagccucaggcauagucuuugauuuaaagucugagcucuugauauccaggugcacccucuacaaggucauguucuuucaggcuaacuaaccuucugcuggcuucccugagaucauuucuuuaucagcagagaucacuuuccccaaugguuucaaaugcagccauuucuuucaucuguauuccuagcuugauuagugagaaauuaaugagcauggaagauuugauuuagauaaugauuaauuaggggaaaaggugccagucuaauagcuagucacuauuauaugcuaaggaaauuaguuaauauuuuuggauggcaaauugacuuguccuuuguuaaauauacccuuuuaaaaugccugauacauuugauauauaauuuuaauaaacauguguuaguuuccuuacaagucaugaaguagccagguuuuuauaucauuaaauucuuuuguccaguauuaccucaugauaauacugcuauuuuauuuucagcacaguguuccuuuguuagggaaaaaaaacccacugcucauaaagcagaccuugacaaugaaaugugucaaaucaucacacauacucacauauauauggaaaagauuucaauuuucauuguuacugagcccugacgauuuuuuucuguugcuguuugaauaugcuguaucugcucuuagagaagcauaaggaucaaggucuacauggcaauuuuuucuguucuuuaugugcuauuuaguaugauuuugacaauuuauugucauuaguuaaaauuguagucuuauaaaauaaucaacaaauagaauauaauaaagguaauuagagaaucggaggacuugaagugaccuugagggcuuauucuguccauuucucaauuucaggcuaugugacucaucuuccuagacagcagucguugucauauuauuccccuugugugaaaacaucuaguuguucauuguuugcccgugguuagguccacaggucuuggccugcauucaagucccuucaaauuugggccuuucguacugauuaacuguagcuuacauugcagccugucucuggccaaguugaccuguuuacucuccuagugccucucgaaauccuuucuguccucuguguucuaacucaagccccauguccucuauugauggauaauuuguaaacaauaagaugcacccauuuuaagucaugacuuuugacaaacauguauaaacucuuguaaccacuguuucaauuaaacuauagauuauuuucaucacuucagaaaauguacugcauauuuugucacauaaccaugaaccaauuuaacuguucucuaguuauuuuggggugugaaagucuggucuccacaugaauuuaggcuucuuuuuuauuuguuuaauuugaauuaacacuuauuggagguuuacucuguagcaagaaggcuaagauauuuauuuaaucuaugaagcaaagaguguugguaaucccauuuuacagauaagggcaaaaaaacauauaaaggucaaguaagcugcccaggcuuucacagcuggcaaauggcaaggacuagccucuaaguaccuuaaccuauggaacaagaagaacuucuaccuguuccugcuauuaccacuuuuaauaaugcuggccuccuaucuuggaauaaaauccaauaggacugacauauucacauauacagagagucaugugcacucuccacucuaugcuguuaaugaugggaaagggguagaguuucuuacuacuucacagccuugguggaguuggcuaaggaagacuggggguagccaaaaaugucaggucuuucuauggaggcaacagaaagcgugaccuggguccaaugggaagaccuugggaugacugucaagaagguugagccgcagaugcccaugccuggagacaucaucagauguaaauguaaaggggcacguggaaaaggugcccaaauugagacuacaugaguagaacccuccaagagauaaagcugcugugcuacagauagcccuuuucaguuguaagaccccaaacuggauuccacuugcaagaaagacuuacgguuaaaauaauuagaaauauauguugcauacuuccuucaagugaaacacauauuuguguauagucaagaugcuuggaaauugcuuuuaugguauuuuccuaagaucaaaguuauauaauuauacagaucuaaaacugucagaggcaucuccacuacccugaucuuuaaauauaggcagacacauaguucuuguuagucuucucagucuacgacucucauuaauucaaaugguauguacaucaguugaaugagaucgcugagacauuccaaaggagaugagagucccucucugcucuuuaagaaauuauaauguagcugggcgugguggcccagcacucgggagucagaggcagguggguuucugaguucgaggccagccuggggacagccagggcuacacagagaaacccugucucaaaaaaaaaaaaaaagacagaaagaaaagaaauuauaauguagagaguacagcuauacuaugaagguauuuuuucauccuccaaaauaaaugaaaguuaguaacccuguaaugacuuuaguuauuauuuuuuagcauuugaggaugaaaguuuuuaagucuccccaaguugaccucccuugacuuauuugaacagugaagucuucuauuuauugccaugcuaggauguauuguuuaucacacuuuccauuuccaggugaauuucauucuuuacauaaaagguaugugaauauccuucuuugaaaguuuagcccaaaguuaguuuucugucuacuauaugggaauguuucccuuuuacccuuuugaaccucaugugcuuacagaaugcuucccuauuuauuaagucuuuuguucuuugcuuugaaaauuauuuuauguguguggguauuuuguuuugauaugucuguguaacacaugccuguaguacccauguuagccagaagagggcaauggaucuuuugaaauuggagaucucagacuguugugagccaccacuugggugcuggcaauugaaccugggucuucaggaagggcagcuaguacucuuaaccacugaaccagcaucuauaauaugucuuuuguugguggcaucuuaguucuucuauugaucuuuuggcuuuugccauuacaaguguguagaguauucucucaguguaucuccuuagccauuauuugccuuaggauuuacuugguauucauccuauuuuggaaucaguucuuagaguaauauuuuuaauuuaguugauggcauuccaucuaacuuucuucucaauaccuuuuugcuuuguuacuuuccugcaaaugcucacagcauugaagugguuaaauuucaguacuguuaguucauuuaggcaugaguuugucauacauugaauuugucaugaggguuuuuugaaguuugucuacagauuauaguaaauuuauuuacaacaaauuauuuuuuccauuagguauguauucccuuugauagggaauccuuaauccuuaucauuuaugauugucuuuauuuccuugacuccauagccaacccuuggucccugagacuaauuguucugguuuauugauuuaccaggcacuaauaauugaaacaaaguaaauauugcuauaauuucacauuuacauuuggacauaaauauacuuacaucuucauaauauuuaccaucaucccugaaaaguuuucauuuuagcuuuuauuccuuuuaaauguuuuuugcuaaccugaugagaugaugagguuucuuuuuuuucuuuuuuuuucuuuuauuggguauuuauuucauuuauauuuccaaugcuaucccaaaagucccccacacgcucccccaccacucccccacccacccacucccaccucuuggcccuggcauuccccuguacugaggcagauaaaguuugcauguccaaugggccucucuuuccagugauagcugacuaggccaucuuuugauacauaugcagcuagagucaagagcuccgggguacugguuaguucauauuguuguuccaccuauaggguugcagaucccuuuagcuccuuggguacguucucuagcuccuccauugggggcccugugauccauccaauagcugacugugagcacuucuguguuugcuaggccccggcauagucucacaagagacagccauaucuggguccuuucagcaaaaccuugcuaguguaugcaaugguaucagcguuuggaggcugauuaugggauggauccccggguauggcagccucuagaugguccauccuuucgucucagcuccaaacucugucucuguagguccuuccaugggugccucgcucccaauucuaagaaggggcaaaguguccacacuuuggucuucguucuucuuuaguuucaugaguuucacaaauuguaucuuauaucuuggguauucuaaguaucugggcuaauauccacuuaucagugaguacauaucaugugaguucuuuugugauuggguuaccucacucaggaugaugcccuccagguccauccauuugccuaggaauuucauaaauucauucuuuuuaauagcagaguaguacuccauuguguaaauguaccacauuuucuguauccauuccucuguugaggggcaucuggggaugaugagguuuguaagacuuagccaagggauaguguugccauacuaaauaacuguuuggaugauuguaucaauagcaaaucaaacuguugucaccauagcuuagaaucauucuuaaacuucugcaggcacauugaacaacauuucauuacuguauaagaucuuagcaacacagcacuuacuagaagaaaaaauucaucccuauuauuuuauuccucccauaaccagugcuagugaaaaugguugcaauacuaacagccagccauccuguagcuauagcucagccauucuacaaaacuggaaaugauccccaaggcaaauuagaaaaauacagagcuuucuuugucuaugacaauuaauuuuaugaacuuauguaaguucagagaguuuaaauacacaugauauaggcauugcuuucccaaggaaguaaaucaaaccuuguuaaaugaucagggaccuaguauauggaaagguuuacuaaauagaguucuauccccccccccccacaucuauguguguguuccaaccaaccuuguuuacauuuagaucagccacucuuccucaagggggcucuuuuccuucuugguccaguagacugaaucaguuuccacuccuagaauagcagaauguuuuguaauuucauguagaaagaacauaguuacaacuagccccgauuucuuuuugugucuguuugugacuauaaucauaaaaccuuuaagcauagacuuuauuuaaacuugguuuaaggcuuguauuugagauugagguuuauaggagauaaaucugaacuccaugucuucagaucccaacucguauuuugccauuaaauaucacuuucuuuccaguagcauaaauuauggugcuggauuagguuugcugauauguauuaucugcucucuccuuuacugcauuuguucccuucuguaaagggaagcgaagaacuuguccuuaauaccuuggacucaacagugaugaugugagaaacacauggugaugaauuucauucuuaacuuaagaaaaccuuagacacaugcauuaaggccacaaucaauuacaauuacucugaaacuugguguacuaacaugacaguuucuguuaaguuagggcuaacuagucuccccuccuuuauuaaauuucaaaacuuaaaaaaaggugccuaaaauauccaauaaugcuuucuaaugucacuaagauuuaaugaaccuuacuuucucuaggaucuuaugguguugggcagaaguuaugguccacauacauaguuuaucauccuggugauguugauuuauuacguuuauuuucuaggacuagggauauaucucucuuaauccauuuagaugaugagguccucuugggcagugucaauguuguaccuccaauauaugcuacagugcuuggcacauagauagcaguuuagaauggguuauuggaagacuagacgccaacuggacagguaaaucuaagccagcauuggacuggauguucauuaggauuauuaggauaaaaaauuguggaggaaaugaggggggcugcugaaggaggaugaaaugucauuagagcagaguacgggucuguccccccuaggaaggagggauaaaaaaggaaggguuguguaagaaacccccuagccuauaguguaaaauuaagaaacuuuucaaaugggaaccuuuacccuaggguccccugugagcaaaguucuaugguauacaggaccucauaucuuggccauguacaucauucaugaguugggagccaccccuaaggauuguggccucugcacacaugguagugaaaccagaaagcagcuccugggcuacuagucaauuaaucccuccaggaggagagcccacaugcauauguucauagccacauggcagguacuccacaaguguuuacugaagagagucugaguaaacgaggaguaucggcuuaugugugaguugagggguucgaucccuagucacccuuugccacaaacaaacaaacaaacaaacaaaaccagaaagagaaacaaaagccaccuuugcagauugaaaggaguugaauucaauacccauuaaguauuaauauuuaccaaugucuuggaggacaauugcaaugagauucuucccaccucugucuccaggcuucaguguugucuucuggaaaacaaguuauaaaucagagugguccuugcugcuaccauauuauguauaucacuuacuaacugcuauguaguaaacagcauaugcgucacgaguacacauugacaauuuggacauguacuccacaaucaaaguaaugaagguguccaucacucuaagaaauuuccuuuccgaucuuugugaucuuccccuuuguccucuuguucugccauccauccuuauacagccaccacuaaacucucugucuauagauauuuuccauuuuguagugccuuauagaaauggaaucacugggcuuggguuuguugguuuguuaggauguaccaggacuucauuccuguaugccauuagucccuuccauauuuguauuauauuuuauauaguagucaucuucacuugacauuuuguuucuaucuuuauuugacuguucuccucaagacuauaaaugccacgagggcaaguccauugguucauguauauuguuuuguguacuuuacacucauugugauuggcaaguaauagcaaccaaauaaauauuuguugacucuuguagaccuuuaguuaaaacgguaacaaagcuuugauugguauugauguuuugauuuuuuuuuccggaacaggaauauuaggcuggccagacauauauuucacucgaaaucauaacugagauuuuaaaaaauugucuuagguugugcucauauucguaaauaacaaucaggaaaaauaaauuaggagaaugaagauugauauuuuaaaagacaaauuaaauguuuguguugaacagcccguacuuggugcugcuauaaauuaguuucuguagaauuuaugagucagaccucagcaauuagcugacaguuauucaaaaggaaucagcgaugagggcaauuggaugaauugagauaaacaacauaaucaagaccuacuguauuuaaaaagaaacuuguuguuuuguccuguuuaauuuugugugugugaguguguguguguguguuugugugugugugugugugugugagagagagagagagagagagagagagagagagagagauuuucugcuuacugaaacaugaauaccuuauuuguuucaggaucagauuugcaaguaugucuccccaagggcccaacaugcugcucaagaaagauggaagaaaaauaccaacuaacagcacggcugaacauggaacaacugcuccagucugcgaguauggaacucaaguucuuaauuauucagaaugcugcgguuuuccaaggugaguuugggggaucauuuucgauguacuguucaauggcaucauuauuugggcacuaggcuuucaaauacuaaauauaauuuauaaauuaccauuccagcaugcaugcuugauauaaaaaccucccagugagagacccuggauaagaaacacaguuuuuaaaaggaacuucaauuuaaucuuugaaaaaguggauaauaggccgggcauugguguagcacaccuuuaaucacagcacuugggaaacagaggcaggcagguuucugaguucgaggccagccuggucuacagagugaguuccaggacagccagggcuacacagagaaacccugucuuaaaaaaaggaaaaagaaaaagaaaaaguggauaguauuaaaacucauuguccaagaagauuuuauuucccuguauauaaaaggcaaaaagcauugcugaagaaguccaugauaauuuuuucuguuugucuauuaagacuuuuuuuucaacccucacgaccaccaccaccaccaccaccaccaccacaacaacaacaacucucauaaauuccauagccaguuuucuuccagagugagucagauaccuguggaacacacacgaacuccuucugaccacuggggccauuuccauucaagaggaagcagcuggcucugguguccagccaguuuccaguuugugugcgugaguguguuccuccccucuucuuuugaaugucacuuuuuaccgugcuucucuaggaacugggaaaggaugggcagcaagugauuccacccuuggcaauuuacagggaaacuacagcagcacagggaagacuccuucagaucaaagaucaaguggagaugaugguagugauaagacuguacagaguaccaugugauuuuaaguaauuuacacguaucauuucauuuaauccucacaauccaccuaugggugggucuuuguuauccccauuuuauagaugaaggugcaagaccagaaugguuaggugauuugucaaggcuacccaccuaaaauuaauagugaaggcaagauuugaauccagcucaccugguguuuagaggugaugauuuuauccccuaacuuaggcuaccucuugccacuaggaagauuacuuguggauauggagcuucucuuccaucccuuccuuauaguuguauugggagguugcuguggacggcuauauacuugguaaugugggugugugcacauguauguacaugugcggaggucagaugucaaugcaugugcaucuuccucucucccgcucuaccuuuuauuuuuuuuuuuuugaaagaggcucucucacuuaaugugaaccuuaccuauucagcuaggcuaacugaccacuaagcuuuagcaauccuccuugguugcucuccaucuccagugaugggguuacaggcccacacugcuacaccugacuuuuucugugggugcugggucuccgaacuccuuacuugaccagcugaacucucccccuaaccugcguuucucccuucuaaacuaagaauacugaaucaacugccacuugccuuuaauguuggcuuggggucagagcuaacacuuuggacuauuugacauucuuaaguuucagauuaaugacaccuuuacaagaauuaaccuaugaauuauaaggugggucaauuauaccuuauuuuagguauuuaaagugaaauucuuagcauuagcuaaaauguuguucaaauuagcuaauaaaacauacauugccaaugguuucuugugucaaaagccccagggaauauugauguuagguucauuauaugaaguauaauacaaaagcgugaaaucuuuguuaaccuauuuaugcagugaggcucccgugaagcauuuguugagacuaacaauuuagugauagaaugaauaauucagaccaguuuaaaaaauacaugcaccauucauguacuucuuagauugguuuuggaguugauacacuggcuggaaguggggugauaaguaauguuacaagaggauugggaaaaaaaacccaagaggauuggguugaaguggacagaugaaacagucaaggcauggagguacuugaugagaauggaacauuagugacuucuuucgcuccuagaauaaccaagccccucauguucccuuucuaacauugccugcugagaugcaaugucagaaugauaaugcugguuucaaucuucagagcagcugguauugcugucugaggguuuuugucauuagaauuccuguagcuguccagucuugcgcuuugcauauuguguuucaggggacugaaacaguacgagacuagggacaaaaauaaguccugacaguguuuuggauugguguccagauacggcugcuauaguauagaagcugaauaguagccaacggagcugagaguagaaugcagagccaacaccuacuacuacugauguccucucucuguuucugucucucacacauacauaggaguagaagugugugcacacacauuuauuucuagaaucacagggacaggcagaagggcaacucuaggguuggagcauggagacagcaaaugaugccgacuuccucaugcuugcaaucuuacugucaugccuacuccuuuaucucuuuucauucugauuuuuuaaaaauuuuuuauuuuuagugugccucacuuuaaaaaagcccacaagagaaaaucaaccacaaucacagaccucaaggcauuuauguuaugcuuggagaagcauugaccacaaauucuuucuguaacaaacauuuugacgagggaaggcuucaaacaaggcaucagaacuaggcaauugcuacgaaagcugggcaucuauuuccuguuucucauaacuacuuauuauucccaugaauugggauugagggacacaauugguuuagcucaaaucuaaacauccaucccucaagauccugguagaccaaauuauugagaaaauugcccuacuacuuuguuuaugugaaauucgaugugguagcuuuugugagcuauuuccuccaccacgugcaguuggaguaagcuuaucuuaaucuuggccuagauucucaaucucuuuaggauucugucaguagcccagauugguggggguauuuuagcagggagagcacuuuggagcucugugcacaguuucaugagcaguccuuacugccucgauuuggauuuuaugucuuugauugcaggaagccuuugcccucauacaugagccuggggcccuuugcuaccgugguuggagugcucuaaugcuaaugcuguuuugauaaugauugaagcauuaaaaaaguuguucuuuauccucaaucuuugcauugccucguuuccuaaauuuaauuuacuuagaugugcuuaggaaaauggggcagcacaaucguuuucuguuucugcuuaauuaauucuuuuugagaaacuccacugaaaguacauuucccuuugcuuucuuuccucuccccuacuuuauacuaaugaggauaaagauaauggugaagauucaguaagugcuuacuguauggugcuuacuuuuacauaauuaucucauuuaauauuccuagcaacccuauggggccuguacuguaaucaucacuaguuuauagauaagggaagucuaagguaccaccgugccucccaagcaaucuauccuaugacuugguucuucuugcucucaggccaaacaaaaguacaaagcagugggauuuauggucccccugaagaaaacaugagauccaagucugacauuuuguaucucuaauaccuccucaucuucaggauuacagcucuguucucauucguggaauuucaucaugacuuugaggcuuacacuaccaggaaaucuuuagccauaugaccaggguuuuuaucaacauugaaugauuuuggucuuucccaaggugccaggugccagugacagagggagaaugggcuccuuagaaugcauuaacucuaugcuuuuacuggaaguugacugucccacagccugaacucuugaucagagcaagaaaccugugguuuagcugcaaacaucucuauaugaugucaaaugccacagagcuucuccuuaugcaguuagcucaucugagagcacccaggguccuugcuuggagccuacucuuguuauuaauucacagucuuuacaagcuucauuuucugacuuucuagcuauuaguggagaagcaauuggauggaaguguggcggagugcuauggagacguacauaggcccaauaugaagcaacauggaacaguaagaguagagagcauagaacuugacccaauaacucacuaaaugguaguuaggggcauuuauagaggguucuauauguauuauaguaaccccaaucauauagaaggcaauacaguuaguguucauaggugacugggaagcaaccugggaagaucagauuaaguucauuauccuugucuuaauacuuacaucuuaaaaggcuuaaaguaccagaagaaugcugaauuuaugccagugagguggcucagacgcugugggugcuugucaccaaaccugauggccugaguucaguccauggaacauacuuguuggaaggugagaaccuaguccugaaaguuguucucugaccugcacacaugcauuuguguguaccuccuaagugugaugaaaaaaguguuuuuuuuuuuuuuuuuuuuuuuuuuuuuuuuuuagaauacugaauucuaagucagaaaaaucuaguccaauucaagaccugcauuuacagcuuuggagauauuauuuagauuggauuauuaugccaaaucuauaaaauggggcuaaaauuuuagucauggagaaaguuuaugugaaaaugucuuacaacacacacacacacacacacacacacuuuauaaagacagcucuuuucuaucgacauuucuagcccagguggugcccaagaaauuaugggggccuuugaccucuuugaagauguacaucaugacauacuuaagcagccucugccacauuuagaugguccaguuucagauagcuccagugcaccagacccgccgguccucaugcuuucacaguuagcaccucccccagggagcccccuugacacugcccaggccacaccugaacugcauugucuauuacaguggaggcaaaggaaggcagagccccagggcugcuuggaggauuugcuuucuguggaugggaggagggcagcgguuucuuccugcuuuccuugcucucugcuggcuuucucguucuauaugcgcccauucuugucaguccugucucuccugguccccuaaaugaaacugaccuugguuaggacacccuuucccaucaacucugagcaauuucuucagucauuucugcuagaaauaacuagacucuuuuuuuuuuaagcagauuuaucuuacuucacaguuaauauguggcuaaauaauugcuugacugcugguaaacauguuuuaugauucuaucauuucuuaauuucgguuuuggugaugugcuggguguuuucagugacuacugagcaaguuuucuccauuucagaaauucccccuccuuaacuagcucugcuuaggcugagccccacugagucugaacuguuaacugcuggccacccugucacaccccgucuuuguugaaaacagugugccugagagaauaauuacguugacguuuaaucagaacuuaauucauuuguuggagcuaaauagaauaacauucaauugaaaagaagaauuuuaggaacacaaacccugaccaugagugagguuauauauccucaaaaaugucaauuauuaaucagcccacucgucgcucagcaaagcucugcuaaucccauuauaaaggggaaauuucucaucagaacacagaaggugcuggcucuaauuagaggacuuuuuauugcacuggcucaaagagguauuuugguuccgaaguuuaguuuuuguuuuuuguuuuuuuauguaauuguuuuaauuauuagggcuauuggaaaaaauuaacggaaaaccgaguguuuaaaguaaaucaguuuuggucuaagaacuuugagauuccauuugguuuuuaaauugcaguggcuuuagcugugcaggaguugagggaguugcaaaccuuuccugugcccucuuauugauuuaggaaagucagucauuaggcugaaaacuguuuaauaaaaagagcuuagaaaaaugagccagugugcaaguagagacgucuaaggucuccaaugaggugagaagauuaugcagaugagcccuuagcccuguucacugcagcaccucuuacacucaccaccacugcccaccuuuaucacuagcgugccccaccaagcaaaugaaggguccuucugccuucuaccagcuuccaggaagacucucacuuugccuagaguugauugcuccccacccugcccccccaccgggcuuuguuuacuuucuuaaaacauauguuccuccuccuuuuucugucucacugcguugcaguaccugauauggggguaaugaagcauauguuugagagauuucaauucuccugacaguugaauggagguagaaacaauuuuccucuaagcuggaaguggugauguugaaauuaaaaacacuuuuccuguggacugugagaugcuuccagggcuuagguccgaugcugccuuucuuccugguccuaccugcucuucucccauuuuuuucccccugcaucccugugcuccuuacccaggcucaguugucucauucaucaucugauguuguauuucaguuccagucuccaucaguucucagcuagaauaccagcaaaggcacagcugagucuccccuucuucaucgccuuugcuccccacuucugcaaugcagugcaaugguuauggauacagccuccaggccaggucaacuggccucagauccuucugaaugagagaaaauaagcaagcggauaugggguggaaaugauugugaguugcagggucaucgggaacuuccuucauaaauaggcaccgagagacuaagugagaaaagaagggaaagucuccugcucuaaccaguuucauuucuauuuaucuccuugaaaccuccccucaagccugugaaauugguagcuuguugguuucauuuuacuccugaggaaguggaggcuuagggaaauuacaaguccaaaguagccuagccaauagauggugaagaggaauuggacccaggaaggacagcuggagagaccacgcccuuaaguacuaugcuuuagccagacucccuguauuuugcuuugugguuaugggcagucauucauuucuaauuuucuuucuuucaagggaacucuguuccauuuuauuugaaaacuugcugagcaguaccuagcauguucaaaaggcaaguaucaagagggauucaaagagcuaaaugacuacauagcuaccaucagagaguucagaucucacaaagcaagacguuuuguacauggcuaacagggacagucagcacucuuagagaaaugcugcaugaaaagguuuacaguuuuuauaagguguuggaguggauccauauuugcugaggcuuucuacaguuuuagggacucauuuccuaaggaaggccauuuagaacacuaagcucucguaccucuucuggaaguagaugugccaagguggguccuuguagcucuuuucauuagcuucuuaggaaaucugccuccauagggauuggaaaaaaaguaaaaaaaaaaaugauuucaacuaguggcuggauauucuugauuaggguaggggaagauugucagugugaguucucuccacagauguggcuuuuaacugaagaugagagcacgugagagaguuagguaauucaucuuuuucucaaauccaaauuaucagucaucuuuuagauguacucuuccuagacuugcuggcugaccuugucaucugccacucauccuuuucucuuagaguggggacagggcuagugugccaaggaugugcucugacuuaagcaggcagcaguggaagugcagcucuguuagaacuc

SEQ ID NO: 9493 - RNA, 676 nt, Mus musculus
aaugcucagaagcagagccuugccgggagagaagccuggguuuuccaggcaucugcauucucuucuccugggacuccuuugcuuugcagccgacccucauauuuuaccauuucccccucuccuuuccucccuccucuuccucccuacacagcucagaaacaguuucagcaugcaagcccucuccaucaacuccuccuggggccaugagacaaucugugccugugccuuaggccucagauccccaaacuuuugagucggaugagagaacggaagaguaaggacaaagacaacaccaacaucccaguuuaaggugaaaauucacgggcuucugaugcagcccugaaaggauucgggcaaacuuaguuaagaucacagucuggguggguaguuggauuugcuaaacuacgacgaacaggaaggaaagcgagccuuaggaaaaaaacaaacacaagggagcaagaauuccaggcugcagcagcagcagaccagcuuuggagggaaggcccagcuuaaaaggcgcgcaccuuuccgaacacuucugacucccuacugccccucuguggagaaacacucuguggaaaauauugucuccagggaccuauuguggaggaacauucuaggccauacucugccugcuuuuggauuagcuuccacuucuccccguagcuaaguagcu

SEQ ID NO: 9494 - RNA, 33588 nt, Mus musculus
cggagccuggccggcagcguuucugagccauugcugaggcggcgagggagagcguugggcuuaccucacugcuuuccggagcgguagcaccuccuccgccggcuuccuccucagaccgcuuuuugccgcgagccgaccggucccgucaugccgacccgcagucccagcgucguggugagccaaggggacuccagcagagccccacagccgggccccaugcgcccgguggcacagugacgcaggccggagcccugaggcucccgaggcccgcucugggcgcuggggcggccgggacucuuugauggcgggggcggucagggauuccuggagucuggcuagaugccccaugagggcggcgggcaggacgggauggcgggguucggggguggggaugccccuccagugagccccgacagagagagagggcaggcugcguguggaccaggaagguggcaauggcguuggacuugacaugugcggccggcggacgcgcgcgguggcaagcggcggagggcggcuucaggaaggaucaggcgcggggagggcgggggagcucuccugggagaggcccagcucuacaaguuugggguuuggcggccagggaacaccucuagaaggagcuucgguucccaagacgaccgcaugagagggcauguucaggccuggacuuugccccuaauucugcagaugccauaauucauauuugugggaaugcgcaaucacuccguugaaucagcgcugcggcccaggcagugaaaaucacgccuauuuuccaccugaagaguggaaaggcggcucguuuuuuguuuuguuuuguuuuguuuuuuuacccccccauggcccagaauaaugggcuuuggcuucagauacacuugacuugggagcccaugcccuuggaugcugugggaauuuaaaaaaaaaaaaaaguauggauuugguuguuacguuggaugacuuuuuuccacacucaucuucagauauccugccuuuucucccauuggcucaauuuuuucuaaccugccaagcucugucuccccuaucaaucccaacgccauaaccuugcugaucaugcuugcuagaacaucccauagcuccugcuucugauuaacgacuuuagccugcucuauucuuauucuugccucugguacuccuuaaaugucauauuaugcuuuauauacuacagauuuagcagguaucugguuacuuguugguugacuuucccacucacacguacuuuaucuugauguuuucaggcagggucuuacuauguagcucugucuggucuguaauugguaauguagaccaucaagcuggccaugaacuugugacagucauccugacucuugccucccaaauguugcaucacugagucuugcugguuuuuuaaaaauucauuuuagggaaugaacccuuguucuacuggguaagcaagcucucuacucuacugggccaaaagccaggccccuaaacaagccucagcuuuagguauagcacaaugucugguuuguggcaaguuuucacuaauaguuuguugggugaauuaauaaccauuugagcccuuaaaaagguguucucucauaguguauuagauauuguggcuuaaggcaaaaccacuguguucuuaaugacccagaauccugcuugcuuagaauauguucuauguggccuucaguaucuucaccuagacugaagcuuccuuuucagacauuucuuccugugcaaccauugcccuaaguagaccaggccuugaacuuucagccaucuugcuucuaccucagugugggaauuacaagcaagcauaugcuaucaccagguuguacauuuuucuuacaccugagaugcuggcugcugguauuguuaaaaggacuguaagauaauaaacaacacuuauauagucccugagugggaauagcauaauagccaucauuuuguuuacauauaucuauccuuauuaguuuucaaaauaauccuguaacaaagggcauguucacauuaucagacacaaguuauuaagaggguagagagcuccccucaauuauguacuaaacccuaguuuugaucaccagcaccagaagcaaggauacauuuuagaaaauggaguucugucucaauucuuggucugugucugaggucuaugcaaauaaauacuaugguaggauucaguagauaauguaguaggugcuacuuuuauucggauauggcugcuuuuaagcuuggagauaugguacuuguucaguguagaguuaauuaguucuuugugcuagaaguggcuauucuuaguuuuguuugaacauuaagaaauucacaguauuuuuaguuuguaaauuccuguuccuuuuuuuuuuuuuuuuugcuuccuuccccuaaauugucugcaugcuaggaauaacaaacacuuaaaaagugcuuacuacaugcugcuugcucuucuaagcccguuagcagauuugacuucuuuuauuucuauuuuuuuuccuguauauggcugcuuugccuauauguaugcauguaugccaugugcuugcuuuggaguccaaaagagcugccauagggguuaugcucauggauuggcaggaucaauauaguaaaaauggcuaucuugccaaaagcaaucuacagauucaaugcaauccccaucaaaauuccaacucaauucuucaacgaauuagaaagggcaaucggcagauucaucuggaauaacaaaaaaacuaggauagcaaaaaccuagguccccugaagaacaauacguacucugagccauccuucaaccccuacuugacuccaucuuuuaaaaaaauuacacagacaagguaaauaacuugcccauaucagucagugcuaccacauuugaaccuguuaaucuggccccagauucuacccuuaaccaguagacuuguuaggagcuacagugaauguuuaugaaauacuuguucugucuucagcaaugacaaauguuuuguggacuuuaccuaauaccaauaaguuacauaauaagugccccuuguguagaugaacaugacuggggugauacaagguagaggaaguaaauauaagcuacauuacuuucaugaaaugggccccuagauaugcuugagagcuacaaaaacgugcugcuuguaacuaucagucuagaaaaggcuucuggcuucuuacaaacuaaugugaaacaucagauauguuuuauaugguauacacuugaacuucaaaauagcccagaugaaaguauaauauacuaacugaacuuaaaccuuguuaaugaauuuuucaaaauuuauagugucuugagacaaagacacacucuguaaauuaauguggccugcuggccuuaaacuaacaguccuucugccuuagucuuccaugugcuagaguuacaaucaugagccaccacccuuggcucagaugauuuuuuugagauacauacucuguaguuuuaggcuggucuccuaacucacuuugugagaauaagagacacauucuaccaugcuugguaugcuaaugaaagugaaucuguguuuuggugaucuaacuugaggucuugugcuaauaagcauguuucaccauuaagcuauaccuuuaucuaucugcuaauuuuuuucaguuuuuaaagauuucuuguuauguguaugaguguuuugccugcauuauauguguguguguaccauuaggaugucuguggaugucagaagaaggcauuucaucuccuggaacuggaguuacagacuauugugagccuccacguggguuuggggaacuaaaucuagauccccugcaagagcaaguacuuuuauaaaauuaauucuuuuuaauucacuuuauguccugaucacccucccuccucucuccccaguccuacccuaccauccuuacaaaucccucccccucccucagagaaggggagcccccacuuugcucauaccccacucugggcaucuagucccagcaggucucccacggaggccuaaccaggcagucuaaguacuccuaaccauugagccgucuuucuagcccaugguuuuuuuuuucucucagaauugguuaaauauuguaguuuuugccuaacacuauuuuauuauuaucaauggugucuaaaauaacauccauuuauaaauaagaccaaaaugaauuauuuugaucaccaaaaaaugggaauagucccucuuagagguuucuuuauguaaauuuuauacucuuguuaccucuguuauaugucuaucuuauuuggauaaaaauaaucuggauuauuguagcaggugggaaaaagacuuaauuauaucagaaaaaagaugccuuacaguuuuauuauuguuuugggugggguucuuuuugugagggauuaguuuacuuuauuuagucugggauauauuuucuuuauauaggccaggcuugucucagacugggaauccguuuuagucucuuaaguguugggauuaugagcauagacugcuaugccuagucuuguaguuuuuuuuuuuuuuuacuuuguaaauuuuagaugaaagaaaaaacagcuaacuuauuuuauuaaugacuaucaugaauugaauuuucacuuuuuuauuuuugugcaauugguaguucagagaccuuuacaguuuuuuuuuaaauuucuuuuccuuuuuuuucuuuuugguuuuucaagacaggguuucucuguauagcccuggcaguccuugaacucacucuguagaccaggcuggccucgaacucagaaaucugccugccucugccuuccaagugcuaggauucaagguaugcuaugagucacaacacuugacaaauuaaauggaauuauaucauuuuccccuucccuuuucucccuccaguucuucccauuugcccacccuagaaucuuuuucuuugauuaucauuguuaccuacacauguguauguauguauguauguauguauguauguaugugcacauauacuuguuuguguguaaauggguucaagguugcucacuccgcaauggauagccaaaaagggagcucuuccugggcgugacuaauucuucucacaguugucauugguugccuguaguucuuugucuaggggugggaccaagagaaauuucucaaaccuggaauccuccugccuuagucuccugacuaacuugccuuaguugauucuguaauucucugauguagauccuuaggauuaaauucagauuaaguuuggcagcaaguucuuuuauccacccuaccgucucagcagccugagaugggaucuggcuguguugcccaggcuagcccugccuuaauuuuccagguacuuaggacuacagguguaucacccuauucccaguggaauguguuuuauuccauaauuaauuagauuaaacaaugguccaugucauuuuucuccccuauaguaaagggguauugaaauuguguuuguucugucuuucuguaauuuuauguuagguggauuuacuaacauugauagaucacauagaaguguuaauuacuaccaguaauaguaauauugagauacacuuguuauuuuccuguugaggacuaccaaaauaacuaccauuuaaauaauuuguuacuaguaggaauucagacacuucaaauugcuuugaaaacuacuuucaguuuuuucuugcuguuuagugucaaaauaucuaugauucuacuaugcauauuaguaaagggaaagauuuuuuuuuuuuuuuuuuuuuugguuuuucaagaccggguuucucuuuauagcccuggcuguccuggaacucacucuguagaccaggcuggccucgaacucagaaauccaccugccucuacuucccgaguccugggauuaaaggcgugugcuaccaccgcccggcaagauuuuuuuuuuuaauucauguccuuacagauaugguaguuacaggccuacuugccuagagugguuauaacuuauuccugggcugaguagucuacuaccuuauuuuaauuuuucuuauagcuuuaacccuuggaaaggaaacaaauacucuauguauguuauuuguaggacugauaaaaaaaaagaaaaugaacauaguaccauuuuaaguuguuuucauauuuaggaguaucuaucaauaaauuauaauuuuuguuuaaucauauccagacauaauauaaauuaucucaaggauagcuuaucaucugcuuuuuuugagauuuuuuuuaaaaaguuuuauuuguuuuugaaaaauuuuaauauauuugaauuaagcuagugucucacuguguagccaagaacuaguaguuuucugucucagacuucuaaaugcugaguuuauagguaugugccaccaugcccagcacaaaucccuauuauaaaaugugcacauuuguaauaauggcaaucacaugaaagacaauccuugugauuuacacauaaaauuuccuguuacacagguacauuaucagaaauaauaugaaaaaggaaaugaaccuaagcuaauacgaccuuuggaaugucagguuauugucuacaauuuggauuguuuaagucucuuuauaguaaaauauaacauuguucaugagcccaaacaagacuccauuaaauggaagugaguccuaaaaugacuacuugggagacagggggagaagguucagcuacauagugaguucaaagccagccugagcucaugagacugucucagagaagaaaacuauugugaauuaagaguuguauaguaccaggcagugguggugcaugccuuugaacccagcacuugggaggcagaggcaggcagauuucugaguucgaggccagcccggucuacagagugaguucuaggacagccagggcuauacagagaaacccugucucgaaaaacccuccaaaacaaaacaaaaaauccccaacaaggacaggaagaguuccaagccagcccgggucacauaguguugagacaggaaagggugugugugugagagagaauaauagauaguagaaaaauuguuuugaauuuuaugacuaguaaucagcauguucaaaguuuuagaauggacagaaaugugaccgucacaucugugcaccuguguucacacaugcaugaccacauaaauacacacacacacacacacacacacacacacacaaucucaagugaagaguuguaagacuuuuugcauuuuggagaagaauuauguugauauggcuuuaauaaacuggguaugaugguucauacccauaaacccaucauaugagaagccgaggcagaaagauugccccggguuugaggauagcuuagacuaugucgugagauuaaguuuaugguguacugcagagccaaggcaaucugaaaucagaaacaaauuuuuuaauguuaaaauaacuauaagcauuucagaggaacaaaacaaaaauucucagauaugaauuuguuuuaauuagaaaucaagacuuuugcauugguguguugauggaaauagaauuccuauuuuugaguaauuccugauguuuguauucuuagacuacuugggugcacaucuguaaucccagcacucagaggcagagggaggaagaucauagcaaguuugaggccaaccuaaucuauauagcuaguuccaguacagcuagaguuacauaguaagacccugucucaaacacacauaaaaagacugggaugaacuuggcagaguucacauuggauuugucuuuaauugaaacagucuuugaaguucuuagguagguuaccuguagaaccuguaaccaggcauugagcuauuuuaguaggugcaguagucugaugaaaccugggugugauaggcuuaaggcagaaacagagugagugggcagaggguaugagaaugccucaggaaagucauugugguauucuaauuuugauucuaagguacuuugaaauaauccagcuuuauuuuugucagguaguacauaaguucucaugagccuggccugaauauuuauuguuguuaucuuauaaaauugagcagucugucaucuuuccccaaaacaugaacuaaaauuugcuuuauagaacuuacaaaaaugcuuuuuuuguaaaauacucuuugaauauuccuuuguaugauacaaaugcccaauuucuauuuuuguuacuaaauguccuaauauaaauauuaagugaauguuaagcagguuuuuuuagcucucuaauuuuuuaaagaaauugccauaauguuucacaaauuuuucugauuaugaaaaaaaauacauguguauuuaagaauaaaucaguauucugcaugcugcagguucuugugaacagaccuaaaaauaaauaaaauucuaucaaacauugagcucaaaauagaccuuuugugacuaaacagagagacagacagacuauacaacuuuuaauuuuuuucucugggagaaaccucaaaauauaucugaauucugagcuggguguugacagucccaguacuuggaaaguagaagaaggguugugaguuugaaaccagcaugagcuaugcaaugcaauuccaucucaaaaacaauggcaagugaauucugcaaagaacguaaacuuauguaauuuuaauuuuuuucaaagucaaaccacuugugacgaaagcaccuaauaaaacguuaacugaaaggaagaacucuguaugaauucacagauaugaugaaauuuaguuaugauuuggccaauauuccuugaaaacugccagagcguagacaaccaggucuuguagucuauucgguuuagaggauuuuuugggaugggggcaggagcucucuauguaggucaccuuggccuuuaacucgugauuaucccugccuuuguacccgagugcuggcauuagagaugugugacaccaugugcagcuugaugcuuuaguucuuacaacaccgugccagggacugcugcuucuuagauggggcuuaaaaguugggaaugucauguaagauugaguagucuaauucuuccuggcuuauuucucucaauaaguuuuuuuaaaaagauuuuuauuuauuauuauagauaaguacacuguuggcugucuucagacacaccagaagggggcaucagaucucauuccagaugauugugagccaccgugagguugcugggauuugaacucaggaccuucggaagagcagucaguguucuuacccgcugagccaucucuccagccccucucauuaaguuuugauuaauagauuaacuuaugaucuuuuaagcuuuucuuguaguuuaguuuuuguuuugcuuuuaguguaaagagggcuggagaugagcuugguugcuggagugcuugcccgguaugcaugaaacccuggguuugacaccuagcaucgcauaaacugggugugauauacucaugcucauaaucuaaaagaaggagaagcuucagaaguugaaggucaacugcauagugaguuuuaggccaguuuaggauccaugacacccccccgccccccauaucucacuauaauucacugucaaauggcuuuuaugauuuggaguuuggggauacuuuuaaagacagggucuugguagcuccuagauggcuugggauucacuuaguaacccuugcuggccuaaaauucaggaacuucuaccucaucuucccaaguacuggguuaguagggauguccagcauauuuagcuugcuuuaaugauuuugcuguacuuuuuucuguguguacaggugcauguauauuuauaaaacuaacauaauauauuuuacccccaaaguaccauaacccuaauuaaugcuauuaaauguuuuguaugcugggcucugggcauacuaauauaaccaauauuauacaaugcaaaacaauuuuggaauaucuucuguaaaauuaucuuauuaguaaguuguaaccaucucagacuucuaaguuugaguuuguaaaggaucaguuuuuuuuggugaccuacacacacacacacacacacacacacacacacacacacacacacacacacagggggguggauucugagaauuuagagaauuuagaugguuaauaccaguuuuuauuuuuauucugugugauauuuauuuauuaagauuuauuuauuuauuacauguagguacacuguaucugucuucagacacaccagaagagggcaucagaucucguuacagaugguugugagucaccaugugguugcugggauuugaacucaggaccucuggaagaacagucagugcucuuaaccguugagccaucucaccagccccgugauauuuuauuuaacuuacuagaauauacuguguuaaaacauauuuuaggggauuggggagauggcccauucuguaaagugucugccaugucaucuucaggaccugcguuuguaaccccagcauggagaagacagagacagggagaccccugggcuuccuggcaagcuagacuagcaaauuugguuaacuagguucaaugagagacucagucucaaaacauaagaagugaauuuuuuagacccaauuucaaucucugaacuccauacguaugcacauguaccugcauauaaauauauauacacacccauaaacacaugcacacacaaaaaaugguucaaaaguucuuaaaauguauaagaguagaaaguguagagccgggagugguggcgcacgccuuuaaucccagcacuugggagcagaggcagguggauuucugaguucgaggccagccuggucuacagagugaguuccaggacagccagagcuauacagagaaauccugccucaaaaaaccaaaaauaaaguguauauacuaaucuuucaugccuaaaauauuuauuuuugccacauuuuucauaccucuuuaauauuuuucuuuuucucuuugugcuucaaaggaaauuuugugucauguuuuacuuuucauucuugacucuauucagcaguaagacgcagcauggcuuucuuagagaaguauaaucuauuacaaaacgguaacauuuaacugcucuacauacccucuuguagcuaaauuccucuguuaaacuaagacuuauuaucuaaacguaauuaaauguugauaucuuauaaugcuccacuuugaaacagcugucuuucuuuugcagauuagcgaugaugaaccagguuaugaccuagauuuguuuuguauaccuaaucauuaugccgaggauuuggaaaaaguguuuauuccucauggacugauuauggacagguuaguaagaccucgauugaaguuauuuuuagagggugugugugugguguguguguguguguguguguguguguguguguguguguguguguguguguaagagagagaggagaggcaugugugauauauaugugaaguguauugcauguacauggaauccagagaaggacauuagguguccuacucuguugcucucuuauucccuugaaucagugucucuugcugaaccuggggcauacauacugauuuggcuaggcugccuggcuagcaagacccagggaucugcuugucucugccccccagugcugacguuacaagcaggugcaaccacaucugguuuuuauauggguacugggggaucugaacuuagggccugaugcgugcccaagugcucucacccgccaagccaccucuccagccaaaggguuuuuuuucuuguauuaauucuaacuuagcaacuguugaguaguugauguuugaauauaagcuaagccaacuuauuagaauaaauguuuucuauuuuuuacuuguaugugugagugccugcauguauguaugugaagcauauguauuccaggaugucagaauugugauggauucccuggaacuggaguuacagaccauugugaaccacuguguaugggugcugggaacugaacuuuagguccucugcaaaaacaguaaggaucuuaacugauaaacuaucuuucuagcccuaaggcuuucuacuuuuaaaguucguuucucuuucucucucucucucucucucucucucucucucucucucccucucccucccuccuccuccuccuccucuuuccccccucucgccuccucuuucucucuccccucccucucucucucucacacacacacacagacagagagaggagagagaaaggaagccuuacuaauuaauuaccuaguuuuagacauaacuagugggaauccauaguaaguaaaucaacauucuugaagagagguuagaagaauuggcucucguuguccaucgaggcuguauaagauuauucuucuguuuucucagcuuaccauacauauuuucuacguagacaauaccaauucaaauacacuguacguaaaguauaugcgcacacacacacacacacacacacacacacacacacacacaaguuacauauugucauauaguacuaaaauuuauggacuuuuucauauuaauacaucuagagcuaucauguuuuuuaucuuuuaaaaauuacuuuacggggcuacagagaugucucagcaguuaggagcacugacugcucuuccagagguccugaguucaauucccagcaaccacaugguggcucacaaccaucuguaaugggaucugauccacucuuauggugugucugaagacagugacaguguacucauauacaugaaauaaaucuuuaaaaaauuacuuuaccaucaggguauauauauauauauauauauguguguguguguguguguguguaugaaguauuugcuauuugagagggucucacuguuuagcucagucuggcuuggaacguucuguauagcccagacuggccucaacucagcagucccccugaaaggcucucauauguggagauuacagguaugugcuacugugcccagcccuacauguuacuuuguuuuugaaauaggguaucaaauagcuuagacuggcuucuaagucaguguguagcuaaggauggucugagcuucugaaccugcuacuucaacuccuggugugccaucauggccaguuugcacaguugugagaguagaacucaggaccuccuauguguuacuagacauguucucuaccagcugagcuacaucccaauucgccuacauuuacuuuuauuuuuuaaaagauuuauuuauguauacagcacucugccugcauguacaucugcaugccagaagagggcaccagaucucaucauacauaguugugagccaccaugugguugcuggggauugaacucagggccucuggaagagcagucagugcucuuaaccucugagccaucucuguagcccccuacauuuauuuuaaagauuauaggcuauucuauucauagaugugccauaacugauuuaaccagaucuucauuauuuuguacuuaguagaguauauuagagggaaugaaucuuaaauacacauuuugacacuugcucagcuuuagacaaguaaaaaucacuggucaaggaaauggugcuuaguggaugcuucugaacugucaaauuguccuccaacaaguuacaucauuuuauacuuccaacguuaugugagaguucauuuuucuuuaggcucuucuaguauuuuauauuugagaaauaaaauuuaaccaaaauuugccaaucuaguaagcuuguuuuuauuuguaucuuuaaauuuuaugauagauguuauaguguacucuccucuccccuccccuccccucuccuccucagcaggaucuuguuauguagcccuaagggaucuaauacuuacucuguaguccaggcuguccuucagcucaugagacacaccaucaugcuuggcauguuucuuguucugaaagguaucugguuuuaauuuugguugagcugguguguugguguauaucuguaaucucagcacaggcaaguagagacaaggauuaugauuacaguccagccugggcuauuuagagggauucucuuuaaucuuuccucaugccccaaaaucuuaccuuugguauaugaaaaauagucuccacuucugcaaaauauugcuuuaugaaguaagaauucccuucauagagacaaggaauguguccuguaaaaguuuaauguguaagaaguauuuguuauaaaagauaaauauucagaaucuucuuuuuaauuccugauuuuauuucuauaggacugaaagacuugcucgagaugucaugaaggagaugggaggccaucacauuguggcccucugugugcucaaggggggcuauaaguucuuugcugaccugcuggauuacauuaaagcacugaauagaaauagugauagauccauuccuaugacuguagauuuuaucagacugaagagcuacuguguaaguauaauuaacuuauaauuaaaaaaauagggccauucuaguuuuaucuauauuuuuuuaaacuugugcaaacuaugcuacauaaucaacuuacuugauuauguaauauauauaguaauaguuggaauuacuauuauuacauauuuauuuuucugugcugggguagaacccagggaacuaaguacuguaauaaccgagcuucauucauccuagucauuuuuaauuuuuuuuuuuuuuuuuguuuuuucgagacaagguuucucuguguagcccuggcuguccuggaacucacucuguagaccaggcuggccucgaacucagaaaucugccugccucugccucccagugcugagauuaaugacgugcaccaccacugccuggcauuuuuuuuaaaguuuuaauuugagacccuuucucacuaacuugcucacacuauccucgaacucauuacgugggcuggucuagaaauuucagucaacuugccucagcuucucaaguagcugggauuacaggcaggugcuaccacuucuggccaugaucauuguuguuguugcuauuauuauuauuauuauuucacugauacuucauaucacaacacagaauaguaacuguaguucaugaccaacaaaaaaguuguacaguuucucuguugucuuauuuugaucuggauuuugauuuguuucauggcacugggcaggcuaaucucaaacugcauggcucaaauaguccuucugucuuaaucucccauguucuggaaguauagguaucacuacaccuagcuguauuuucauauuuaaaaaaaaacgccuaagaauugcuauugaaugaggcggagagauggcucagcagucacaaguacuuguagaggacugggguuugguuacuagcaccucaaagauggcuuacaauuaucuguagcuccaauuccagaggaucugugugguaaagcugcauguauaugggcaugcagguaaaacugcuaaacauauaaaaauagcucagucuuaagagaauucuaggccuggugagguggcucacuagucaaaagcacuggcugcucuucagaggacucagguucaauuccuagcacuuacauaguggcucacagagucugucccuuuagucccagggaucugccacucucuucuguccugcaagggcaccuggcaaucacauaggaaacaaacuugcagcagaaacccccauacacauaaaauuaagaaaaaaagaauugcuauugagacuugauguuuucucaacuguguaugcugguggcaaauacucucacuggagauaauugcucugagaggaauccuaaguuauuugaagcaaagccuuaauuauuaagguuaaugauuauuucuuggaaaucagaaaauacuuuuggccugggaccacuuuaccuuugccagaguuugaaaugauuuagaguauugacaguaugaugaaacaaaauaaaugucaucuuuauauguaaaaacuucaccauucacaauuaugaugguauaguuuguuucuuccuuuccuuuccuucccuucccuucccuucccuucccuucccuucccuucccuucccuucccuucccuucccuucccuucccuucccccuuuuucccccuuuccccuuuuucccuuucccuucuuccccccuuccccuuuccccucuuccccccuucccccucuuccccuucccccuucccauccuuugacucucugugcagucccagcuguccuggaacucacuauguagaccaggcuagccuugaacuuagugauucccccccuucaaucccagcacuaggagugcaccaucacugccugguuaaaauauguauuuauuuuaaaauuaaaacugcagaaaguuauagaaaaaaaagauugucuuuccaaagucuacuuuuuaaaaaauagauauaauuuuauuuuauguuucugcgguuuuuuugugcacaugaguauauggaucaucuugagugccucaugucugcagaggccagaagaauacaugggauccccuggaaauggaguuucagguguuugugagucaccaugugggugcugggaacugagccuggguacucuaugagaauagcacauacuuuuaacuguuggaccaucucucuaacuccugucaucacuuuuuauuuugaauauuaagaguuuucucuauauauacauguccccacauacaacuauagcuuacauaaucaguauuagcccaggagguauuuaacaauccaagugcaaaacagccuaaggaguccaaauaucuauuuuauuaaaugaaaaaguccacuaauuaaaaccacuguauuugugugcuuuuaagaaagaaacuaccuccaguuauaguuguauggugccaugaauuaugauguuuacagagguaguaaaguaugaauguucaucuucaaacagugaaauauaguguuauauauuuggugacauuuuuucugucccuagugcucuguaacuuucagaaaaaugaaacauuugauaaguacacaaauguguccuauuuugacuuuuauuucaauuuuauaaaauucuaaaaucgucgaagaacaaaacuagaccuugagagaaaggguuguuaguaaacaaguaaugguuuuuaaaagauuuauuuuauuuuauguauaugaguacacuguagcuguacagaugauugugaaccauccugugguugcugggaauugaacucaggaccucuguuuguuccggcccagcuugcuccaacccaaagauuuauuuauuauuauauguaaguacacuguagcugucuucagacucaccagaagagggcgucagauaucauuacauauguuugugagccaccaugugguugcucaagaccuguggaagagcagucagugcucuuaaccgcugagccaucucuccacccacaaguaauguuuugaguuuuauuuuuaaguuuguaauuauuugaguguuggaugaaucuaaggucgugaauaugcuaagcaaauaugcucuaaauccugagcucuuguuucuauuuagagguugccagaaauccuagugauggaaaaauaggaauacaacuucuuucuugucacucccacuuuuccaucuagacucuaagagguagacaaaguagaaagaaacauuacggcuguauuuauagaaaccugagcuucuggggaaaauauauauaaagugaguguuuugccuguauacaugucuguguaccauaugugugcuugaaguccacagagggcagaauagggugucuggaccccuagaauauaguuauagacuguugaaaugcuggaugcuggaaauugaaccugggucuucuggaagccguugcucugaaccaccccuucagccuccucuggggauuuuugguaguugacaguagugacaccugaaugaaggaugugaguauacuguagcuguacagaugguugugagccuucaugugguuguugagaauugaauuuuuaagaccucugcuuguuccaggcaacucugcucacucaggcccugcuuguucuggcccaaagauuuauuuauuguuauacauaaguacacucacuguaggugacuucagacacaccagaagagggcaucagaucucauugugggugguugugagccaccaugugguugcugggauuugaacuaaggaccuugggaagagcagucgggugcucuuaaccacugauccauuucaccagcccauauaacaacuauuaaaugaaacuuuuuuucucuuuauagugucccuuuaaaaggaagcuguuuccuuaacaaaaacuucagggaagcauaagcugaaacacugaaugggacuguggaaacgugaacaucuuagcgugcaaguguucugugugcuuuggaguucuguugccucggacccuauagcaauagccuuuggaucacacuugcauucuuagauauuuauuccuuaugucuguccuuugaaagaggaaguacuuggcauugggcuguaauaccauuuuucuacagcaggugucaguauuuaucaggguuuguuauuacuauguagcacucaguguaaugccaucuuaacuagguucagguuuuguacaguucuuuuucuuugugucauuaaucaguuguguguguuugaaauucugaguuuuaggcuaaacuaguuuaaauuaaaaagccaacauuuaguuuacagcuuggacuaguaguauuuuuuguuuauuuuguucuucuccacuccccuuaaacaugcuagguaaacauucuaccaacugagcuaucauuuuaaaaaaaaauuuugagauaggguuuugaauaccgaauaaaaauaguuuuauagguaguauauuugucugcuacuugguguuacuaauuaguauugauccacauaagaauauauuagauugugucauucuuuguaauaguuucauaguauuauuuauguguauuaauuucuuuaaguaauucccuuuuaaagacaugcuggguuuuuuuuuguuuuguuuuugaugacuaccugauauagugaacauuuuugaauguuucccuugcauguuuguggauauuuuuguaacacugauucuuggaaaugggauuguuagaucaaaauaauuugcauguuuauaauuuuaauaggcauuacuauauuuuuucaaaagaggucauauugcuuucuguaaucuaaccagcagcuugaguauuuguuucuccugaauguauuaucaggcuuaauugcuguaaauguggaugaaugaacaguagaaucacauguagaaucugucagguggccaucaguugucuauuuguauucuaauaguucuuuuuuuuaaagagauuuguuuaucuugcuucauguguaugugugaaugccagcauauauguauuuacaccauauggaugccugauacauuugagcucagaagaggggaucagaucaccugaaacuggagguauaggcauaugaacugccaugugggugcugggaacugaacccagguccuuggcaagaucagcaagugcuauuaauucugaucucucuccugucccaccugguagguucuuauuuugagcagaauuuacauuaggaauagugguuacagaucuuuuuaguuggaguucaugacuaguuuuuuauccuuucuaagaauacaggggaaaauuauauauauuccugggggcugagagauggcucagcaguuaagaacacugucucuucuuccagagguccugcgucugggaauugaacgaauucccagaaaccacacgguggcucacaaccaucuguuaugggaucugaugcccucuucuggugugucugaagacagcuacaguguauucauauacauaaaauaaauaaaucuuuaaaauaaaauauauucuuacauuuucuucuaauccacuuauaguucuauuuuuuacauuuagauuuuaguccaucuggaauuuauuuuugugcauggugugagguaggaaccaugcuuuauuuuuucccaaauggauaaguaauugaccaaauaccauuuguugaauaauucaucucuuaauuacugacucaaaauaucaucuuugucauauacuaaauucucauguuuuugggucuguuucuggauuuuauuggguuccuugaacuuuuugucauucacugugcugguucuauaccaagcuaauugcugcaguuuuugguaugcuuugcugucccaguagaguaaguccacacucuuuuaaucaucaguuuucugauuuaauaccagcacauccaaauuauagcuauucccaccaacucuagugaguguuaaucacucuccuuugaaaccucuguaagguuuucugcuaauuucucuacaagcagaaagugggaaccuaagaaggauguucuaauagacuaguaaucagaccugguuucucagacaguucugaagaugaccuggauaugggcauauccaggauauggacauauuuuaugggcauaucuucaggguugaaugugauauagaccagcuccuacacuugugugacucacaggaaugguucagggccagaagcagacaccugucaugcuaauaaauuguccuuuguaguugagaaguaccugauugaugaguagcuauaauaugcccacucagaaauagauguacucuaguuuuagaacucuucagagccucaaauacuaguaauggucaauuaagauuuuuaauuuuuacuaaucucuauguaaaauuuaccuagucauucauuucuagaaaccuaauucuuauacuuuauaauuuagaauagcauaauuuuguggccauuagauagcuaacuuuuuaaaucuuauagcuuauaucuaauaauuugagaagcuuauauauauauacacaagaauuugcauuuaagugauguucuuuuuucaacuagaaugaucagucaacgggggacauaaaaguuauugguggagaugaucucucaacuuuaacuggaaagguauguaacuugaagaggaaagaaagaacauuuuuauaccaagaaacauuaguaacugcuuucaaccacuuacuuagagguacuuuauuaguaaaaguaagcugguauuguuuaacucuuagaaguacuugauauagauuaauauuaucuccuggacuuuauagccaaaugacagcagaauauaccauuaacccucacaguccauauugcuaauuacugcuuuauuuugguuuuuucgagacaggguuucucuguguagcccaggcuguccuggaacucacucuguagaccagguucgccucaaacucagaaauccacuugccucugcccccaagugcugggaucaaaggcaugcgccaccacucccggcuuuaauuacugcuuucuauaauacuacuuugaaacucuaauuugggauccuucagaaaauauagcuggagagggacagucuuuuuuuuuuaauagauucaaauguaguuucauuugaaggugugugugcgcgcacacaugcuucucuauguguauuuguuuuucuaagacacagucuuacuuagagucuacaccaucuuugaacaucucuuauguaagucagguuggccuugacauggugguccugcuucagccucccaaaugcugggauugcaagcauaagcccccauacuagacuguguauguuuucuaagcggcugguuauuuuuuacuuguaggcacugugccauauauaaauguauuaaccugguuacuuucacaguaaucuagugaaggcaguuauauuuccauuuugcagaucaggaaaugaaacaauacacuuacaguuucaaaaacuccuugggauuaugagauguaaacaaucucucgaagucacgcaaccaggaaguagaaaagcuugcaugcugacaccaaauucuuucuuuccucuagcuuuuagguuuagugcucacugcuuucuugcacuacuuacucacuacucacuacuuccuucacugaaacucuguagggaacuuuaacauaaaaugcugguauucuggaggccuguaucagggucacgccaaacuaaugucgcugucagcaguguuuagaaccuccaggggcgaauuuguaaucuguucguucucgcucucugccucucugcuguccauuugguguacaacugccagaccucuuucccuuuuagcaugguuuguccauauuuagaagcuauucgaaaccugcccuucuauaauccguuuucggggcuggcaggggccuagccuucgaagccugcugggauuuaguuugaccuucuucaccuaauggcucugucucuacacagcgcugugaucuuaaacagagcucugcuucuaaaauaacuucucagagcagccacaauagauucuuuuuauuguggaaaacaucaaggaauacaaauuuaguaaaguuaaaucuugaugaugagauuauggguuuauuuaaaacauucuaauuuuuuguggaaauuuaucuuauguguaugcaaguacagacauaaugcacacauuuucccauuaauacuugaaacgguagucuuuggauccaaaauaaccuuuauucaaaccccuuucucuugcccuucucaauguuuacuacuuuagguaguucauuugacuacucagccucauuguuuccauuauuaaguagacauguagcuauuugacaaaauaaacucucagugguagcaguucucucucucucucuguauuagaacaauagucuuuaaaaugucccaaauuuuuauaucuuuuuaaaauuuucuaugcauauccugaccuuuauuuuuugaaagauuuaccuacuuauuuaauuuauuuauuucuauguaugugaguacacuguacagaugguuaugagccuucaugugguuguugggaauugcguuuuaggaccucugcucacuccaguugguccuguuuacucuggucaacuccauuugcucggucccugcucacucaggcccagagauuuauuuguuacuauaaguacacuguugcugucuucaggcacaucagaagagggcaauggaucccauuacagaugguugugagucaccaugugguugcugggaacugaacucaggaccucgggaagagcagccagugcucuuacccacugagccaucucaccagccccugaccuuuacuuuaaaguggcuuuuuccugccuauagaaugggaugcaguuguagcuuguuugccagaaguucugggcuuacauucuuagaccuguauagcacuguaagauacugccuucuaugguaaacuacuuugaaacauggacauauuagauguuuuucuugauuauaauuuccuuuuaacgcacagcuuugauucuccaaaugauuuacccacagcauauguauuuuuaaauuacacuugaguuuugguaguaauuuaucuuguaaaguacuuaaacuauaggcuaaaggagaugaaguaugucuuuaguuacuuugaauacacacaauaccaaggcaacuuauaaaagagaacauguaauugggagcuugcuuacaguuucagaggguaagucuguaaucauccuggaggguagccugguggcaggcaggcagcaugacacuggagcaguaucuagagcauacauauuacaugcacauuggaugcagagaguacuagagacuagacccgguguggcuuuugaaaugucacuuuugaagcccauucccaguauaugccuccccuaacaaggccacaccuauuaacccuucucaaaaacaguuccaccaacaagggaucaaacauuccaauguaagagccuauggggggaauuuuucauucaaacuacaaggugagaaagaauuuugaauuuucauggacuccaauggaggcuauguacucuaccuugauaaucacuaacuuaaaguaauaaagaagacuuggcaauucugauguuaugguuguuuggcagagugauuugagaacuauagacuaacaguauaaaauaaaucuguccagugaguauugugggcaugugaaaugucugucaccuuaucucucuaacuagcaacucagaccaggcaugauaaaucacaauugcaaucuuacuauucaguagguugaggcagaaauggugcugccaguuugaggacauuuuuggcuacauuaugaguucuaggucaaccugggcuacagaguaaaauuaacuagaagauugaguugggguugggguggguuuaagggcucugguggauguauugauaucuuuucccaguuucccaaauacgcacacaaccauauacuaguuuuagcuugauggagaaauaaaaaauuugcauuuuauauuauguuagaugcauuauuuuaaaagacauuuauacagauuacaguucuuggaauauuagagucaaaauacauaaaaggagagcugguucaaguuuuucaguuuacauaugagucacugagauccugagaaauuucccaaguaugaauuuggguaauuucuuagaauuuguuuaaugauuucacugauaauugggaauacugucucacuucauauacuaauuuucauuucucuguuuucuucuagaaugucuugauuguugaaguaaguucuacguuuacuuuuaauauacugucuacaacuuucuaacuuaguguguaugguaauaaagguaagucgggggcgcuuguguuuucuaacccuaagagaagccagguacaguagggcaugucuggaaucccagauccucaggaggcucaugaauuccuggguuagccugaguugcauagugaguuuaaagaccgagaaaauccuuauuuuaaaaacaaaacaaaaagacacaaacaaaaaauauauuuuguaagugauguguuuugcugcucaugaaaaaaguuauauacuuccuuuuucaguuuugauuuuuuucuuuuaaaacuaguuauaacuauauagagaagggugugugugugugugugugugugugugugugugugugugugugugagugagugugugauuucauguguuaaguuuuauuuuauggaauguuacaagauuuuuaacauuucaucuaaauaauauaaaaguaucaaauauuucuggcaagugaguggaguaaagacucaaaccgcuacugucuggagcccauugcuuuucaauguguaaaaaaccaaaagcauuagccaggagcuuauggauucagaaucuuugugauaaaaaccaucaauuuuuguuugagcaaaccuugagcugauuccgauacaugcugagcuuuaagacccauugauuuacucagaagaaaaugagaagacacugucucauuaaggccuucuuuggcuguccuacauaaaaccguacauuuccaugucuucaucuuccuauuccuuuccauacuuuuuuuuuuaucacugccuacaugcagacuuuauuuuuugccuguggcuucccuguuucacaucugucugacuugcugaacucuauacauguacgucuauaccacagauuguggucauccuccuaccuugacucuauuccccaguucuucaggaugcaucuuaauagauucucauuguggcuucagaauauauaucagcuucauuccccaucauuuuucauucuuuauacuuuuugcauuuccuagagcaucauuuuucuaucuucauuuucugucccuaguaguugcuuuucauuuuuguaaucucuuguuuccuuuccacuuuuuguaguauuuauguuugugcauuguuuugugugucugacuggguauguaugugugugcaaguaugcaugcuagugcauaagaacagaggccaguagaggaugugugugccauccucuugcacuuccuauucuaugaggcagggucucucccugaaccugaggcucacauuuucuuacauaggccggaagcuagcaaaccccagcaauccuccugccuccugucuuuucagaccugaguugugauggaagcaggaugccuggauuuugugugaguccugcaaugcaaacuccagcuacuauaguuaaccacugagcuaccucuccagccccaaugccccuauuuuuuuuuuaaacaaaagaauuuuuauucuuucuuuuauguguggugcuagggaucaaacccagagcaugcuaaauaagugcucuaccaccaggcgucacccuugacucuuuaggguuuuuuguuucuuuguuuguaagagguagguaaauaucucaggcuagacucuuacucccuccaucccaccugccuguaccucucaagucaagugcugggauuauagguaucuaccaucauuugcgucucuucuucccucccucuuucucuuauuccaucccugcugucuuccucccuucccucccucccucucuccuuucuucuuuucuucuuuucucccuucagcaugaucuugucauacaacucaagaugaguguuuuuccuucuaugagaccuggucuuaauguagccuccucaucuguccugggucucacuauguggaccaggagccuaagccuucugaaugcuauccauuacaauugugugccaccauaccugcccuccaagcuggcuuugaaccuacuguguaaccugugcugccugugaacucauaaccucucugccucagcuuuucacaugauggaauuauaggugugugccaccauugguugguuuguauuucuuuuuaagaucucuucucuuuuuucaauuaguuuuagucuacugcauuuugauuauguuugcgcccucucucuacuccucccagaucucucuucccuucccuaccuacccaacuuuguguuucuuuauuuaaaacccaucaacacaauuugugcugcuccuguacucuuggaugugugaccauccaucacuagaauggucaacccaccaggagacacauccuuaaagaaagcugaguccucuagccgcagcuaucaaugauagcuuccucacuaugggugggacaugauguccaccucccccacuccaugcugggaauuugucugucuuugacccugcacagguugugugcaugcauucucaacugaugucaguugauaagugcaaauguuguacugugacagaaaacauuguuucuuuauaguuguccaccaccucugguucuuucucuuuaauuaaaaacaaaacaccuuugugcuugcaugaguaagcaugacacagaaugcacauggaggucagaagagcgcuuuguauaacugcuucucuccuuuaccacuuacauggaaucuagggauugaacuuagcucacuaggcuugcaugguaaaauguacccacaaagccagcuaucugggcgccguucuuuuaaguaacacaucucaucucccucccuacagagcaaucaguauccuucgccaucauuucuuauuucuuucucccccuucuccacuuucuaagguuuauuuuuugaggacauaggugagugggauuacaccguaauugcccuuuguguuugaagaggaucucacuauuucucucuggcuguccuggaacuugcuauguaaaccaggcuguccuugaaccauggcagguuuauaaacacacacacacuccacaaauaaaauaaacguagcuuuuuaaaaaaaguucauguaggaugauagcacuguacaguuucuggugugauuggccagaugagggacaauuucucccugacuauccagggguagcucucaacuacaaagaucaucccucaaguccuacgacacagcccugucacagcaucacagcuuuuuaaaccagcaggagaguuagguuucgagcccugauauucguuguggucuaucuguuuuauggauuuuuaucuguuuucugauuuuuuuuaugguacuggagaaucuagggcauaaugggugccauguggguguuuuaucacugauaaagucauuuuauauaguaaaacuuauuacuuagaugcuuuuaaagauaauacaaagugggcuggagaaauggcucagaaguuaagagcauugucugcccuucuagagguucugaguucaauucccagcaaccacauguugacucacacccaucuauaguuagauuuggugcccucuucuggccugccagcauaaugcaggcagaacauuauauacauaauaaaucuuucuguaaaaagauaauacaaagcaauguuucuuagaguaucaaaguuugggauguuaagagucccuaucuuuaauuuacaaaaaaaccuacuauaucuuuuacagaauuaaaccugguaauuuaugccugcaacccuaccucuuaggagucuaaaguagggggaucuugaguuuaaggccaccaaccugaacuacauagcaagacccugugugaaauacaacagaaagauuuguguaugugugcagugcuuacauguagacguuccauuuacuguuuuugaccuugccacaucuaugcaaucuaguucuggggacugacauuaccucugcuuacuuagagccagauagguuacaaguuccagacuaucucugugugaauuguggugagauuuuguguauacuaaaaaugaauggcauugugucguggaauacuagaauauugcauuuggaauuguauguuuguaauaaggaugauuuuuuuuaaauuguggugguuuuauuuaccauuaaaugucucuuuucuuuuuaaaaggauauaauugacacugguaaaacaaugcaaacuuugcuuucccugguuaagcaguacagccccaaaaugguuaagguugcaagguauguaugccacuuuaaaguagaaugcuuuccuuauuuagaauauuaagugauagcuucuuuguaaggagacaugcuuuuucagcuuucguuuuaucauuacagaguaauguaaucuuaaaacucaagacaguagccuuuguaauuuuauuguguauuaauaagccauuauagucaauuccuugucuaauacaguauauauaaggccuuggaucuagaacuaccucagaugcuaaacucccuagauguucagguccuucauaaagaaugucagaugagcugcugagauggcucaguggguaaagucaucugcugccaagccugacaaccugaguucaauccugggacgcaugugguagacagagaggacugacucccucugaccuccaugugugccacacucaaguaaaauaagugcaauuguuaauggcaggaguguuugcacagaauccaugcauacucucccauacacuguaauaccuaccacaguguuaauacauauaauuacgcuaaauuauuuagggaaauacauaucuuuauaguauggguucuuagaauauuguuuauuuauguguguaguauauguauuaugugcaggugaguacacacucaucaugcagauaugugaagggcagggcaggacugaauauccuguacugcccuuuacucuguugccugagacauggucucuaacugagcuguaagcucaaaguuuuagccaugcaggcucauuggugagguuuuugaaucuaucucuagccccagcgcuggggucacgaacacauacagccaugggcaacuuuuuaaugugaauauuaggagucaaacucaagugcuugugcuugcagaccaaauagucuuauccauggagccaccuccccagucccuagaaugucuagucuugauacacaaguuuuuagaaauggaacucucacauauauacagagcuauguaacaauugcuguuucagcauguuacuuauaucaaauuuauccugagugacauggcauaugaucugagguccccuugugaaauugaaauaaaucauaccaagguaguaacaagugguggacacugcacaucugaaucuucuggauuagaguggugagugaggcauucuauuuuguguugucacugaaauuguaccaugcuugcuuccuuuuucugaagucucaaaucuuacuauaucuggguauuuggcuugugcuuucauaguuuucuguuuuuauccuugguuauaguuugauucuacaacaguuguuaucuccaccuuauagauaaggauacugaagccuagggaauugcccacagacacagagcuaauaagcuauagagagaagauuugaacacagggaaccugucacaguugaugcuucugcuauuuuaaguuggguuuuguuguuaaaagugacaucuuuuuuguuguguuguugcuauugcuuuuugcuuuauuuuuacuuuauaguuucauuuuuacuuuaauaucuuugacugcucugugcuuuuuguguagaggagaggucgggucuuuuauuuuugucuuuuccugaaugauuaauuggcucuuaauuuuuuuuaaagacuuuacuuauuuauuuauuauaugaguacacuguugcugucuucagacacaccagaagagggcgucagaucucauuacggaugguugugagccaccauaugguugcugggauuugaacccaggaccuucggaagagcagucagugcucuuaccugcugagccaucucuccagcucccgguucuuaauuuuugaaaauuuacacuuauuuauuguggcaggaauauuggcacgugccacuugcacuuguguuggucagaggacagccuaagauucuuucuaccuuguugguccugggucgggguggaacauaguuuggcagucuugauagcaauagucucauauacacugugcuaugucugcugaccaauuaaacuagcuuuauaaaaucguuuuaaaagaucaaaguaucuauaaagucuuugaaucucuauaauuuuaauaaaacuuauuucagcaauuugucuucauggacuuuuuggauagauggcacaaauauaccucagugaguuuuugccaugcugaaggugagaugugcccagagaauacuuggguaauuuuugaugauguaguuguccuacgcaaguguguuuuggucuuuccccaaacuaaaaauuaagucuuauuugguaguauuguaagauagcguggucacucuagaaagcaguuuuuuuuaaaaacugcacagggaacuaccagaagaccccagacguugugcugaguacuuaucccugagaagugaccauguugcuauaaaaaucuguauugguuuauagucagguauggugguucaccccuguaaucucagauuuuggaaacugaaggcaggaggaucacacugaauuugagacaagcagccugagcuauauagugaagaccugucuucuaucucccuacucaaauacgacuguucacgucauuugugauaaugcagaauuaagaagaacaaaauuugaacaaauuugaagcacauuuauaccacgaaaucagcaauaaauaggaacagccaucaauaugcagcaguugagaugaguguuacuggagcuguacagugcuucaggaggacauaaagcagguguucgcucuuucuguuuaaaugcuuaccugucucccaguuuugauaugcccaagauuuuuaauuuuuuucaaggcuauuauaauaguaggacaccaaaggcaaagcaauaaaacuguaugauucuacuuauauaaccccguuugaaaugacagaugagaauggauuagggguuaccagggguugagagagaauacaggagggagccuugcaugagucagaguaucuugauugugguagugauuagacuagucucuaugugauuaaaauugaugaaaucuguacaaggccgcuuaguucaccaaggcccauguucugguucugauaaucugcugaaauacgacacuagagaccuuugugugugauuuuuuuuuuucuuuugugacuucagugaaaacaaaaauaaaaauuuugaaagccauuaacuuuuuuugggcgauauuaggguuucaacucugguuguaugcauauaugacaagcauuagauaacuagcauuuaacuuuguaguuuuauauaauuauguaaucaaacuacauucauaaauucaugauuucuauaaauaauaaagguauaaauuuaaaaauaaaacugcuuaaaacuuacauuuuuagcaagagucaaguaguugaaaauguaauuaacuaaaaaauugagugaguaacucaguggucgaguacauucuuaaugugaucaaggcucugaguucaguauccacugcaaaaaauucccauuggugagccaguuauuacaaguccugaugaaagagcaugucuuaccuucuuuaguuaggauucugcucucagaagcaucuuaccagguuccagguggugaucagucgggggccuugaccuucaugugaccucucugugauuuaguucuucucccuuucagccuuccuaugggucugcgaagcuguccuuauucugaaugcagaugauacuacuuaagaacacugauguuuucuuuguaaugcucuguagucuuuccauaugccacauguaauuuuuuguaauuaacagcuugcuggugaaaaggaccucucgaaguguuggauacaggccagacuguaaguagaugcccuuuggccaaucauuuauccaucuuauaacugaaaaaguuaacuaugaaauggcuuaggguuacuuuagagaacauuugugaggaagguacauuugcaagaauuagaauugaaaguauuauuuucucuaaagaauaaacuaugauuauuuauuuacaguuguuggauuugaaauuccagacaaguuuguuguuggauaugcccuugacuauaaugaguacuucagggauuugaauguaaguaaugcuuuuuuuuuucucgcucucauuuuucaaaaacccacauaaaaauugaggaaagggaagaauuguuuucuccuuccagcaccucguaauuugacccgacugaugguucccauuagucacauaaagcuguagucaaguacagacguccuuagaacuggaacuuggccaggcuacggugacacuucuugcuggcugaaguaguugaacagcuuuaauauacaacaacugucuuauuguuauuucacaugauauagucauaaguaagaaauaaacgauucaguuucaauuuuguaauugacucugcuucagaucccugccucccauucuggaggcaggaaggagucuucugggugaguuuauaagcaugguccaggagcaguuagaaagucuccaugggcaauauuaccuaaagcguauuuuuuauuucacuuaccuguuuugauuucagcuuuauguuucucaaaguuacguacuaagacaaagaaaaagcaaacuaauggacuauaguucugcuuuguuuucaaauuauguccucuucaaguugcugguccaaaauaccuuguuugguagaaacccagacaacguaggaggacccuuuaaugcuguuauuaccucuuuagaauccgcuuuucuaacgagaaugucuuuuauuuuauagcacguuugugucauuagugaaacuggaaaagccaaauacaaagccuaagaugagcgcaaguugaaucugcaaauacgaggaguccuguugauguugccaguaaaauuagcagguguucuaguccuguggccaucugccuaguaaagcuuuuugcaugaaccuucuaugaauguuacuguuuuauuuuuagaaaugucaguugcugcguccccagacuuuugauuugcacuaugagccuauaggccagccuacccucugguagauugucgcuuaucuuguaagaaaaacaaaucucuuaaauuaccacuuuuaaauaauaauacugagauuguaucuguaagaaggauuuaaagagaagcuauauuaguuuuuuaauugguauuuuaauuuuuauauauucaggagagaaagaugugauugauauuguuaauuuagacgagucugaagcucucgauuuccuaucaguaacagcaucuaagagguuuugcucaguggaauaaacauguuucagcaguguuggcuguauuuucccacuuucaguaaaucguugucaacaguuccuuuuaaaugcaaauaaauaaauucuaaaaauucgcca

SEQ ID NO: 9495 - RNA, 33588 nt, Mus musculus
uggcgaauuuuuagaauuuauuuauuugcauuuaaaaggaacuguugacaacgauuuacugaaagugggaaaauacagccaacacugcugaaacauguuuauuccacugagcaaaaccucuuagaugcuguuacugauaggaaaucgagagcuucagacucgucuaaauuaacaauaucaaucacaucuuucucuccugaauauauaaaaauuaaaauaccaauuaaaaaacuaauauagcuucucuuuaaauccuucuuacagauacaaucucaguauuauuauuuaaaagugguaauuuaagagauuuguuuuucuuacaagauaagcgacaaucuaccagaggguaggcuggccuauaggcucauagugcaaaucaaaagucuggggacgcagcaacugacauuucuaaaaauaaaacaguaacauucauagaagguucaugcaaaaagcuuuacuaggcagauggccacaggacuagaacaccugcuaauuuuacuggcaacaucaacaggacuccucguauuugcagauucaacuugcgcucaucuuaggcuuuguauuuggcuuuuccaguuucacuaaugacacaaacgugcuauaaaauaaaagacauucucguuagaaaagcggauucuaaagagguaauaacagcauuaaaggguccuccuacguugucuggguuucuaccaaacaagguauuuuggaccagcaacuugaagaggacauaauuugaaaacaaagcagaacuauaguccauuaguuugcuuuuucuuugucuuaguacguaacuuugagaaacauaaagcugaaaucaaaacagguaagugaaauaaaaaauacgcuuuagguaauauugcccauggagacuuucuaacugcuccuggaccaugcuuauaaacucacccagaagacuccuuccugccuccagaaugggaggcagggaucugaagcagagucaauuacaaaauugaaacugaaucguuuauuucuuacuuaugacuauaucaugugaaauaacaauaagacaguuguuguauauuaaagcuguucaacuacuucagccagcaagaagugucaccguagccuggccaaguuccaguucuaaggacgucuguacuugacuacagcuuuaugugacuaaugggaaccaucagucgggucaaauuacgaggugcuggaaggagaaaacaauucuucccuuuccucaauuuuuauguggguuuuugaaaaaugagagcgagaaaaaaaaaagcauuacuuacauucaaaucccugaaguacucauuauagucaagggcauauccaacaacaaacuugucuggaauuucaaauccaacaacuguaaauaaauaaucauaguuuauucuuuagagaaaauaauacuuucaauucuaauucuugcaaauguaccuuccucacaaauguucucuaaaguaacccuaagccauuucauaguuaacuuuuucaguuauaagauggauaaaugauuggccaaagggcaucuacuuacagucuggccuguauccaacacuucgagagguccuuuucaccagcaagcuguuaauuacaaaaaauuacauguggcauauggaaagacuacagagcauuacaaagaaaacaucaguguucuuaaguaguaucaucugcauucagaauaaggacagcuucgcagacccauaggaaggcugaaagggagaagaacuaaaucacagagaggucacaugaaggucaaggcccccgacugaucaccaccuggaaccugguaagaugcuucugagagcagaauccuaacuaaagaagguaagacaugcucuuucaucaggacuuguaauaacuggcucaccaaugggaauuuuuugcaguggauacugaacucagagccuugaucacauuaagaauguacucgaccacugaguuacucacucaauuuuuuaguuaauuacauuuucaacuacuugacucuugcuaaaaauguaaguuuuaagcaguuuuauuuuuaaauuuauaccuuuauuauuuauagaaaucaugaauuuaugaauguaguuugauuacauaauuauauaaaacuacaaaguuaaaugcuaguuaucuaaugcuugucauauaugcauacaaccagaguugaaacccuaauaucgcccaaaaaaaguuaauggcuuucaaaauuuuuauuuuuguuuucacugaagucacaaaagaaaaaaaaaaaucacacacaaaggucucuagugucguauuucagcagauuaucagaaccagaacaugggccuuggugaacuaagcggccuuguacagauuucaucaauuuuaaucacauagagacuagucuaaucacuaccacaaucaagauacucugacucaugcaaggcucccuccuguauucucucucaaccccugguaaccccuaauccauucucaucugucauuucaaacgggguuauauaaguagaaucauacaguuuuauugcuuugccuuugguguccuacuauuauaauagccuugaaaaaaauuaaaaaucuugggcauaucaaaacugggagacagguaagcauuuaaacagaaagagcgaacaccugcuuuauguccuccugaagcacuguacagcuccaguaacacucaucucaacugcugcauauugauggcuguuccuauuuauugcugauuucgugguauaaaugugcuucaaauuuguucaaauuuuguucuucuuaauucugcauuaucacaaaugacgugaacagucguauuugaguagggagauagaagacaggucuucacuauauagcucaggcugcuugucucaaauucagugugauccuccugccuucaguuuccaaaaucugagauuacaggggugaaccaccauaccugacuauaaaccaauacagauuuuuauagcaacauggucacuucucagggauaaguacucagcacaacgucuggggucuucugguaguucccugugcaguuuuuaaaaaaaacugcuuucuagagugaccacgcuaucuuacaauacuaccaaauaagacuuaauuuuuaguuuggggaaagaccaaaacacacuugcguaggacaacuacaucaucaaaaauuacccaaguauucucugggcacaucucaccuucagcauggcaaaaacucacugagguauauuugugccaucuauccaaaaaguccaugaagacaaauugcugaaauaaguuuuauuaaaauuauagagauucaaagacuuuauagauacuuugaucuuuuaaaacgauuuuauaaagcuaguuuaauuggucagcagacauagcacaguguauaugagacuauugcuaucaagacugccaaacuauguuccaccccgacccaggaccaacaagguagaaagaaucuuaggcuguccucugaccaacacaagugcaaguggcacgugccaauauuccugccacaauaaauaaguguaaauuuucaaaaauuaagaaccgggagcuggagagauggcucagcagguaagagcacugacugcucuuccgaagguccuggguucaaaucccagcaaccauaugguggcucacaaccauccguaaugagaucugacgcccucuucuggugugucugaagacagcaacaguguacucauauaauaaauaaauaaguaaagucuuuaaaaaaaauuaagagccaauuaaucauucaggaaaagacaaaaauaaaagacccgaccucuccucuacacaaaaagcacagagcagucaaagauauuaaaguaaaaaugaaacuauaaaguaaaaauaaagcaaaaagcaauagcaacaacacaacaaaaaagaugucacuuuuaacaacaaaacccaacuuaaaauagcagaagcaucaacugugacagguucccuguguucaaaucuucucucuauagcuuauuagcucugugucugugggcaauucccuaggcuucaguauccuuaucuauaagguggagauaacaacuguuguagaaucaaacuauaaccaaggauaaaaacagaaaacuaugaaagcacaagccaaauacccagauauaguaagauuugagacuucagaaaaaggaagcaagcaugguacaauuucagugacaacacaaaauagaaugccucacucaccacucuaauccagaagauucagaugugcaguguccaccacuuguuacuaccuugguaugauuuauuucaauuucacaaggggaccucagaucauaugccaugucacucaggauaaauuugauauaaguaacaugcugaaacagcaauuguuacauagcucuguauauaugugagaguuccauuucuaaaaacuuguguaucaagacuagacauucuagggacuggggagguggcuccauggauaagacuauuuggucugcaagcacaagcacuugaguuugacuccuaauauucacauuaaaaaguugcccauggcuguauguguucgugaccccagcgcuggggcuagagauagauucaaaaaccucaccaaugagccugcauggcuaaaacuuugagcuuacagcucaguuagagaccaugucucaggcaacagaguaaagggcaguacaggauauucaguccugcccugcccuucacauaucugcaugaugaguguguacucaccugcacauaauacauauacuacacacauaaauaaacaauauucuaagaacccauacuauaaagauauguauuucccuaaauaauuuagcguaauuauauguauuaacacugugguagguauuacaguguaugggagaguaugcauggauucugugcaaacacuccugccauuaacaauugcacuuauuuuacuugaguguggcacacauggaggucagagggagucaguccucucugucuaccacaugcgucccaggauugaacucagguugucaggcuuggcagcagaugacuuuacccacugagccaucucagcagcucaucugacauucuuuaugaaggaccugaacaucuagggaguuuagcaucugagguaguucuagauccaaggccuuauauauacuguauuagacaaggaauugacuauaauggcuuauuaauacacaauaaaauuacaaaggcuacugucuugaguuuuaagauuacauuacucuguaaugauaaaacgaaagcugaaaaagcaugucuccuuacaaagaagcuaucacuuaauauucuaaauaaggaaagcauucuacuuuaaaguggcauacauaccuugcaaccuuaaccauuuuggggcuguacugcuuaaccagggaaagcaaaguuugcauuguuuuaccagugucaauuauauccuuuuaaaaagaaaagagacauuuaaugguaaauaaaaccaccacaauuuaaaaaaaaucauccuuauuacaaacauacaauuccaaaugcaauauucuaguauuccacgacacaaugccauucauuuuuaguauacacaaaaucucaccacaauucacacagagauagucuggaacuuguaaccuaucuggcucuaaguaagcagagguaaugucaguccccagaacuagauugcauagauguggcaaggucaaaaacaguaaauggaacgucuacauguaagcacugcacacauacacaaaucuuucuguuguauuucacacagggucuugcuauguaguucagguugguggccuuaaacucaagaucccccuacuuuagacuccuaagagguaggguugcaggcauaaauuaccagguuuaauucuguaaaagauauaguagguuuuuuuguaaauuaaagauagggacucuuaacaucccaaacuuugauacucuaagaaacauugcuuuguauuaucuuuuuacagaaagauuuauuauguauauaauguucugccugcauuaugcuggcaggccagaagagggcaccaaaucuaacuauagaugggugugagucaacaugugguugcugggaauugaacucagaaccucuagaagggcagacaaugcucuuaacuucugagccauuucuccagcccacuuuguauuaucuuuaaaagcaucuaaguaauaaguuuuacuauauaaaaugacuuuaucagugauaaaacacccacauggcacccauuaugcccuagauucuccaguaccauaaaaaaaaucagaaaacagauaaaaauccauaaaacagauagaccacaacgaauaucagggcucgaaaccuaacucuccugcugguuuaaaaagcugugaugcugugacagggcugugucguaggacuugagggaugaucuuuguaguugagagcuaccccuggauagucagggagaaauugucccucaucuggccaaucacaccagaaacuguacagugcuaucauccuacaugaacuuuuuuuaaaaagcuacguuuauuuuauuuguggaguguguguguguuuauaaaccugccaugguucaaggacagccugguuuacauagcaaguuccaggacagccagagagaaauagugagauccucuucaaacacaaagggcaauuacgguguaaucccacucaccuauguccucaaaaaauaaaccuuagaaaguggagaagggggagaaagaaauaagaaaugauggcgaaggauacugauugcucuguagggagggagaugagauguguuacuuaaaagaacggcgcccagauagcuggcuuuguggguacauuuuaccaugcaagccuagugagcuaaguucaaucccuagauuccauguaagugguaaaggagagaagcaguuauacaaagcgcucuucugaccuccaugugcauucugugucaugcuuacucaugcaagcacaaagguguuuuguuuuuaauuaaagagaaagaaccagaggugguggacaacuauaaagaaacaauguuuucugucacaguacaacauuugcacuuaucaacugacaucaguugagaaugcaugcacacaaccugugcagggucaaagacagacaaauucccagcauggagugggggagguggacaucaugucccacccauagugaggaagcuaucauugauagcugcggcuagaggacucagcuuucuuuaaggaugugucuccugguggguugaccauucuagugauggauggucacacauccaagaguacaggagcagcacaaauuguguugauggguuuuaaauaaagaaacacaaaguuggguagguagggaagggaagagagaucugggaggaguagagagagggcgcaaacauaaucaaaaugcaguagacuaaaacuaauugaaaaaagagaagagaucuuaaaaagaaauacaaaccaaccaaugguggcacacaccuauaauuccaucaugugaaaagcugaggcagagagguuaugaguucacaggcagcacagguuacacaguagguucaaagccagcuuggagggcagguaugguggcacacaauuguaauggauagcauucagaaggcuuaggcuccugguccacauagugagacccaggacagaugaggaggcuacauuaagaccaggucucauagaaggaaaaacacucaucuugaguuguaugacaagaucaugcugaagggagaaaagaagaaaagaagaaaggagagagggagggagggaagggaggaagacagcagggauggaauaagagaaagagggagggaagaagagacgcaaaugaugguagauaccuauaaucccagcacuugacuugagagguacaggcaggugggauggagggaguaagagucuagccugagauauuuaccuaccucuuacaaacaaagaaacaaaaaacccuaaagagucaagggugacgccuggugguagagcacuuauuuagcaugcucuggguuugaucccuagcaccacacauaaaagaaagaauaaaaauucuuuuguuuaaaaaaaaaauaggggcauuggggcuggagagguagcucagugguuaacuauaguagcuggaguuugcauugcaggacucacacaaaauccaggcauccugcuuccaucacaacucaggucugaaaagacaggaggcaggaggauugcugggguuugcuagcuuccggccuauguaagaaaaugugagccucagguucagggagagacccugccucauagaauaggaagugcaagaggauggcacacacauccucuacuggccucuguucuuaugcacuagcaugcauacuugcacacacauacauacccagucagacacacaaaacaaugcacaaacauaaauacuacaaaaaguggaaaggaaacaagagauuacaaaaaugaaaagcaacuacuagggacagaaaaugaagauagaaaaaugaugcucuaggaaaugcaaaaaguauaaagaaugaaaaaugauggggaaugaagcugauauauauucugaagccacaaugagaaucuauuaagaugcauccugaagaacuggggaauagagucaagguaggaggaugaccacaaucugugguauagacguacauguauagaguucagcaagucagacagaugugaaacagggaagccacaggcaaaaaauaaagucugcauguaggcagugauaaaaaaaaaaguauggaaaggaauaggaagaugaagacauggaaauguacgguuuuauguaggacagccaaagaaggccuuaaugagacagugucuucucauuuucuucugaguaaaucaaugggucuuaaagcucagcauguaucggaaucagcucaagguuugcucaaacaaaaauugaugguuuuuaucacaaagauucugaauccauaagcuccuggcuaaugcuuuugguuuuuuacacauugaaaagcaaugggcuccagacaguagcgguuugagucuuuacuccacucacuugccagaaauauuugauacuuuuauauuauuuagaugaaauguuaaaaaucuuguaacauuccauaaaauaaaacuuaacacaugaaaucacacacucacucacacacacacacacacacacacacacacacacacacacacacacccuucucuauauaguuauaacuaguuuuaaaagaaaaaaaucaaaacugaaaaaggaaguauauaacuuuuuucaugagcagcaaaacacaucacuuacaaaauauauuuuuuguuugugucuuuuuguuuuguuuuuaaaauaaggauuuucucggucuuuaaacucacuaugcaacucaggcuaacccaggaauucaugagccuccugaggaucugggauuccagacaugcccuacuguaccuggcuucucuuaggguuagaaaacacaagcgcccccgacuuaccuuuauuaccauacacacuaaguuagaaaguuguagacaguauauuaaaaguaaacguagaacuuacuucaacaaucaagacauucuagaagaaaacagagaaaugaaaauuaguauaugaagugagacaguauucccaauuaucagugaaaucauuaaacaaauucuaagaaauuacccaaauucauacuugggaaauuucucaggaucucagugacucauauguaaacugaaaaacuugaaccagcucuccuuuuauguauuuugacucuaauauuccaagaacuguaaucuguauaaaugucuuuuaaaauaaugcaucuaacauaauauaaaaugcaaauuuuuuauuucuccaucaagcuaaaacuaguauaugguugugugcguauuugggaaacugggaaaagauaucaauacauccaccagagcccuuaaacccaccccaaccccaacucaaucuucuaguuaauuuuacucuguagcccagguugaccuagaacucauaauguagccaaaaauguccucaaacuggcagcaccauuucugccucaaccuacugaauaguaagauugcaauugugauuuaucaugccuggucugaguugcuaguuagagagauaaggugacagacauuucacaugcccacaauacucacuggacagauuuauuuuauacuguuagucuauaguucucaaaucacucugccaaacaaccauaacaucagaauugccaagucuucuuuauuacuuuaaguuagugauuaucaagguagaguacauagccuccauuggaguccaugaaaauucaaaauucuuucucaccuuguaguuugaaugaaaaauuccccccauaggcucuuacauuggaauguuugaucccuuguugguggaacuguuuuugagaaggguuaauagguguggccuuguuaggggaggcauauacugggaaugggcuucaaaagugacauuucaaaagccacaccgggucuagucucuaguacucucugcauccaaugugcauguaauauguaugcucuagauacugcuccagugucaugcugccugccugccaccaggcuacccuccaggaugauuacagacuuacccucugaaacuguaagcaagcucccaauuacauguucucuuuuauaaguugccuugguauuguguguauucaaaguaacuaaagacauacuucaucuccuuuagccuauaguuuaaguacuuuacaagauaaauuacuaccaaaacucaaguguaauuuaaaaauacauaugcuguggguaaaucauuuggagaaucaaagcugugcguuaaaaggaaauuauaaucaagaaaaacaucuaauauguccauguuucaaaguaguuuaccauagaaggcaguaucuuacagugcuauacaggucuaagaauguaagcccagaacuucuggcaaacaagcuacaacugcaucccauucuauaggcaggaaaaagccacuuuaaaguaaaggucaggggcuggugagauggcucaguggguaagagcacuggcugcucuucccgagguccugaguucaguucccagcaaccacauggugacucacaaccaucuguaaugggauccauugcccucuucugaugugccugaagacagcaacaguguacuuauaguaacaaauaaaucucugggccugagugagcagggaccgagcaaauggaguugaccagaguaaacaggaccaacuggagugagcagagguccuaaaacgcaauucccaacaaccacaugaaggcucauaaccaucuguacaguguacucacauacauagaaauaaauaaauuaaauaaguagguaaaucuuucaaaaaauaaaggucaggauaugcauagaaaauuuuaaaaagauauaaaaauuugggacauuuuaaagacuauuguucuaauacagagagagagagagaacugcuaccacugagaguuuauuuugucaaauagcuacaugucuacuuaauaauggaaacaaugaggcugaguagucaaaugaacuaccuaaaguaguaaacauugagaagggcaagagaaagggguuugaauaaagguuauuuuggauccaaagacuaccguuucaaguauuaaugggaaaaugugugcauuaugucuguacuugcauacacauaagauaaauuuccacaaaaaauuagaauguuuuaaauaaacccauaaucucaucaucaagauuuaacuuuacuaaauuuguauuccuugauguuuuccacaauaaaaagaaucuauuguggcugcucugagaaguuauuuuagaagcagagcucuguuuaagaucacagcgcuguguagagacagagccauuaggugaagaaggucaaacuaaaucccagcaggcuucgaaggcuaggccccugccagccccgaaaacggauuauagaagggcagguuucgaauagcuucuaaauauggacaaaccaugcuaaaagggaaagaggucuggcaguuguacaccaaauggacagcagagaggcagagagcgagaacgaacagauuacaaauucgccccuggagguucuaaacacugcugacagcgacauuaguuuggcgugacccugauacaggccuccagaauaccagcauuuuauguuaaaguucccuacagaguuucagugaaggaaguagugaguagugaguaaguagugcaagaaagcagugagcacuaaaccuaaaagcuagaggaaagaaagaauuuggugucagcaugcaagcuuuucuacuuccugguugcgugacuucgagagauuguuuacaucucauaaucccaaggaguuuuugaaacuguaaguguauuguuucauuuccugaucugcaaaauggaaauauaacugccuucacuagauuacugugaaaguaaccagguuaauacauuuauauauggcacagugccuacaaguaaaaaauaaccagccgcuuagaaaacauacacagucuaguaugggggcuuaugcuugcaaucccagcauuugggaggcugaagcaggaccaccaugucaaggccaaccugacuuacauaagagauguucaaagaugguguagacucuaaguaagacugugucuuagaaaaacaaauacacauagagaagcaugugugcgcgcacacacaccuucaaaugaaacuacauuugaaucuauuaaaaaaaaaagacugucccucuccagcuauauuuucugaaggaucccaaauuagaguuucaaaguaguauuauagaaagcaguaauuaaagccgggagugguggcgcaugccuuugaucccagcacuugggggcagaggcaaguggauuucugaguuugaggcgaaccuggucuacagagugaguuccaggacagccugggcuacacagagaaacccugucucgaaaaaaccaaaauaaagcaguaauuagcaauauggacugugaggguuaaugguauauucugcugucauuuggcuauaaaguccaggagauaauauuaaucuauaucaaguacuucuaagaguuaaacaauaccagcuuacuuuuacuaauaaaguaccucuaaguaagugguugaaagcaguuacuaauguuucuugguauaaaaauguucuuucuuuccucuucaaguuacauaccuuuccaguuaaaguugagagaucaucuccaccaauaacuuuuaugucccccguugacugaucauucuaguugaaaaaagaacaucacuuaaaugcaaauucuuguguauauauauauaagcuucucaaauuauuagauauaagcuauaagauuuaaaaaguuagcuaucuaauggccacaaaauuaugcuauucuaaauuauaaaguauaagaauuagguuucuagaaaugaaugacuagguaaauuuuacauagagauuaguaaaaauuaaaaaucuuaauugaccauuacuaguauuugaggcucugaagaguucuaaaacuagaguacaucuauuucugagugggcauauuauagcuacucaucaaucagguacuucucaacuacaaaggacaauuuauuagcaugacaggugucugcuucuggcccugaaccauuccugugagucacacaaguguaggagcuggucuauaucacauucaacccugaagauaugcccauaaaauauguccauauccuggauaugcccauauccaggucaucuucagaacugucugagaaaccaggucugauuacuagucuauuagaacauccuucuuagguucccacuuucugcuuguagagaaauuagcagaaaaccuuacagagguuucaaaggagagugauuaacacucacuagaguuggugggaauagcuauaauuuggaugugcugguauuaaaucagaaaacugaugauuaaaagaguguggacuuacucuacugggacagcaaagcauaccaaaaacugcagcaauuagcuugguauagaaccagcacagugaaugacaaaaaguucaaggaacccaauaaaauccagaaacagacccaaaaacaugagaauuuaguauaugacaaagaugauauuuugagucaguaauuaagagaugaauuauucaacaaaugguauuuggucaauuacuuauccauuugggaaaaaauaaagcaugguuccuaccucacaccaugcacaaaaauaaauuccagauggacuaaaaucuaaauguaaaaaauagaacuauaaguggauuagaagaaaauguaagaauauauuuuauuuuaaagauuuauuuauuuuauguauaugaauacacuguagcugucuucagacacaccagaagagggcaucagaucccauaacagaugguugugagccaccgugugguuucugggaauucguucaauucccagacgcaggaccucuggaagaagagacaguguucuuaacugcugagccaucucucagcccccaggaauauauauaauuuuccccuguauucuuagaaaggauaaaaaacuagucaugaacuccaacuaaaaagaucuguaaccacuauuccuaauguaaauucugcucaaaauaagaaccuaccaggugggacaggagagagaucagaauuaauagcacuugcugaucuugccaaggaccuggguucaguucccagcacccacauggcaguucauaugccuauaccuccaguuucaggugaucugauccccucuucugagcucaaauguaucaggcauccauaugguguaaauacauauaugcuggcauucacacauacacaugaagcaagauaaacaaaucucuuuaaaaaaaagaacuauuagaauacaaauagacaacugauggccaccugacagauucuacaugugauucuacuguucauucauccacauuuacagcaauuaagccugauaauacauucaggagaaacaaauacucaagcugcugguuagauuacagaaagcaauaugaccucuuuugaaaaaauauaguaaugccuauuaaaauuauaaacaugcaaauuauuuugaucuaacaaucccauuuccaagaaucaguguuacaaaaauauccacaaacaugcaagggaaacauucaaaaauguucacuauaucagguagucaucaaaaacaaaacaaaaaaaaacccagcaugucuuuaaaagggaauuacuuaaagaaauuaauacacauaaauaauacuaugaaacuauuacaaagaaugacacaaucuaauauauucuuauguggaucaauacuaauuaguaacaccaaguagcagacaaauauacuaccuauaaaacuauuuuuauucgguauucaaaacccuaucucaaaauuuuuuuuuaaaaugauagcucaguugguagaauguuuaccuagcauguuuaaggggaguggagaagaacaaaauaaacaaaaaauacuacuaguccaagcuguaaacuaaauguuggcuuuuuaauuuaaacuaguuuagccuaaaacucagaauuucaaacacacacaacugauuaaugacacaaagaaaaagaacuguacaaaaccugaaccuaguuaagauggcauuacacugagugcuacauaguaauaacaaacccugauaaauacugacaccugcuguagaaaaaugguauuacagcccaaugccaaguacuuccucuuucaaaggacagacauaaggaauaaauaucuaagaaugcaagugugauccaaaggcuauugcuauaggguccgaggcaacagaacuccaaagcacacagaacacuugcacgcuaagauguucacguuuccacagucccauucaguguuucagcuuaugcuucccugaaguuuuuguuaaggaaacagcuuccuuuuaaagggacacuauaaagagaaaaaaaguuucauuuaauaguuguuauaugggcuggugaaauggaucagugguuaagagcacccgacugcucuucccaagguccuuaguucaaaucccagcaaccacaugguggcucacaaccacccacaaugagaucugaugcccucuucuggugugucugaagucaccuacagugaguguacuuauguauaacaauaaauaaaucuuugggccagaacaagcagggccugagugagcagaguugccuggaacaagcagaggucuuaaaaauucaauucucaacaaccacaugaaggcucacaaccaucuguacagcuacaguauacucacauccuucauucaggugucacuacugucaacuaccaaaaauccccagaggaggcugaaggggugguucagagcaacggcuuccagaagacccagguucaauuuccagcauccagcauuucaacagucuauaacuauauucuagggguccagacacccuauucugcccucuguggacuucaagcacacauaugguacacagacauguauacaggcaaaacacucacuuuauauauauuuuccccagaagcucagguuucuauaaauacagccguaauguuucuuucuacuuugucuaccucuuagagucuagauggaaaagugggagugacaagaaagaaguuguauuccuauuuuuccaucacuaggauuucuggcaaccucuaaauagaaacaagagcucaggauuuagagcauauuugcuuagcauauucacgaccuuagauucauccaacacucaaauaauuacaaacuuaaaaauaaaacucaaaacauuacuuguggguggagagauggcucagcgguuaagagcacugacugcucuuccacaggucuugagcaaccacaugguggcucacaaacauauguaaugauaucugacgcccucuucuggugagucugaagacagcuacaguguacuuacauauaauaauaaauaaaucuuuggguuggagcaagcugggccggaacaaacagagguccugaguucaauucccagcaaccacaggaugguucacaaucaucuguacagcuacaguguacucauauacauaaaauaaaauaaaucuuuuaaaaaccauuacuuguuuacuaacaacccuuucucucaaggucuaguuuuguucuucgacgauuuuagaauuuuauaaaauugaaauaaaagucaaaauaggacacauuuguguacuuaucaaauguuucauuuuucugaaaguuacagagcacuagggacagaaaaaaugucaccaaauauauaacacuauauuucacuguuugaagaugaacauucauacuuuacuaccucuguaaacaucauaauucauggcaccauacaacuauaacuggagguaguuucuuucuuaaaagcacacaaauacagugguuuuaauuaguggacuuuuucauuuaauaaaauagauauuuggacuccuuaggcuguuuugcacuuggauuguuaaauaccuccugggcuaauacugauuauguaagcuauaguuguauguggggacauguauauauagagaaaacucuuaauauucaaaauaaaaagugaugacaggaguuagagagaugguccaacaguuaaaaguaugugcuauucucauagaguacccaggcucaguucccagcacccacauggugacucacaaacaccugaaacuccauuuccaggggaucccauguauucuucuggccucugcagacaugaggcacucaagaugauccauauacucaugugcacaaaaaaaccgcagaaacauaaaauaaaauuauaucuauuuuuuaaaaaguagacuuuggaaagacaaucuuuuuuuucuauaacuuucugcaguuuuaauuuuaaaauaaauacauauuuuaaccaggcagugauggugcacuccuagugcugggauugaagggggggaaucacuaaguucaaggcuagccuggucuacauagugaguuccaggacagcugggacugcacagagagucaaaggaugggaagggggaaggggaagagggggaaggggggaagaggggaaaggggaaggggggaagaagggaaagggaaaaaggggaaagggggaaaaagggggaagggaagggaagggaagggaagggaagggaagggaagggaagggaagggaagggaagggaagggaagggaaggaaaggaaaggaagaaacaaacuauaccaucauaauugugaauggugaaguuuuuacauauaaagaugacauuuauuuuguuucaucauacugucaauacucuaaaucauuucaaacucuggcaaagguaaaguggucccaggccaaaaguauuuucugauuuccaagaaauaaucauuaaccuuaauaauuaaggcuuugcuucaaauaacuuaggauuccucucagagcaauuaucuccagugagaguauuugccaccagcauacacaguugagaaaacaucaagucucaauagcaauucuuuuuuucuuaauuuuauguguauggggguuucugcugcaaguuuguuuccuaugugauugccaggugcccuugcaggacagaagagaguggcagaucccugggacuaaagggacagacucugugagccacuauguaagugcuaggaauugaaccugaguccucugaagagcagccagugcuuuugacuagugagccaccucaccaggccuagaauucucuuaagacugagcuauuuuuauauguuuagcaguuuuaccugcaugcccauauacaugcagcuuuaccacacagauccucuggaauuggagcuacagauaauuguaagccaucuuugaggugcuaguaaccaaaccccaguccucuacaaguacuugugacugcugagccaucucuccgccucauucaauagcaauucuuaggcguuuuuuuuuaaauaugaaaauacagcuagguguagugauaccuauacuuccagaacaugggagauuaagacagaaggacuauuugagccaugcaguuugagauuagccugcccagugccaugaaacaaaucaaaauccagaucaaaauaagacaacagagaaacuguacaacuuuuuuguuggucaugaacuacaguuacuauucuguguugugauaugaaguaucagugaaauaauaauaauaauaauagcaacaacaacaaugaucauggccagaagugguagcaccugccuguaaucccagcuacuugagaagcugaggcaaguugacugaaauuucuagaccagcccacguaaugaguucgaggauagugugagcaaguuagugagaaagggucucaaauuaaaacuuuaaaaaaaaugccaggcagugguggugcacgucauuaaucucagcacugggaggcagaggcaggcagauuucugaguucgaggccagccuggucuacagagugaguuccaggacagccagggcuacacagagaaaccuugucucgaaaaaacaaaaaaaaaaaaaaaaauuaaaaaugacuaggaugaaugaagcucgguuauuacaguacuuaguucccuggguucuaccccagcacagaaaaauaaauauguaauaauaguaauuccaacuauuacuauauauauuacauaaucaaguaaguugauuauguagcauaguuugcacaaguuuaaaaaaauauagauaaaacuagaauggcccuauuuuuuuaauuauaaguuaauuauacuuacacaguagcucuucagucugauaaaaucuacagucauaggaauggaucuaucacuauuucuauucagugcuuuaauguaauccagcaggucagcaaagaacuuauagccccccuugagcacacagagggccacaaugugauggccucccaucuccuucaugacaucucgagcaagucuuucaguccuauagaaauaaaaucaggaauuaaaaagaagauucugaauauuuaucuuuuauaacaaauacuucuuacacauuaaacuuuuacaggacacauuccuugucucuaugaagggaauucuuacuucauaaagcaauauuuugcagaaguggagacuauuuuucauauaccaaagguaagauuuuggggcaugaggaaagauuaaagagaaucccucuaaauagcccaggcuggacuguaaucauaauccuugucucuacuugccugugcugagauuacagauauacaccaacacaccagcucaaccaaaauuaaaaccagauaccuuucagaacaagaaacaugccaagcaugauggugugucucaugagcugaaggacagccuggacuacagaguaaguauuagaucccuuagggcuacauaacaagauccugcugaggaggagaggggaggggaggggagaggagaguacacuauaacaucuaucauaaaauuuaaagauacaaauaaaaacaagcuuacuagauuggcaaauuuugguuaaauuuuauuucucaaauauaaaauacuagaagagccuaaagaaaaaugaacucucacauaacguuggaaguauaaaaugauguaacuuguuggaggacaauuugacaguucagaagcauccacuaagcaccauuuccuugaccagugauuuuuacuugucuaaagcugagcaagugucaaaauguguauuuaagauucauucccucuaauauacucuacuaaguacaaaauaaugaagaucugguuaaaucaguuauggcacaucuaugaauagaauagccuauaaucuuuaaaauaaauguagggggcuacagagauggcucagagguuaagagcacugacugcucuuccagaggcccugaguucaauccccagcaaccacaugguggcucacaacuauguaugaugagaucuggugcccucuucuggcaugcagauguacaugcaggcagagugcuguauacauaaauaaaucuuuuaaaaaauaaaaguaaauguaggcgaauugggauguagcucagcugguagagaacaugucuaguaacacauaggagguccugaguucuacucucacaacugugcaaacuggccaugauggcacaccaggaguugaaguagcagguucagaagcucagaccauccuuagcuacacacugacuuagaagccagucuaagcuauuugauacccuauuucaaaaacaaaguaacauguagggcugggcacaguagcacauaccuguaaucuccacauaugagagccuuucagggggacugcugaguugaggccagucugggcuauacagaacguuccaagccagacugagcuaaacagugagacccucucaaauagcaaauacuucauacacacacacacacacacacacauauauauauauauauauauacccugaugguaaaguaauuuuuuaaagauuuauuucauguauaugaguacacugucacugucuucagacacaccauaagaguggaucagaucccauuacagaugguugugagccaccaugugguugcugggaauugaacucaggaccucuggaagagcagucagugcuccuaacugcugagacaucucuguagccccguaaaguaauuuuuaaaagauaaaaaacaugauagcucuagauguauuaauaugaaaaaguccauaaauuuuaguacuauaugacaauauguaacuugugugugugugugugugugugugugugugugugugugugcgcauauacuuuacguacaguguauuugaauugguauugucuacguagaaaauauguaugguaagcugagaaaacagaagaauaaucuuauacagccucgauggacaacgagagccaauucuucuaaccucucuucaagaauguugauuuacuuacuauggauucccacuaguuaugucuaaaacuagguaauuaauuaguaaggcuuccuuucucucuccucucucugucugugugugugugugagagagagagagggaggggagagagaaagaggaggcgagaggggggaaagaggaggaggaggaggagggagggagagggagagagagagagagagagagagagagagagagagagaaagagaaacgaacuuuaaaaguagaaagccuuagggcuagaaagauaguuuaucaguuaagauccuuacuguuuuugcagaggaccuaaaguucaguucccagcacccauacacagugguucacaauggucuguaacuccaguuccagggaauccaucacaauucugacauccuggaauacauaugcuucacauacauacaugcaggcacucacacauacaaguaaaaaauagaaaacauuuauucuaauaaguuggcuuagcuuauauucaaacaucaacuacucaacaguugcuaaguuagaauuaauacaagaaaaaaaacccuuuggcuggagagguggcuuggcgggugagagcacuugggcacgcaucaggcccuaaguucagaucccccaguacccauauaaaaaccagaugugguugcaccugcuuguaacgucagcacuggggggcagagacaagcagaucccugggucuugcuagccaggcagccuagccaaaucaguauguaugccccagguucagcaagagacacugauucaagggaauaagagagcaacagaguaggacaccuaauguccuucucuggauuccauguacaugcaauacacuucacauauauaucacacaugccucuccucucucucuuacacacacacacacacacacacacacacacacacacacacacacacacacaccacacacacacccucuaaaaauaacuucaaucgaggucuuacuaaccuguccauaaucaguccaugaggaauaaacacuuuuuccaaauccucggcauaaugauuagguauacaaaacaaaucuaggucauaaccugguucaucaucgcuaaucugcaaaagaaagacagcuguuucaaaguggagcauuauaagauaucaacauuuaauuacguuuagauaauaagucuuaguuuaacagaggaauuuagcuacaagaggguauguagagcaguuaaauguuaccguuuuguaauagauuauacuucucuaagaaagccaugcugcgucuuacugcugaauagagucaagaaugaaaaguaaaacaugacacaaaauuuccuuugaagcacaaagagaaaaagaaaaauauuaaagagguaugaaaaauguggcaaaaauaaauauuuuaggcaugaaagauuaguauauacacuuuauuuuugguuuuuugaggcaggauuucucuguauagcucuggcuguccuggaacucacucuguagaccaggcuggccucgaacucagaaauccaccugccucugcucccaagugcugggauuaaaggcgugcgccaccacucccggcucuacacuuucuacucuuauacauuuuaagaacuuuugaaccauuuuuugugugugcauguguuuauggguguguauauauauuuauaugcagguacaugugcauacguauggaguucagagauugaaauugggucuaaaaaauucacuucuuauguuuugagacugagucucucauugaaccuaguuaaccaaauuugcuagucuagcuugccaggaagcccaggggucucccugucucugucuucuccaugcugggguuacaaacgcagguccugaagaugacauggcagacacuuuacagaaugggccaucuccccaauccccuaaaauauguuuuaacacaguauauucuaguaaguuaaauaaaauaucacggggcuggugagauggcucaacgguuaagagcacugacuguucuuccagagguccugaguucaaaucccagcaaccacauggugacucacaaccaucuguaacgagaucugaugcccucuucuggugugucugaagacagauacaguguaccuacauguaauaaauaaauaaaucuuaauaaauaaauaucacacagaauaaaaauaaaaacugguauuaaccaucuaaauucucuaaauucucagaauccaccccccuguguguguguguguguguguguguguguguguguguguguguguguguguaggucaccaaaaaaaacugauccuuuacaaacucaaacuuagaagucugagaugguuacaacuuacuaauaagauaauuuuacagaagauauuccaaaauuguuuugcauuguauaauauugguuauauuaguaugcccagagcccagcauacaaaacauuuaauagcauuaauuaggguuaugguacuuuggggguaaaauauauuauguuaguuuuauaaauauacaugcaccuguacacacagaaaaaaguacagcaaaaucauuaaagcaagcuaaauaugcuggacaucccuacuaacccaguacuugggaagaugagguagaaguuccugaauuuuaggccagcaaggguuacuaagugaaucccaagccaucuaggagcuaccaagacccugucuuuaaaaguauccccaaacuccaaaucauaaaagccauuugacagugaauuauagugagauauggggggcgggggggugucauggauccuaaacuggccuaaaacucacuaugcaguugaccuucaacuucugaagcuucuccuucuuuuagauuaugagcaugaguauaucacacccaguuuaugcgaugcuaggugucaaacccaggguuucaugcauaccgggcaagcacuccagcaaccaagcucaucuccagcccucuuuacacuaaaagcaaaacaaaaacuaaacuacaagaaaagcuuaaaagaucauaaguuaaucuauuaaucaaaacuuaaugagaggggcuggagagauggcucagcggguaagaacacugacugcucuuccgaagguccugaguucaaaucccagcaaccucacgguggcucacaaucaucuggaaugagaucugaugcccccuucuggugugucugaagacagccaacaguguacuuaucuauaauaauaaauaaaaaucuuuuuaaaaaaacuuauugagagaaauaagccaggaagaauuagacuacucaaucuuacaugacauucccaacuuuuaagccccaucuaagaagcagcagucccuggcacgguguuguaagaacuaaagcaucaagcugcacauggugucacacaucucuaaugccagcacucggguacaaaggcagggauaaucacgaguuaaaggccaaggugaccuacauagagagcuccugcccccaucccaaaaaauccucuaaaccgaauagacuacaagaccugguugucuacgcucuggcaguuuucaaggaauauuggccaaaucauaacuaaauuucaucauaucugugaauucauacagaguucuuccuuucaguuaacguuuuauuaggugcuuucgucacaagugguuugacuuugaaaaaaauuaaaauuacauaaguuuacguucuuugcagaauucacuugccauuguuuuugagauggaauugcauugcauagcucaugcugguuucaaacucacaacccuucuucuacuuuccaaguacugggacugucaacacccagcucagaauucagauauauuuugagguuucucccagagaaaaaaauuaaaaguuguauagucugucugucucucuguuuagucacaaaaggucuauuuugagcucaauguuugauagaauuuuauuuauuuuuaggucuguucacaagaaccugcagcaugcagaauacugauuuauucuuaaauacacauguauuuuuuuucauaaucagaaaaauuugugaaacauuauggcaauuucuuuaaaaaauuagagagcuaaaaaaaccugcuuaacauucacuuaauauuuauauuaggacauuuaguaacaaaaauagaaauugggcauuuguaucauacaaaggaauauucaaagaguauuuuacaaaaaaagcauuuuuguaaguucuauaaagcaaauuuuaguucauguuuuggggaaagaugacagacugcucaauuuuauaagauaacaacaauaaauauucaggccaggcucaugagaacuuauguacuaccugacaaaaauaaagcuggauuauuucaaaguaccuuagaaucaaaauuagaauaccacaaugacuuuccugaggcauucucauacccucugcccacucacucuguuucugccuuaagccuaucacacccagguuucaucagacuacugcaccuacuaaaauagcucaaugccugguuacagguucuacagguaaccuaccuaagaacuucaaagacuguuucaauuaaagacaaauccaaugugaacucugccaaguucaucccagucuuuuuauguguguuugagacagggucuuacuauguaacucuagcuguacuggaacuagcuauauagauuagguuggccucaaacuugcuaugaucuuccucccucugccucugagugcugggauuacagaugugcacccaaguagucuaagaauacaaacaucaggaauuacucaaaaauaggaauucuauuuccaucaacacaccaaugcaaaagucuugauuucuaauuaaaacaaauucauaucugagaauuuuuguuuuguuccucugaaaugcuuauaguuauuuuaacauuaaaaaauuuguuucugauuucagauugccuuggcucugcaguacaccauaaacuuaaucucacgacauagucuaagcuauccucaaacccggggcaaucuuucugccucggcuucucauaugauggguuuauggguaugaaccaucauacccaguuuauuaaagccauaucaacauaauucuucuccaaaaugcaaaaagucuuacaacucuucacuugagauuguguguguguguguguguguguguguguguguauuuauguggucaugcaugugugaacacaggugcacagaugugacggucacauuucuguccauucuaaaacuuugaacaugcugauuacuagucauaaaauucaaaacaauuuuucuacuaucuauuauucucucucacacacacacccuuuccugucucaacacuaugugacccgggcuggcuuggaacucuuccuguccuuguuggggauuuuuuguuuuguuuuggaggguuuuucgagacaggguuucucuguauagcccuggcuguccuagaacucacucuguagaccgggcuggccucgaacucagaaaucugccugccucugccucccaagugcuggguucaaaggcaugcaccaccacugccugguacuauacaacucuuaauucacaauaguuuucuucucugagacagucucaugagcucaggcuggcuuugaacucacuauguagcugaaccuucucccccugucucccaaguagucauuuuaggacucacuuccauuuaauggagucuuguuugggcucaugaacaauguuauauuuuacuauaaagagacuuaaacaauccaaauuguagacaauaaccugacauuccaaaggucguauuagcuuagguucauuuccuuuuucauauuauuucugauaauguaccuguguaacaggaaauuuuauguguaaaucacaaggauugucuuucaugugauugccauuauuacaaaugugcacauuuuauaauagggauuugugcugggcaugguggcacauaccuauaaacucagcauuuagaagucugagacagaaaacuacuaguucuuggcuacacagugagacacuagcuuaauucaaauauauuaaaauuuuucaaaaacaaauaaaacuuuuuaaaaaaaaucucaaaaaaagcagaugauaagcuauccuugagauaauuuauauuaugucuggauaugauuaaacaaaaauuauaauuuauugauagauacuccuaaauaugaaaacaacuuaaaaugguacuauguucauuuucuuuuuuuuuaucaguccuacaaauaacauacauagaguauuuguuuccuuuccaaggguuaaagcuauaagaaaaauuaaaauaagguaguagacuacucagcccaggaauaaguuauaaccacucuaggcaaguaggccuguaacuaccauaucuguaaggacaugaauuaaaaaaaaaaaucuugccgggcggugguagcacacgccuuuaaucccaggacucgggaaguagaggcagguggauuucugaguucgaggccagccuggucuacagagugaguuccaggacagccagggcuauaaagagaaacccggucuugaaaaaccaaaaaaaaaaaaaaaaaaaaaaucuuucccuuuacuaauaugcauaguagaaucauagauauuuugacacuaaacagcaagaaaaaacugaaaguaguuuucaaagcaauuugaagugucugaauuccuacuaguaacaaauuauuuaaaugguaguuauuuugguaguccucaacaggaaaauaacaaguguaucucaauauuacuauuacugguaguaauuaacacuucuaugugaucuaucaauguuaguaaauccaccuaacauaaaauuacagaaagacagaacaaacacaauuucaauaccccuuuacuauaggggagaaaaaugacauggaccauuguuuaaucuaauuaauuauggaauaaaacacauuccacugggaauagggugauacaccuguaguccuaaguaccuggaaaauuaaggcagggcuagccugggcaacacagccagaucccaucucaggcugcugagacgguaggguggauaaaagaacuugcugccaaacuuaaucugaauuuaauccuaaggaucuacaucagagaauuacagaaucaacuaaggcaaguuagucaggagacuaaggcaggaggauuccagguuugagaaauuucucuuggucccaccccuagacaaagaacuacaggcaaccaaugacaacugugagaagaauuagucacgcccaggaagagcucccuuuuuggcuauccauugcggagugagcaaccuugaacccauuuacacacaaacaaguauaugugcacauacauacauacauacauacauacauacauacacauguguagguaacaaugauaaucaaagaaaaagauucuagggugggcaaaugggaagaacuggagggagaaaagggaaggggaaaaugauauaauuccauuuaauuugucaaguguugugacucauagcauaccuugaauccuagcacuuggaaggcagaggcaggcagauuucugaguucgaggccagccuggucuacagagugaguucaaggacugccagggcuauacagagaaacccugucuugaaaaaccaaaaagaaaaaaaaggaaaagaaauuuaaaaaaaaacuguaaaggucucugaacuaccaauugcacaaaaauaaaaaagugaaaauucaauucaugauagucauuaauaaaauaaguuagcuguuuuuucuuucaucuaaaauuuacaaaguaaaaaaaaaaaaaaacuacaagacuaggcauagcagucuaugcucauaaucccaacacuuaagagacuaaaacggauucccagucugagacaagccuggccuauauaaagaaaauauaucccagacuaaauaaaguaaacuaaucccucacaaaaagaaccccacccaaaacaauaauaaaacuguaaggcaucuuuuuucugauauaauuaagucuuuuucccaccugcuacaauaauccagauuauuuuuauccaaauaagauagacauauaacagagguaacaagaguauaaaauuuacauaaagaaaccucuaagagggacuauucccauuuuuuggugaucaaaauaauucauuuuggucuuauuuauaaauggauguuauuuuagacaccauugauaauaauaaaauaguguuaggcaaaaacuacaauauuuaaccaauucugagagaaaaaaaaaaccaugggcuagaaagacggcucaaugguuaggaguacuuagacugccugguuaggccuccgugggagaccugcugggacuagaugcccagagugggguaugagcaaagugggggcuccccuucucugagggagggggagggauuuguaaggaugguaggguaggacuggggagagaggagggagggugaucaggacauaaagugaauuaaaaagaauuaauuuuauaaaaguacuugcucuugcaggggaucuagauuuaguuccccaaacccacguggaggcucacaauagucuguaacuccaguuccaggagaugaaaugccuucuucugacauccacagacauccuaaugguacacacacacauauaaugcaggcaaaacacucauacacauaacaagaaaucuuuaaaaacugaaaaaaauuagcagauagauaaagguauagcuuaauggugaaacaugcuuauuagcacaagaccucaaguuagaucaccaaaacacagauucacuuucauuagcauaccaagcaugguagaaugugucucuuauucucacaaagugaguuaggagaccagccuaaaacuacagaguauguaucucaaaaaaaucaucugagccaagggugguggcucaugauuguaacucuagcacauggaagacuaaggcagaaggacuguuaguuuaaggccagcaggccacauuaauuuacagagugugucuuugucucaagacacuauaaauuuugaaaaauucauuaacaagguuuaaguucaguuaguauauuauacuuucaucugggcuauuuugaaguucaaguguauaccauauaaaacauaucugauguuucacauuaguuuguaagaagccagaagccuuuucuagacugauaguuacaagcagcacguuuuuguagcucucaagcauaucuaggggcccauuucaugaaaguaauguagcuuauauuuacuuccucuaccuuguaucaccccagucauguucaucuacacaaggggcacuuauuauguaacuuauugguauuagguaaaguccacaaaacauuugucauugcugaagacagaacaaguauuucauaaacauucacuguagcuccuaacaagucuacugguuaaggguagaaucuggggccagauuaacagguucaaaugugguagcacugacugauaugggcaaguuauuuaccuugucuguguaauuuuuuuaaaagauggagucaaguagggguugaaggauggcucagaguacguauuguucuucaggggaccuagguuuuugcuauccuaguuuuuuuguuauuccagaugaaucugccgauugcccuuucuaauucguugaagaauugaguuggaauuuugauggggauugcauugaaucuguagauugcuuuuggcaagauagccauuuuuacuauauugauccugccaauccaugagcauaaccccuauggcagcucuuuuggacuccaaagcaagcacauggcauacaugcauacauauaggcaaagcagccauauacaggaaaaaaaauagaaauaaaagaagucaaaucugcuaacgggcuuagaagagcaagcagcauguaguaagcacuuuuuaaguguuuguuauuccuagcaugcagacaauuuaggggaaggaagcaaaaaaaaaaaaaaaaaggaacaggaauuuacaaacuaaaaauacugugaauuucuuaauguucaaacaaaacuaagaauagccacuucuagcacaaagaacuaauuaacucuacacugaacaaguaccauaucuccaagcuuaaaagcagccauauccgaauaaaaguagcaccuacuacauuaucuacugaauccuaccauaguauuuauuugcauagaccucagacacagaccaagaauugagacagaacuccauuuucuaaaauguauccuugcuucuggugcuggugaucaaaacuaggguuuaguacauaauugaggggagcucucuacccucuuaauaacuugugucugauaaugugaacaugcccuuuguuacaggauuauuuugaaaacuaauaaggauagauauauguaaacaaaaugauggcuauuaugcuauucccacucagggacuauauaaguguuguuuauuaucuuacaguccuuuuaacaauaccagcagccagcaucucagguguaagaaaaauguacaaccuggugauagcauaugcuugcuuguaauucccacacugagguagaagcaagauggcugaaaguucaaggccuggucuacuuagggcaaugguugcacaggaagaaaugucugaaaaggaagcuucagucuaggugaagauacugaaggccacauagaacauauucuaagcaagcaggauucugggucauuaagaacacagugguuuugccuuaagccacaauaucuaauacacuaugagagaacaccuuuuuaagggcucaaaugguuauuaauucacccaacaaacuauuagugaaaacuugccacaaaccagacauugugcuauaccuaaagcugaggcuuguuuaggggccuggcuuuuggcccaguagaguagagagcuugcuuacccaguagaacaaggguucauucccuaaaaugaauuuuuaaaaaaccagcaagacucagugaugcaacauuugggaggcaagagucaggaugacugucacaaguucauggccagcuugauggucuacauuaccaauuacagaccagacagagcuacauaguaagacccugccugaaaacaucaagauaaaguacgugugagugggaaagucaaccaacaaguaaccagauaccugcuaaaucuguaguauauaaagcauaauaugacauuuaaggaguaccagaggcaagaauaagaauagagcaggcuaaagucguuaaucagaagcaggagcuaugggauguucuagcaagcaugaucagcaagguuauggcguugggauugauaggggagacagagcuuggcagguuagaaaaaauugagccaaugggagaaaaggcaggauaucugaagaugaguguggaaaaaagucauccaacguaacaaccaaauccauacuuuuuuuuuuuuuuaaauucccacagcauccaagggcaugggcucccaagucaaguguaucugaagccaaagcccauuauucugggccauggggggguaaaaaaacaaaacaaaacaaaacaaaaaacgagccgccuuuccacucuucagguggaaaauaggcgugauuuucacugccugggccgcagcgcugauucaacggagugauugcgcauucccacaaauaugaauuauggcaucugcagaauuaggggcaaaguccaggccugaacaugcccucucaugcggucgucuugggaaccgaagcuccuucuagagguguucccuggccgccaaaccccaaacuuguagagcugggccucucccaggagagcucccccgcccuccccgcgccugauccuuccugaagccgcccuccgccgcuugccaccgcgcgcguccgccggccgcacaugucaaguccaacgccauugccaccuuccugguccacacgcagccugcccucucucucugucggggcucacuggaggggcauccccacccccgaaccccgccaucccguccugcccgccgcccucauggggcaucuagccagacuccaggaaucccugaccgcccccgccaucaaagagucccggccgccccagcgcccagagcgggccucgggagccucagggcuccggccugcgucacugugccaccgggcgcauggggcccggcuguggggcucugcuggaguccccuuggcucaccacgacgcugggacugcgggucggcaugacgggaccggucggcucgcggcaaaaagcggucugaggaggaagccggcggaggaggugcuaccgcuccggaaagcagugagguaagcccaacgcucucccucgccgccucagcaauggcucagaaacgcugccggccaggcuccg

SEQ ID NO: 9496 - RNA, 824 nt, Mus musculus
cugcagcauaggccccaugggagggagacucuagaacagcucccaacuagaguugcugaucugugacucugacugggugugacugaaaguguguuguuagcgccucacuugcugcucagguaaaagugaaucaacugggaaaaaaaaaaagcacuuccuggucaucaaguaguauaccacccacaagagcgaaacaagaaaauuuguccuaaguccucaacaacaaaauggagaagggguccuuccaaaaggaauaagaaggguucugaagggcaggaaggaugacuugagaaaguccccauuucucuuugcaguuuaggaaagauuaagggguccgugggagugucccuggaucucuucgugucuugcuggugcggacccccaggugguacaaugagaggcaauggcccaacaggaagccucagugaggcucugcauuucuaguccccauuuaucccccuuucccaaagucaucacacaauucuacauggcaguggggacauggggacacccuugucacugccuagaagucucugagaaaauggcugcuuugugacaucccaaacucugcugugauuaaucauggcaccuccguuucccugaggagcccuuugagccuggagugaaaaaaaaaaacaggucaagaggcgccugggaacuggagaagaguguuaaacuucuggagcaagacuguacuuuuccugugaaaaucacuuuccauaaucuggaguauaggcauguaaaggacuguuggaaaacggagugugggugaaaucgugcugcuuugucuuauuaaaaagaaauaaaauacauguacacacacc

SEQ ID NO: 9497 - RNA, 2986 nt, Mus musculus
uguuggaaagcagggugugguggauaguggggaggaggagacucuuaccucagaaaguagaugaaaagugggauuaaauaaacugagacaauuugguaacaucuggaucacucuugccagcuccaaagucuuggugaaacuuccugcuaccuuguauaagucucauuuauuguccccggguuuugaucauuuauuggaaauuggugcaaggaacuuuugauaaucaaaaaaaaaucccucuggguagucccaguugguuuuacugaauacuauaggcauggaauagacuugucuaguaguuuccuccguucuuacaguaaucaccucgucauuaguuauuuuuaaggacaaagcaugagaauguucuagaugaaacauacauuccuggauguucucauacauugcuggcuacucaagcuuauuuauaaagacauuuguuaccaucgacaucaaaucacaaaucaagaacuuuaaauaaaugacauccuuaaauacuugauguuaaauacaaaucacuccuucuuaagccacgccacugaaaaucuugucuugaaauggccggcacugugcgcucuccucagcucccacuguugcuuuucaaaauggacacacaugagcaacaaguuacauucauuuccuuguuuaaacaaagcauucaggaaagcacaaaaaccauccuuuaguccuuaaccacaaaccuaauaacuaaaacaacaaaacuacagugccuuugaaagcaaaaaacauucuguauacaaauuuccuguauucucauuuaaaauuauguccguuuuucgaaacuaguacaaugaaugcuggguccuuuuaauuaauuaauaaaauauacagaguauguaauuaaacuaaauacaaaauuccuaacauaacagauaaugauccagugcuaacauaugcauugcuuaggucaugauaaauaaagccauuaauaauaacagccccacuccuuaaguuggaaugaaaauuccgucuuuucuuggcuauauuacaagucauuuuuacauggacacggaauuguggaggaaaaaaccaucgauggucaccuuuaaaaagaggagagagaaaagccguguuuaguaaagauacaauuauacuuuaaagauacguauuuuucucccaauuuaacuuuaugucccacacaaaugucacaucagagauugcaauuccucuuaauuuaacauuuccuuaguugacuacucauaaaaacaaaauucauucgagauaacaucaucaaaaacgaaggucuuacuagauaauuuuguuaacgaauacacuggaaucaaauucaucucuagauuauccuucauccauuucuuuucuucccaucacucuacaacgacuuauauccuuaaaaagccaucucacucccuggguuuguguauuuccccuugggcuuaacuuuacuuacgaaaagagagcacaaagagaugucuggucacuucuagagagggucauucgcugauacaauagacaaagaaucaauacuuuaggguuaccauggccccacccacuucagaaccacgacgggucaaaauggccccacccacuucagaacugcgaaggguuuggccaaaugauuuaagagccaaagacuaagccucuuccucucuucccaguugagaacguuuugucuuuuaauguugcagaugccaugcgcccccacacccaaaacaugaugcacagguccuccgcaccuuccagccaaacuuuuccaauacuggaaaaaaaaaaaaaacaacuaaacaaccuugaaaaguuuuaauuagcgagagacaauggaaaacgaauuuuacgguucuuuccaggacauucuuuacugcuuacaaaugaguggcccaaagucccauuuacagucugucaaaacuaguugcuccccacccuggcaaggcugacagccugaggcugcccgccccucacucauuucucucuccccaccccuccccguuuacucuucucaguccacuuucugagaaguucccuggccacacucacuugcuagacauuuuaaagaucuguccuccccccaccacgacccccggacacgcuuuccacccccacaccccacccagcgcgacgcauaacauuuuuuugagaauuauccccguaucuguuacagucuguagugaccagagacauaguugggggcggggggaggcgggccaaaaaguucccuucccccucguuuuuuucuuuuuuagauucuaagucaccucucacuccacucgaaaauggcgccgaaaucguagaacuucuuaaauuucauuguaagcuuuuugcaaagguuucugggauuuuccugcgaagcugcuccucagcgucgaccuagaaaacaagccggggaagcuagagagaggaaggaaaaggcgggcggggaggcggacagacagacggacagcgagagagaaagggcggagggguguggcgagguugugagguuagaagagcgagucgcggagacuugggagggcgcgagguggcgguggugcgggacaucgagggacagagggacggacagccggggaaccgggguucgcggggcgaggggcucacagagaggcguggcggagaagaaccggagccgggacggagcugggcuggaaccgggcuggaaucgggcuggaaccgggcuggaaucgggcuggaauccggcuggaaucggguuggagcggugcuggagccggcggagcuggcggaguugggcuggagccgagcgcaccccaagaggcgagcgggagcagccagcgcccagugguccgcagcagcccuagaaaaagccggcccggggggcguggccaugcgcugcuccgcgccccgcccaaccauucgcccgcucgcucggaggccccggagcggaaggggggaggggggaggccgugcggacacgcagagccacagccuuggccugcagccaggaagggccgggaaggacacggggagccuggaguggccacguacagagagccucaua

SEQ ID NO: 9498 - RNA, 2986 nt, Mus musculus
uaugaggcucucuguacguggccacuccaggcuccccguguccuucccggcccuuccuggcugcaggccaaggcuguggcucugcguguccgcacggccuccccccuccccccuuccgcuccggggccuccgagcgagcgggcgaaugguugggcggggcgcggagcagcgcauggccacgccccccgggccggcuuuuucuagggcugcugcggaccacugggcgcuggcugcucccgcucgccucuuggggugcgcucggcuccagcccaacuccgccagcuccgccggcuccagcaccgcuccaacccgauuccagccggauuccagcccgauuccagcccgguuccagcccgauuccagcccgguuccagcccagcuccgucccggcuccgguucuucuccgccacgccucucugugagccccucgccccgcgaaccccgguuccccggcuguccgucccucugucccucgaugucccgcaccaccgccaccucgcgcccucccaagucuccgcgacucgcucuucuaaccucacaaccucgccacaccccuccgcccuuucucucucgcuguccgucugucuguccgccuccccgcccgccuuuuccuuccucucucuagcuuccccggcuuguuuucuaggucgacgcugaggagcagcuucgcaggaaaaucccagaaaccuuugcaaaaagcuuacaaugaaauuuaagaaguucuacgauuucggcgccauuuucgaguggagugagaggugacuuagaaucuaaaaaagaaaaaaacgagggggaagggaacuuuuuggcccgccuccccccgcccccaacuaugucucuggucacuacagacuguaacagauacggggauaauucucaaaaaaauguuaugcgucgcgcugggugggguguggggguggaaagcguguccgggggucgugguggggggaggacagaucuuuaaaaugucuagcaagugaguguggccagggaacuucucagaaaguggacugagaagaguaaacggggagggguggggagagagaaaugagugaggggcgggcagccucaggcugucagccuugccaggguggggagcaacuaguuuugacagacuguaaaugggacuuugggccacucauuuguaagcaguaaagaauguccuggaaagaaccguaaaauucguuuuccauugucucucgcuaauuaaaacuuuucaagguuguuuaguuguuuuuuuuuuuuuuccaguauuggaaaaguuuggcuggaaggugcggaggaccugugcaucauguuuugggugugggggcgcauggcaucugcaacauuaaaagacaaaacguucucaacugggaagagaggaagaggcuuagucuuuggcucuuaaaucauuuggccaaacccuucgcaguucugaaguggguggggccauuuugacccgucgugguucugaaguggguggggccaugguaacccuaaaguauugauucuuugucuauuguaucagcgaaugacccucucuagaagugaccagacaucucuuugugcucucuuuucguaaguaaaguuaagcccaaggggaaauacacaaacccagggagugagauggcuuuuuaaggauauaagucguuguagagugaugggaagaaaagaaauggaugaaggauaaucuagagaugaauuugauuccaguguauucguuaacaaaauuaucuaguaagaccuucguuuuugaugauguuaucucgaaugaauuuuguuuuuaugaguagucaacuaaggaaauguuaaauuaagaggaauugcaaucucugaugugacauuugugugggacauaaaguuaaauugggagaaaaauacguaucuuuaaaguauaauuguaucuuuacuaaacacggcuuuucucucuccucuuuuuaaaggugaccaucgaugguuuuuuccuccacaauuccguguccauguaaaaaugacuuguaauauagccaagaaaagacggaauuuucauuccaacuuaaggaguggggcuguuauuauuaauggcuuuauuuaucaugaccuaagcaaugcauauguuagcacuggaucauuaucuguuauguuaggaauuuuguauuuaguuuaauuacauacucuguauauuuuauuaauuaauuaaaaggacccagcauucauuguacuaguuucgaaaaacggacauaauuuuaaaugagaauacaggaaauuuguauacagaauguuuuuugcuuucaaaggcacuguaguuuuguuguuuuaguuauuagguuugugguuaaggacuaaaggaugguuuuugugcuuuccugaaugcuuuguuuaaacaaggaaaugaauguaacuuguugcucauguguguccauuuugaaaagcaacagugggagcugaggagagcgcacagugccggccauuucaagacaagauuuucaguggcguggcuuaagaaggagugauuuguauuuaacaucaaguauuuaaggaugucauuuauuuaaaguucuugauuugugauuugaugucgaugguaacaaaugucuuuauaaauaagcuugaguagccagcaauguaugagaacauccaggaauguauguuucaucuagaacauucucaugcuuuguccuuaaaaauaacuaaugacgaggugauuacuguaagaacggaggaaacuacuagacaagucuauuccaugccuauaguauucaguaaaaccaacugggacuacccagagggauuuuuuuuugauuaucaaaaguuccuugcaccaauuuccaauaaaugaucaaaacccggggacaauaaaugagacuuauacaagguagcaggaaguuucaccaagacuuuggagcuggcaagagugauccagauguuaccaaauugucucaguuuauuuaaucccacuuuucaucuacuuucugagguaagagucuccuccuccccacuauccaccacacccugcuuuccaaca

SEQ ID NO: 9499 - RNA, 26417 nt, Mus musculus
uuuacgauccaucuuuuuauacacguauauauacuuuauuaaauucacaauuuuaggguauacacuaggucaacauuucacaaaacuuucuauuauuccaaaagcaguuaucauaaaacagugauuuauaagucagucaagcaaaaccaguaucuauaggauuuuauuaugguuucauuuuuuuguaguaguuuucaaagagaagcugaaaauauaugauauaauaugagaauaggaagaaagaauuuuacuuuauaacaagaacuacauuucaaauauuagacuuuauauaaaaauaaagggguacugucaacaaagcugcucuguggauuagcauauuaccaguuuuauuuauuucaaaacaaucccugcacaaacuuagcuuucuaguccauuuaaacaauauagaagacaacaauaauaaaagguuacuuuacaacgaaaaagacaagaaugugauaagggaaucuguaagaagaaguggugacugaugguugggacagagaugcaggaggguagggggcaagaguaaucagaaugaauuuuaaaugaguauggaauugagaaagaacaaauugaaaacacucaauuagaaacauuaguaaaagaguuggucucaaacaguaaagggaauccugccucuuugaucucaucauaccauugggacaguuucaguuuucugcucugguuuuaccuuaccauugaguuuuaaacacaaauuuagguaucaucacauuucaaagauuauuuuuuaagaauccuaaaucuggacucuaaauuugaacugcaaagugucccuuuaaggcaaauaagacagaagagugaaggcagacaaaucuccugaaagaaaaacucaucucuuaucauuacgaaggcaagagccuuugaauacgguucauuaacagaguggauacaccgagugcuaucaaagaauuguuucuuuaaaauagcacaggagugggcgagucuucuaacagcacauuuauguuagguuuggaggauuaggagcuuuucacaggcuaaagaaacaugggaacucaggccaguaauagcuuuuaugacagugauuacaauguaaacuuaagaccugauucuauaauggaacugcagcaagcuaagugauggucucugauaauuagaagagagguuuugcuucaagcucacuaauuucuagucuguaaauaccuucaaaccaccuccaaggacuuuagauuucaaaagacuuaugcuuaaucauuuucuguuuguuuuuuuuuuuacauucacuuaauaacacgauucuagugggaauauuaaacaaauaguccauccaccagguugaacauuaaaagaaaccuaaccgcacagacaucgcacuauuacaccauuucuaguguaauacauaauaaauacugccacaauagaucacacguggauuucuuaaauauuuuagucaggaguuuucuuuuguaaaaauuacagaguauauguuacgucacacugcauauacacugcuuagagcucaaaacacuucuggaagcagagggcacagcaguacugaccuuuuuagcuccucaaagcuuccuuaacugauauuaagauauuaaacugaccucuauagggcaacaaggacaagaagaggguucugacucuagcacagcacaaaaaccaacaacacccggucaccacaugacagaacaaacucaaggacaacagggaaucaggaaaaaaaaaucaaacagaauagcacgcacauacagaaagcuuccauuuccacaagacccuacgacacauauucccuacaggacggcaauguaccccaaggcaccuaaggccucauaauacuacccaagacacugacagcuucauggacgcuugcuugcuuuuguacagugguuuguguaaauaacuauucguucauuuguagaugcuccacacaucuggucaaggcaggaauuucuucuccuugauaacaccaccuagaaauaucaacaauauuuuauauaucccuuaaggcaccagguuuggggagaaaaauagcaacugugauagcaaaguccuaagacccugaggugacuaaugcaggcauccuguaagucuaguucauucuacauuguaaaaucagacguuacugcauacauuccaauagcaaagaagcaagaaugguggugauggaagcaacuauggguuucuuccccuuggugagaaauggcaaggagcaggucaaacaggcaagggaaacaaaacaauguucuuuaaagcugaugcagacaaaaugaaaauuugauauaaucaaaaacaauuugaauauuaccaugaaauaaagagaugggaaaguauguagucaacagagaauuuuuauaaaucucucaagcaagagaauuucugauuaacucuguuuugccacugcuagggaaaagaacaauuauagagaauaugcaugaaugcuccccuuaaauguuugaaaguaggugcucuuugaggcacuagggaaaaaguccuccaagcaaucagaaauguguauuugagauuuagucaucaaacgcaaaaugagaucagcccaaacagauguuaguaaggugacucugcuugcaaaauugaacuuuagagagagaugcccagaaauaggagcaucaucggaaugguugcaaucugccaaacuuuaauccccauuguggaucaaaguucuccgcauuccucacugaauguuuuaugugggaaacaguuaaaacacucaaucagaaaugguuaagucacuugggugagagaucauccaucaagaugaacggagagcaugaauuggagcaugcuacuggagacucugcgggagcgcugccuguagccagugagucugaggacaagccacugcugauacuacugccauccaaaauaucugaacugaggacaaagcaaaaagaauuauaagcgaaugcauguaucagggucaacauaacaugcaaugacaugauuucacggacacacgcaucaguacagcaucgguaaauaauaagaagcauaaaggccacagcacugaaaugcauacuacaccauguugagagacuugugaaauucauaaagccacagaaacccaaagugaaacuugccacacugucucauauacuuugauuaucccuauggaggcgccugacuaucuaacauaugguaacugucccucuuaccaugccagguuuauugugagggggguuccuguccucugucugaaauauuucuaucuucauauuuaucuucuuaccuuucaagagucucagagcaagaauaaccucuguuauuaauaguuaguaagcuauuuguucucaaacuugccgagugugccuucagaaauauuacuucuauuuuugaggaaagucuuucaacugccugaaacugaccauuuuccuugcccacucccaagaggcuucaaggaaaauauuuugaaugauuuuccccucuaaguacaugucuuugcuauucuuuucauuuuaugaauccguuuuccuguuucuuuacagacccaaauauccccugcuagccauaagagccuccuuuuuuuccaccucucaguuccucuccaccugagcuucugaaaugcucucuucucacagucuccaucacgucucuuuaauccaaacaacuggccucugcucucaucuucccccugaaacugauuuggacaccaagggcuuccauaagcaaucccagggacaugcuuuccaaccagcucagaugcccacaaaucaacguuggccugccuucaaaaccuggcuucuucauacuuuccauggaaccaaaacccucugcuugacaucaagcugccuuucuugguucgauucccagguauuguagaucuaugcucuguauaugccuugaauguacucauucccuucuucuaauauuuacuaagugccugccaagugcagaagguauguagauacuugaaggacaaugauguaaaggaaagacaagguccccagccucacugaauuuacaggauaguagaggagacagagauuuaaauauucaggcucauaugaaaauaauuacacuucaugacacgagugauaaauggaaaaggauccaggggguaugagagucugacauauggguaaccugaucuaaccugaucgcagugaagggauucuccgaagugagauuuguguucugacugaaggaugaguagcauuuacaggaaggguuaggaagaagcaagacuaggucuggaaucacagaggcaggguagagucaagagaacacagggagagaugaacugaaggaguaguccgacaguuuaaguuuacacagacacuuuuuuauuuuuugaaauggaagaaaaacauagacuuagagaaggaaauacggguucuagucugccacuagcuccuuggcaaaacuccauuuuguucuaauaaguggaauagaaaguuacaccuuuaauauuauuuguguaaguuuccaaguugauuucuucccauuguaaagaagcuuauaguacauuuguaagucucgggcccacacuguucuccugaaaggcaacuguuccucucuugccuuucuacucaugugaaacgucaucucuuucuuucaugauuuuaccugcagugcuaaggauggggucuaggcccucguucaugaugagcaagcauguuaccacugaagcuacaucauaguccccuccaccaucucuuucgguugccuguggguuguuuuuagguggagacagauuacaaauagguuuuggaagacuacaauuaaaaaguagaaauaguaucauccacauuacuccuccacuauacacacgguugucaaaugcaucauuaauaauaucacuuuuaaggaagaagucuggaaaacucaguuggcucugauauuugcuaaacuacacagccaacugguccaaaaauaugaauuauucaacaacugaaaaaaaguugcacagauaauccaaggcacuggaaaauccaaaggaccuuucuauuugccuugggaacauaugugaauuuuccccugcagcuuucugccuagacuaauauuaaaaugaauugacuuucuuaaagcacauauuggcugagcagcacaaggguaugcucuaugccauuuggcaggaagaaaaagacuuagauuaaaauuuggccaccaugcagauaaucugaagauaaagaauuccuuauugcaagcagcaggaugagagcaagcccaggacuagaagauuuucuuuguaccaagaccugcuagcuuaggugacuccuguacucauuccaaaacaaaauaagacugugcagugaaauguuuuucuuaacauuguugauuacuuacuagaaaaaagcugacagagauauuacuaacuagaaaaaaaacccugaauauuucauaaugucuucuccaucacuccacaugaaagucucuauuuuuucugucacaaaaaugguauagcuauacuuugucuccaccacaauuuaccuucaaaaccuuaagcuuaaaguagauauugccacugaacuaagacuggguuucucuucuaguuaaccuggcagaacacauggcaugggagcugaugcugcaggccauaucacucccaucauuaauuagguccauggacaucaggacuugugcaacuguguaauccacagggauuacugugugaacauaaauuguauggauugccaucacaucguauaccaaagcuucgaaaagcaauggauuuugguucaauuuggguuuuuucuuuucucccauaaccucugaugagagugcuaauaguacugagccuuccuuucacuagggguccagagcuagacaauccuaggaaagaaaagauaauucagaccaaacauaggacucucuggauuaaaagggaacugauucaucccagccaggacugguguggugagauggcucagugaguaggggcacuugcugccaagccuacagaaccaauuccugaucucuacauuugcaugccccacauaaauaaauaaauaaauaaauaaauaaauaaauaaauaaaguguagagaaggaucuagguauggugacacaugccuggaaucccagcauuucagaggcagaaguaggagcaccaggaguccaaggucaucguccuuggcugcacagugaguugucccagcacucaggagguagaggcaggugaauuucugaguuugaggccagccuaaucuacaaaacccagccucgaaaacaaaacaaaacaaaacaaaacaaaacaaaacaaaacaaaaacaaaacaaaaaaaaaacccaacaacaacaaaaaaaggcuaguuuuggauuaagaguaagaauucuaccuaagaaauuuaaaaaauaaugauuaaucauuaauuagguccauguagaucaggacuugugcaacuagagugugauagcacaugccugcaggcauagaacucaugaggcuggggcagggaaaucucaaguucaagacuagacugggcuauacacuaaauuucagaccagucugggauauguaaugagaaaacucaaacuauaaauguaacucaaaauguuaauauuauccaucacauuaaacacugaugcgcuggguaugaaaacucaagaauuuuuccucuuaugggcaaaauaggguaccacuuaauuuuuaccacagggcuagggagucugaaaauaccuuaguuuacucugcaguucuacagacacauacagucuuauucccaguugaaugagggacaguaggggaauucuuaauauaaaaaaaaaaaucaaucaaaguaccauacaaggcauacuucuaaauuaugcucaaacucuugauguucacaaauacuaaauauaaaaaggcauaauuccagcuuuguaguuagcaauguucccuucauucuguugacagugacuucaagauuuuguaauuuuagggggaaaaaaaggaaauaaaaaguaugcccaaauggacacaaagccuaaauggauuuacauucaaaguucuaauuuaauuuauacuucaaagacgucaguuuuaaagauuauuaaguagcacauaaacuuuaaagacuauaaaaugcaucuuuuccuucucuuugugguaugggacagggaauaaagaaaaguuuaaaaagaugagaucauaucugcuaguuaucagaucuuugagauacucucuaaaagaaagaguccuuacuuucauuaucaaguauacugccauauuuagcagcagaaauaaggacacaggugguuccuaucucuggccccaucucuaagaauauggaugucugauuuugaccaauugaacugcauuaagagacagauguuucugaaaaugcagaaucgcgauucaauauuaagaguaacucacacaaaauguauucacuguagacauaaaugucagcauccuuaguauaugaggugccccacagaucuuaacacaauuuuaagcuuuaggauccuuugagacuucacaaauucaaccaaaaacauuacuugaaaguuaauuaacugccuuugcaaggcuuguguaugcauuuguauguggagugcauucaugugugugcacaugaauauucauguucaucacugcucauguagagaccagaggccggaggauguuggcugggcugcuuuagcacugucuuaucccuagaguuuccaguuuccuggcuaugcuggcuaaucaguaagcaccaguaaagcaucuguuucuccccucucccagcacuggaguuauaggccuguguggccacaccuggcuuuuauguaggugcugcggauguacugugugugugugcugcaugcaugugugugcauagaggaggccgcugggugucaugcuuguacagcaaguguucugacccacugagccaucuuucuaguuguugguuuuguuuuguuugggggaggggagucucccuaugcaacccuggcugaaaacuccuaagcucuaugauccuuccaaccuagcuuccugaguaccuaggccuauagacaugugccacuagacauggcuagcacuugagagcuuacuuuuugugaauugugaauaaguuucuuuaauuuuagucagcacuugagccaagcuuccacaaucuauauaugaucacgaauuaggcaaauaccuuuugggugauguuuuucuguuuugcuuuuguuuuguuuucuuuuugaaacaagguaaucaccauguagcugaagccacccacucacuuuaaguuucaucuaacauuaauguccaugucuccaggacuugcccagcuauuucaguuuuauucaugguuuguaacaacagcacugcuguagccagguagccagguagccagguaaggcugugaggcuuaaaacaugaaugcccacauaaaccacaaauaaauacuguuacauuucccuuucuuucuuguuucauuuugguuugaauuuucguauugcuguggaucaaacucaggguugcaagcaugcuagagaaguuuucuauuacuggguucuaccuuccuguuauccuuuuguuugauacagucuuaccacauagcugaggcuauuccuuuucacuauguagcuugggcugaccuccaacauggcagccugccucagccugcauugugcuaggauuacaggccagugcuaucacaaccagcucccuagccuggcuuucuaauuugcauauaaacuucuuucacuguuuuguggcaauguuaaaaaaaaggagauaaaauauaaauauauauaaaucugaccaugcauguuuugccaugcuggagauagaaugcagagccuuguauaagcuaaacaugcacucuaccaccgaguuacacacccagcuccucauugucuuuguuuucugcuugacagaauguugggaacuuuuuuccucauuggaucacuugauaaacaacuggauacgcaaaucuauuuauagccacgugccuauacucacacuuuaccauaaaagccacaugcagugugcagcaaguauauaguuuuauccacuagcccucuugaccagcuucaggaacugcucuuugcaaacuuuacauaucugggaagacacucuguaccaaaauuagcacacugagcuaccaaggauacauggagacgguggaagauacaaauaaauaggagugauugcgaaggcauuccaacaguucuagucagcaagccucucgaaagauaauaagcuaggacuugcucaccuccaagugcaaguuaucuuaaauaaaauaauacacaugcaauuuaggaagaaggaauugucgacucuuacaagagugaguggcuuuuauacuuuuuccauuuggagaguaccauucuauguuuaaagugagugcccccaugaguuuuuaaaaaaaggguucucaucuuuaaaacccagggaacagaaaggccuaaaagguguuaugcaauuguauauagaauauggguacucagcaaguugacuagaauauccugaaagauuacaaaauauuaccuauaaacuguuacuaugccuuccucccagaugucugucagcauccaauuguucaacuucaagaauaggaaaagaagucaauucucucauaaaucauugaaaacucuuacauuacagaccuaaacuagaaugagaacggccaucagucaugugaccuggaccaucgaauuaguaacuguuacuaagaaaccucacauuuaagcuggaguugaugguacaugcccguagucccaguacucaggaggcuaaagcaggagagguauaaguucugggccagccuugguuacauagugagcuugaggugagccugggcuauagaauaagauuguguuucaaaaugcaaagagaaacugcaaucuuaaugagcauugugaaugacuacuauaaauuuucuaagaagauuuuuaccacgcuagaugacauuacuuaguaaauaccacagucauaaugcuuugaauaugaaaugucccgcacuagcucauguguuguaugcuugguugccuggguaccgguacuauuuuggguggcagaaacuuuaggaggaggaaccuauuuggagccgggaagcuaccggggucaugagcaugaaagucaugcccuguccccagucucuuccuuucucucugcuuccuggcuuuuaugagggcagcagccccugccagauguuccuacugccauaaugaccugcaucaccacagguccagaaucaagagagucugagaacaucagacugaaaccucuaaaaccaugaguggaaauaacucuuuccucccuuguuuacaacaagggcuuugucacagugauccaaaguucaacugauacgcagagguaagauguagccaugucuuagaagugaacagcauggaacuugaaaugcaagcaaagcagugacaaucaauguacauuuucuccacaguaacccagagguucuuccucagaucagucaauugaugauacuacaccaccccaccccauucacugagaaaggcugaccuaacagaggcuaggaaugaaauaaaggugcauaauggauacauacacuuccaaaguaguacuuggggcuuucagaggaccuggucauucaaaaucacuuacaccuccauggagacucccccuaugugagcauggauuauauuucaaauuaucucaauauucuuucaaugugguucuuuuuaaaugugagucauacccuaauaguuuuuuuuuuaauuucauuuuuaccaugaacugaaaucagacaauugugcaggauugguagacagcaugcugguggugccuuggaagggucucuuaggcuggcuuuccaucuccauuuccccuacaacaaaagaaauauagcuaacauaaaacaauuuuacaaacacaggguuggggcuaagugauggugauauuugcuuggucaaaggagacuacuuucggcugcuauucuguaaaaguuccugcaugugccaggaggccagaguuccagagaacaaggcaggaagagcaagagcucaauccugggcugcauaucuacuuccgggucagcucacacccaccauaguaaaucaucucucaaaacagcccccuccauagcagucaguuuccuaugugcuuuaacauaaaagaaauauacuucuauauacucuggccaaauauuaauaacuuuuauuuuaauacauuacguacaacauguuuuauacacacacacacuuuaauaaaagagaacaaggaucuuaucaagcaacuuaaauaaaaacuaaccaaugguagaaauaaaauagguauucucaaacaguuaaaacucacagcgaauauuuuaugacuagcaaagaauacuuauuuuauaucuuuuaauaucuuaacguuucuugagacagcaacaaaaugcauauucugauaggguggacaauagaagguugaguuggaugauauacuacaaauagaaauauaguugaaaguccagcuuugagaaagcaaugagaguaacucaguucacacauuaggaacuaugcugcuuuauucaacccuauagauuuucacaggaacagugcuuaacauuugccugcuaacuacugaggguuguuugccucuucucugccccaagcucuguuuuuaguucaaaugagcauguuuuuaaaauucuauggucuuuaucugagcuuaaaaauagaauagaaaagacaauuuaagauaaaugugaauuugucuguaauccagcauuugugagguagaggcaggaauauaaccaccaaguuugagaguaacugggcuacccagaaagccauagcagccugaacuacagaguaaaacccugucucaaaagaagaaggggagcaagcaaaaauuaucgagcaugucuauaccucaccagaaccguggaacugaacguaaaacuuaggacagaaaaagauccaagaagaacaaauguagccuucauuuuuccccuauuaugaauuaaaccauauuauuuuucuucugagcuacuaugaaaauuacuaaaguucauaaaaacuauguuucuuaacuggcuuuguucagugcuuuaauacugaacuuugaaacuacaagguuugaaacucuagcaaagaaccccuccaccuacuggcaaauauuggaacagcuacuaaaaacacuaauuccauuaaauuucuggacagauuuuacuuuaauaauaacaacaauaauagcuuuagcuuaaaguguacuuucaccuaauacuccuaagaacauuccuaagguuauaaauaauugcuugcaagauuaaauaaagagaccuuacucacuaaauacaguuacugacacuaucaggauguacuuuccaaagcauuaacaucuuuauauuuuugagaauuucauauguguauaaaauuaaauaugaucauauucacccccaacuucccucuccuacucuccccaggucuuucccccauauucacauuccaauuucauaucuuccuuauuauuuuauaaccuacuaaauccaguuagugucuuuuauaugugcaugaguuugaggcgguccacuggaauaugggcaacuuucuccacuacagugauccuccugccucugacuuacaaauaugugcaacaacaugcuggguguauccuucccauagucugucucugggcuuuugugucuccccaccccuuguucuuucauaaacaagguuucauguauccaucuugggugguguugaacuucccaguuaucagagaaugaccuuuauuuccuggucccccugccuccacccaccaagugcugugauuacagguaugcaccaaugagcuccuuauaccacaguagagagccaacucaggcuuucguacacacuaggcaaguacucuaccaauuaugcuauacccucagcccuauuugaucuuuuugagacugagcuucaugaggccaauugaucuugaaaucgcuacgaugaaggugaauacucuugaauacuuaaucuuccugucuccacuaccuaagugcuaugauuacacaguuguguggcaccauacaacuguuugaugucuuaauucuaaguugucuuaaauauaauacuucugaauuugugugugugcuaggacuagaaaaacuucaccagcgccacuuuccuaguauuuuauugguccugaaggugaucugaauugcuuauuuuugaggguuuauaaaacagauuuguuuauuuuucugugugugaauguuuuagcccugaauauguaugugcacuacaugccuggugccugcagaagguacaagguacaagggaagguauuggaucccguggaacuagaauugaguccaggucuugcagagcaguaguuguuccagccacugaaccaucucuuuaaccugcccuccugcccuccugcccuuuguuucacuguguccagguuggcguggaacucacuaugcccaggauagcccaagcccuggcaguccuauugucuuagccuuccaauuuaugccaggauuacaggcauaaauccccacacuaagcagaacugcuuuuuuuuaaaaauaaagauuuauuuuuauuauuuuuagcuaugcauguguuggcaugugcaugagugcaggagccuuuggaggcuagcaguaucagacucccccuggaucugaaguuauagguggcuguaagcuaccuaaccuaggugcuggaaacagaacuuaggcccuuuacaaaagcaguaugcucccuuaaccacugaaccaucucuucagacccuggauuacuuuuuuuccuuaaggcaauuuuaaaaacuauucuuuacaauggcaucugcuuauaccuguagguuuaagugcuuuccucuagaaauuccagcauuacagguuuuuuuuaaagauuuauuuauuuauuauauguaaguacacuguagauguccucagauauuccagaagagggcaucagauuuuguuauggaugguugugagccaccaugugguugcugggauuugaacuugggaccuucagaagagcagucggcauucuuaaccacugagccaucucgccagcccuacagguuuuauauuaaggucuuugaucaauuuugaauugcuuuuucguacaguaucuaguuucauucuucugcauauagauguccaguuuucccaauagcacuugcuaaagaggcuguuauuuuuuuuucucuaauguauguuugggacacauuuaaaaaauuagguagaugugggccagagagaugcuaugcucugugguuaagaacauuugcagcacuagcaaaggacccagguucgguucuuagcauccagugguggcucacagccaucuucucaaacuccagucccaaaggacccaaugcccucucugcucugcacaggcacuucaugcaugugaugcacauauaugcaggcaaauaucuuuuaaaaauuauguguaaguaauuaugugggucugugaaaacuggauaucccagauuaaauuuuuauauaugugcauuuauguguaaguaugguuguggguauagaauaugaaacuagaaaaggucuaagaagaaaaaagaggucuucaguggagagcagaaaaggaaggucaaagauccaaauaagaaaaucaccuagagagggcacuaggggaagaaagggaugaggucggaugguagaggaggagcgacauaacuaaguauguguaaaacacauaaagaaacccauuacuuucuaugcugauccaaaaaagaaaaagaaaaagaaaacgagguggauaugguuagcacccaccuagaaucacaauugggagguagaaaccaaaugaccaagaguucgaggccagucuuagcuauguagugaguucacugccagccugagugacauuaagacuguaucaaaaccaaaccaagucaaaucacuaaugacaaaagcaaaauaaaauggugccuggcacuuccaauuguacagucaaauugccaggaauaaugacuaaaccaguaccaacuaucucagccauguuuaaagaaacagaugcuaucaggggccuuacagaaccaucuaaaacuacugcuaacugagaacacguuaggacuuugugguucuaaguggacuuuggggacuggacuauuugaagacuuuacuuugcugacacauacuuugcugauagggaagugaaucccaccugagcaaauuccaugucuacagaucuaccugcuaugccaguguagaugucugcacacaaggcaaacugugcaucuguuagauucagaucacugaaaggcaaauauuuuuggaauguauauugauaauaugaauauaagaauaugauucauauaugaauuacaaaaauauagacaacauaaaaugguuaauuuauauaacuuagaaccuauagaacacgcugaaaauauuuaacauuucuuuaggaaaaaaaguaauucugugaguucauuucagaccagaauucuaguuucuaauacaaacuuggcuaaaugcaacacccaaagcgagauggcuccuuucccccaauacuacuaucaugacuguauccagacuuaguaaggugugcagugucagguccggugcgugcguauacaauauauuaccacacguacuuugccuuuuuccugguggaugauaagaauauucaggagcuacucuuguagccguuuuaaagcauguaauauauauauugcauuaaccauaguugccacauaccuuuucucuuaagaggaccaagaacacugggccuaaugcacuugaccgggcucuggcuccuccugcuuugacaaauaaacaaacaggaugauaugaaguaccuccaagaugaaagccgaacaguauuauagcccaaguaaguaacauggacagucauauagauugaaauacaaagugcuuguauugugggaugauuugaguuggcauguggcguuaugaaaagacguggcauuuuaaagacauuuaaaaaauauucugugagacaaaauacacacaauugcucaaagaaaagcaucuuauuaaaaguguuauuugcauuuugauuuauaaucuuuuaucuuuaaaauagguguugauauguuaguguguggaugaguguguguguguguuuucuaaauauaaaccaauauuaauacugggcucuugcuucgagccucaggaucacaaugaauccaucaaucagcauuaagucucaagccugcuaaugccucaauauaaguggugagcauauguguguucauuaugaaguucuaacaauuuugauauauaucugaaaaauuccauaauaaaauuaaugugagggagcaugugcauguucaaguuccuaugcuugugugguggccagagaaaaaugguuucucacucuccaucuuauuccuaggagauaaggucucuuacuauaucuauaacuaggcuaagcaugcaguaagccugaguucuccuccugucucaagcccgccaagugcuggggcuacgggugugaguggcuaccaugagcuuuuccuaugggcucugagaucuaauugcagauccccgugcuugcagaacaagcacuuugacccacugagccaucuuuccggucuccacauuuaacauccacauaccuugaaaaaugucuuggauugagaacaggacucgguggcaucccgcugcugcucacaaacauuugcaaggauggcgacaagcauugcuagaaaagacaagcaccguuacaacagccacgcacuucuuguucuccaaaggggcuuuucuuuuguuggguuguuuuucgaaagguucuuuugaaauaugacagaagcagcauagcugugcgagugccucauacauaugacauuuuccaauuuacugacacagcuuuucaagucuauggagacuugaagugaguugaauuguauauauguguuagaauaaacagcucacugugaaaaggacaguuaauaucuugucaacaaucguaccuuuccaaauccucugguuggggaaggagcuggagaaacuggagugaagucaauucuuuugggagaauauaauuucucuggcuugucaaaaucacuaucacucuguaaacauaaaaguaguauccuccuucagcauaucacagaucuuaggcacuacuauaguaacauaccuauauuuugaagaguacagauggacacauucaaacauuucgcugacuaagcagagaucaaaacuaagaaucacuguggaagcaggaggggccucaguguacgaaagaauuaaccaaaucaggugaacaacacaaagcuuucuggaaaaugacaacacaggcccacaucagaacacuuuaccaggcucaggcuuucgucccaugacuggcuuaucugcaucccugcuugugcuucccuaaaagcaaaaacaaaaguaaaaauaaaaaaccugggcuuacaaccaaggcacaucaggggcuaggcccugccucgcuaaccacuaaccuuucauuuguaguuucucuguucaucauauccaggccuucuuccuauaaggauaagcauaugugcuaaaucaacauucauccaugugcuuauuauuccaacaaaacugaaauaaucccagguggucagaacuaccauccucaggucgucagccaugcuuugccaggauuuuagaguacaugcaaguguaaugcuuccggcuaaccggagcugcaccuuugauaauuuguaagauuuuagucuucaauuuaagacugagcuaguaaguuaaaaugacccuucagauuugaugcagucugcuacuaagaauaggauuaggcaaagguggcagcaacugggaaaaaaauggaaacauuuacuacuuuuguaacacaaagcauuugucacuauacuguacaaccucuuccuacauaauucuucauauucuuagaaacauagcucuucaaaccccuaaacauuaauacacuagaggcaaugcaugcagucuuuagaaaguacaccagguguccaaccucaaggcaccaucugucgcuagacaggcacugacuuuagcacuuuucccaaaugaauggaaagcuguguaaauuuaagggaaacaagacugcgccuuggaaguauucauuauuccacuaauguaaaauaagaagcuaugugaaaugggaaagaaaacagugccaaugcuaucaauuuuuauuacugaugcacuaaugaguaaagauaggcuaacagacccaacauaauacuuuuuauaugauuaauguucuccaaaauacuuuaaaauggcaagaaggacauuuugcuuccaugcuguaaaucaucucuaagguuugaucucuaaucucaccaugagucauaauaguuaaagggagaccagcuuuaggggaagaguguuugccucgcgugcacccugcucuaggaccaaugaagaaggcaagguuaaccuucaaaauaauugcugcuuucgcuuauaucaucuuuucuucucuuucagacaggguuccauguagcccaggcuggcuuugaacucacuguuuagcugaggaugaucuuguauuucugauccucuagucucuaccucuugaauaucugguauggagagcuggggaugaaccuagggcuuuguacaugccaggcaagggcucuauaaaugggcuccagcccucauuuuuuuuuuuuuuuagcaauuuuaaaaauauuuauuuauuuauuuauuuauuuauuuauuuauuuauuuauaugaguacacuguagcuguuuucagacacaccagaagagggcaucagaucccauuacagaugcuugugagccaccaugugguugcugggaauuaggaccucuggaagagcagucaguguuccuagcugcugagccaucucuccagcccaagcccucauuuuuuaacaucaugaaaugauuuggaagcccaauuauguuccuuuaaaauaaucaccaucuugucacagaauguaagauauaauucaagccaguggaucuuacaagauuguagcaguugugaugucaauaauuaguauuuucuccuaagaaauacaaaugaacucguaagaguauaaaaucaaacaagacaauuauucugcuuaaaaagcuuuaugcuauuauaacuuuaaaaacaauuauaauguagcaagugguauaacaaugggcuuuuuaggcaacagcuaauucaaggaaaauuauccacugagacaugauuuuaccuuaaaagauauacgcccauuacccaccccuuuuguauuuuucucuccuaguuuuaaaacaagaaacauuuuacaaguaaaaucuuuuguaacguuuuguugguggugguuuuuuuguuguaguuuuuugcauuaugaaagaaacacaugcuuacugcugaacuuuuaaugaguucauugaaaaaugauaaacucccaggucaggacauaagacaggguugcccuaacaggcuggaguggggaagcauacgcauguguguaagugugagaacuaaggaaugccaaaagguagcgaaaucaucugcagagccaaaauauggaggaagucagaauuucaaugcaacauugauaaaauauacaacuucucaauauuagauaagucuacaaaguggcucagaaacagggagagguaggaacagaacuauauuuagaacuagaaacaagaauaauuuaagagcugaaaauuuuuuucuaagagcuuuagggagaugcuggcuaacgguguuaaagaaagcaaagagcucaagugggauacgaaugagccccccggcacugacacuuaagugggcauuagugacauuuucaaggacagcccuuaauggaguugugguagaagcagcaacauuaccaacuagcuggaaauuagaagacaaggagcuagauauagucaaggcuagauuauucuuugacaaaggucagagaagggaaaggagggacagacuuaggugcaagaaggccacacugucccagacaauaugccaaggaggggacugaguguuuaagauaggagacaacagcuauguaaagugacaggagguucaaaaccaaagaaacaaaccccccaaacugucuuaggcaccagggagaagcuccauacgugaacacaaagggguuuuaacaagaaaccugguauaaaagacagaugucagggcuggaggcagcucagcagcgaagagcuacugcucugccagaggaccugaguucaaugcccagaacccacaugacagcucacuacugccuguaacuccaacuccaggggauccaacacccucuucuagcccccauuugggcacauagugcacauucauucaugaagucucacacacacacauuaaagaaauuaauuuaaaagcaaaaagcuaggugucuguauuaucugugaaaugagaagugucuuuggcuggaacugaacauugguaaagcaggaaguggacagagacuaaacaacaacaagggauucuagagcuugggagaacauggaacauuguggagucacugggaccuuagccccuggagagaguuaaucucccuuucaaacuacccaucuuuucaacuucucucugaguacucaaggcaacaccacuccccuggucaauugaacacaauuuuagucagcuggaguccuccuucucccagaauuguuaguuuagaaaagguguaacacuguaaggcugcuuaagcagaauaauugucuuauuugguuuuauacuauuacacauucauuugcauuucuuauggaaaacaguaauuauuuacauuauggcugcuacaauccugcaaacuccaucaguuugaauuauaucuuacauuuuugugacaggacuaugauuauuuugaaggaaugugauuuggccuccaaaucaacugccagcaaguauuggcagaccuuuaacccaaauguaucccuuuggauuugcugccucuaacacagcacugagaggaagcuuacuauaauuggguauaaauuuuagaugguucacauauaucuaauugguuggcaaauucuggagguccuaccugugcuugucuuuuaagcaucucagcccuuccauuuccucuuugcuuguuacuaugggacacgggugaacgcauuaugauuuauacacuguaauaguaguauagagugucauuaaugucaugguggugugaguacguggacaaaggagauagaaggauuaaacuagguuucaaagaagcaaaaaagcucgaaaggaggaggaugagguugauggguaauauaaggaccagugaauuaccagggcccuuuagaaaaugaggcaccgagcaaaggauggggagugaugacaggugagccuacccagcgcggauaagaaucuucaccucuuagaaaagagcuaagugaaguggagagaggcaaauucauuuuucccgucuuugcuaugcggcucuuaucaggagcacagcuguauaacacguaagaacauuuuucauauauccaacaaaaauaaguacuuauauuuucaaguaucgucagggaaauaggugaagcaaaucaaaccucuagauagcuaacauccccuuuuaguauuuuuagcuaguucaguggaaaucuuuccaaaguguguaauaguguucccuuucucgaacagguucuagcaaucagaauggcacuggaagaucuuuauucuagugccagcucugccauguaccacugugugagccuaagcaagucacuuaugucacuugagucaguugcuguagcuucuaauugggaaaaaauaccuuuugccuugucucuucucugcuucauggagacuguuacauggacuaaaugagugaaaguacuuugcaacauggaaaauaccaucaaaguguagauguuaguagaaauuaggaaaagguuaaugaccagggauccuuaagaacaugaccauagguuucuauacuagugacacccuugggacuaucaacaggcucucagcccugugccaaaccacaaacagugugaggagggaaaaaacccugucugcuuucuguuucucccuuuccucucuugcuagcaaguauuagcagaccuuuaacccaaaugaaccccuucugauuugcugccucuaacacaccacugaguuggaagcuuauuauaauuguguauaaauuuuagaugauucagaggucagagaggcuguccuauaaauaaauggaugaaccuuugugcacagacuauggaaaucuaguucagccauuuagaggucugugugcuuacaucucagaugucuaaagcugccgggugagugagcucugcaugugaagugcuacuauauaaaaaccucuucauaauuuuccccagugcagcuaucuaauccagugauucccaacagcccuggcuacagagaaaauacacacucauccacucuucugggaauacaaacacauaauuuacaggggucuuuauuuuagacaagcaauguuaucugacagaugcaugucagaaacacucaggcacuauuugauguuuuuuacuuuauuuuauuuuauuuuaacaucccaggacgaauaaagaccacuguguucagcuauauuuggagguuacuccugauuuaccucacgacugugacgcaaguagaaauaaauaacaaugaauaauuuuuuuacaaauacaaagcccuagagcaaugaaagcaauuuuaagccuucucccucuccucucgcucucucucucugaaccaaaagcugaauggcccuggcaaaacuaguaagcaagauguguaaauuaaaucuuuuuuuuucaaaaaacaauugugcccaggugcccagcacauaauuucccagaaagagcucuauuuggaaguauuuuucccgcuguaaaucacugcacauacuuacuuugauacuuaccaagcuaugauggcucauaauugccguacugguccucccaguucuaaguggauauggcucaaaaaccugugaaaggucacugcaaaggaaaaaaaucaaaucaaaucaaaggauuagcgucuucuaaaggaagcuaucuuucaacugaacucaacacccucuagucuguacuuaacaauggaaugaaucuucaguagcuccucuuuuccuagcgacaaggaacuccuuaccuuccacuuggccgagccaggcuggugugcugcaggagaagcucuagcuagauacuuaucuccucgguggcugaggggacagcucugcgagcuauagggcggggcuccagacugguucauuccagcugcuucaggucagaacuacauccccaaaccaguuccggucagaugugaacagcucaucucuuuaccccagagaaccgugaggauuacuuacugcucugcaugugcuaccaacugagaagagcuggggacuuuuuaagaccgaagucuuaccaacaugucugcccuaagcacgggaaauacuguucuaucucugacuccugauguccaagugaauagauggaacugaagaaguuugcauuuuuuuccuuucaauucauguuuccccucugaccucacaugcccuccuuccuacugucaucugucaaacccguccuuucccuucacaccuaccccaagagccuugccuccuugaaagcauagcauaaacuucucccuauuccacaaacauaaugcaaccauuuccugcuuggaacucacagaagcugggggguggcaagcuucuggagacagcuccuugcuuuucaaagauaggauuuugcugugucguccagguuuguuuugaacuccugggcucaagaguacaccaccacaguuggguaaacacucuuuaguuuugcuuucagggcuagagauggaaucaagaaccuuguauagcggggugugguggcgcacgccuuuagucccagcacuugggaggcagaggcaggcggaugucugaguucgaggccagccuggucuacaaagugaguuccaggacagccagggcuacacaaagaaacccugucucaaacaaaaacaaaaacaaaaaaacaaaaaaacaaaaaaacaaaaaccuuguauaucccuaucuaaaggucuaccucgagauauaccaccaugucaguaugguaaauauaucuguauguuccuguggcaaagucaugacuuuacacaugcuaagcagacaagcacuaccaaacagcuacauaccaagcccaccuucuaauaaagaaagggguuccccagcauaacaacacaaguagaaaaucgaucaaaggaaagaaauggaaaauacaugcaaaugcauauuaaguuacucaggagaggugcuuuauucaucuuuguauaauaucacuaagugucuagcagucuguuuugccuguaauaagaauucaaggauuuucaaaacugaacugugcugggcucuaagagaccacugacaaucccuauuuccacuauucucauuuuaaagagaaaacagacaugaaaagguuaacucacucacucauuagcacagcuaguuggugacaacugagaccaggccuggucucuucuccucuugucugucacaucaugcuaucuuucaaguaauuacuuaaauugugguucacaaaacaguggguuuuuuccucaauugucuaaaugcaggucagugggacagcccaaggccuuagcaauggcuuguuuaccagacuuucgcaagacaaggagagagaaggugggguauccacgagagacaaagggcacagcuuccccuuaaauaccccaaaaccccuugaugauaccauggacaacaucaucagucacgucaucauucccucggcuucaaaaucguauuuaaaucuaggggaaaaauguacuugccucucugucaaagacagauguuauaaucaguucaauuggaggcaaagcauuaucaagucuucaacugugcuugaagaaagguuuggggcuaauauuacucccauccucugcucuguccugaauuaaugcccucucuguggggucucgaaauugaccucagaagaauugucuacuuacaaaaguggaauacaauaguucauuuaggcgagccaaccagccuucaccaucacaagcuuccaccugaaacucccugcugucuuguucauacaaaaacacaauaucuugucacuaaaauuaaaggagugauuuuccccauuauuuucucaaaccuguguuugacugacuuaagcuagaaaccuucucucucucuccuuuuuuuuccauuauaacgcauuucaggcagcuucaaaaacuauaaacacuguaacaaauccaaaucacuuaacaggauacgaccacaccauggaaucccaaguuauuagauaaacugugauuucuuaaagcaaaccucuguuaaugccaggguuccuaaacucagcuuagaaacagcaccucuuagagacaggcgucaaguuacaagccuaauucaggggauucagccugauuugcccugauggaaauaagccagggcaagcaaccugucagcugagccagguuucuacuacguacauucucuuuuagaacugcacagcaaggcccccccagguacagggagggucccuuucucagacauggccagagugugaggucaaacuuucccuccaucuaggaaaccaagucacuauuaagaaaauaagaccucaaccccucaguuuggagucuagaugaacucgaacuggcacuuucgggaaggaagacuucuugcccagggacaaaccucugauccccacacuccguccuccccaguccagcucaccugagcacauggaucaggggagcacuguuggaccgucucaggguggcccccucagaugugucagccucaaaauccagauccauuuucuccugagccauucggauacuugcuaggcaacacagccggcagugcucucggcuccuggugcuuugcuauggacucacugcaggacugagcugcuggggacuggcagcugggggcgggggcuaaugggcggaggcuugggagcgagggcggagaaaaguaggagaggaggaugcagaugaggaaggauguggagggcgggcggaggaggauauagagcugguguugggagggugacaggaugaaaaaggggauggaggaaagacaaaggugggagaaagaaaaagaggcacagggguugauaaaggauagauggaaaugcagggcauagcacuaaugaaagagcauagaagugggaaaggaggaaaaaggucagggugaaggggcacagggaugggaaaagaggaggagggagaauguggaagcacaggagaagaaaggggaggaaacuaggcaguggcagaacucaagcugucauuuuucccgccuaggaccgcaagcgcggcucggcuacauuuacagaggcugccuuugcagcgcuagcaaugaggacuugacagcuggccaggcggccucggcugccccaccuccacaugcucagggucucuguccaguccgccaugcucugggccccgguccccggggccccucagcgcagggauggcgcuuuucacucccuggucccugcccgccugcacgacucagaaaagggaucggcccucugcaccaccgcggcgcugcuucuaucucuuauuggcucuaaugacccgcgggacccucuggagcucaaauugauuucuauaaccugccgccucuuuugccucccacgcuucagaaaugggagccuccgaggggccagcucuuccgcauc

SEQ ID NO: 9500 - RNA, 1407 nt, Mus musculus
gauguugguuacugguuugguugguaaauacaacgcgauggugcuggaacugcugggaccgaguuuggaggauuuguuugaccucugugauagaacguuuucucuuaaaacaguucucaugauagcuauacagcugauuucucguauggaguauguccacucaaagaacuugauauacagagaugugaagccugagaacuucuuaauaggacggccgggaaacaaagcccagcaagucauucauaucauagauuuugguuuggcaaaggaauauauugauccagagacaaagaaacauauaccauacagagaacacaaaagccuuaccggaaccgccagauacaugagcauaaacacacaucuaggaaaagagcagaguagaagagaugauuuagaagccuuaggccacauguucauguacuuccugagaggcagucuuccuuggcaaggcuuaaaggcugacacauuaaaagagagguaucagaaaauuggagacacaaaacgagccacaccaauagaaguguugugugagaacuucccagaaauggcaacguaucuccguuacguacgaaggcuggauuuuuuuugaaaagccagacuaugauuaccuaagaaagcuuuuuacugacuuguuugaucgaaaaggguauauguuugaugugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaacaugauugcuuuuaucauguuuagguaugggccuugaguuccugaucuuuccaagacuuuuaucaugaauggguguuggauuuugucaaaugcuuucucuguauuuaagagaugaucaugugguuuuugucuuugaguuuguuuaaauacuggguuacguugauggauuuccauauauugaaccaucccugcaucccugggaugaaaccuacuugaucagaauggaugauuguuuugauguguucuuggauucgguuaauaagaacuuuauugaggauuuuugcaucaauauucauaagggaaauuggucugaaguucucuaucuuuguugggucuuuuugugguuuagguaucagaguaauuguggcuucauugaaugaguuggguagaguaccuucuguuucuauuuuguggaauaguuugugaagaacugggauuaga

SEQ ID NO: 9501 - RNA, 1229 nt, Mus musculus
auuuccuuuuaaauagcaucugauguuuauucaacgugaggaaaaggcuucuguacagguagagcagacaagaaggaaagagcacaggggcuacuguguuggaaaaggcauacacaucagagaaagagcugcaagcugguuucucaggaaaaccagcuaguccacaagacaaaaugggagacagcagguuucugggagcagggaggggaagggucccgcugaaggugaaucaauguccaugggccgugggcagcccagguaccucccaggugaguccgggucaguuaagggcagcagccaguccacauauggguugugcaggggcuugaaauggcagcaucagcgcaggccuuaugggcagaagcuugcagacuguccacuggguaggagguaaugaaaugcucuggcggcgagugaucugcccacuaaacgacaggagcucaucuuguagcuggaaaccagacaguguucaaaugugacugggaugggcugagcugucagcucugggaggccuugugcuccaagagccaggcccagcagagacagcagcaggagacuggggagcuauuccuggaacaaaggcuaggacacaggaagggacaggggcauucaugcuugauuggggagcuggggguggggugggauggcagaggcggggggagggggugggcaguggacaaaaaucgcgauggggggugggguagcagcucacccucuuguagccccugccccaggccaggcuugccagaggccuagaaguccucauccuccucccacccgaacuccuccuucaucucauucaggaagccggaguaauuguugagcauggggcugucugucuggagauagcgcauagcccacugcagggcccggcccuugaggcgggugaugaggaacaucaccuugcguuugucggugucgaaggucuucucaucuacuaacauguaggacagggucugcacgaugaacuccgggagcuucuccaucucgccaucaaacagcucaggaaaugggaugggguucugccaacggccuuuacgcagcucgggccaggccaugagggccauaaucaacuuaauccggcgguccauggcggcgaggucuccuugcuuggcuugucaauaaguggacuggaucucugccuggucgggggggcgcucuucuaagggucugcuucucuuugcugcgucagcugagcacgcagcuugucacuuccuaggcuuagcuga

SEQ ID NO: 9502 - RNA, 1250 nt, Mus musculus
cuccauuuccuuuuaaauagcaucugauguuuauucaacgugaggaaaaggcuucuguacagguagaacagacaagaaggaaagagcacaggggcuacuguguuggaaaaggcauacacaucagagaaagagcugcaagcugguuucucaggaaaaccagcuaguccacaagacaaaaugggagacagcagguuucugggagcagggaggggaagggucccgcugaaggugaaucaauguccaugggccuugggcagcccagguaccucccaggugaguccagaucauuuaagggcagcagccaguccacagauggguugugcaggggcuugaaauggcagcgucagcacaggccuuaugggcagaagcuugcagucuguccaccagauagaaagcaguggacagcaugacauguccaucagguggcaguugaucuguccauuaggugacaggagcccaucuugcagcuggagccugggacaguguccaaaccugccagggaugggcugagcugucaacagugggaggccuugugcucuccagagccaggcccagcagggacagcagcaggggccuggggagcuauuccuggaacaaaggcuaggacacaggaggagacaggggcgcgcgcaugcgagaucuccaggcagggcgggcgcgggaggugggggaguucucgggguaggaggggggcccggggggagggcgcacucggcgaccccggcugcagccacaggacaacacagcagcagcccacccucccggagccccaaccccaggccaggcuugccagaggccuagaaguccucauccuccucccacccgaacacccgcuucaucucauucaggaagccguuguaaucauugagcagggggcugucgaucuugauguaggggaucacccacugcagggcccggcccuugaggcgggugaugaggaacgucaccuugagcucgucggugucgaagguccugucguccaccaacauguaggagccggucugcacgaugaacuccgggagcuuguccaucucgccaucaaacagcucuggaaacgggaugggguuccgccgacggcgccgccuguugugccugagcauguaggccuucggccucuuuaccuugccuuggccuuccaugacgcugcgcucucugggcugaucuagucgcuugguggccgggcuggcuggaggcucuccggacucuugauggggucagcugugcuuugcuggauccgcagagcacagaga

SEQ ID NO: 9503 - RNA, 14935 nt, Mus musculus
agcggaacguugguggggccagaggucuuggccucuccucgaaggccgcugaagccgaccaggggugugaaggugauuauuuguagagacaguaaaccugguucagccaaggccguuaguucaggcgggaagaggggaugaaugugaugacggaguguagaggagggcaaagagugaaaaggaaggauuuggagaaggaaggugagaaggaaggagugugagaauggaugagaaggaaguaggauaggaaaguacacccuugcgggaggccugguccaggcccccauuugaucggugagacaaauccuuuuggcauuacucgagcccugcggagguccccgaggggaagauggaggcgguggcgaacccugccgagguccccaaggggaaaauggucgccgaggggaagguagaggcaguggugagcccugccgagguuucgagggggaagauggaggugauaguggucgcugaggucaccgaagggaagauggaggcgguggggagcccugccaagguugucgagggggggaaauggaagcggugaggagcccugccaagguccccgaggggaaaauggaggcgguggcgaucccugccagguccccaaggggaaaauggaggcggugguggucgccgaggggaagguagaggcaguggugagcccugucgagguuucgagggggaagauggaggcgauaguggucgcugaggucacugaggggaagauggaggcgguggugagcccugccgagguccccaaggggaaaauggaggcagugguggucgccgaggggaagguagaggcagugaugagcccucccgagguuucgagggggaagauggaggcgauaguggucgcugaggucaccgaagggaagauggaggcgguggggagcccugccaagguugucgagggggaaaauggaagcggugaggagcccugccaagguccccgaggggaaaauggaggcgguggcgaucccugucuagguucccaaggggaaaauggagcgguuuuggugaccgaggggaagguagaggcagugauaagcacugcagugguugucgaggaggaaaauggaggcgauagugguugcugaggucgccgaggggaagauggaggcgguggugagccuugccgagguugucgagggggaaaauggaggcggugguggucacagaggaaaagguaaaggcggugguuagcccugccgagguccccgaggggaaaauggaggcggugguggucaccgaggggaagguagaggcaguggugagcccugccgagguccccgagggaaaaauggaggcgguggcaaucccugccgagguccccgaggggaaaauggaggcggugguggucacagaggagaagguaaaggaggugguuagcccugccgagguccccgagggaaaaauggaggcgguggcggucccugccagguccccaaggggaaaauggaggcggugguggucgccgaggggaagguagaggcaguggugagcccugcuaagguuucgagggagaagauggaggcgauagugguagcugaggucgcgaaggggaagauggagguggugaugagcccugcagaguuugucaagugggaaacauggaggugcuuuugagccuugcggaggugagcagaaacuggaggcgagguuguagaggggaagauggaagcaguggugagcccugcugaaguugcagagcagaaaauggugaccccugaggacgucaccgaggggaaaaugaaggagguagugagccuugccgagguugcuaacaagaaaauggugguggcgcacgccuuuaaucccagcacuugggaggcagaggcaggcggauuucugaguucgaggccagccuggucuacagagcaaguuccaggacagccaggacuacacagagaaacccugucucgaaaaacaaaaaaaaaaaaaaaaaaaaaaaacaacaacaacaaaaaaaaaaaaagaaaaaaaaaaaaaagaaaauggaggcggugguaaaucuugcugagguccucgaggggggaaaauagaggcgguggugauccuugcagagcuugccgaggggauuaaauggaggcagugguggaccuucugaggucaucgaggggaagcgguggggagccuugccgaggucaccgaggggaaaauggaagcagcgguaaacuucacugaggucggagaggguagauggugagccuugcugaggucaccaacaggaaaauggagguggucgguggugagacuugcugggguuguugacaggaacauguaccuguggugaaccuugcugggccuugaacagguugaagccuaagugggaggaaggacaaccuagagcaguauggaggcccugggagguuucugcugucauuacaaggguggcaacuuaaagcauggggcugggguugggggugaaggcagaggcuaagagugaagagaaucuugugguaaggauuaaaaucuauccacgucuugcuuaucucuaaucucucccaguuaguuucccuuuugugcuaaggaggaagaggagcagggagaaugguuaggagcaaggaagaaauccggauacuaagaagaaauacugugauguggaguuagaaaaaggagaggcuauagacaaguugaagcuagggaggagcuuaccaggaagaugaguuagagaagugauggggggggggggggcuuggagaccaguuagguggcuuucccuuuuagaguaaggaugaggaggagcaggggagugguuaggauuggggaugagaaggagcuggagaaggguaaggagcaaggaagaaauacagagagaggaaguuugggggagggaaagaauggguggcauguccaaacuggggaggagcuaagggugagaagaugggaaggggcuaaagaggaggcuguagaguugaggcagugauggggauggaaagaacuugggagagucuacagauaaggaaggccuguccagggguaaggagcaaggaaaaaaugggcaaagaguaguuggauagggagacgauggagaugaugggggagaguagaagcuggggaaagacuaggugucagaguugagaguagagguuugggaaauagggauugggaggaacaaggaggaaaaaccuggugaugaggaguuaggaagaggaggggcuguggggaaguugaaauuggggaggagcuuagcaggaggaguuggagcagaaagaaguugaggaaggcuaggagauaagagaugaauaugacgaggaucugggaagaagcuagggaugaggaaaaccugagaggggaugagaaaggagaaaauagggcaugaaggagauauggaggagguggggaaaaguuaggggcucaggagcugaggaaggauugggaugaaggaagacgccugaagaggagaugggagagaggagguauugggagaugguaggugaaaggagugaauaggagcuggggcuuaugaaaaggaaagguuaggggugaugcagagccaaaggguagagaagagcuaggaauaaggaugacuuggggaaggguaaggagcaaggaggaaauggaugcagagguguugugggggaucaggggaagacagaggacaggcugugaaugaguugaaguuugaaaggagcuagacaugaacaggugcucuggaggggcuaggaguaaaugugagaagauauuaagaguaaugaagauuuuaggagggagaggagucuuugaaagagggcgaggaauaacuauagagggguagguguuugcuagaugugggaaguacuggggaagaguuagaagaaaaaggagagucaaguagcuggaggagcugaggcuaguuggagcugugaagggucuagaaacaagaaacaauuagaguugggaggaucuggcuagaaauauuggauuaagaagaguuggggagagguaagaagcaagaaggaacacagggugaggagcugggcagggacaaagaugaggaagaccugaggaggugugagggacaagagacccagagcuacuggagcuaagaauggggaggagcuggguaugaauugaagcugguaaggaguugggaugugggugagcucagaggggggcuagggugaggagcugggcagauguaagaaacaaugaggaacuagauuuuggagguggggaaucuagugguaaguagcugggaauggguuagaagguuggagaagcuaggagggcauggggcaaggaauaccuggggagggacuagaagcaagggagcagcuacuggugaagaugagcuagaagguuagaaggagauggggagaaguuaagaguaagggggagcugggugaaggcuaggagcaagguggagcugugaugugaggaugaucuggggaggggcuguaagugagaauaugccgaggagguguggaggaaauaaggaauaagguaacaaggaggaaauagaguugggaugggcuuauagucggggucuagggaggucuuagggauuagaagaugcuggguagugguuucugggggacagggugagggccuggauagugaauacggaugaggaggagguugggggguuggggaggggcugggggagguuuaggggaggagcaccuagaaacaaggaggaacuagggugaggagaagcuaaggguuugggaagagcuuguggggaagagaaccugggggggaugagauagagaaaggaggaacugagaguuguuaagggaacuacaggggaaaacuaagaagaggagccagggagaaauuaguggggaggggaaaggaaugaggaggaauggaaagggugugaggugaagugaaacuggggagaggguaggggaaggaagaccuaguggguuagggaaguugagaagagauuggagggacagaguagcuggagagagauggaguaagaagaacccagagagcaacaacaggcuagauugaauagggagugugaauccuuagccguugaaguggauuugaaggaauaaaagcauauaggagcuaaugucaaggaggaaggagcacagugccaggaaggaacuaggggugaaucaggaguguggggccccagaacuauugaagcuaaauagaguugggggacuagggguggcaaaagggccaggaaacagggguucuaggggcccugguagaguuugggcuauugaggaacugcagaacagguggaguccaaaauggggaagggagaaaaaaaaagcacaaagaaauuagaaaaggacagaagugaguggggcaggcauggccuagaauagggaagaaacagcuauuacuguacagccaagauagauucaaacuggugaaucucuggccuuaaaguuccugggauuagaggcacggaucaccacauugagcuuuuucuguuuuacuuuuguaagauaguaucuuacauugcagcccaaccuggucugacuuagguaggccuuaaaguugcaggcuucugcccuugacgucuuaauuuaccaagauuuuccuccacuuuagagauagggcugugcuggcuucuuaugggccuggcaugagccucaugguuaagcuacauucccaguguuauacaacguucacuuuuaguauuuauuuuguuaggagcagauuuuuggcacucucguguucuauuuuuuccagcaguauauaucuuugaaaugacauacaaacuugcauauuugcucaaauuuaucaagaauuagcaaaaaaagguacauaaaacucagaacacugagugaaugggugcaaacaugguccaaguuaaaccaccuuguuuuaacuucuuuuuacauugacaagugacaaauuguuuaccugagauccacuaaaguaagaaaccaacauuauucaaauaagagcaucuugguuuuauauaauaauuuucuaaguaaauuuaaauaaugccuuuggauucaaauggcuugaaagauuuguuuuccuuauuuguuuuucuuacuaugcuuuaaaacagaaaacauacaauuauguuuccccguggaagaagggacccugaagaauuuaaaagcaccccagaggacccugaagaaccugaaagcaccacaagggacccuggaggacuugaaagcaccccaggggacccugaaggauuugaaagcaccccaggggauccugaaggauuugaaagcaccccgggggacccuaaaggauuugaaagcaccccgggggacccugaaggauuugaaagcaccccaggggacccuguaggauuugaaagcaccccaacagaggaagaacauuuagcaguuuauuccuuugaugaugacuuucagcaucccaggguuuugcagaggagugaagguacaaggugucaaauguugggugcuggcaagcugccucaggggguacauuuuauuuaauuuuauccaagauagucuuggaaauuaguuucuguaaauggccaugaauggugaucuaacuucaucaaagaaaauuuuguauucauguaucuaauacaaaaccuuaaguugccaaaagucugugaaagaauguaaaaaaauuuuuuuaaguuuuuucaagacaggguuuuucugcguuacaguccugacugucuuggaccucuuugcaggcuaggcuggccucaaauuuacagagaucugccugucuccgccuucaagugcugggauuaaaagugugcaucaccauacauggcuuaauuucaguuucuuaaaauaacauacuuaauuucaaaaguguuuuucuuuuucuuuuccuugucaacagaacugcguucaacaucugauucaugucgggagagaaguccuguagaacuguuuacagauccaggguaaaauauuaaaaguuaucuuuguugaauaauguaguucaagaaauguuugcuuuguuuauguaauaaguagcauacauaaaauauuugcuauuucucgcaagaagaaaauaggaaaacuccuuauucuaccuuaugaauucuuaauuagacaguguuuaauauccaacagaggguuuuaugcaugcuugggaaaugcucuauuacugaacuacaguaacagcuuuaauaauuuuuuuuccauuuuuuauuagguauuuagcucauuuacauuuccaaugcuauaccaaaagucucccauacucacccacccccacuccccuacccacccacuuccccuuuuuggcccuggcguuccccuauacugaggcauauaaaguuugcguguccaaugggccucucuuuccagugauggccgacuacgccaucuuuugauacauaugcagcuagagucaagagcuucgggguacugguuaguucauauuguuguuccaccuauaggguugcagaucucuuuagcuccuugggugcuuucucuagcucuuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcacacaauauguacucacugauaaguggauauuagccccaaaccuaggauacccaagauauaagauacaauuugcuaaacacaugaaacucaagaagaaugaagacugaaguguggacacuaugcccuuccuuagaauugggaacaaaacacccauggaaggaguuacaaagacaaaguuuggagcugagaugaaaggauggaccauguagagcuuuaauaauuuuuaaaaaugugguuucuucauagggaaaagguggagguuaugcuuggaagaauuggagguauguuuuuugauaacuuuauauuuuuauaaaauuguuuaaaacuacguaacaaucaucauaaaauauguuagccaguguacuauaugucugcaguucaaugccuguuuucauaagauuuuucauaaauauuuaugauuuagcaucauagauauucuuccuuaaauguuuccauggugagagaagcaaaaaugauguuuuuagacaugugacuucaauggaauuucagaagaaaauaggaaaaguccuuauacuucuuugaacagguguagugauguacuauuucuguauaucaguuucuucuuuuacugucuauguuauuuuuuuauucaauuuauuucuuaggauuuauacuguauuccuuucuguagaguagguagcauaaaauuuaagcuuauaaaauaacuccuuguuaguauuuucauucuaauaaauuauguaacaugaaacuuugauagacaguaagaaauuuaaaauaugagccaaaacccuucuguuuuuaagaacaauguuaaagaucaguuauacuagcuuucuuuucuugaagagaauagucacuguuguuuacuuuguuuugagaaugucuuaguaugaggcuggcauuagcacuguagauuaucugacuuaaccucagagauguuggcauuauagggacagacaaacccaaccaaggguauaguacucuuuuuaaaaguuaauagaggacagauaaauggcucagugguuuaagaacacugacugaucuucuagaggaauccaauuugauccccagcauacccauuguggcucacagccaucuguaaauuuaguucaaagggauccagugucuucuuuuugccuuagugggagccagguucauggugcacuggccuaaaugcagccaacccuuccccacacauacaaaaguaguuaauauuagauuuuaaggauuacucacauaaucaacauuuuuggaagaaguacauguuuuauaaucuguugucucgucuauguauuauagcugcugagaucaucuuucaucuauguauaacaggaaacacuuugauuuagcugcuacaaugauaaauuauugauagaauaauagagcuuugcuaugguuacuaaaaguaacugguaaaaacaauauuuuuuuccuuauugagucacaguuugauuaugcagcucuggguggccuggaaccugguauguaggacagguuggcuacagacugaauuagugguauauacuaccauuccuggcuaccacagaauauuugauauuucaauuuuuguaugaacugcuugcuguauagaagcaugaugaaguauaaaggacaaccaaagcauacuaagaagauacgauaggcaagcacuuaccaacugaacgacagcugcaccuucccauugacagucucuuuuacaaguaauuuuaauaauugaauuaacuuuucuuuuugguuuuuaguaacaggguuuuucuguggcuuuggaucuccuggaacucacucuguagaccaggcuggccuacaauucucuguagaucugguuggccugaaacugacagagguccaccugccucugccuuucaggugcuagguuuaaccuauuuuagauucuauuuuuaauaaccuauaucauuucuuuuucuuaaacaauagcucagguaaguauguucuuccaguauagaauguuuuauaauuuuuuuuaauucuuuaauagauaauguccaccuuccccucuuguuuauuagcucauuuuuaucaucucuccaaacaucaucaguuaggaaagccuaauugugcugugguugcaaaaacuaacuaggaccagaaauguuucagauuucaaaguuuuaaauuuggaauguuuucauagacguugcugauggaacagaccuggucugaaaauuccaaauaccagauguucaaagaaugaaaauugugugcaaucacguugacaacauuuuaaaauuuaguauuaaaugucuuugcuauugaugaguguacauuauucaaauuuguaauuauuugaauauguaggaacaaaauaauuuucuuugacauugaauucuaaucaacauuaauuuuuaauauaguugacauuaaccgugcucuuagugcuaagagacaaagaauggagacaacugccagacagucuuuugagggaguugagcagaaaaugaaagaaguuuggaacucucaugaagaugcaauguaaguuuuucuuuaagaaccauguuuauaucaauuuuuaauauauacugauauaaaucacucaagaaaaaugcuaucaucuguuuauuugagaguuuaguggaaaaguuugacuugaguuuacucuaggaagguaccugugugacuuacuuacugccuuuauagaguugcuucauagaagccaaugaagaauacauuuuucuccuuuaaguaacaauugagguuuauuacuccuugguauucacucuugaaauuaguuggauaaauuuuagaugaauagaaucuaauaauuguuagcuaguucacuauggcugacaguguagagcaaggucaauuugaacauauuaaacacuuagaucuuguuuuauucuaaauugugguugugccaaaauggggaguggggaaauuagugaaaugauuguacuuguaaaucauuugauauuuuugugagaaucuacauucaguagaaaaaaugaaaaauaaacuauuuagagauauuauuuucugaaaauugauaugugucauaaaaguucccuaguuuucaaaagcugcugcaugagagggacauuuacguuaggaaaagguacuucuggaaucaauaaaaauuuaauuuacuucugacuuuuccaucaaaauauauaacuauuauuuccucuuuauacuuugagagugugucaauucaauuuugucucuaaugauuucaugauaguauaagagguuacacuauuacuguauguugauuucacaauaguaugagguaaaacauuaugauguuuuacagggcacagcuuaaugaagagucugcucaggcauuugcaaaucuguuugagcaauggaaugaggauuuuaagaaauuccgagaacaacaugagaaacuugugguugguauugccauugcaauuaaucuauuauaaguaaagcuuaaguaagaauggugaagcuauuugaguugaaugaaacacauccaggcuucuuuagaaacagaaauguccaagaaugagugauguccugaagacaauuuccuaccugugugggggauuauuuuagggugcugaggaaggggaaaaugugaggagugaaagaguagccucauuuagacauaaugcuugcuaaagaaaaauacagagggcagucaucuuaaaauguaauuuucugaguuuagaauaguauuguuuucuagccgggcaugguggcacgcaccuuuaaucccagcauucaggaggcagaggcagggaaauuucugaguucgaggccagccuggucuacaaagugaguuccaagacagccagggauauacagagaaauccugucuggaaaaaaacaaaacaaacaaacaaacaaacaaaagaauaguaucguuuuucuaaauuuaaaguuuuaggguuucauggaaggaguuacaaagacaaaguuuggagcuaagacaaaaggauagaccauccagagacuaccccacccggggauccaucccauaaucagccaccaaacccagacaguauugcauaugccagcaagauuuugcugaaaggacccugauauagcuaucucgagugaggcuaugccagugccuggcaaauacagaaguggaugcucacagucaucuauaggauggaauacagggcccccaaugaaggagcuagagaaagcacccaaggagcugaaggggucugcaacccuauauauagguggaacaacaauaugaacuaaccaguacccccagaguucgugucucuagcugcauauauagcagaagauggccuagucggccaucauugggaagagaggccccuuggucuuggaaacuuuaugugccccaguacaggggauugccagggccaagaagugggaguggguggguaggggcgcaggguggggggggguuauagggaacuuagggaacuuucgggauagcauuugaaauguaaauaaagaaaauaucuaauaaaaaaaaguauuacgguuuaagcugcaccucugagggacuacguuugccuugcacauaugcaacccacagcaacaagcaacucuuuccaaauucguaauacaguuuuuuuuucuuuuguauuuguagaaugauuuuaagcaacaggagaagauuuuucaacgaacuagauuuguucagaaccagagaauuagaacaauuaaagaaauacaugaacaauucuuacagguauguuugcaugauaacguuauguuccuuaaaauaaauugcacauuuuuccauacaauaauaauuuccauuuugaaugaauuguuucuaauugacaugauaauuagauauauguagcauuugaaugguuucaugacaguuauuaaagacagaaguugugaauuuccuauagauacauauuugacauguaguauagccauauuucaaguuuagucauuguuuuuuacuuaacuaaagagagaaagacugcauaucauuuuuauggucuuucucuuuguaucccaguauauauuaaauaggaaaggcuugaaauaaaucuuaaguauguaaggcaaaagaugcccuggaacuggaguuaaaguugcaagcugccuuguggguacuaggaaugaaacccagguccucugagagagcagcuaguacucuuaacugccuagucaucucuccagccucaggaaggagccaaauucaguuaaagccuuuuuugaaauuuaguagggaauaccuucugguguguuagauuuuagaaugauugauugcaguggcuaaaauaacuuuauauguuaauuuauaauguuagcucagaauuuaauaaagguuaaaaguuguugcuugagaauuaaggacaugcugguaaauugagguauaaacaaaaacuuuaaaauaaguauuuuaaagaacuuuaacuucuacacaaguuauuuuguguguuuucaaauacaguucuugcuaguuuucucuacuguucccugaaaacaauuuguuaauugguaccaauagaaguauguucuagauaauaucaccagauauuacuauuaguuaggaacuuuaauauaauuuuaaauuuuuccauagccuguuuucacauucaguaacuacuagaaugcuaccauuuuuuaucucaauaguacuucauuauuuauuaaacucuuauuucauaaauagcucaugcuauuuaauguucauaugauccuuugcuuguacuaugaaaacuguuuauucuucagucaaugcuucaaagccuugucauauuauauuuuuaaaacauguccauuuuccuauacaucuacuaacuucucauuuucuguucugaagaugccccaugacaugagucucuuuugagguuacauuuaucauaauugugcauuaacacacacaccuuucuacauaaucauuuucucuguaucugcugucuggauauacuaacucuuccccucacuuaaauauuuuaaacuccuuuucauuaauucaaauugguucuuuugucacacaaacuggaaacauuuuccacuuuguacuuuauauuuauaggaagcugcauugucugucauucccaauauaguuuuuguguuauuuccauuuaaauuuuuauuuucucuggaaaacaggaacaauuauguauuaucaucuuuaauuuuuccauaguacuuaacaugauauuugucacuugguugaugauuuuucucacuggaaaaugauuagaaaagauuuaaaguauccuuuuaaguggauaucacaugcauacauuauuagugccaaagaaacuuggagagauggauggauggaaaguuggaagguagcuugguuaauauagugagauacuguauuacgaaacagaaauagaaauuuugcuauuaauuacuugaaaaaggauuucauuuuucccuuuaguaaauucaugucacauuaggucacacugacuuuugaccuuaaguagauuguagccugauguuucagaaauucacuagaauuauucacaauuaugaugcuugccaaaaagauccugcuuuguugcucuauuuuuucauuuuccuuucuuugagaaaaaguguaugcauugcacaggcuagcucucaggcucucgguccuuccaguugugcuugggaacuuugggauccugugcccaagccuccccucuccucucccugucuugaccuuaauauucccucaaaccauuucuugagcagagagugccauuggauauucuauaauuauauuuggcucaugucugaguuacuuuacaucccaacaguaggaauuugggucuuuuuguauuggauaguuguuuuuuguuuacuugaaauaauguguauuacuucaauauuuaaaauucacuuuugaauuuuuauuugaaaaauuuacaauuugaggugaaaagauaaugucauaggaauaaacuagucuuucguauuuuagaaauuggaagaccuggagagcaagaaugaugaucugcuuacuagaacacaaaaugaacuuaaggaugaaauuaaugaucugcagaaaaaaauuuugagagaaucuguaaguuguauuucaaacugaaaaaaaaaugaauuaaugaaagcacuucauaguggauaaguaccacuaaaauaaaauauccuugcucucucucucucuccucucccucucccuuccccuccccucccucucccccucccccucucccucucuucugaauuacaggaggagucuacgcucuuuugaugggaagaauauuugaagaaggaacuuuaacugaagugauacaguucaaaugccagcgaggauccaugcuugaagacaaguauuaggauaaaugaugagaucauuagucauuaguuugucucccuuguucuuuauuuagaauaacauccaguuauguuaguaucaacuauuccuguaugucaaggauuugccucuuuuguuauaauagagugaauuuuuguaugacacuguugaguuguuaucaguaaaaaugauugaaguuuggau

SEQ ID NO: 9504 - RNA, 2246 nt, Mus musculus
gccccgccgaccccugggacucuugccaccucgcugcagugcgcggcuggcaagugaggaguaaagugggcgccgccuaggacgggggaguggagcuuccugccccaggcagcggccaggcggcuccgcgguugauuauggaagauucccacaagaguaacacgacagagucuacaucucagccugguucaaccguugcggggccucacguuucucagauaguacaucaggugucaucauuaucagaaagugaggagucucaggacucaucugacagcauaggcuccucacagaaagcucacgggauccuggcccggcgcccauccuacaggaaaauuuugaaagaccucucuucugaagauacacggggcagaaaaggggaaggagaaaaucccagcauuucugccaucacgucuaugucuguuccagcccccaucuaucagacgagcagcggacaguacauugccauugccccaaacggagccuuacaguuggccaguccaagcacggauggcgugcaggcacugcagacauuaaccaugacaaauucaagcaguacucagcaggggacgauccuccaguaugcacagaccucugacggacagcagauacucgucccgaucaaccaggugguuguacagacugcaucaggagauaugcagaccuaccagauccguaccacaccgucugccacguuacucccacagacaguggugaugacuucuccugugacucuuacaucucagacaacaaagacagaugacccucaacuaagaagagaaauacaacugaugaaaaacagagaagcugcccgagagugccgccggaagaagaaggaguacgugaagugccugaagaaccguguugcuguucuggaaaaucaaaauaaaacucuaauagaggagcuaaagacuuugaaggaccuuuauucucauaaaaguguuugauucuuuaaagagaaaguauuuuuuguggacuuuaaagcuuaaaaauuagguggauuucuuuuuaguggaguucuauaaauucaaaggucaaagaagcuacuuuguguuagguuuucacaaacagacaugauggagggagaauggagaugaccugcagaaagcugcugucucaauuggaagcuccgaaaagagagagugcucaaggaauggacuuucagcaguuuaaauagaaauaauggucagcaacgaaaauggcaggugacguuagugaagcaguccguuccugcuacgucuguauuucucuguucccuaaaacuugccuuugugugugugcgcgcguguguauguguguaugugugugugugugugugugugugugugugugugugugugugugugugcgcgcgcgcgcgcgcgcgugccucauuucugccaauaaauuuacaaauguaaaagcauaaagcguuacuaaguauguaaauuauguggucugauugugucguaaugucagguauguuaaaugaguuuuuagcaguuaguuugguuggacucgauugguuuggagaucuccuaaauggcguggagacgcaucagccugugguggaggugguuugugacuuugcuuugucagaaugucugcaaguuugacaguuuaauaguuuguuuuuugcuuccucugauaagggcaaguacauaauagauugguuuuguuuuuuguuuuuugauucucuaauccugugugcaguugaagaucauucucuugcgcuuuaacagaaugaaguguuugcaaaggcccucaaauguuuuuaaauaaccugaauaugcacaccaaaacuuuccugagggguuuuauaaucaucuuaccuuaagguuugucagguucuaaaacagcuacugaggcaaucuuacguugagacuauuguguaauguagcccaugguaccuuuauaaaagaagugacugccgauauauuuuuauagugaaucuuuauaaauucuaauguugaguuuuuaaugauuauuuuaaauguuuauauaguuuguuuagcaaaaaaaauuguaucucaaaguaucauuuuuauauuaugagaagaguaaaguuuucaaauuagcugauaauugaauuguauguuuuauauaaaguuuuaucuaaaguuucaucuguggucaguacaccagcauuuaaccucuguauucuaaucuguguucacuuggaaacugcagaacuguugugugccuacagaguauguuucacauugucugugaaauuuaaaaacauuugauaagauuaaaaaaaaaac

SEQ ID NO: 9505 - RNA, 1381 nt, Mus musculus
uuuuuaagauuuauuuauuuauuauauauaaguacacuguagcugucuucagacacaccagaagagggcgucagaucucguuacagaugguugugagccaccaugugguugcugggauuugaacuccggaccuuuggaagagcagucagucgggugcucuuacccacugagccaucucaccagcccucaggauaucuugacuugcccacuuguaugugacucacaaaaguuaauucucauguccaaaccauggcuugaaauggacuagccaucaagacucaguccccaagagaaacuuucuguuaaccuaggcuguaugcuuggcuuugagauggacaucugacaaauauaaaggcuuaggaauuuacuagucauuaaaucuuaaugaaagacuuacucaagucuuucucaagcacuuuagcaguaagaacaagagacccaagaggaagacaaagaagaguuacaaaaacagcaaguaaauacucacacaaaagggcuuuagauggagccaaaagagcagauuagaagcaagcagaacuuaccaguuucuucuuggcucagaaucaaaaaagacaaagaaaaauucagugugggacagcgcugaacaucaauauuauuuggauggauuuggagggaccugguggcguuuauaagaagauaaagagaggagggauguguuuucugcuuguguagucagguaugggaaaaggggugucuccuuggguccaugcugaggcaucccuucccccuaauggaccagccacacgaugggaugguguaguauagaauagaauuuauucaaggcauggggaggggaguuaagaggguagcagaggcagagaaaggcagagggagcaagggggagguagauaaguagaugaauagaggucugcgaggcagugggcaugggggaaagagggagugggggaaaacccgcaucccgccagaguuccggugcccugggcgggcagacauauaaggacugcugcacacuuuccacacagcccaggguaaaccccagcucgucggaggauggacaaggggcaguccuagguaccaaguucucagccccuggcaucccagacaccacuggacaccgcgaaagagcugagaacagaaugggggccccaggggcggcucagucagcucugggccgaagggaggagagggcaggggggaaagggaggcgcugugugguucccacgugggugagaguccuugagagucagugucuggagcacagaaaggccuucuggagggagguuagauguggcucguuaggggaaagccuauccaucaucguucaagcacugcaggccuugaugagcagagacaguuuaugguuuuaggacuuuauuguggaaaggcagggggaaagaga

SEQ ID NO: 9506 - RNA, 53007 nt, Mus musculus
  misc_feature (1479)..(1479): n is a, c, g, or u
  misc_feature (7439)..(7439): n is a, c, g, or u
  misc_feature (46658)..(46658): n is a, c, g, or u
gugagcagacagaaguugugucagugaacagagagggcucucagucuggggcgagcgcucuagugagcguggacggaugcuuaggcaguaguccuggcagcggcagcggcggcgggcaguagugguggcagaagaggggaagagagacggcccggagaccgacacacucacacuuucaaguucccuuggagggagaggaguuggggcugcagaaagaggccaggagcggucccaucuaucccaucccguuucccacuuuuccucuugcucccuggcucugcgagaguucaggauuuggguagccauacguggcauugagggaaaagggacugggagaguggggaccagaaccagggguguaguggaagaugcccauccugcuguuccucauagauacguccgccuccaugaaccagcgcacugaccugggcaccuccuauuuggacauugcuaaaggcgcuguggaguuauucuugaagguaaaaggaggggaaaggagaugaaggggucgcuucugugggauggguggguuggacugaggugcuucuguaacguuuguaucgcuuccccucguuuccuacgcgacccccccgucaucccucgccccgcagcugcgcgcccgggacccagccagccgcggagacagguacaugcuggucaccuacgaugagccucccuacugcaucaagguaaacaggccagcgggggagcggugggcgggaagagcgugcgcguccacuagccuggggcugcugaucccuuuugccuccacccguggcgauccugcgucgcccugcgggacgggcugcagugaggagcgccgaagggcaggaggagcagggcggguggcggcggucgggggucgcagagaggggcccggagaugagcagccgguguagagaaggcacuggagggccgaguuccuagcacggcugcagcaaucgccuccgaagauggcggacauuuugcuuuuguaugaggcagccagaggcagggugagggcgcugcugagauggaaaggagggaggggaggaggccgaggaaggagggcucgaggcccauggugaggcugcggccccuucgccugggacuccgccccgauguucucuuagccccgcgcgggcuuugcugccgcccgagcuccuccucuggucccuccuuccaucccucggcccgccccgccugggcuuccucucccuccucccgcuccgguccguuucuccuucaccgcaucuuccccuccucuuccugccaaaugccgggcugcacuagcgcuggccucccagagcagcuccuuugcauucgaggcucuggcccccgccccuccugugccaccacuagcucggaacugcuuagccuaugcagcucccagacccugcacgcucagucagguugagcccagcucucaguuaccuuagcgacaguugcuguuucauuggaaauuccugcgaagcaaccacagaguguuugggggagggnagggggcgcgcgcggggggguugggagggggugcccaggcaaaaucuucuuagggaacugguuuaacaggggccagaguguuuuagggagcaggccuaccuauuugcauccgaaauuagguuugcucuuagcugcuuagggauuugccagggggcguuuagacugagcagaugcacuagaccaagucaaugauuugauucucagggucugacccuuagccucggugggguaguuauuuguguucccauggugaagagauaaagaacugguucgccugcaguggcuugauaagaagaacucaaacuguuaaaucauccugcaucaggaucgugcuugcauguugaaauauuagaagguuguuaccauuauccuugaugucuuucauuggugcgucauccauccguccccccucaccccacccccggucuaacucaucucaguaaauuaacaggagguucagucuggauguuguaagcccugguuuagugaguuguuacgucucaaaguaaguuggccagaauguucuucagacauaaugaaagcgaagauacugauuugguaacucucugcuuugauuaaaaguuuaaauugcaggcuuuuccuaauacuauucugguuucagcucguuuguuuucaauuuuuuauuuaucuaccaaaaaucguauacuucuuguaaauauccuaugguuuuagaaaugucaguuuucuaggcuagccugggcuaacauauugagacccuagagcuggagacauaaauuucaguaauggagcacuuacagauaugaagcuuugcaaacauucuaaccuuagcauagaaaaauaaaauaagagccagaggcugauuguugacaccucuugacuacuaaugauaacaguaagagccuaccuuuuguagugcgccuauuugaagacauacucaguaauuuaaagcaguggagggauaagcuccaaaaucaguuccuaccuaucguuuucuuucaagggacagcauuuugcaaggacugaugguaguuccuaaaauaguuuuuuugaguuauaggaauuaugugacagucuguccugguauuacaugccuuuaaucucuaguauacaggaggcagugagagagauggaccuuuauaaguuugaggccagcuuagucuacucagcaaguucugggccagccaggguucuauagugagacacuuucucaaaaaaagaaagaaagaaagaaagaaagaaagaaagaaagaaagaaagagaaaaaggaaaggaaaggaaaggaaaggaaaggaaaggaaaggaaaggaaaggaaaggaaaggaaaggaaaggaaaggaaaagaauccaugacaauauuaacacacuccuuuccuuuggcaggaagagguuuugccccauuuuaacagucauuauuacaucuucaauccuagcacugggaauccauggcucauacuauuucuuuucagugcuagagauacaacucaggcuuuucugcaugcuaagcaacuguucugcuccugagcuacagcccagccagugugcuuauuuagauucgguuucccccacuucuuuuauucagugaauuacccugaguggccaugcauguuugaauggcuggguauuuuagccacauguuuaugaaacuuucgauauuuguuuggaagagaagaaaauguucaguauuauauuuaguggaaauuuuauuguaguucuuuuucuucugcuauguugcauccuacaagaaguauuccaccacugaugucuuucacacacuuucuucuuuaaagugugugaagauacauuguguacuauguuuaauuauuauuauuuuuuuaauuuuaugucuguugguguuuugccugccugcauaucugugugagggugccagaguccuuggaacuagaauuacagacaggugugagcugccauguaguugcugggaauugaacccagguccucuugagcagcuggguguucuuaaccacugagccaucucuccagcaaauuaaacaaauuaaaaaaaaaaaacuaaacaaaucucuguuuaauuaucaaucacuuagucuuaguucuucauuuuaccuacguaaaaggaaauauuaaguaucuaguaauauuuuugugcuuuacgaacauuacuauugguagaccauauuuagguaagaguuuucugaauuuccauuuuggacuuuaccuuucuaccucgcccaaccuucucugccugugauaaccucguucauuugcuuuuuagguuguagcuugcuuagaaguucuggaauuuuagagcaucuugugauaguuuucuuaaaauucaguauagauuuucacguucuaguaguccuauaggaccguuuucggucacacaugauaucaaaauaggucuuucuuugacugucagcuggcaucuuaguuucuacuuaaaacuuuauucucucuuaggggcucaaguaaugguuugguaguauuuuauugguaacaaauuguucugcagaauaaauaaagugucauuuucacuuucucugaggcugcagaaacauugcaacauuuuacuucgcagaucuggaguauauccaacuccaaaugcuuccaaaugaauuuuauuuugcuaguagauccucuucuguuccagcuguaauaagcaugaguugugcauuugcuuaggagauuucuuuuuaacaggcaugcagcucuucccaguauauccacuuacaagcuuugacaagaaaucuugugcgaaguugcugcagcaggaauuuuucacuaacauaugugguugaguauguaaauauaguauuucaccaaagacuugguaacucuacugcauacuucuuugcauauagcugucuacucuuuuaauauuagucauaccuguuccaugcugugccauguguguugaugcaauuaaguuucauuuggggaccauguaugaaaugcaaacauuguguguuaaaucucuguugcuaaguguugcuucauaaacuuguuucauccauggaguuacaguauuaaugcucucuguaugcacuacacuuucaguguacauagcuagauacuccuguuuaguauuauauauauauauauauauauauauauauauauauauauacuauacaguguguccuuagaagaugaaugcaguacagggcuuuuaaaauguugugugagaacuuuguggcaauaauuauaguucucaauaguuuuggcugagauucugcugucuuguauguuuuguuuuguuaugaaucauaauuuccuucuauucugugacugggagaggcaggcuugucagaagaaaguaagccacuagccuggguucucuccuaguaaaaguauuaaaaaugauauuauaguugaagccacuuuauuaaaauuauuuuuauuuaaaggaguuuuuuuuaaauaacagaaacaucuuucaagaaauaguugaaacgugaauaaauaguggucagaaguguuauaaauaagagauaauguuucaaagaaacucucuaagcuaauaauuugaaaauauaaaccauuugaaaaagugagcaucucucuuggauguuacuuuucaacauuguguggcuacuuuugauuacuagugucugcaugccuuuaccaaugugagccagaaagagaaagaauucuggcuuaccaacugaggaaguaaacucaauauuuuaaaaacugauacauguaauagacauuuauuagaauuuugacuaaaguauuaaaagaacauuuguuguuguuguuguuuuccagacaggguuuuucuguguagcccuggcuauccuggaauucaaagacacccaccugcuucugccuccugagugcugggauuaaaggugugcaccaccacugccuggcuaagggagcaccuuuguuuuguuuuguuuuucuuuuucugaggcaggguuucucuguauagcccuggcuguccuggaggucacucuguagaccaggcuggccuccaacucagaaaucugccugccucugccucucaagugcuggaauuaaaggagugugccaccacugccuggcaaggagcaacuuuuaauggaguccuccauugugguuaagaaucuauagaaaugcucugguuauccugaaacuuucuguucaggaucuuucagaucaggcuggcuuugaacucacagaguucaugcugccucuaccucccaagugcugagauuaugccuagcuugauuuuggcuuucuuucacacuuccccuccucccuagcuauuugaagcaucugacaauagucauuguagauuaucaaaagaaaaggggaugggauggggacuuaacucuagaaggccauaucucuggccaaggucuaauggucugaguccaaugcugagauuagggaucaacaagaagauacaaggagagcacugacgacauuguagagaucuaccuucuauccuagaccucucuuacguauaucuagccauucuugaaaugucaguguuugccacuugucaccagagccacugguguggcugacauucagcgagucuuguccucuagucauucuucccuguuuguuaaucuuuaaauaaagugaaacagucauuuugcugugaaaauccuucaggcaccgggcaugguggcucaugcuuguaaucccagccuggcuuugcauauuuauauuuugucuccaaaacaaaaccaagcccugaaugaugguuuccucaugggauucuaguacuuggaaguuugaggcaggaggauugccaugaauucaacuauccugugcuacacagugaauucaaagagccugggcugcagagugagauauuaucuccacaaaaaguaaauaaagagaaauaaaaaaaaaaaaaaaaggaaaaguccuucaggauuuuccaucagaugucagaauaaaaaguccaaacaccuuggccuaaacacuagucaugccuuuaucuggauguguguuaccuuuccaacaaugucugucuauuuucuucucacaugaacccaggcuccaaucagcaagagaaauuaaguccuccuuuccaaagugguuauaccucuaacaucugugugacuguauauacauuguucucuauagcuuggacguacuucaacucauuuuguuuuguuugauccgauguagcccagacugacuuugaauucauagcaguccuccggccucagccuccagagugcugagaucacagacuuguaccaccaugcugggauuugcuuuucucucuagccuccugccucaggcuucugcgugcuagaauuaaaggucuauaugcugccgcacccauucagcuucaacccuuucuuguacauucucugaagugaucaggcuccucuuccccacuuccacuccaaggaguguagcaaguucccuuaacccuuucuccacacagccuccccugccccccacugccaccgccucugcauuuagcaguuuauuacuguauguguguugauauucuucugggauacugaauccacggccucauagaugcuaagcaguuuuacuccugagauacacccacagcuccuaacaugguaaauguaauaguguucaucuugaccucccuaauaugagcaucugaacauaaggaaggcuguuuguaccucuaguacuagagagugccuagaccuuacuagguauucaacaggaaaaaauauuucuggcaauguguacaugcaaaagcuacccccauccccaccagcauccccauuuucaagauuuuuuucuccagauaguaaucaccauuaaccauucuaauuuuccuuuaucugcuucucauuccucuuucuugcagggaaaugcaacuuuuauuauugcugugauaugaucaaaauggugauuccccaggguggucugacggugccucccuaucucugcagucuaggcagacauuuauauuuauugagcaaugucugcgcacuaagcuuuguuauagagaccuaggguaauaccaggaaacacccagcucaaggggaaaacgggaaggagunuagaagacucugagaacgcagguuauuucauuacaauugggaguaguucagagagaacacaggagacuuuugaaaccgacaagcuacaguuuguguauuucuuuaauggaggugucugaaguggauuuggagagaaguggggguaggguuugucguccgugccuguuugguuaugauuuuacagcauucguccaagugggccaggguggagaggaaguguggaggugggguaacguagaagguuuaguggaaguugucuucucuuuaauuagugcuagcuacuugaaaguguuucauccuggcacugggacuggggauguagaaggccaggugcagggaaggagaaggcaaauauuuuccuuuucaguuugccuuugcuucuggaagagaaaaugagcugcugagaacacaggguucuuaguuucacagugaccaaacaaggcagcuguucuaugucuuggggugaaacgcgcuuucuagggaagggccagauuguauggguggggguggggucugaauaaagaaaaauuuaacuccuuuaauauggauccuuaauugagagagucuccuguucccuucccucuaguccaacagcauggauacguguuggaagccggggauacuuaucucgugaauacaggguugcaaguagugaucgacuuuccagggcuuccuucccaggcaagccuuuuuaacccauagaggucacucagccacagaacugcuguguuuauucucuguugguaaauggguuuggguuuccagucugauuucuuuuuguuuguuuguuuguuuguuugagacaggcuuucucuguauagcccuggcuguccuggagcucacuuuguagacuaggcuggccucgaacucagaaaucugccugccucugccucccaagugcugggauuaaaggcgugcgccaccacgcccggcuccagucugauuucuuaaaaacacauccucucaagacaccguuuucuuccucagaacucccugucugugcugugugaggauuuggaaaaggcuccggcagagacagcaagggacugaggggguagagaggugguuggcaugucuuucaaguguuuacccuccuuugugugaucaucugcaugugucacucuggugcaugugugcaggucagaggacuucucuccuuccacuauguagaaccagggauaaaacuuaggucaccuagcuagggucaagcaccuuuucccaccggccuaugucaguaguucgagauucaauauuuuucuacuguugccacagcagccauagccacugagcacuuugaaaguggaugguuuauaagugugcugaacaaugcaaaauauaguuggcuauauuauguuaaguaaauggcauacaauuccaguugugugugugugugugugugugugugugugugugcgugugugcgcgcgcacaugcuugcuugcucgugucuguguguguauguaugugugcgaucuuaccauauugagcagacuggccuagaacuccugagaucaagugacuuucuuacagcuagcugccucuugagaggcugggaccacaggcacaugcuaccaguccuagcuuuuauaguuuuuaaaaugugguugcuuggaaaucuaaaguuccaugcaugucucacacugcaguuccagugagcagugagugucucucuguccucuuucugaagguaguuucugaaguucaggcccuggaaauuguuucugaaggaggcucuuuucucucagaguccuguuuaaaaugaacaccaucauaaaggccucauuuauacaugaaagguuaucuuacaguucagaguugauggcucgauaacccucaacucuggggcaaaauaugaaagcauccuauucuuggcuggacugaaagcuaguuugcuugcuuacguuuuuggaugcaguugccgauccaacugguuggguuagauuuuuuuuuucccugggcuaaguauaauauaguauacaugugaacgaaucuaaguguaaucgcucaggauuccauugacagcauguguucauugguagcacucaauguuucaggcuuucaguguuauuaaagucuuuacucuguccuuccuuagaguccccuagcuacuugguuccagauucuccaggaaccgcuuucugcaggaaaaguaagugagaggauacacuuuuccagcucacauagugcaaucguaagaaacaaaagggaguuugaaucauugcucucacggaaguuuauuuuaaugcucuuugcucagcccugucuuaucaugggaagucaucagagccuuaaagaggaaugcaugguggugguggugggguuguccaccugacaggaaagugucgaagauucuuauuucugggggauucaacuuccuaguggaguuucuaaggccaaucugauugcauuauuacuauaaaggcuccaauuuaaagaauaaauguguauuauaaagaugcuagcacagauaagccuguuaauaacaugcaaaauaugugggaguggcuagaauguggcucaguaguaauuauuuagauuaugugaagucccagcacuguaacaaacccuuuauuuuaaagacauagaucauuuaauagccaaguuuuggguccuccuaagucuuauuuuauggucaaauguauugucuagaccuuaucauaugccauaugcuucagauaugaauugacucagaucugcuuccuugaaaaaaugcauguuugcuuucuaauaauagcagcugacaauuauugagcaaugcuuauauacagggcagcuugccagugaauauaaaguguuuauuuaguuuaucuccccagucagccuaugucauagguauuauuaucaccacuuaauagauaagucagagccauuuaucuggggcccagagagguuaagaaacagaacugauagcaagcugccucuauuccagagucuucuaauaugauagugcauagcaaagcaaucacccagcgagggaaaauuaguacugcaaaguuuuuguuuguuuguuuguuuuuguuuuuuuuuaagcuggcuguuucuaggugaguaucauuuugcauuuccaccuuggauagaucucacagcuggagcccuguuuagcccagguguguagagugauucuagugcugaggggacgggacuugagauagugcauaucuuguauagucugucagguggggaggcugaauagaccuguaagaacaguaccagguuuggcaacaacaacaacaacaaaagaaauaugauuuuuguuuguuuguuuuguuuuuuucgagacaagguuucuuuguauagcucuggcuguccuggaacucacucuguagaccaggcuggccuugaacucagaaacccaccugccucugccucccaacugcuggaauuaaaggcgugcaccaccacugcccgguaaaacaggauuuuuaaagcucugcaugcaccaaacuguguauggcuggcucugugucccuccuauugcugguaagggcuccauuucauccaguguucccauuguccucaagccauggugagagaguucucucuuucuuacuuggaugaccugcaauuuagauggauuucaaaggucuggauucuggcauccaguucuuugaaguccacugcacgaagacuuuuguggcaaugugcuacacggccacagaaaaaccugagcuuuguaucuuaaauccuauucucccgauucuacaguucaucaggacucaccaugcucuaacccagcagcuugcaagccauugcaguuaugaagcagcaaugaaaacaauuugaugauuggggucagcacaacaugaggaacuauaauaaagggucacagcauuaggaaggcugagaaagcaguuguuuaauuacuuauguccaccccuugguuugaaucauccaguaaauuuuguaccaaaagccaagcuuugggacuugaaugcuauugaacaaaagacucgacaguuuuauuuguacagcugaggaauacuacuauugagaaaauaugguuuacuacagucuuaaggguucuuuccuuugggacuccuuuggcaaggcugaaaugaugggucacuggguaccagcagugaccuccaaagccuggcaaccugagaauuauccucaaaggccaugcaaaagugggaggaaagaacuggacucaccaaguugcccucugcccucugcagcugcacugagucacaugggcccacacacccaguacacacacgcacaauaauaauaaaaauaccaguuccuugagguuuuacguuucuuugcaaggaguuuccuaguguuucuuccccuugcccuuaguagcuagguuugaaaugaacuaccucuuucuuccagaggcccguuacuuccuuuagaaaaggcucugcuuugcugucuucucauccuugcccuagcuucuuccuuuuuuuuggggggggggguugguuuuucgagacaggguuucucuguauagcccuggcuguccuggaacucacucuguagacuaggcuggccucgaacucagaaauccaccugccucugccuaccgagugcugggauuaaaggcgugcgccaccacgcccggcuucagugaggacauuuuauaguccuuugagauagcagagugaaaaacagaaaggggagaagcauccaugcagacagaauauaucaaacuaugaaaagagcaggaugcauucaucaauggaaaaaaaaaacuuaagaagcucggacaaagccgugcguuaggacaaaccgggcgugguggcgcaagacuuuaaucccagcacucgggaggcagaggcaggcggauuucugaguucuaggccagccuggucuacagagugaauuccaggacagccagggcuacacagagaaacccugugucaaaacaaaacaaaaaccaacaaaaacaaaacaaacaaacaagcaaaauauccucccuagcuagcugcucuaaccaucacggcacaguuacgguguccauggauugagucguccuguugcaucaaaucacguaggauuuaaagcaaaccacgaugcagcuuugauucuuuccaucuuuuuucuaaggccuagcuggcgucccuuuaacaggccuccuacagccuuagcuucaacucacuuuugcugcccucuauguugugaugcuuugagcguuauaccaaccuuguaauuggucuuccagggaccucccauguuccuaccauccguucaaaccaacuguucauuuucuuuaaaauuucauuuccucacaucguucuccccaugaaccuucaaagacucuccaugccuauggaggccaaguccaacuuucucuggguuuuuagagcucucugggaccugcuccauguuucucuauaaauuuauacuucaucauuuguggccuaacacuucagccagaccugucucauauaccugcugggugugacuaucggacucugucugcaacccuuagaaccucacuuaacaaaggaccuaagagauccacagccuggcagcuuauggacugggguggggggagggaucaggaaggaagugaacugaaagguucccauuaagggugugacuugaggggaugaugugacagaaggugcuuuuaaacuguuguuauacuggagaggcuccgagggaaugggggagggaacuggaguaugaccuuuagugguuuauuagccugaaccagaccagagcgcauugguuuaaauuggccugaaguugccuagaagcacauuuguuuagugaaaaggcucagucucugcauuucugucaccauggaagagagcccacauagcuaggcaauagacugugggauucuuggguucguaucaaacauuuaauucagccauggcauuggaaaguaaggacucccuucugcuucauuucuuagagaagaaugucaaugauguauaaagcagaucucucguuuccaugaaaauuuccacacguauauaaacacuguaaauuuuauuucucuuucugucucucucuuucccucuaucuuucucucugucucucugccucucucucucucugucucacacacacacacacacaaaaacacacacacacacagguuuucuccauguagccccuagcuguuguggaacuugcucuguagaccaggcuagccuggaacucaugcauaucuaccugccuuugccucccaagugcugggauuaaaggcaggagccauuauguccugugugaacuucauuucaaaguaaugcuuuuaagcuauauguuaaaaguggauucaaaagcugggcauaguccauccugucugcaaaacgagcuuuccacugccuuggcuuccugcaugcugugccugagcugcaagggugggagaccuaggguuuuaaccugagucugcuacuaauuacacccaugaccccugagcaagucgcccgaaucuuuuauggugugaguuuccucaucugguaaacgacaggaucagacuggauuauuuccaugguuccuuccugaagggaguaggagaaagcuauagggcugaaaggcaggaagcggaauaauugaggaguggaauuccgugugauuuagaaaucacuugaaguuucagaaaauagcuuacucaaguugguaagugccaccccacuuuauagugcuccuguuugcugcuacaacgcuugcuuuucccaagucgccugucaaugauuacuucagaauccaggugcugaagguugagcgaacagacuagcuuucuuuuuauggguggauuuucaacagugaaugaauguuacuuuuauuuugugcaaaucaacucaaaacuuauuuugagauauuuuuuuuuaaaaaaagaauuagcccccugggaagagaugcugugugauauuagaaagucauaaaugaccauccuguucgcauugcugagcgucaucccugaccaagagccaagugugcuuuucccuaggccauuucugugaauuuuuaucuuguguaucuguccacaaaaaugucucacuguaccuaggcucgauaacacuuggacucuuagcagucagaggcuaagaaaggcauaaggcuagugaguuugaaguuagccuggcuauauaguaagacuccucaaaaaaacaaaaacaaaaacaaaaacaaaaacaaaacaaagcaaaacccaaaccccaaaaccaaaaccaaaaaaaaaaacaaaagaaaaacaaaucucaucuuagaagcuaauauugaaaacaaaaaucugcacaguagcuuuuaaaaauauuuguuuaguuauuuauguauauguguguauguaugugcaugcacccacagaggccaaaggaggcuguaggaguguccgaagcugcaauuacaagugguuagguaccaucugauagggcugggugcugagaaccaaauuuggguucuuuugaagagcuaugagugcucuuagccaccaaaccauuuuccugccaacaaaagagcuuaaaaaaaaaaaaacauagauauccaaguuuuguuccauuauauguagcagugcaauagacucagacagaagaugaaagucuugaaacuguuaauuucuacaugugcccauccacucacugcugaagaucaaauuuccucugcucuuaccuuacuuuucacugacuguuuguuuucugcucaguuuacuuaacacauguaauccugugagucucugucagccccuuggaaaacaauucaacaggccacagagugauaaauaagcauuuguaguaauauauaagggaaccacuuuuuaauaaaguggguuuuguuuuguuuuguuuuguuuuaguguaggagacagucuuguucaguuguaccuccugaagcacagggauggaaugguagcauuccguguccacaggcagagagauucucuagugaaugagaauggauuuugcagauuuuagcaaguucaagaugcaggggcccucaaggaguaacucagacaaaugggaaucggagaaaccauguauuccucaaccaaguguguuguaagaaagagcucuacugaucaaaagacuaacagaaugcaucccuugagccucccaaggguguagcaguaccauuagucaaaugccaaagccgagggaugcuucuccgugggcuuaggcuguucuacauagcaguuucccagccagccagggcuaugucuccguaaaauaaaauaagggaaaaaaagugaaaaucuucacaaaggaaaccaaguuaaaauuuuccauguugggggaaauaggagagggcacacaaggcaaccguuucauugcugcaaugcuauggcaucuucucaauguguccgcccuaaugcuaaugccuuccuucagaggugaauuagauagaaauaaucugaauggcuauuuuaaugauuucaucugucagaguguucuauuacugauacaucucuuauauagagauuggagagcagaccugugugugguggcucauguccauaaacucagcacuuugaaagcugaggcaggaggacugucaacgagucaaccaggacagucuauauauugaauuccagggcaguuugggcuacagaaggagacucuaccugaaauaaaagcuaaagguggggcuggagauauggcuuagcaauuuaagagcauuuguugcucuugcagaggacuagaguucaguucccaguaccuacauggcagcucacgaccaucuguaaguacaguucuuggggaccuggugcccucuucuggacuccccaggcaccaggugugcaugcgauacacauauacacaagcaggcgcacgcacacacacaagaucgaacaagucaguuuuuaaaauauaacugaaaccaccaaacaaacaaacaaaacaaacaagccuccaaaauugggaacagggaugggcgaagaauugaauuugaauccauuuuaaucccaaggagggaauucuuaacauugaaagcuuuaaguugcacaaauauuuggcauaaggcuaaggacaagaaccaagagaaaagucauuugucuuguggagagacagaguugauuggaaaagcugggcauauuuuuguuccaucauuccaucuuuuucaucuguuuacugacauagacccgguucuugaugacaaagaugaacagugucaaauugaagaagaaaguaaacugguuaaaaaauacuguugaaauugcuuuauuucaauggucuggguugcuacagagaaaacuuucccuaaacuuauggagagcagauggaaaaaaagaaaaacuguuuauccuucaacaaaagaauugauggcccuacuauauuuagacuuuaacuugggacaucugggaaaauguucaaauccguuaaucaucuaguuuguaacuaucuacaaagaagcugaaggucgagauuagcccuuuagcauaggcuuaugaagaacaaauacuaucaggcugcuuuuauuuccuuucaugcaaaaccaaauguguguugaggagggaaagcaacauguauugucucccggacaucaacagcagcccuuguuauucagucgccaugaagggcucuccucagcugggaugacuuagacugugcggcuaucaggagagugucaagauaggcugaggagcaacugugcucccaaaugaggcaugaguuggggacagaaggucacagugacugguguguaagagaggcugggucgugacagucuguaacauguagugcuuuauuuuuauuuuuuauuauuugcucuuugaauagauccacugcugguaccuuuuaauagcuaaccaugcuagagaauuucaaucaucuauuuuuuuuuucugcuuauacucaauuuacauaguuuguaaagaacauuuaggugcagcuguccuaaauaccuuuaugcacgacuuuggauggggauguuaauacuguguuuaugaaacauuugaauuaucuuaagucaaucaaggucacuaauauuuuggaaaaggauuacaaaugaccuuuagagcuagagcagaaagggcucuagcacuacucccacaucccuccccuucgagcacuguggaucuucuaucuccuuuacuuguuuagaauuccugccaagguuuaauagagggcagaguuucucuauuaaaaaaauaaagaagccagguggugguagcgguacaccuuuaaucccagcacuugggaggcagaggcaggcagauuucgaguucgaggccagccugguguacaaagugaguuccaggacagccagggcuauagagagaaacccugucuagaaaagccaaaaaaauaaaaaaauaauaaaaauaaaaauaaaauaaagaaaaacccuacaucagagauguaggaaauggucucugggaaauggaaugaugaauaagaugcugagauuugggggugggcgguugcuaaauauuccuccauuugaagccaguggagaaauagacacaagaaccagcuagagucccuuuuguuguuuauuuuuugagacaaggucugguuugccuccaacucacucuucugccucagcuuucccaagugcagggauuacaggcaucaaccaugagagucagaucagaguucuaaguaacacccuucuuccucauaaaggcuugacuaaggauccgaucuagauguauguuggucuguuuaggaccaggacuaccuaccucagaagcacugcaggucagagaacaggcaauucaaaggggcuuuagcaacagucugggaaagacagugcuggcagauuggcucuaaacuuggcacuuaggguagaagguacagauagugguaauaagaaacuucauuggaggcuucccaccucugaggagacucucucuacuguguacugguguaacuggggaauacguagcuaguggccaguuaggcagagcugagaacagaaugggucaccagucugcagaaaucccuguguucuucucuugauacgaaaugguauuuuuaagugggcuaugcaaauguaaacaagaccuaaauuaacauacuuuauaaggcaguagguguuuuccuucuguaggucgguuuuacuugaaugacuauuauaagacauggaauuauaggguaaguaaauguuucuagaaggauuguuaugggguguagaauuaugggauaugaaaauuagaagggauguuaagauguuaagagccucacuguguaacccuggcuagccuggaacucucuauguaaaccuggcuaacuacaaucucccauugauccgucugccucuuccuuuagagugccgggguuaaaggcauguucuaucacgccuggcuuagggcugguuuuauagcucuuucauuucuuggaugaugaaauaguucuccagacacuuauucuggacugugccagguagcuggugacacccaggacuagaccagggucauauaauuuuuaaauuuacuacccaaacccuaaguguccugaacuuagccaucagggaaaauaggcugaguaacuugaaauuugaaaacucuauuaacuuugaacuuagacauuaaucuaacagcauguguaugagaccacuuagagagcaugcgugagaguagugaagugguuuuagugggagggacaugcccuaagauuuaggcucccuuccuucaagauucuggcuuggccucgauacaucucagugucuucaucuagaaaauggauguaacacuaguagcccccuucugugagcuucugauuccgaggcuaagaugagaaugauauaucuuagauucugugcuuuacauaggcgaguucccugugaaugagcacugauaaauacugucugccauuauucaccauccccaucauugagacaccuuuccagcuugauccgugaaaacaacaaaugcuuccuuucggacuuugcucaucccggguuuacuucuuggcccuaaaccucccuucuccggaucucuuaucaucuuccccuuuuaggccuguccuccaugacugagucacagcuuguacauuucaaauguuucuuuuuuuuuuuuuuuuuuuuuuuuucgguuuacucugccuucauccugucgcuauucuggucccgacugccccaguccuggauuacuccauaguuucuuuuucugaauaccguuuuccuuccucuggucuguuuugguuguuacuuaccagacugaucuuucagaggcauuguuuuaucuuguuuccccuggcccugaaaucucuaauggcuccauugucugcucucucaaaggccagcccucaugucugaccuccuuguccuuagcagauucagcgacuaaaagaaauaauacaaggucugccauacacaacuuaaaauauucaaguugcaauguuuuaaaaacacucgugugaaugcacacacauuuaguccuagcacuugagaggcugagacagaaggaacaggcguuuaccuggacuacauauuacacuacacccaacuacuuuugcuaguauuuuuuuuuuagagauuuauuuuauucuuuaauuacauauauguggguacgugcaugugaguacauaaguccucagaggcagaggucuagaauccucuggagguggaguuaaagaugguugugagccacccugcacugguguugaauccaacuuguauccgcuacaaaaccaggauguaauccuaacugcucagucacuucuuucaccccuuuauuaguucauuuuaacugaauaugucucaaagaguaucauuaaguauaaucaauauaaaacaaguagcaaaauuguauaugcuauuugggggaggagucuauaugcucaagcucucaugcauagagcuagggaaauaauucugugagagaccuugccuagcauggaaagagcccuagguucuguccucagcaucacgaaaaaaagugucuacauguuuucgguucuuauaucauaucuucauuuugacuacccacauuucaaguguuuaauagucacauguugcucuacuuguuauugcugucacuuccaaaaaacaaacaaaucucacuucuuccuugcuuguucaaauaaaauagaaugacaggggaccuauuugguuggguuauucuaagccacuaugugaagugugaacauacuuuauaaguuuaauucugcaagaauguguggaagauacugucucauaggagaguagaaugucuuggaaguagaauaauuugaaagaaauaaccuggcucugaguacagcucggugguaaaaugcuugccuugaggccagaggucaguccucaguccagauaaaagaaacucuucugcauuaguggcugggacuguagcucagugguagagugugugcuuaggauucaagagaccagaaauugaauaucuguacuucuaaaaaggaaaagcacauuaacugucuugaauuagacugugaaaacuguaaccucacacaaugaauggaaauuauuaacauguccuuuugccuacuguuucaucauaaugguuuuuaggaagaaauuaguuacaucuuauuaauguaaccuuauuauuuucuaauuuuuuuggcuuuuugagacaggguuuucucucugugguccuggcugucauggaacucacucuguagaccugguuggcuuugaaugcagagauccaccuaccccugacuuccaagugcuggguuuaaaggcccacaccacuauugucugggugguucuuuuuuuuuuuuuaauucuaucucccaguccuccuuccuuauggaaaauggaaauagggucauuuacuuucuuucuuaaaauaggauccaggcugcuaucaagaaaacccacaccccauuguacucaaggauagaaugacuuaaaacuuuuucauguuguccaauucaauauaaaggcuaagaaucuaccuaaaagcaccagauauuuagauguugaaaccauuuguaaaauguuuucaagcugugcuauuaaaggacauuuuaaggaguaaguguccugacaaauugaugguuaagacugguaaaacccaggaugcacgcaguccuuuaaacaccaaugaguuagcccucucugacccagugccuugugcaugcuaggcaaacacuaccacugugcuacaccuccauagauuucuucuccuaguuuguuucuguccggcugcuuuugugaaaagaucucaguguguagauucaacugguccugguguuguucaggcugccuuuaagcugucaguccuucugccucaguuugcuaagugcuggauuucagcugugcaccaccaugcucagcugcccguuaaacauuaugaauauuuauugguuuauuuauguauuuacugugugcauguggugggugcgagcaugccccagagcacguguggaggucagaggccaauguucaggaggcgucuuucucuuuccgauacauggaucuuagggcuggaacucaggucaauuuauguauccauuugugugugugugcauccguguguauggucaugugauccauggugcacauauucagguuagagggcaauuuaugacagucaauucucucugauauugugggucccagggauugaauucaaauugucagacuugauggcacacacucuuacucucugagucaucuugcccccuccuuuugagauagaggucaggcuggcuagccuucaguuuuauuuggagacaggcugggcugucucuaccguaugagcgcuguguuuacaaaaaaggugcuaccacacuuuaaaaauaguuuguucuuuaaauucuuuucuuuaaaaagauuuauuuauuauuuauauguaaguauacuguagcugucuucagacacaccaguagagggcgucagauguuauuauggaugguuguaagcuaccaugugguugcugggauuugaacucagaaccuucggaagaacagucagugcucuuaaccgcugagccauuucuucagcccccuguucuuuaaauuguuaaacccuucuugauucuuugugaauuucgcaucaugcaccugaaucccacuugucuccccguuccuccauagccaccugauacccuugcaaccucccccaaagaaaacaaaauaaauguuaaaauaaauauaauaaaaaaaaaaagaaaaagaaaccaucuugccacggaagcugcugugugucauacagucuacccuuuugccucaacagcuuuccuugcaaauggucauuggucugguucaaggccaauggcuucugcuacacuaucaagauuggaucucacugggacuccucucagacaauccuguaguugccccaaggugucaaccauguuuaacaauguugaugaguuuuuaaagugauucccaaauaguacacucauuucucuuuagucauucccugaccuguccuguggcucuuuaggaguucaacacuuaauauaaguguaaacauaaguuuauagugugaaacuaacauugcugaaugaaggauuccaucauucauaaguuuucccaagccagaaacucagaccuaacacaugacuccuucucccucccucauuccgcuaaauuaggugugguauccauacaacucugccuuuugaaguacuucacuggucugcaauaggcucucauccuugccgcccuaguucaggcuuucaucacuuuccucuuagcuauugcaacagucuacaaaccaguuuuccugccuugagcuucagccugcccuccaccccucaauuuagucuccaccucuuagcagaaccaucuugcuaaaaugcagaucugaucacaccgcuccccuaauuaaaaagaacagggaguucuucccagggcugcagauacaauccaaacuucugagugugcuguacaaagcauuuaauagucagagcccaaauuaucccauuagccuugacuucugccauauauccagagcaguaauaauuuuauaagugguucuccaguaagacucguccuuuuaggaacuauucucuucuuucuacuugcgucaaugagacauguuaucuucaggcuuguucuaaugucccuucaucuccacacuggucauuuguucuuuuaucgcuugugucuuauuguucauugagaggccaugagacuagaauacuauuuguuguaguuguauugauaaugagcauuaugacuuuagcuaaacaugaaauauuaaauuacugagcucaucucugcauuacuugcucuuuuugcuuccaacuguacugcccugguugguguaccuucaauguucaaucuauugucuuuguccucgggguccuccaggcuuaagagacugaugcuucagucuuccauguugccagacugugcuuucugcauucacuguugcuggcaagcucacuccuuuguggcuuccugaaagcuccugacaucuuugcauuucucuucuugugucucacguugcuuugguuuuagauucacugcugaccagacaguacaauccuuuccuuccuccaauucuacagacuaaugacucucagcaacaguuggcuguuaaccuugaguuuuugguucuuugcugcuauuuauagccucugggggugccuagaaucuguuaacucacugcaaauccuuuucuuuuucuucuuauucuagauuugggaccuucugaaguuuaauagugccaauagucuccaaauaaauagggcucugcuucaucuaucaucugucugucugucugucugucugucugucuaucuaucuaucuaucuauccauccauccauccauccauccaucuaucaucuauuuauuuuagcuauguguauguaugugugcuugcuugucuguauauguaccacauguguucagauaucguagagaccagaagaaggugauggugucugggaacuggaguuauggggcacuugugagccacacaguauccaugugcugggaaccaaaccagaguccucugcaagauuagcagaugcuuuucuccacugugcuaucuccccagucccucuauguguauaauucuuuauugucauuuaaaagggaaacuauugcacaagaagaaucuuggguaucaaaauucauguaucucagacacucaguguuuuguuuuguuuuguuuuguuucucuauccaggacagagcauuuucaaaguaguuguuuuguuuuguuuuguuuuuacucucacaucacuccaugcucaccugcucauugccacuaguaagcugagggagccagcguguauggguagguuagguuaagucucaauauagaauaccaucuugaaacaaagcccuccugccugcugucaugaacgaauggauugguugcuugacuucuuugccuuuaaucauuaaagcaguacuuuuuuaaagugacugcuuugguuccacuugaacagucaagauacagaguggaauuaguuuaaagagggauuaauuugucagauguuugauacuguguuauuuagugcuuauuugcccuauauauuauucauuguauaauugagaauuucuuugucaauguuugcuuuucaggcugguuggaaggaaaaucacgccacauucaugaaugaacugaaaaaucuccaggcuucuggacugacuacucuuggucaggcucuaagauccuccuuugauuuguuaaaucucaauagauuaauaucuggaauagacaauuauggacagguaacaauuuuugagugaauauaguuaauuuauuuugaugacuuggaguaagagugcaaaauugggcaagauuugugguacccuagaguaucaaccaaaaagagguucauguaccuuuuagaugcacacuucauaaaagagacucaacagacccaacuuuuucgguucuuauauaucaauucaucaaucaaugguuuaaauaguaaaugaaauucugaucauuuaaucaucagaaauuugacaauauaauggaaaagguaccgccgggcgugguggcgcacgccuuuaaucccagcacuugggaggcagaggcagguggauuucugaguucgaguccagccuggucuacaaagugaguucuaggaaagccagggcuauacagagaaacccugucccgaaaaaccaaaagaaaaaaaaaagaaaagaaaagaaaagaaaagaaaaagguacugcaaaauguuggaagaagacaguuggagagaaaucuucugugucuuuucuucucuccccuuccccaaaacugauaacguuuuuuuuuaagcacuaggaaaagggggagggcagagaagcacuugcuccugcucccacuguccuuuucuuccucaaucugugccagaauguuaacacaggugaacuggcucacaaguaugggggaggcuuuuauuucuuauauaccagggagaacuuggucauguuugaggguucauuaguaggcaaauguagaaguguaaaaacaauuaucuuacauuacacagcucuaauguuuuuuuuucuuuucaaauauauuucaggggagaaauccauuuuuuuuagagccgucuauuuuaauuaccaucacagauggaaacaaguuaacaaguacugcuagcguucaagaagaggugagauauaauuuuaaauuuuucauuuaaauagcagagaacauacagcuauuucugugagaggcaugcauuucuaguuaagaauaacguuugcggcgaucuagcucgguaacccuugagagagggcuuacuucugcuggguuccaggaaagcgaagcgagccaguuaacucuuucuucguuuggaugugaguugugaugcugaaucuuuuccaauuuugccuugucagcuucaucuuccuuugaauucuccucugccuggaagugaacuaaccaaagaaccuuuucguugggaucaaagguuauuugcccugguguugcguuugccuggaguggcuucuacugagccagagcagcuagggagugucccaagugaugaaucagccaucacacagaugugcgaggucacaggagguacuaguauucugucgucucucugaaggaagaacuguggguaggaaaguggaguucuuacuaaaugcaguagcuuuccuuugccugcuugccuucgaaaucuaugaacucugccgcuuaaguucagaccacauuccugcuacugcaguuguggugauucuaaguuggauuuuaggguuucaaauucuuguguugggaaccaguauuugcuuugaucagacggugagcucuuuauuuuucucucuggcauaggucgcuccuacugugugagaacacaaagaauguuaaaucaguguuuagagucacuaguucaaaaaguacagagugguguaguuauuaauuuugagaaaacaggaccggauccacuuccuguuggagaagguacgguaauuguuauguuuuaaccauaaauaguguggggaagaauaaucugagauugaaaagacauuaauuacucaugcaguagaaucuucaguagccauaugcauucgagucaaacaacuaauggcugcaugugucagguggccaaauucuagcaaccuucauuucaugucaaaccuuuuccuaagaacauuuuuacuuucucugaccccagucagagggucagagaaggcgcucguucauuccuucucccugcucccgaaauguuuggcuguccacuaugguggagcgcuucgguaagcggaucucauucggggcuugugaucaccagcuaugcuaaacuaucuuuaugaaugcaaucuguguuaauaagcaccccacgggaagagagugugaauguuuacccagguacuuacaguauucgguaagggcauuuauugcuauuuucuugaccauucuuuaacuacaggauguuuucauaucugaaaauacagaagcucauuuugcauaaggagcuuaaaccguagugaaccuccagauggucugucaaguggauguuucugaauggcuuucaaagggaucaggggaacuaaguuacaccauaguaacacagagcaggacuuccugaaagcucuguucuuuguuauugcuucuccuuucucucagcauguguguacccacacacacagaggggggaagggaaggggaacagggacagggagaaagucugagauuucaccaugguguuucguuugaucugacucccuuggguaaggccaaagggacccccacuauacaaggcagaaagcgauacauuuuugucaaaagcaauggauauuguguuucuuuaacucuuguaucccuuugagaaauuaucacaaaauauagauucuuuugccuggagaaaaaaacuuaagucgcacauauauaguuuuaugccuaacuucaggaguuuuuuuuggauuccuaaguuaagaauaucugccaaagaagacuggagccucacaguauuuguuuguuuguuuguuuuucgagacaggguuucucuguguagcccuggcuguccuggaacucacucuguagaccaggcuggccucaaacucagaaaucugcccgccucugccucccaagugcuaggauuaaaggcgugcaccaccacugccuggcuugcacagcauauuuuaaaucaaccauuuauaaaggguguguuagcaacugacugcccagcccauaauucuguguuuaguaccucagcaugaaugggaaacuuccaaguggaaauacuaguuggauuugcugucauauaaauagcucagauauuuuuccagcuccauuuuuucucuuuguccagagaauuuuuuuuuuaauuuugaagaaucugauaaaagucaguacucagaaggauggacaucacauugccaguagugugagcucaacuuucgagggguucucaaauguauuuacauguuucucuuggagccugugaaucacugagaaauaugcuggccucaaguaauuacuuguugaaaauaauaccaaaauaaguaaaucgagucauguaauuuaagaaaaaugauacuaaaauguccuuuguaguuauaauuuagacgacaaaucauggcauaaggguuuuuuuguuuguuuguuuguuuuuguuucagacaggcaaagaaguaagcuugaauuaaauaauuaaaaugcacuaauuauauauuaugaugcauuauauacaguggccagauuacaaagaauguuaaugguguauggaaaaaauggggugaauucuuccacgacaaccuugagacauuugcuuuauauuugcuaucccuauguauacacagauugugucacagagauguccucuaucuucaaaugaauuuggaauguguguguuuuguuuuugaggucauuggguguagagcaaaaauguaaauggaauuuauaaucuauuuugcuagaccuccaaaauguaaagacuauccagggaauaaaugauuuaaucugccuaauuugguaacugaauucuugaaaaaugaccauuguguugugauguguuuaauuuauuugugcuaguuuuccaaacaacuucauauuccccuaguagauuaagaaugugggaggcguugaguuaaagggcaaauuagauuaaaauugucucuagagagaaagcagaaauccuugggcggucauugcucuucuguccuuuuacauaaaccauauuuguuuuguuuuaauuuguccuuugccugaaacugaaaaucguguacaagaagacaaagaacuguaaaagcaaccaugacuugugacacguauuucucuuguagacacacugauggaguugugcaggccaagcaaccuauuugcugcucaaccguggcauaguugucauaaacucaucuaugugcgaccuaauucuaaaacugguguuccuguuggacacuggccaauuccagaaucguuuuggccagaacagaauuuaccuucacuaguaaguguuauaaauuaaaagggugaacacuggaguggguuuuauuuuuaaaagauuuauuuauugcauguaugugagcacacuguagcugucuucagacgugccagaagagggcaucagaucucauuacgggugguugugagccaccaugugguugcugggauuugaacucaagaccuucggaagagaagucagugcucuuaccugcugagccaucucgccugcccuggacuggguuuuuuaaugauaugacagugaagauuuuaaaauaccuuuaagguuuuuaagcugugccugaugcaaguagacacccucucuuuugguugccaucucuuacugaaaggcuaguucuguagcguaaagcuggggaagagaauggauuuuauuuugcacuguugccuuugccauauggauauuaaaaagcauugcuuuuaauuuuuuucauuuuuacauuuauuuaguguguguguguguaaccaaagcuugcauuuauuuauuuauuuauuuauuuauuuauuuauuuauuaaaacaggguuucuguguguagcccuggcuguccuggaacucucuuuguaaaacaggcuggccuugaaaucacagagauccuccugccucugccuccugauacccggugauaaaaucacuucucuguugaucuggugucgugccccaaacacucaggccuuugaagucucaccaaaaguacccucucagcuuuagcuauucagagcaaaccugcggguaugagcaaugcugcaaaaucccuuugagaccccggaaguugugaccagaucauucucacuguguaucuugcccuuccauaccuuugcucucuuuccuuuugcuucucagugacuuaaccucugccauuacuucauuagaaaaagaaagagcuucuccuugcccauugguaucucaauuucccacccuaugauacagaagacuggagagcagugaaugcuuaaaggccacaaaaauggauuguaaagugagaggucauccuauggaucggaaggguuacuuuaaccuaaguaacacaguucauguuucacugaaauucuagcucuggguuaccuuauuucccucuucccaguacuaaguagaaguuagagaugaagagcuugggucaccgcccccauugaagccaccgggaauucuuaaagcucuaaacacucuugaauacuaaucuguagcuuaguaaugguuugacaaaacaauaauagggcuuucagaaugguuaaaauugugagcuugccugauauccaaucauauucccucucccucucucuuuuuagccuccacgaacaucacauccuguugugagguuuuccuguguugauugugaaccaaugguuauagacaaacuucccuuugacaaauaugaacuugaaccgucucccuuaacucaguauaucuuggaaagaaaaucuccucauacuugcuggcagguauuuauccuuuccuaguaaccaaaggucuauaauucuucugggaucugggaauuguuuuuaaauguuucaaaaccggggcgagggguggucuagacagauagcuaaaugauuaagaaugcauacugaccaggcuugguagcauacaccuuuaauccuagcacuugggaggcagagcaaggcugaccucugaguucugaggccauccugguuuacauagcaaguucccggaaagccagggccacacagaaaaacaaacauaaaaugcguacuauggcuggagagauagcucagugguuaagagcauuggcugcuauucagagguccugaguucaauucccagcaaccaugugguggcucaccaccaucuguaaugggaucugaugcucucuucugucauacagacauacauggaaauagaacauugauauacauagauaaaccuuaaaacgcauaguaaucuacagagguccugaguucaguucuguucuucacaucagguggcucccaggcuccggugauuauagcccccgaugaucugaugccuucuuucugaccucuggacuucacaugcaugcacauaauuaaauacaaaaauagggccuaaagagauagcucagcaguuaagaacacuuaaugcuuuuguggaagauacagauucagguuuaguauucauguggcaggggaccgcucacaguuaucucuaacuccaguuccaggaaucagaugaccucuacugaccuuugggggcaccagggauguaugugguguacauacaugcauacauacauacaggcaaaacacucauacacaaaauaaaaauaaauauauucuuaaaaaaauauaagaaaacuuuuaaauaaaauaaauuuuaaaauguuucaaauuggugauaauuauagugucuuuuaaaaaugcuuuaagauaacacaggcaagcaaauaauaauuuuagaaagguagaaaacauuaauguacuguacauugccauuuauggaaguagagucugaagaagucauguauuugaggauuugugguuagguagacaaguucauaucuguuccccagguuaagacucaaucaucuacagggugugauucaauucacguaugagcaagacucucggcuuuuauuuugaacuugacaaaugagaaauccugacuauuuugggccaagaaccagaaccucugaaauuaccuucuguaugaguauaaugugguuaaaauauaguuuuguugguccaagcuccccugauguguagacugggaauuugcuuggaugaggcaagugcaaagauaccauucacuaguuuuuccaaguacuguaccgcaggaagaaagacuugcucauuacuuagcacaguagccuauggcauuugacuuguaaaauucuagacuugacagucauggcuuuuuuauuuggauacagcaaaaaagucuuacauuauaagaaugucuguuccauuacugaacgauaagaccacauaccaggcaguaaguuugacacagggaacuccuucagacucccaucuguuuuguucuaaaaugugaaaucauuaaugcauaguacauauugugcuacuugaauucuuucaagaugcuaaggcuaguucaaaagaagaggaaugggguuaagcagauggaaagaguuaagaaccaaaauuucaacuacagaacugaacagaagccaaacaagaaagauuacauauuguauacacauacuuuucuauauccagacagcuaaaauuaccuuccucugucagaagucagaauaauguuuccuccuccaggguaagaaaccagaaagggacgcgauuggguuucuuguaauguaaacaacaccuaagucaagaaacagaacaggaccagcaacucccuccuguccuuuucugaaauacuaaccaagccauauacuuguuuaccccuaaaauuuuagaaacauggacaauagaagacuagcguaaugauaggagcuuugaauuucuaccacaauauuaaauaaaauuacaaaucacacuuuuucuuaaauaaauucucuucccacccccuucacagcaucucgaauggcgucguccuuguccugaccucauacuaacuuuaucugauugauuuguauuacugaaaaaagaguaaagcaagacccggcaaacuccucaaaaccguaguagaggagguguuuggaucgagcugcgcauccacgaggacuucaguucaaucccaguacccagcguuagaaaaccaaaggcccuccacuaaaugucccuuuaauucuagcauggagagguagagcaggagggagcuuccuggccagccaggguagcugaauuguugagcuccagguucagugagagagagagagagagaguaugucucaaaauacaagguggagagcacucgaagacagcacucaacauuaaccucuaggccuauacacaugcauaugccugugcacccguguauacacaugcaccugcacacacacacacucacacgcacauaaugugacaauuuucuugauguaucguuucuccuuacucuuaggaaauauacaugccccuuuuguuacaguuaccuguuuacauuaaaguuugaauugcagcaaaaaucuagaagaaucauuuucagcacuguuuguguuuuauggagucaucaauuacagaaaagaaauuucuuuucuuuucuuuuuuuuuuaaguggggaauuguuuuauuguuuaucaagacaggcucucucugcauagcccucccuggcuguccuggaacucacucuauauuuggccugaagcucacagagauucaccugccucugccuccugagcacugugauuaaaguugugcaccaccacaccauauauuuucauaacuaagcuuuagaaaacucuccugaacucaggugauagugcuguuaggaagagccaguguggugaauggcuguuguuaagggaauccuaccaaaggccuuugggaagggauaguucauacugguguccaggccagagagucaaaagaaggaacacagauaaagcauggugucuggaggucucuggcacaguguaucaaguguauggaagcugacaagguaauauauaccagccgagagagaaucgaaagaauacaacuaacacucuagucuuuuaaguuugauauggccaggaaaaguccagacugaaagaaagcaucuccuagcugccucggaaguuuuauaauaguuucugucuacuaauagguuacucucuacuuauuuauugaaugaaaauucaagacgaugggaguaugugugaggauggauuauauaaucacauaaguggccuuucucuuuggaauacuauuucagcaucauuauacuaaccaagcaaaauuuucggucuuacugauguauccugggaucucugagugguuaccguaucaccuaguuucacuuguaagauaauuauggaguaucuauacuuugaauauucauacauaagcacguuauuuuuacauaauccuaugcaaaaauaccuagucuauuuuugaauugcugugccacagguguugcugugggggguugaucuguguuugacuuuaugugaaaaugauuauugucauaacuguacauuucuucacguucgucuuagguguuuguuaccagcaguucaaaauauaaugagcuuggauauccauuugguuauuugaaagcgaguacuacuuuaacuuguguaaaccucuuugugaugccuuacaacuacccagucuuacuuccucuuuuaggugaguaaaauaugugcuucuuaaucaucuuuaaaauauggcagaagugcuagggagauaaaauaugaauaagcauuucaaauuccaucggggaauaaccaauaccagaauaaguaagugugcaaaaacugauuuggaaggauaaggcuucauucuuuucaauuuuuuuguuuguuucuacaucaaauagaagagauagauaccugcucuuugcuguucuucaaagugcaaagucuauuaaucguccucccuucuccauguuuggcuuacuuguagauguguuuggcugcccuagaaaacguguguguguguguguuacaugcccauguauguacauauugugaaggccauagguugaugucagauaucuuuugaaaucacuugaauagcuauaucuauuuauaguaauaccauacuacaugacauccuaguuguaaaguuuugagggauuuuuuuugugagaguuucuaaauuuuugcuucaaagaugaaacauuuacaaaauuugaucaugguacuacuauuaauagacaauguauuuaaaaggcaguacuuuguugauauuuaagaaacuuaaaaguaggucaucaucauaaauaaaucagcaugguugcucuguauauuuuagcuacuuuauuuuucaguccagucugaacauaucuuccuuguaagaauugcuacuaguaggaaguaucugaucuaugauagaggauacuaagauuacaaauaaagaggcugggggcuugcuguuuuucuagaagaugcagguuccccagcuuacagcuaucuagaacuccaguuccagggauaugucacccucuacuggccacagagaguacugcaugaacaugaugcacagacagacauguuggcaaaacagucgugcacauaaauagaaauacauaaaucuuucucagauuacuaauaaauuaucuuucuauuuugaguaaucucuccccuaucuuaaauaaguccuuaugauaucaguuuccacaaagauauaguaaagaaaaaauguguaauuuuuauuuagacuuuaaacaauguuagaaaaguauacuuuuggcccauuuuauugcacuaggauugacauaaaaaaagcuauacauaaugaaacaccacuaaaauuuauguucuaaacauggcuuauucaugucuuucaaagguuuccauuauuauuauuauuauuauuauuauuauuauuaauguuguuguuguaacaaaagcauuuaccauaggaucuacucccugaauaaaauuucuguauacaaaacacuguugcuaguggcuggagcuuggggacucuugugaaagaauaggaagaaggacugugggaccccaaagggaauaggaacuccacaggaagaccaacugagugaacuaaccuggacccuugcggcucucaaagacugaaccacuaaccaaagagcauucuacugcuagagauagccccaccgcuguucauauguugcagaugugcagcuuggucuucauguggcucccgaacaacuggagcaggggcuauccuuaaaguuguugccuucguugggauauguuguucuacuagcugguccgccucgucuggccucagugggagaggaagugccuagucuggaagagucuugaagugccaggguggggagagacagggugguugggggugggaaaccaacucagaggagaaggggagggggaaugggugaaggauugugggaggggacaacugggaggcaggcagugagugggauguaaagugaauaaguaaaaauaaauaaauuaauaaauuuaaaaaagacgcuguugcuaaguauaggcacuguguuggaggauguuacacuguaggaaaugaaggagacauacaaggacaaauaaggacgcucagccaucuuuccagccccauccuuacugauucuaacaaugccagacgcuuugucuagaagcugauuuagucuauuucuugucaguucuuuuuucaguguuggggaucaaacacaagcucuuaagcaaacuaggcaagugcucuccuacugagcuauaucccagcucuuauagacuuccacguaacugucaaaugacuucaacaaacagcacaguauagcaggguuucacugcauccuguuaagaugggaacgggcuguaaagagccugagaacuucagucagggauggcugcugaucccuucugcuuucuucuacccuauaggagaagaacaaaagaccugcuuuuauggcuuuguaaauuuauugaaauuuguuucaucaggaguaaauaauuuauuagggcaauaaagagaaaauaguauacaguugcuuuucuuaagcaaagugccucuuaaggaauagaccuauuuguauaauuuuuuucuaaguaaaauauuuacuuuaugaaguuuaaaggcacagcagaggauugguugguacuaugcugccuuuauagucaguguggcagguagagguugggcuggggagaccaguuggaauuauuaagcuagaaaucucucacaguggaagggaauaaagaggguguuuggaagcauucaugcaguaugcauaauguguguauuuagguuucuaaaauaauuguauucaacuauuaaaagauagggaacaucugcauauucgcuauguggaugcagguagaugcauauuggcuauguggaugcagaugguguucaagaggcuuguaaucccagcaguugagcagcugaggcagaaggaugauuuuuuuuuaaagauguauuuauuuauuucauguauaugagcacacuguagcugucuucagacacaccaggagagggcauuagaucccauuacagaugguugugagccaccaugugguugcugggaauugaacucaggauguccuggaagagcggucagugcucuuaaccacugagacaucuuuccaggccauuacauuuaaaccuuaucuaggcuacacagugagaccuuagcuaaaaaaagaaaaagaaaaagucaaaacaagccugggagugugcacacgccaugguauuuguuuucuuccuucuaccauguggcucugagggauugcuugacugcaagcaccauacccgcugagccaucucacugggccccacccucuaugguuuuucuuuguugguuuggucccccccccccagacaggauuucucuguguaucccuggcuguccuggaacuugcucuguagaucaggcuggccucaguaucagacauccaccugccucuccugggauagaaggccugugccauaaugccuagcugguuuuaaaccaaagaagacauuaguuugucaacuagugacuauggaucccccaggcaaaaauuauuauauuagaauuacuaaugcauagcacagcaggaaaaauauuucaaauggauccaaaucaguauuauguuuuaauauuauaccguauaaacuuagcaaauggaagauggauguauaauugauaaucuauuucauuauuuagauaaguacaauagauaugcuucuuaacuuauaaugggguuaagucuaauaaaccauaucuaaguccaaaagugccucuacuaccccuaagauccagaucaucauugcauagcauuggaagaacguucuguacuguauaucacuaggcugaggaaugacugcaacuuaaaaguugaaaugugguugcuacugaauacauuaccucccucccaucuuuaaguuuucuuuuuaaucuuaaauugaccuguucuaaguuggagaccaucuuauauaacuuugguaggcauaacaaccaggaaagacgaucagauaaaugucaaugaaauaaauguucaucuaaugugaauaagaucugauuucucgauguuagcuguuugauuuuagaucuugcaaacuguuucugggcuaacauaauuacuugauuuuguguugcagaugacuuguuuaaagugcacaagcuuaagccaaaucugaaguggcgacaggcuuuugacagcuacuuaaaaacucugccuccauacuacuuaauaguauguauuuuuuguguguguauauauguauauguaaacuguaacugaugauucuuguuguaaggaauaaggaaucaaaagcuuuacccccccccccgcgagaagauaacuaucuuuuuacuuuacaaacauuugugucgucauugucuucucaaauuguaugcaagaguuuagaggugacauggcggcacaaaagagcauugucuuucucuguuuccuuuauuuuuaacugccauggucauuguucucaacacaucuauguuuuucuuauuacaacuaaccuuacccaauuguaauucuggaaugugagaacaaauaaugucucaauucaugcacaccaacuucccuuuugaacucuagaagcucaguguggcauuucauuccuuaaacaaaauuuggaagaaaucguaguucuuuauuaccaguuaaaugcauccuugacacaacaugauguaaaccauucgcauuagagagcaucuaaggaagagaaaaacguggcuuggcuuccuucugguuuugaaucuuuugagaaaacuaugcggaaugauucugaaccggucacguaaucaagaugaucaaggccauuucugaggucguugucauaacuuacugccaccuuucuagagguuaaaaggcauagacuucaaugggaccauugcugggaggggaagugggguguguuccuauuuaccauggcaagugugggcuuuguaauccgaugcagugggaagugauuugaugaugggauuaaaacugaaagcaauguacuuguuugcauuggcugcuacuggcucuucuuacccacucucuucugauuuuuuucugcuccuuacuucucugcuauuuucauugccacuuuugaauguuccauguuugguuuuaugugcagcaccuugacuucuaagaaaugaaucaugucccccuugccccuuauaacugaacuuuugaguauuuaagauuuauucuauucuuacuguuguguauuuuguuuccuuauagccauuaaagaaagcacuaaggaugaugggagcuccaaaucugauaucagauaauuuagauuguggacuuaguuacaguguuaucucuuaccuuaaaaaacucagccaacagguaguauugguaaaaucgaacaaaccaaaauccuuugcccucagaagugcauuuccuuauucuuuaguguaauuguaacuuuucaaauuaaauguguauauaucucuacacuuuauggauuaguaauaaugugauucucuguggcuucuagcuuuaccauuaaacgcaguuaagggucugucaguaucauuggaugcugugccgucucuccuucugccugccaguuuguccugcccauaugcuggcugauauuuuguggccuaagaggggcagaagcuuaacaggauucucuugugggucccauuuugucuguccuccaacuaguuucuccucaauucacuuggcuagagcaucccccuuuugugagucagcacaccaaggucuggugggauucaaugcuuugcccacucuucaggcaucauguaaaguucuuauccucacaugcuagcccuuggauaaauagcugccugcuuuacccuggagaagggggcaccugagaccaguauucuucaaccuggagggcaauagaccuucaucuuucccuuuagacccgccucauucaccauuauucaacuugucccuugccugccccucucuauuagcaccucaucuuccacucaccccuccuuaucauauuucucacucuuaccuagaccauucuuguaggauggagauauuuggaaauuacuaugcuauggccauacaacuguguggugugauaaaugaaugcagcugcuuuacucucauauucacaaaggcaguuuuagguagggaguagcacuugcagcaaccacagcauuucaagcugagcacguuuugcaaauuuggccuuuagaaaacugagucuuaagcaaagugucagcuuucacuaagggaccuggagggcuucauaauugggaugcugacacaccuugcuaggaaugagcaaaaacuuaaacccaaauucuaaagcucacaagagcauacuagucuagcaugcucauaagugcaaaagaaaacaaaggcaagcccugacuuuugaccuaacgaguccccuaacucccgggccucccugcuaauagauuguuauuguuguaaauaccuuggcuauuuauggaucuauugaucuaauauauauauauauauauguauauauuaauauauacacauauguauuaauauauauauuaauauacacacauauauauuaauauguacauauauuuuaauuugauguuuauguugggccuuuaaggcuuugucaagguauggccagaaaggaagaaaagugcacagaguugaaacuaaaugcugggaccuugugggacacauauccuuuuauugaaugaacuuuuacggucauucaagaaaacagaccccuuaucuacuucugucucauauuucaugacuuaagaauuuguuugaguucauauuuauaugaguucaaaaauauauuccaaaguuaguuagggaaaauaaauaucucuggccaacucauaaaaacuaaaaaaaaaaaauuauugggggcuuauugaacauuaauggaauuuuaucuuuuagaaaaaggaaagauugcuacuaauuucuuauucucuaauuacuaauuaaauaucuauaucaccauuguucccugaaccaucuuagauguaucuaaaacacaaaauaugccaaaaucccuacuuuuauucagucaaacagaaucaagugauaaaaugucuuuuaaggagauuucccaauguuuguuagugauaaacuuacugaguagacauuaaaagucauuugcuuaguaauauuuguucaaauaagcuuuaguuuuauaagacuuacuggauaaucugauuuuuuuaaaaaaucaacaucauuuuuaauguuuucagauauaaugccaaucuauauauguucugaaucuaaacaauacauguauaaguacagacuuuuaaaccuuucugucuggaucaaaacugaaugaguugauuuagauuggauuuugcaguaaugagauauaguuuuucaugucuaugaaugaaauucuugcccaugguuucuauuuucuccaugagucguucauaguuuugacacuccaagagacacuuugcaugaaguccucugucuuuccaguccccucuguguuugcugggguagaacagagaagcauagaggagguucacuuacuguuuuucugugauuugcacaugaaaacuguuuggugggguucuuaaaaguauuuuuucuuaaagaauaaaaugaugauaugguagauauuuucauaacauauucuguacuucccuuuuagaccaagcuagagucagaccaaauucuagcaucaguggggaagaaaccuccccaggaaauugguaucaaagugaaaaaccauucugcauguggccuacccuuggcucacaauaaaaguuuuaggaaacuguuaaaagaaaucauaggggaaagugcaccaaggcucacagaacugaaucccaaagaguuugcuggcuuccaaguggggcucuuaaacaagguagguugugcccuugaaaggucaggcuccgcucacuuugccugguauauguguuguuugaaacgauggccuauuuggagaguuuuauuaguguuguuguuguuguuguuaauaguaguagauuuuagguuuuuguuuguuuguuauuuuuuuuucgagacaggguuucuuucuguaacccuggcuguccuggaacucacucuauauauucggcuagccuugaacucacagagguccauguggcuaccucagccucagccucugcaucugcuucugccucugcuaggauuaaauauauacacgaccaggcacggcuuggaguuaguaauuauuaacaaagccauuuuaagauuauucugagaggaaaaaaaaagauuauucugccagcacaaacaagcaugaaauuaaauguaugagauacauuggcugguaggaaugggcaguaaacagcugucaaaaggaaacuggaaaggaaacugcagugggcaggcagaugcuccagucccgugcagaucuaguaccuaugacagaggaaguaguagcaaguggugcggggaugaagaggcucugcacagcuuggggaaagucucugccagaccacgugacaccucuggccccaggcauucucuuggagaaagugaagaugcucagagcagcugggcccuccacucugcacaucucagccccuggcugcaagcagccugacucauacucgggcuggagcaggcuccaagggcacugcagcugggcccgaagccaguuucgcacagugugcagucagcaguugcaauguuguagggagauggcugcaucccgccucauugugugcugcggagagagauguagguuacaagcagugguacuacugcaaggcagcuacagguacaaauaaaucuuggauucuggaguuuuaaauaauauacucgaaaagugauauucccaguggcuuuaaugacuuaugagcguguuagcauucagaacaauaaauagaaguuuucuucuggaaaaaaaaguggcuccacccaguuguauuaaauauuguucucuucaguaagacuuuaagaggguauuacauuucuuuauuuaaaagccuuaguaguaacugagauuguucuauuugaaauaggauuugaaaccucagacauauaggaacgcuuaugauaucccacguagaggacuuuuggaccaguugaccagaaugagauccaaucugcugcagacucggaaguuuauuguuggccaagaugaagguaacugaccaguagccuaccuuucauuagaagaaaagcagacacggcucccacgaaagucuuuacugcagaaugauuuuguaguguguuaauguguacaaaguucacauucacucaaaccccacaucuguuuucaccucucucaaguuucaaggcagguaugcaguagucagcaucugagaccacugguacuguuauccuguguggucauucaagaaaaccacagaaucuccacagauacauacugauuuaagcccacuugaagagcaagcauuuuaauagcuugcucgagcagguuuaguuagcccacuggaaagugccagaacuuaggucugucacauuuccaaaccuguauacucagacauugauugugaccagccugcugugaaaaugucaggaaaaaccugcucuucgugagagcaaugaacucuaggaauguccagggauauuguggcuguuugcaauuuuucuuuauccuauuuuguuaauuuugaaugggggucaggggcuggagagauggcucagagguuaagagcacucacugcucuuccagaguuccugaguucaauucucagcaaccacaccguggcucacaaccaucuguaaugggaucugaugcccucuucuggugugucugaagacagccacaguguacucauauacauuaaauaaaugaauaauucuuacaaaaaauuuuuuuaaauuuuuuaaauaggggucacugauccacagagaugaacaaaaaagccaguucucuaucauuauacauuguguguguguguguguguguguguguguguguguuugagacagagacagagagggacacagagagacagaaacagagagagagacagagagacagagaucucauuaaccaagaugcugugugugacaagaccguaccauaaagaacuggacaugggcaugguugcuuagcacucaagagucugaugcuagaggucuacacauuugaggccagucuggcaacaaagugagacucuuucagaaaacagagagaggggcuguaaagguggcagaaguuaaggguauuggcuccucuuaagagagaccuggguucaguucccauuaccuacaauggcggcuguacauggacagucguacuguccaugacuucagcuccagggaaccuggcaccuucuucuggauuuugcaggcaacaggcaugcauguaaugcacauacgugcuggcaaaacauacacauaaaaugaaaauaaaucauuuaaaaaaaaacaaacaaagaacaccagaacaccauggagucuagguguuucaaaauggagaaaguauacagaguuuugaauucaagugguggugugcaggaagccagcuuaugcuuacuuacauggugucgggaggaaagaaguugcucugguccuugugaagugagccuguaggcacgaucuaacuguagaucacugacuaguauaaacaagauaugcuagaugcugggauacgaguuuuaauccacaugcuacugaaacagcugugauaauauccuuucaaaaugaccauauaccucagcucuaauuaaucaguuucucugcuggugauuuuacagauucacuucauagugucccaguugcacaaauggguaacuaucaggaauaucuaaagaugcuggcuucuccacuacgagagcucgauccagaucagccaaaacgacugcauacuuuuggcaauccauuuaagcaagauaagaagguaguauaccuauguccaugucugucauauuuuuugcuauaacuuucuguuuuagucagauguauacaaaucagaaguaaauaugacaccaaaacucuguguggauugaaaguggagucuccuuaaugcaaguuguguuaguuuaauaaaauauuagcugucauuuguugaauauguacuagggcuugguuuuuuaaaugauuauguuugcauccagagguguuuugaaaacuugcaucugcucuauaauaagaagaaaucuaggcuuaaauuagcugucagaacacugugauguggcugacaaagccaggauuugagccuauauauuucuggaauacauucuguauuccuucauacuaccacacacuaauucuuuugauauagagaauaccaacuguuuccuccauuuccaugaucagcucuauacuguucuauugaaauaguggugugcauaucccuagagcuauaacuguacuauuuggugucacuuugaguuauuauagaguuuuaacuaugaugcgaguauauguguguugugcacgacugacuugaucauuuaaugaugaaacgaaauggaauuauagcugcacacuuauuuuuauaggugaacuuggauauaaaucauggauauauuauucucuaucucugugucucauaaaacuuaacuaaaaaguauuccaacuuaugccaaucuuuaguuaacugaagauuuuuauuuauuuauuuuuguugugccuugauuuauuuucauguaacacugggaauaauaaaugcaccagacugacagagcuuugugggauauugagugggauauugacaccuacacuguuuagaauauuacugagcauauacuaagcacucgguaaaaaugcugugucuuguuuuguauggauaacggggggugggggagaacauccuuuagaaagauauuuuugccaugauuuuuuccaaguuauaaggcacauuauucggcuaucuaugaugauagcagguuuuaccuaagcuaagaaauugcugguucucauuuucaucuguucucaagaguaaacagccccucacuuucugaugagugccaaggcagacaggcauauucgaaucugcauuugagguagugucugagggaauucuguucucacaucugccuaccauucaccaucuacaugcauugcucugugcaggaaugaucaguguucccgaaagcuuuaaaacaggcuaguacaagaugguugguuuuuuuguugcugucauuuguuuguuuguuuguuuguuuguuuguuuguuuguuuuucgagacaggguuucucuguauagcccuggcucuccuggaacucacucuguagaccaggcuggccucgaacucagaaaucugccugccucugccucauaagugcugagauuaaaggcgugcaccaccaccgcccagcaaaaugguuuuuauacuacuuuaaaaagguugacugugggugccacgaagauggcucagcaguuaaaguacuugcagacgacccaggcuugauuccuagcucccauauuagguggcucacuacuuccagggggaucugauacccuuuucugggcucccugugcaccuauacacacugugcacaccaagcaugcauggguggacacacagacauuucuuugaaaagauuuuuaagaaugacuaugguuuucucuuacuuggucauuuuugaggcucucuauuaacuguagaccaaaaacgugcauguuaguuuuuuccuugcuccacuucaacaggauuaaaauuggguuucauuuucuganagcagaguugcuauagggauuauaauuaaggcuaaucuagaugaugcagugcacggcuaaggaaguguguguaugacaagugcuugaaugauuauuuuguuuguuuguuuuuucagaguugaacuucuguuuuaaaugaaauaugucugucugucuguuuuuuagggaaugaugaucgaugaagcagaugaguuuguaguagggccacaaaacaaagugaaacguccuggagaacccaacaguccuaugucaucuaagcgaaggcggaguaugucccugcuguugaggagagcacagacagcaccuacuguaacuaaccaugugggcgggaagggaccacucucagccucgugguucccaucuuguccaagccucguaaaacacaccuuuggacauccagguauagaguagugguugugguuuccuuauggcuccauuuuccuuuguacuucuuucuauguucauuuuuuuuguuaauaagcaaacaaaaacaauauuaaauaauuauuaaauauguaauaauuuuaaaaauuauuaaaacaucuaugguaguaguacaagaaaccuuauagggaacagagacccugauucaaugaucuuagccauaugaauggagaaaaaacccuauaauuacauaguaauuaacauauuaaccacauaauuagugauuaauacaugcuuaguaaauauuaucacagugacuaguacaaaaaugaggagcucugagcaugucugcuucccauucuuguuuaauuccuaccuaucuucucucucagcuuggaggcagagugagggucucagcagauaaauaaagccugcuacauccauacagagaacacacccucccuauuccucagcacccacaauacagccugaccacuagcucuauguggccugacaccacaauccucucucaucucaaguuccacugauacccuuaucacccuucacuccgcugccccuggcuuagcccccuguaucuccugcucuugauacaaccugguauccucccaaaagguccugccaccaccugguagcccuggaggcucucuccgaugcucccacuuucaucccuuacuuccaucuuuccucaaaugagagcagauaugaguguguuguugcugacuaugcaguuccucucuguuguccccaugacacuguggguucuguaagagaagugucaguuccuuugcuuccuguucgcugcugauucccagcuccuacucuggagccuggugcagcagaaguuaaguuauuggcauagggggguuggccugaaaauagaaaaauuacucugacccaaagggggaaauaggcagaaucaucuacagagaggcauuugcuuauuagcaggucgggggcagaguauuuguucagucacuguaggcaccuaaauuugcucaggcuauuugguguauacaggagucgaagguaguauucauaaguuguauggauuuagauucaauaauagauagcuauuuacauaugacuuugaagcauacagguugacauuaagcccugagcaccaaggaucuaugaauguguauuaguauauugguuucugcauucauacugggaagagggaagaaggucuuguguuacauuccuacgcuugauuugaauagucucagaccucugucuguucuacgguuuucaucaaugaaaaucagucauuuccuugaaacugaggagcacagagauguacuugugggaucaacaugauguacccacuuguggguuaaaaugguagcccgcgucuggccugccacaggccuacggccacucauggagguggaggcgggaaguuugaccgugugcaucucacacugcugccaugcaggugucaggcugugaaaagcugcagaacccugcuccaggggugggggugggggugcagucuggggacuccgcagacuaccagaguuggcucgggguccuggccugcacggaggcccggauggcaggaucucauucuuggguaacacggccgccacuggaugucauggaagagcugagaacagggugaggcucccguggcuggcucuggccuggggcagaagugaaaagagggagaggagagagcuccauggggacaagaguguuguaggcuuguucgguuggcuuggcuugguggaaacuggcuggaagugcugagaggccuucugcggaagauuagaugcagcucuuuaguggaagaccugcuccauugcuucccacggcagauccgaugagaagaggcaguccaugguuuuaagguguuuauugucaugguggagaguugugaugagugaaaccguaccccacuuucucagggcgggcaaaaggguuaaguaccuuuugcagggaggagugucugggaaggggagcuaaaaggguaguagaagcagagaaaggcauagagaggaggagaguagagaaguagggggaaagggaauguggagagaaggagagcaagagggcaagagagaggcaggaguaaaggaguaaaagaguaagagaggauggggcaagcagcaccuuuuauagugggccaaaccuaccuggcuauugccagguaauugugcagagaaccauacuuggcuguugccagguaacuguggggguggaguccagacagaacaccaggagcuuggggcauuaccccaugugacugauggccacagaauuauggagcugaggccucagugucaggagccuggugucugggggcaugacaaacaccuuccaucaacaccugcugggucucugagguuuaaaccuagcucaaccagaaaacaggcugccuuucacaguaccacaauucccccuuuccauuuuuuaaaagagaggggucacuggagugacugucacuuguagugaaaauuuuggguggggaggcaguaucaaaagaaaacacuacacaggccggagggguaacacaacuaagccagggggguaaggaggguaaaggguggggguugggaaggcaagggaucauugaauuuacaguuugagaguaauagcaucaguuuuaaaacagcauuugauuaaucuagauagacaucaugcuuuccuuauuaucauguaacuucccucaaguucaguagccauuugacuuuggcaaaagaguucaucuguagcuggaaggucacaagucuguguccucugugggguucagaacaugucucacaggaugccuuucaucaucccacacccacuugacagcucaacuucuuaauuuguuuuccagacaccacugucauucaugauacccaugaagagaagauggaaaaugggcaaagcccaccugauggcuucuuauuaaaaucugcuccagcagaguuuaugaaugugucaggagaaagcuuuauauccagccaguuggauucucuaucugacgacuuuacuggucucaggaaagauggauucauucacaaaccugguaauaauauacuucuaggaggagccaaaaccugcagucuuucuguagcugaccaaaaaaucacaauggcaucugcuuuggaaacggugccaaauucaaugcaaaucacuccugcaauggcucaaggcaucaaugcugacauaaagcaucaauuaaugaaggaaguucgaaaguuuggacgaaguaaguagggauggaauauccauagauaaugcaagggacagucccacuuguuguaugauucagagauuuuuugcaguugauuuugagacaguuucucauacagcuuggguugguuucgaacucaugauaugguucagacuggugauaaaaacugaucuuccugucuccaccuccauagugcuaggauuacagguaugugcuaccacagccaauuaacuuggggcuaaggauuggacccaggguuucgugcuuguuaggcaggcacucuaucaauggaguuacguccuugacccaguuuugacaugcauuuauugguuagucgugggcugucacauaacuuaaaagugauucuucuggccuuaacuuacaguaauuucauuuugcugguguaacaaguuaucagacaauccauagcuucagaccacagaaacugauuacagcucuggaguucagaauuuggaauacauuuucacgggacuacagugaaggcaagcuagcaggguaguguuccuucuuaggaauaaaggcaggaucuguguucuugcuuucccuggguucugaagcugugcuucucuguccugcauggugucagcagcucgacccuucucuguccccuuugcuauccacuucuguuacugacucuuuuucuuccugagcucuaauauucuuuuuuuuucaugaauucuuagagagaucuacaauauauuuugauccuauucaccccaacucucuccaaacuccuuccuaaguccuccccaaccccuaucccucaacuuucuguccuuuuguuuuaauaacuaguugaaccuaccauguacuuguggguucgaggcuaucccaguggagcauagucaaccuaucaggagccauccucucagggaaaaccgauucucccucuuccagaaaccaucaacuguucauacuccuuuaagagggauacuugugguuacauuggaccccugggcguaauccuggaaaacucaauaugcagagccuaauucuaucagcauauaauacauauaugaucacauguucacaaggcuucauggauuagggcaguuuggggcaaccaguuuucagcuuaccucauuugaauacuguuuauaagaauuuccuucauaaauauauacagacauuuugauuuuuaguguuuaacauaccagcuauauuuaagacuuucuacccauaaaggaugauuucugaggauguaugaugauugaacuuuauuuuucaugcauauuuucauaacacugaauuuuuguaauaucaucagaguaugaaaggauuuucauuuugcuugaagaagugcagggaccucuagagacgaagaaacaguuuguugaauuuaccaucaaggaagcugcaaggucgguauaaacagcacuuguauaggcuuucuaauugcuuuggguucuauuugucuuuguuuuaauuuaguaguaggauccaaugaaggauaaagucucucucucucucucucucucucucucucucucucucucucucucucucucucucucucucuuucucucuuugaaagcacuuguucuacucauagguaagggugcuuccugcaguguucugauggaugcuaccagaguccugacucauggguucuagcuaauguguaugugcgcucaucagauuggcauguccccuugcucagcccugcucuuuccaugaggaugacuucugcucccuuuggccugcaggcuacauaacaccuggcacucuguaaaguugucuaugacacuuaugcuuacucucuuuuucucuucagguuuaaaagaagagucuuaauucaguaccuugagaagguacuagaaaaaaucgauucccaccaccuucuuaacaaugugaaucacaucaacagcagaucaucauguuaaugccaagccaagugaggaaaaagaacaccuuuuaugugcuuucaaaugcaaugggacguuacugaagcccuauaguauguuugagugacagagcgaccuaacucaggcuaugagaaaggaguugacuugagcuuuuaacgauuaucuggaaguaaaaucugggcuuuugccuuaagaauuauugagaauauuuuuuucauuucguuguuuauuuuuuccaauuaggaaaagagaugcugaaucacagagcacugcugcuccuacuacagcuaguagaguucacucauuuuggaccuugccauuccaggcgguuucagagugaauagggacuggccacuuccaaggcgagcacuaccuacuguccucauugugugcuaaagaacacgaaagcagagagaguccacguggugaucuugugcucaaagaacucuucaaagauuucuagcugugccuuuuaaaccaugcaauauucaggaucguuggaaucaaagaguaaaaagcugcuauuucgguaacuuaauucucucugggaaagggcagggggagucagcaaacaaucuaccucgagugcucuuccacuuugacuaggaccauuacaaaguguaucugaggcugcacuaaccucugacaucuguucuugcaugugacaacagaaagcuuucagguggacuuguacauuuuugugcuuuggaagcaccaaaaggaaaaauaauauguauauuuucuuugaaguuuauacagaaguuuauauggagcaguauuguuguuuuuauuuguaaaaauguaagugaucaaagagauuuucacuuugcauauaugaaauaaaaucauuuuauugauuuuuucaaaacuacau

SEQ ID NO: 9507 - RNA, 12583 nt, Mus musculus
gaggaggccucaggcccuuuuuccgugucgcuguccccuucuucccggcauuccuuuuuccgcguucucucggcggcucucugggucuggccaccgccggcacuucgcgcccagggcucuggugacgucauguuccugcgccgcguggacgcccgccggugaaaggaggaguaccucugccgcccuucgucuccuuuuguugggcugccgcuccuucugaaucauggcgccgucgcuguggaaggggcuuguaggugucgggcuuuuugcccuagcccacgcugccuuuucagcugcgcagcguaaguaacugagggacugggaccgcucgcgugggggacaccaggggcugugggggcgcuccccuaagggacuguugaacccagugcaggagagccguuuuaggucggggugacuaaguaaagccgugcaggguccucagcggagggcuugagaucagauggcugaggaacaccuagauugcaggacggccagaagagguugcugagguuugagaaagaauucagaccgggacucugucccagaacuccagacacgacaugccauaugcagccuagguagcuaagacaaaguguggaauugagaacuuugcaugcauguggcaucgugacagcuagcuagacagcaucccggccacucugcuguccaggcaaagacggagaaguuaagugaccgcuugccucagggaggcacugugacacggggaaagagcaguggacugguuuaaaagguugguuguuaacauuuugcuuaacuguuaaaucugugugaccuugggcaaaugauaacggugcuguaugguggguuuuuauuuuuguauuuuuuuguuuuuuguuuuuguuuguuuucucagaucaauaauugaaguugcuucugcuuuuaggugcuagagguuccuugauuccuuuaagggaauucuuagacuaguggaaaaacuagugggccaacaaauaauugcaguaagauaaugugaauguuccaaagguguguguguguguguguguguguguauguguauguauguguguauguauguucauggggaguaguaauuuggugggacccuggggaaagugccuuagagcuuugcugcucauaguguggucaguagagcagcaucguggacaucaccugggaccuuguuagugucuacucaggcuccaccucagaacuguugaaucagaauauucguuuuaauaaaucccugggugauuuauaguuugugaagcacuguccuggaggagaauaggauacacuggaguacugguuauuuucgaaguaagcuuuggcucuacuauagucacaaagcaaguaaggcccuugcuugaacuccaacagccucauuuucccagugaagaaaugccuagcugaagauagucuuaaauuuccagaguagacuucauucaaacaagaaaguuagcuagaagugugucauuaaaagguuaauccaaacagcauaugauauuggauugauuuugcuuuuaucccuguccuuacaggcucuguaaguucaaauauacucugccugcauauuuuuuuaagcagacucaauacauucacacaagucauuuuaagucuagaguacauuaugaauuagggauuguccuauuuaaucuagaaguggauuguccuacuucaucuagaauaauauuguccugcuugauguagaauuaagauuuuggauuuuuauauuuuucaagugcuaagaaugccuuguggacugaagcaagaccucugcacugcucgugcuggcaaaagacugccauuuaccuuugacacuaguugugucaugggaaauuguggcagcagauagcauccuauggugcuggagcaugcucaucucugccauagugaccuuugauauagcagagcucucacuguucauacacgaaauaaacccuguucaccuuucacguucccauuugccacagaggaaacugaggcagugcaacucuguucacuuucccauuguaacauucugcaauugaaguaagugcuggaguugcugaggaugucuugaaugagguacaguaaauuguaguaaacagaaaagcuggugcuauguaugacuugggguuaccaguuucuagauccugaucgcagccuucagucccuugcagccugcagaagugaaggcagcagcagaauuaagcaguagcaaggacagaaauugaaguccuggaacucgaguuacaucacugcacugaagaggaacauuuccauaccaguuuucacuuuggcuucacuaugcaguggcagggucauugagcauugaaaauguuuguaguccuauugauuguuaaauaguuaugacuucuuugacuacuuagugaaagaaacaguuucaaaauuucuagaguuucuauacuaaugaaaaauuaugcuuaguucuuucgguuucauauuugccaucugucacuuacuuaaggugauaagacaggccuugacaagcauaaacuaauucauaaagauaaggcuaacuauauuagaagagguuuuugaggaaucugggaucauuacuuuauguaguauauaagucaaccacuuuggucuauugauuuucuuguauuuuaagaaaggaaaaugggcuauaauuuccuaauggugugcuucugcuuucuagaucguucuuauaugcgacuaacagaaaaggaagaugaaucauuaccaauagauguaaguuggucguuuauauuccauuaaguacacauuuaaaaucagucacuuugcuuaugacaauuuuuauuuugucuuuuuaauuuuuuuuauaauuuucaagcaugauauggcauuuguuaccugcuucuuuuuuauuaaauuuuuuugaauuagagucucaguauguagcucugaauggcuuggaucuugcuauauagacuuggcuggucucaaauucacagagaucuaccugcuucugccucugccucuuucuuugccuccugagugcuaggauuaaaguccuguguuaccuugcccagcuguuaccugcucuuaucacuguaaaaucgaaagauuuugaaaucuuaaaaaaauucuauuagaccuuuuugaucagacauggaggcuuauaccuauaaucccagcgcuuggagauugaggcaugaggauuggugugaguuugaagucaacuuggacuacagaauaagacccuugucguaaaaacaaaagcuaaagaaggaaaugggggugucucuguauugacaguauaaaauggccuuuaaaaauugucauuuggcucaaauuuuuauaaaaauuccuuuuuaaauauuuuauuaugcguguagcaguucaugccacagcguaaguguguaggucacuuaugugacaguguaacagcaggagucaggucucuucuuccaccaugugggucccagggaaaaaagucucaggucgucaggcuugauggcaagcauccucaccugcucagccauuucacugucccaacaguuaguucuuuugaaaaugaagguuaagaacaagcagugcggaaaaagguggcuuucaacuugaguuaauccuaguccucacuugacuguuuuacuaguuuacuguuauuagauuuaaacuuaccaaaacuguaaguucuuuguaacaaacuuaaacaauagugugaaaauaucuaaucauucaaaauuaaaacaguggaagcaacaaaacugaucccauucccuggcaacuucacauuugcucuuaauaguuuaaagggcaucaguguuuaggcuguagaguguauggacaguguugucuugcugcauguacuuuaccuaacugagacagcuuugcgggggcuggcgaggugucucaguggggaaagacgcuggcugaaaagccugauaauuugacuuuaaucccuggaaccuacaugguaggagagauccaacuugugccagauggcucagauuugaacccuuccuuaugcuauggcacuuacugcccccaccuauaaauaugaaccaaauggcaaaauuaaggugaaaacuagauccuuuaaaaaagcauuaugcacuugcauguguaguuuacaaauuguuuuugaaauuaaaauauaauuguaucauuuugcccuuuccuuuccuccuucucaaugcuucccgugcacucaucccccacucucacucaacuucauggccucuguuucuuuaauuauuguuauaugcauacacauauguguauauauuccuaaauauauaaauacaaccugcucaguucuugcaauguuacuugaauguguaugauuucagagaugcccauggggccucagcccuagacaaagcacagccagcuaaggaaugccgagagcauggagaaauagucuucccgagggaagagcucccagauucgcucucuaaugcuaaguguguauuuagcuuuauaguuagcuaacguuccuguuuuguuuguugagacagagucuauguggccuaaguaagcacugaaaucauauggcccaagcauggccuugaaagucuugagucugcugccuucaucugugugcugagauuacaggcaugugccaguaaaccuacuucagaguuaccuuuucauggacauaaucuuucuggaauguauuuugaugacaauccauugguuuuucacauucuuacuaacaguguguucuaugaaggacauucucuguggggcuagggauguaacucaguacaguguuugccuggcauaaacaaaucccuguguuuucuccucuacacccgauaaaguggacaugauggaacacaccuauaauccuagcacuugggauguagaaaaggaggcucagaaaauaagguuuugcucagcaacauggaacugaaucccugucuuaaaaacaacaacaaaacaagacaaucucuuuggaauauuagugguuggaauguaaagugacauuucagaugucauuaauuuuuaauuuagacagugauagcuugugauuaguuuugucucucuuuaaagaugugguacauguggcuguuugcucauccucuuuuuaccuucucuucuugggagcuauauacaaacauauaaucacauauauauuuucaaaauaaaaaucaugugaucguaacucagaaaauaggcucauaauccuaugugguuaauuucaaacauucagauuauugcuugcacaaccuguuuggaaagcaguuugguguuauguaauacauugaacacauacauccucuguucucaagaguuuccauuccuguguaccaggaaacauguaggaauauuuaugcuggccuuguagaaaugucaagaagcaucccacauucccaguaauaacgcaguaagccauggugcuuucauaugauagguacuaagcacaaagaaaaggaauagauuacugcugcagggaugaaucucacaauguugagggaagauggcuagacucaaaagaauguauuugagugcauuuaaaugagagucacaaugaguaaaaguaaaugguaauguguuuuagacauccuuaaauuguucagaagcacaaggaaaacugucaggaagaacaaggaauggauuacugguauaguaguuaacuuugagaaggaagguucugggaagccauguuugguggcguaccuggaaagacuggugcaggagaauugugaaugccaacuugacuguuucaagugagacaggaggaaagacuggaccuuuagcugguugguggguaucugauaccuuuucauugcucuccuuuauauugugcucauaugcuuugugcccucugcuacuaaacagcaauaacaaaaaggaguuuuaauugcucuuggaagcagacaguuugguacuugaguucugaggggcuuaguaccauucaguacuuggugauuuugcuucugugaacauguugcuaaguucacuuucuaaaucaucaggaguguuauuguacuuaagagguuuuauugugucugaguacaaaucauuucaaguaagaacugaccccuugaugaguggcucugaggaauguuuguuagaagucauccagagagcuucuuuuaguugggagauuuucaauuauugccucuauaucaucgguuaguauggaacucuuuaaauuauucacauuaucuugcuuuaauuuugguagaucacacacaucuagaaaaucaucuguuugaaaagauuauuccagcuugguggaauguaaauguuaaaaggauugaauacucuccaugucuccuuucuccucuuuaauuuuauuaauuucacucauuuauuucuuuugguuaacuuggcuugaaggugugccaaucuuguuaauguuuucaaagagccaacucuuuguuucacugauucuuuauauuuuuguuuuuauuucacugauuucagccaugauuaaugggaucucuauauuauaccccuuccacaaggcucaaagaccgucuugaaagauggggcagaaagacuguaggagccugaagucagggaggaucagagggaaacagucucuucuggcugugacaagagugcuacacucacgacucagagcagcuguggucaccugcacagcaucaguccacucaacagucaagcguggagugggaaggguccaugagucccuacuccucacugaugcacuguggauaguuaauggcuucugugaagggagggacaguuuuucuuaaagguugacuccuggggucgguuauuaaacaauaauuuaauguagaagagauacaaacuugggggucaaagaaacugagacaugugggugggauaaaugggaggcauaucaucaaaauaaaugguaugaaagccucaaagaauuaguaaaaauuauucaagaauauucaucuaaaauaaaagucgcccagagggggaaagcagauugucaguuccaguagcauucauaugcuauauguuaaucugcaucuuuauacucacagauaguucuucagacacuucuggccuuugcaguuaccuguuauggcauaguucauaucgcaggggaguucaaagacauggaugccacuucagaauuaaagaauaaguaagucccuuuucagaagcauuuaauuucaaagacauguuuuauguacaugauuuacagucgguuuuugacuacguaaaaguuguuuucaucuuuguauuaugguuauguaguuuguaaggguaaugagggaaauaauuaagucaguguuuggugucauaggacaagcagaaguugaaagccagguaugguggcacaugccuauaagcccaaaacucuugagaagugaaaagcagaaggauugugaguuccaagacagugugagcucuaugggaagauaaaaaauaaaaguaaaauuaaaauggagaccacuacaaauaagauauuagauugugguuccugcuaguggccuaaaguauugguugguuagaaugugauagguggaugaaaauagguguauagaaagcuaauagcucagaacuggcuuccuucccugcuuuuucuucccauguauccccuuccuuccucccuucuccccucccuuucuaaugcuuuuauccucuugucucagcguauuauuucgaaaaauaacugauuuuucuguuuccucuguccuuuaaucuugacuugaguccugcccucagcccuauuucuguguguggauuaaauaauacuguuguucugcauauuucuccugucuuuuguuugcucucuugccccauauuuuuaauuugcuuucuuuaauucuauuucuggacuuucccaaccuuccuuaucuagaaauaauaaucccuuacaauauuuucuuugaaguauucacaggcagcaucuauauacuggagaaaaucccucccccuccauuuacuucauuauuucuauuuauuuuaagauuauuuuguauuuauguauauguggcuacaugaguuuaugugcacacuaugcacacaggugccuguggaggccagagggaauugaauuccccuggaauuggaaguagaggugcuuaggagccacccacccagcaugguugcugagaacuaaacccuguucucugcaggagcaguacacguuuuuaauccuugagcugccucucaaauauuuccauuuugaagguauucuugggugguuaaauggggcuaacuuugagauuuggucuuuuuuuuccauaaagagaagauucucugguuuuuuucagaaaauaauauuucaaagcaaacacuaaaaguguuuaaauuaauacuuuuuuaauuuuuuaaauuaauuaaauuaguguuuugagaagccauuaauaucucaagauguuuauggacuuuucuagaggauacaaaucucacuggaagagucuuugaaggaucucaggcaaggagccaaaccaaauggcaucaaguaaggggcagcagaaucgaugaguuuggucaauaguacauacagaaggccaaacgggauuucauuguaccugaaaaacagauccgugaaaucucauauggcuugaaauaucuaugacuuaaggccaaaggagaauaaucagaggugcagugugugugcuggcauggaaaggugguauggugauugaaguucaucuagaauguguguguuauuauugcuagacauuccugggagaauggcugaagaaaagaaagucugagaacuuuauggucauuuccaaguuucauauauucucuguauaggaaaaaauauacaguacagugugauuacuauuuauaguuuaauuuguaauucacaacaaauucguaauucauuagaagccugcuuacuuuucaaaugggcuuuuauaaagguuuaucuaaaaauugguguucuuuuuucuuuuaaggacauuugauaccuuaaggaaucacccaucuuuuuauguguuuaaccaucguggucgagugcuguuccggccuucagaugcaacaaauucuucaaaccuagaugcauuguccucuaauacaucguugaaguuacgaaaguuugacucacugcgccguuaagcuuuuuacaaauuaaauaacaggacagacacagaauugaguauuggaguuugggguguaaaacacuccccccaagaucaguauuuauauugcuauuucagagcuaguuaaacuaaucuaugggcccuuguuuauauauuaucgauccgaucaaauggaguaugaauuaucugugaaaugagucuuugaacuuucguauagaguucuuuuguugauuugaaacaauucccauguuuuguaaaagucacuguuucaaacauaauucccugaaaaaauguucggauuuuugugauuauuuauuuucauagauuucuuuucuuuugcacuacaguuuuuaggaauccuggaaauaccauauaccaucuguguuuugcagcacaagaaucaaauggucuucaguucuuaucagaccaacuucuuuaagaagaccaaaauggugacuuuacaguuuuucuuugguccccuaaaaagugacucuacuuuuacagauacuugccaauuuuuacuuuauuaaugguuucucuccggacuccacucccugauacugucuaacauaagcugucuuguuucaucauuucuaggauucugugugcagugagcaauuuuugugucagaaauucuaucauaacauauauauuuaacaagcucaucuugcuguaaaacuacucauguucuuuuguuguaaaauuuucacugauuguauaauguaagacuaguugaaaguagaccaaaaagacaacuugugacuucauuaucuugccugaguagaauaguauugauugaggaaaacugaucgucauuagccagucucacucauuauaagucuguugguuuauguuguacuaaacuagugaauuagugaaaguaaaggaaauggcucauuuuaucuaaaggcacaugugcaaagaaacugggccaaauauguucuaaauauuuggaguucaucuauuugaauucucuuagaaaauucaggucauuuaggaaguugguucucagcuucugacugagagcuggccuggagcuucccaucuucacucugcggugcugagggggaggaugacaugccauuggaugcuuuucagaaacaguaguuuacucugacaacauuggaguagcuuuuucagcuagaaagcuaagaagcucaacauuacuguagagauuauugcuucccacgagcaugaacacauuacuuguguuaaacucuauagguguaaagggaaucacugcggauuuugauaggaaccccgccugaugcuuuuugguuuguuucaggcagggucuucauaucgagaagcucuuuuacuugguagcauuuuuugauuaggaaugaaccucagccuuucugcccagucauacagagccucaaaggccaagguuauuuugucauuucuuuguugguuuugguuuuuguuuguaaacaggauuccguauaaccugagcuagccucaaauguacuauguagccgaggaugauccucaugccuccaccgugucagugcuaagauuauaggugcugucacuacaccugguuuuuugagauccugggcacugaacccagggccucaugcaugcuaggcaagcacuauaccagcugaacuacaucccaggcccuugacauugaauuaugauucuugagcucuguuuugcuaacuaagucuauggagcauugacuguucucuaaugagaacaaacuuggaaaucugcugauuaccuacaauaauuuagacauaggcuaaaagugugaagucaagccaggugugguggcaugugcuuguaauccuagcacuuacaaggcugaaacaggaucacaaguuuagggcagaacugggcuaucuuaaugaaccccugucuuaaccccaacccccaaaaagcgaacccaaggacuaaugcgauagcuaaaucaaaauggcgugcaggacgcaugcuguacaucaggcuuuucugccauacuccucgacuauuacuugacugaagagccucuuguuuucuucuccuuggagacuguuuucccuucuuaauguguuuucauaacaauguuacugagaaucugcguguuuuguacuuccauucuuuaaaggauguauaauugccagauguggcucaugccuauaauacuaacacucaggaggcuaaggcaggaaaguuuucacacagguucaagaccagaauuagauacacagugagaccuuaucuuuaaagaaguuauacaaauuuuaaaggguacaauuaaguaacuuuaaauauacucacaaaauuaugcaaccacuugauaaaucuaggccauuucacuccucuccaagaagcccuguauucuuuaguagucaccucugauuuccucccaguuugucccacguagguccuaggaaaccaauaguuuauuauaugcauaaucugaucauuuacuauaaaugaguuaaugcaauauuuagucacuuaguuucauaaauaugguuuccuacgugggauaaaugcucauucugagaacucagaacccaguacagugacagaaagugucuggguuuguaaaucugguaggaagcuugccuagcacgugcgagacccuaggcucacucacaguaucccaggaaaaaaaaaagcuaguugauaaaucaauggauuuaaagagggaaagccagauaccuggcagacucuagaguuaaucuuauuaaauagaguacuuuuccuccuagccaaacauucauucuauacuacugcuucuaacuuacauucuaguuccucccagcucugcuuugguuuugccaagacaggguuucucuguguagcccuggcuauucuggaacucacuuuguagaccaggcuagacuccaacucacagagauccaccugccucugccuuccaaguguugggauuaaaggcgugcaccaucagugcccagcccauucucguuucuacaauggauauuaaaaugucuucuugucuucucagccaagaaaauccugcuuaaaaaaaugcuaaaacauuuggccgauaacugacaugguaaauuuauuuagacguguccaccuuuggacagcuugcauaccucagaccagguaaauagccccagguuuuuaaaucgacuucauugaauuucugcuaucuucuugaaauaugguacuauacgacuaagucagauuuggguguguuguaacagugcuaagugugcucaguagaauuuuauuuacaguacugugugauaguccauuacugccuaggguaguugaaaaccagugaucugagcuagugcuagguaaaccuauagcugacaugauuucagucacacucaaaaauaggagacauguacccagcaaaguucuccagaaugcaggaacacacuucauaaccagggaacuagccaaauccuaugggcuaauagcucagcugcagggaauaaagauugugaauugguggcaaguaugcacaauaacucccuaauaauugcuuccuaagcacuuguggcauacuuuugagugacauaacagcauuuucuuggcuguacaugaccgguuuccaugauguauugaauacuguuguuugugagccuugaugccuguaacaccaauaaacccauuguugaauauauuuucucucuuuaaaugaccuugccuuguccaauaaauaagcgauugucucaccuugu

SEQ ID NO: 9508 - RNA, 24471 nt, Mus musculus
gugguucucaacuacucucugaagauggcggaccccacuuuugcugcuaccaguagcagcacaucuuuccgggggcuacacgaacgcuugggugagugagauggaucauagucccagggggacagggacacucauaggcagugggguugauguagccccaggauccagagaaguagcguggcucaguaacuuuuccguggagaguccccucggucccucauggucuaugaucccccucaucucucucaacaccuuagggcuggggcaagagagaucagagaaccaggacaugaaggggaaaccaucgggcagugcugucaacauuccaaagaccauugcugggcgggcgggagcuaccaaacccuaacucuagcccugucugcgucggggaccagugacaccgcagcaacugcgggaaagcucagggaugggugggcgcuggcccgugcugggcacauccacacuucaggguggcccugccaggaucggaaaguuuggguuuucccugaaucccaagguguuggcguuuuccagguucagauccaggcgcgcggggggcggggggagaacugacgcuuagggcuuagaauguugggaaaagauuucacuuugcuacggcacgugacuuuaucccuaggcugagcugaaugagaauccucaccuagcaauacuuucucaacagguccuauaaucaaaacuuuuucugucuggggagacgaaaagguuggugggguguauuaaucuuaacaauuuuggcagcaccuauuuaauucaggaaauugugcgagaaggacaagacuacuuuccccagauaugccugugaauaagaugauuuugauugcuauaaaaaucuuuaaggaguuuuacauuguaauuagauguacauauauucauuuaguggguuuucuaugcauuuuaauaugcuaauacuaaagaacuauucuuaucuuaacaaaucacauuuuauauuuucuacacaacuguuuuaaauuaaaaccauucagccagaugagcuuuaaaaacugugugacuuaacuuguugcuuuucccucguuuguuuaaauucacaaaugguuucucaguuuagagcacguuacucaaagauugggaccuauaaaugcaaggaaagcuacuaagacugagagccagauuaacagcguuuuagagcaggagaaacuuuaaaguuagucuagcagccagaaucccagacucagaagucuugagccacuuccacagcuuggaggugugcgguauuaggcagccugauauuuuguuacuauuucgaauggugcagucgggcugggaagggugcucuccccuaacaauggcugcuggacacaaagauuucagcaguuucccaccagccuuucaguagcuauuuguucuccugguaucaacuguuuaucuaguagggaaacauuuaaaaacuauguauucuuugagaaccgauucaaaagaaugcaugcuauuauaccauucggaaguaaugugugccacaaaaauaccaguaguaaaacagggagugagacuaggucuuuaacuaggucauaguuuaucugagcuguuagcucccuaagacuuaaaagcaaauucuuuuuucuuuucugcaaugguaagaucucuauggcagcaauugcaggggcacauucaagcuuaccccuuaaaaugaaucccagauagcccuccccccaugcaaaccaacaucccaaaucccacucacuagggcaaucccuccaguccuuuaauuauuugaacugucuuuccugaacuguugggucuuuuugagaguuauaaccagacuuaugugguaugaccaagggauagauuugcuguccuuuugcacaaaggaaaaaacagugauccccaagcccuugcucaggauuguggguaauuuuagauacaaccauccauggaauucacgguucaguaauucucuauaauccgucuuaauguacaucaucuuauuuuuuucuuucccccaauuuacaugucaucuuacuaauguuugcuuaucacuuuccugcauguugacagaauauauauauaugguacaauuuauauuuauuugccuuacuuuuaaaaacauuggcuguccuugucccagcaacuucauaaugcaucagaauagagccuuggggguacuggcuccauggagguguaguuccaugggggaagggcacauugcuuagcauaauagagggcuuaguucaaucccaaucuccauagagagaagaaagacaaugagcuacuuuuuaggcaguucuaauuguuugagcccgacacccagagggaagguacaggguuguccugaaagugacauaugcagcuaguguauagccagccuagaaaguaccugauauggguaauuuauaaugucuuguaauauugaccucaaucucugaguaucugccuguuauuacuuugcuucuagguuugggucuauaaauuuuuaauuuuuaagagauuuuuauuuuauguguaugaauguuucugccugcauguaaggacaccaucagcaugcagugccuguggaggucaaaagagggcaucagggucccuggaacuguuaguucacugccaagucucugcagaaaacugagccugaguccucuucaagaggagugagugcccauacccaagucaccucuccagcccaaauucuuaauuuuuuauuuuaacaaaacuuuuuucccucaauuucauacaaacucuuaaaaaauuacuuaguuuuuaguuucuugucugacauauuuuauguuuugguuuucucucuguaacagcccuggccauccuggaacuugcucuguagaccaggcuguccuugaacucagagaucagccagccucugccucccaagaacugggauuaaagauguguacaccaccacugccugcaucugauguauuuuuaaaagccauccaucacuaaguuaacuucuccaccugaucuuucuugugcugccacugcuauucacaacuggaauugccuugauguugacaaauaccauacaauuccaagucuuuauuaaaguguuguugaacauaagcaaguucuuagcucaucuuuuuguuauugaccaagauuaagcaguaauguuuuuuguuuuguuuuguuuuuuggguuuuuuuuggguuuuuuuuuucgagacaggguuucucuguguagccuugacuguccuggaacucacuuuguagaccaggcuggccucgaacucagaaauccgccugccucugccucccgagugcugggauuaaaggcgugcgccaccacgcucgguaagcaguaacguuuuaccucauagaaaugauccaaucucuuaccaugaaugacaaaugguuauggauuguauugacaauaucucaggcuuuuuuccuaucuccuuguguuuuaguugccaugacucaagaacuagcugaagaaaggcgacauaaacgugguauuaauucuucugcaggugcaaacaagagaucgucaaguacaccagguauacuuucaaugauauucugcuauaucaguacuguagcuuuaaaaugugauaucaaacuaacggguaauuauucuuuuguaauuuuagaugguucuguccuuaaaaaugaugucaaacagcagcuagccaaagaacgcagagaacaacagaaacgucagcaagaagguacacacgugcagcucauauuuuucugacuuggcucuagucacuuuccuuaaucuacuuauacaauagauuauaauuuuuauuacauaaaauauuauauuaaauuaaguccauuuacuaaaacaccaagaaggccccugaagaaucuguaagcaauuuauuugauuguugaaggagugguuuaaguuagcuucagucaaugaaaauuaaauacugagacuuucguugacaguuguggaaacaagcagauugggauuucaguaaaaauggcacuugguauaaauuaaaacuuuuuccaacuugggugcacacuuugcaacuauguauuucuucuuugaucuaaaucaacugacaagugcucaaauuuauucaagaggaauguuauaagugauuuuuuucaugguagugggagagauagucauguguuaggaagaacauuuuuaugacugcauagguaugaauccucugguugcggucagaaaauaugacuaguaaaacaaacucuuccaucauuggguagacuuugaagucuauucauauaacacaagaaaaccuuucuuccuucuuuggaauuuuaguuuggauaggccaagagucaucuggcuuaggcaugccagguuuuuuuauuuuuuuaagauuuuuuauuuuauauauaugaguacaguaugcuguugcuguuuccagauacaccagaagagagaacaucagaucccauuacagaugguugugagccaccaugugauugcuggaaauugaacucaggaccucugggagagcagucagugcucuuaaccacugagccaucuccccagcccagcaugccaguucuugacauuucagugaacuccuugugaaaagugguucuuuuuuuuuuuaagaucuauuuauuauguauacaguguucugccugcauguaugccagcaggccagaagauggcaccagaucucauuauagaugguugugagccaccauguaguugcugggaauagaacucgggaccucuggaagagcagacagagcuuuuaauugcugagccaucucuccagcccugcaaagugguucuuuagugcccaaauauauuuacacacauaugacacaugcauguuauuuacuagaccagguuauguugucuuaagaaugauaaggagacaaaguaacauuuuucccuuuuauguauguaauguggaaaaaaaauuuggcuuuaacaccaugaaaaugugcuuggaacauuucagccaacaaggaaaaacaacugcuugagaaagaacagaaggcgaagcugcaguaugaaaagcaauuggaagaaaaacaccguaaacugaaggaacaaaaagaaaaggaccagcgacgacaagcaucugcagaagaaaaaagaaaacagaagcaggcagaagauacaguaugccauauuagagucuuuccauuuaguguuggugucacauaguuguuuaguucuuuucuguguuuacugacccuguagaaaggaagggaauaaucucaccucuugcuauuuucuuccauuuuccuuaccuucaggauaaguccuuaaacacuaacuucagggagaaaagaggaaguugaagguccagacacugaaccccauuagccuucagaaugcaacccucaauguauuuugguuuggguuuagcucaggacuauuaucuaccaccugugcaaagacuccaaacacagcacccuaccucucugacaguuuccaucgcaggcugauuuuuccuaauuuaccugaucuuguggcucccugagagaguacgaaccauuaagaacaguuuaagaagcaacaaacauuaauuaggaaacaguacagagugaguaagggucucugguggacaacaucugucuaagacaguuccagugugauaaaagaggaacuugagagagaagaaagaaugaacagaagcaaaagucagugcagacagaaagggaaccagagccgggcgugguggcgcacgccuuuaaucccagcacuugggaggcagagacaggcagauuucugaguucgaggccagccuggucuacagagugaguuccaggacaauccuggcuacacaagaaaccuugucucaaaaaaaaaaaaaaaaaaaagaaagaaaagaaaagaaaaaagaaagggaaccagagccauugcaagauaaagaaaggcuaaaggaauucaacacugaagaauuagaggaggcuaggcacaggcaaagccuaguacauggacaguguaaggaaacuaagaacagggaaggcacuguaaagaugcuauuguuauauaacaguugcuguuaggaaacagaaaaccccuggcccuaaaauugauuuucucacuggaacauaguccauggucuauuauaguaaagggaugauacaucccugaacaaagaccucauucccaaacaggugcuuguucuaucacacuaugacaugugauuuguauggcuguuaucuugagaaguucagguugcaggugaggucaauauaaauacauugcuugccuuaaagccaauucuuacuuagaaccaggauuuaagcuguacuagauaugaacauaauagauaaauaacuuugacuucucugugcaugccacccuuuccuuuaucuuuccacaaaugauaaggcaauuacaaacuauaucaucccaaaugguaaaauaaaugaugaagggaaucaagcaggagugaaaauugagggaggcaaacauaaagauucagaacacugauuaguaugcaugaaaggacaccacccggucuuuguccaguugcuucagaacguuggcuccaaguuuucugaugauaaaagggagaaaagaaacauggucaauuccuugacauagcagcuagaaaauaaaaaaugaguuauuuggagauagcacggguauucauugaugaaacugaaacuuaucuccaaguauuuuaaacuuuucaccuacuugaaaaagaaauauggucauggaguuaguuuuagaaacaauuuaaauauugacuuuaaauuguaaucuaagaaccauauaaaauggucugaaauuuguuuuaaaauaggaaaaauuuaaggcuguugugucucguacauuggagcgaugcaaucguauugaucaacgacagaaaagguggucgugggaggguggugugaugaaugcugacaagucugguaaguaauagaguuguuuaauuuaaauuugcucguguccauuuuucacugucaguuauugguagaaggcugaaugcagugcaagcgcgagcuauucuuuauguccuaaaugaaaacaugauacagagugacuuauaucaccugccaaagcagaaccgaucagauuuuauaacggauuuugauucagaacacauuaaaauuuauuuaaauuaaauuaagcaugaaaaugauggauacuugaauugguuuugguuuugguuuuaauaaacaaaguccaaagcuggagaaauagcucagucagcccagcacuugccuugcaaacuguaggaccugaguuugcgcccucaaacucaccugaaaaucauucagaugugguaguaaaagugacuuuugacucuacuuuaguauuucuugaaguaugucgaugaaaaaaugugugugagucagucaccugacugaugggcuuacaccuauggucgucacauuaucaauccaaagaaugcuuacuugucauaauagugucaauguguacuuuauuuuauaagucucaaagaaaaagaauuuuuguuuaagacuaucccucaguaucuuaaacuagaauauuucaggcaaaaugggaaguauucacacaaagccaauuguuuucucuuauaguuuuguuaccucaugacaucuauagcaaauauaaauauuuuugguuuaaaaauaaucauaauugggaggguauaggggacuuucaggauagcauuugaaauguaaaugaaaaaauaucuaauaaaaaaucauaauuaaauuauccauuauucuuagacaccaucacagaugguuuuauuaaagguuauauuuucacaauuuagggaaaauuccuguugucaaaauuagauauuuuccauauuaaauuuuuaucuguuuguuuguuuguuuucgagacagggcuucucuguguagcccugguuguccuggaacucauucuguagaccaggcuggccucaaacucacagggugacucucgagugccuccugcaaccaccuggcuaaugauuuucaucauuuuccaaauaacuuuauucuuacuucaauaagauaauaagcaaauaauuuuuaauuuggggguuguaaacuacauaauauuugaaauuaaauaaauucuuugaagcaagauuugaaaagcuuuuguguuguuguuguuggguuuuuuguuuuuguuuuuguuuuuguuuuuuugguuuuucuuuucauguaguaauggaaagauuuucuauauacuuuauaguguugacauuuacacaugccaacauuguccuuuucaagagacaaucucacuugaaaauaucuuuaauguaacauuaaauauauuucuuagcuuucaccuuuuacuguugagcacaucaauucuuauauuuucucuaaaauagaaacaaauaugaagucuaugucaggcauugugaagaauaaugauucccuugaggaacaacuaaauaccuaaucagauauuacccugaauaugagcagauguacuuguauucuauaaaucuaugaucugaauguaucuaggaaauuaugaaacaaauccagucuuuuuaauuaauauuuguuguauuauaucuuuuauuuuuggagauuauaguauaauuacauaaauuuuuucuucuuuuuuguuuuuguuuuuguuuuugcuuuuguuuuuguuuuuugagacaggguuucucuguguaucccuggcuguccuggaacucacucuguagaccaggcuggccucgaacucagaaauccaacugccucugccucccaagugcugggauuaaaggugugugccaccacugcccggcuugaaaagauuuuuuuuaauuuauuuauuauaucuaaguaugcuguagcugucuucagacacaccagaagagagcaucggauuucauuauggaugguugggagcaaccaugugguugcugggauuucaauucaggaccuuagaaagagcagucagugcucuuaaccauugagccaucuuuccagcccccuugaaaagauuuuuagacugcuuaauaaaaugagugagucacuccuauaaucuuaagaacuuucuagaaaaguaauauuccuuugcauuugauguuuaggaaaacuggaaaauaaacgaaguuccucucugaguagaaaagacaaccgguuacaucccagaggugauaugcaacacguggacaacacaccuggcgaguaguucuucauaaguauagaucuuaaauucugguuuaaagaagugucuagcucagcucuauguugcuuaaaaaguuguucaagaggggcuggagagauggcucagagauuaagaacacugacugcucuuccaaagagcauuuaccagcaaccacaugguagcucaaaccaucuguaaugggaucugaugccuucuucuggugugucugaagacagccacaguauacucacauacauaaaauaaauaaaucuuuuaaaagaagaaaaguuguucaagaaaauaugcauauaaguaagauacaaacuaagcagguuauauuuagguuauauuaggacuaucuaugcaugacccagcaaguagucaaaggagagcgcauagaucugaaaaagaauaaggaaggggagggagggguauaugggaauguuuggagggaggagaaacuuuuggaggagaggggagaaggaaaugguauaaauauccuauagucucauaaaugaaagaaacuuuuuaaaaaaugucauucaagaaacugcaaggacuaugguaagaggaaaagaaucuuuucuuuccuuucccuguggugcaaauuuccuggcauaugugcauaugacagggaauccagagcaaagcuggaagaaauaaauaaauagauucauauugaaggauuguguggaugcauguacauaugcaugugaguggaggucagcggacaauuugugugagucaguucucucugccauggggguuccagggacugagagcaaguccuuaggcugcuuaguggcaaagucuuuaccaacugagccaucuggaagccugucccaucauccauucccauauucaccccccugccucuguuuuugguggugguggugguuuguuuguuugauugauugauugauugauugauugauugauuuuugucuuugacaggcucucacacuguaacccugacauaguagaccugacauaguccaggauggccuuagccucauagcaaucuuccugucucagccucccgagagcugauucugcaggcaucagcucccuugccgaguuuuuuuuuuccaaagauuuauuuauuuauuucauguauaugaguacacuucagcugucuucagacacaccagaagaaggugucagaucgcauuauggaugguugugagccacuaugugguugcugggaagugaacucaggaccucuggaagagcagucuugugcucuuaacugcugagccaucacuccaggccccuuccuugccuagguuuaaagugauuucuuuuugacagguuuucucccccuaccauuuaccucucauguaacucuuguauuguguuaucauauucgacuuugcuucucugaugcuaugauaaaacacugaccaaaaacaucuuagggaggaaagaguuuguuugacuuacagcuugaaucccaugacuggaggaagccaaggcaggaacucaggcaggagcuugaagcaggaguuaaaggugugugcuaaggacuaggcaagaccacaaggagaaacagaguuuuuaaguaacacaaucuugguguucacaguguggucaaauaucuuacaacacauaaaauaaaaacgaaucucuuuuaaaauguggcaaagauuuugaagugcaauauuauucgaauagaaauguuuuguuacaaguguccacuuuauaggccagcuuauuuucauuuguaguaaacugauauuguagaaauucuguugauguugcuucuauauucacuuauaggcaugaccaaauauguuuuccgauauguuacugcaccaguguuuucuagugaugagauaaagucuucugcuauguucuguaaaccaucagcaaaaacgccaguugcagcaaaauuagaaaaaauaacuacaaagaaacuagacgcuucucucagggggcauguggaaggacucucaaugaugaauauagaaaucccacccaaaauaacaauugaaguccccucuccaccaaagcuggaagaaucaucugaggcugaugcagaaguaagacuccaaaccauggacgacaucucuaaaguuaaagaggacgccucccagaagguggauaucaaaguaccuacugaugagaacauagcaagacacccaaaaccaaauguugaagaacucuccccagugaguguggauaccucuucaaguguugaacuauccuccauagugagugucaacucaucccccucgcugaguacaggaucauucuccuuugggaguguagaaauaucuccuguugucagcauagaugccucacuugaaacaaacauagauaccucaccugaauuaaguauggacucagggaauacgaaaguggccucagaaauuaaaacagaagcaccucuucaggccaggggggagucacgccuugaagcaaguguggaaggacaaccugaggcaaauguugaaggaucaccaaagguaaguguguaagcauagccuaagcaggggguggggugggggugggguugcaaagcacagccuaggcaaacauuaaggcagccccuauggugacugugguagcacuccuuagugaauggugcaaguuucaccauaggcaacuggaaaaaugccuucuacgacaugaaaacaucucccaaagcuaaagggacucuccagagauuuguuaagcaguuaaugugagauguucccauacuuggaggaaaagcaucuuggaagaauguucuggaccauucgaugagguuugaaaauugaaucggauuugaaguagaagauuuuuuaaaagauaacuuuuuauuucuuuuauguauaugaguauacugcugcugucuucagacacaccggacgagggcaucagaucccauuauagaucguugcaagucacuaugugguugcugggaaucgaacucaggaccucuggaagagcagucagugcucuuaauggcugaggcaucucuccagcccccaaaguagauuuuaaaaauauauuucugugauauacuuguauuguguaaccuagaaaaaaaguaucuaauuuucaugaauaaaaagaaaauuggagacuucaggaaccacgacacuauuuuauucagaauauuuucuuauaaaaagauagguguacuaauuuuuuuaucucguugaauugguauguuuauagaacccagaaauagacaaaagaaacauaaaccuuaccaccaagaaacaaccgcugugccacauaccauguuacagauggccaucaucuucugcccuugggugucgcccaccuucucccuuaaaggcucuguaaguaaccuauuuacaguuauuccuuauaagaauuuuacugaaacaaagguuauaucaguauuuccuacaugaaauaauauaguauucaagguaaacaauugcaaaugggaaaaaugaaguagauuuucuuuguccauuauaaaaaucuccuguuuaaaauuucuuuguaaugucaauauaucgcauuguauaaaauuuuuuacugaaaacuaauccacacacauuuguuacuuuuucauggcaggcagacucgaaagauacgaccuccaucuccuauaccagucucaucaaaauuaucaacaaagacuucuuugucauauaaaauaaccccaguucagaauguccuauaugugccaaauucauuagguguaauagcaaccaaaaaggaaaccauccaaaaguauccaaucaaaaaagguaaauucuuucccuaaggaauuuauuuuagcagcacggaaaaucuugaaguacuugaguuaucauaauuuuauucccuaguuaacaggacuuugaggaguggucuuuguuuaaagagaauuaaccaagcccugguccccuggaacgcuucuucucugcuugcuuauccacugcuuuguuuggaaauuucauuuuuggaacaguuaaaagcauaaguuaaaugagagaauugguauauuauucuugugggcccuuccaauuaggauacuggcuuugucuuggguucacuuagcuacugguagaugaauacauuuuaucagauguaugccaguuuucauguacauacaugacaugugacacgugcuaacuuacgcuguauccauguuccuaaaaguacaccauguuacuuugccuaucacauacauuuuuacacaugccaaugcuacuuggucucaaaccuacuagggaauuugguucuuaugagaaauuccagugaacucucuguaucaaaugaucuuuuauuaugaauuagcuauucuugaugucuuaaaauuuucauuucuacauuguuuaucuaauacaacagaauuaguuauaucaacuaaauaguauaauauaccucuguguugagccaggcaugauagcacacagcuuuaauuccagcacucaggaggcagaggcucuaugaauuugcgacuaccuaaucuacagaguuaguucuaguauaucuagaacaaagcaaauagugagacucugauauuugagauacagagauauauuuaauauauauuuauauauuuaaauguggcuuauuuuacuggucgucuuggcuucuuuuucuaucugcagcuagccacuauaugauaaccacauguauauagucagcuguuucggcaaauagcaauaaaaauaauguccaaauuccacacuuaugccagaugugauauuugguugaauauuuaagauuuuuacuccucauuuggaucaggccuaaacuugacuucagcauauuuuaaucuuuccucauagaguccuuaauugaccugucucuaaauaguuaaaccaaagcauaaacacaccauugcuuuuugaauauuugaauaugcacuuguuugaaagagacaacuugcuaauucuguuguuagggacaaguugugguuugaacaauuucccuaauuagcauuugauuaauuuugaucugugugaugguuugaauaagcuugaccaauaggaaauggcacuauuagaagguguggccuccuuggaggaaguguguaagugggaugugagguucuauguucaggcuccacccagugggaaagaggcucuucuccaagguguccaugagaaagucuccuggcuauagugguaucaugauguagaaauaucagcucuuccuccugcaccaugccugccuggacacggccaucucccaccauaaaccuuugaaccuguaagucagcccccaauuaaauguuguccuuuuuaagaguugccauggucauggugucucuuuacagcaauggaaacccuaagacaaucuguucauauacuuuuuaauguugggguggaucucauuuacuucuuugugggauugagaggaaauagguccucuaaucaacuguuucacauguuucuuuaaacuagaauuugguaauagaaguaugccaagugcugaagcaaucaagaaagcuuuuauacagauacgccaugcugcuuaugagcaaagcaaaaacgagaaagaaagacuccagaaagaagagacaaagcaaaggucagcacacaacaauccuucuagccugggaccuagggugcaaguuuaaacuuugaaaauuugcccucaaauucaaaguuuuaaaauggcaauuuauuuuuucuucagugaggaaaagucugucauugccuucuaaucaaguaaagaaaguauagugugauaaaaaaagggaaaagaaagagagaaaggaaggaaggaaggaaagagagagagagaaagaaagaaagaaagaaagaaagaaagaaagaagaaaggaaggaaagaaagaaagaaagaaagaaagaaagaaagaaagaaagaaagaaaagaaagaaagaaaagaaaggaggcaaugguggcacaaccuuuaaucccagcacuugggaggcagaggcaggcagaggcaggcggauuucugaguucgaggccagccuggucuaaaaagugaguuccaggacagccagggcuauacagagagacccugucuugaaaacaaaaacaaaaaugagggacggggagaaaggggaggaggaggaggaggaagggggaggaggaggaagagagagagagagagagagagagagaaguaaaaagaacgagaggaagaagagaaagcaacaguggaaaccacuuagaaagguagcggaaugaacagaaacacaucccuuucagucuucauacauccugcaccauuaaagugugguaggacaauguaaaaagaaaccaaaaucauguccacgauuccaucucagcagcagcaucuagaugaccacauagcauuucuguucuccuucaugggaaggacaaaaaaacagggccaggggccagggaugaggagacugagacagaaagauacagacaaugaguuacucugagaagacuauuccacugguaaggaauuucaaguuuagcugccuuuacuugaacuugaaauguucuuauguucuuaccuugagaucugccuugucauauauuuuauguuguaucuuguaauguaaaucccuguucacugaguauacaaaauaccuauaguacugacuugauuauuuuuaaauuauuuauuuaucuuauguauaugaguacacuguccuugucuucagacacaccagaagagggcuuuggaucccauuacagaugguugugagccaccaugugguugcugggaauugaaccuaugaccucuggaagagcagucagugcucuuaaccgcugagccaucucuucagcccugugacuuuauuucaaauagcaaauguuuaaaguacaguugcuuggaaaaaaaagauacuuugaauagcaagaaauuuauaacuucuuuuuuuuuuuuuuuuuuuuuuuuuugguuuuucgagacaagguuugucuguauagcccuggcuguccuggaacucacucuguagaccaggcuggccucgaacucagaaauccaccugccucugccucccgagugcugggauuaaaggcgugcgccaccacgcccggcuuauuauuccuugucucaugcaaacagagauaaucuaacacuugaaaguauuaaauacuggcacauaauuagacccuccuccagauuaccugucauccugucuuagucaggguuucuauuccuacacaaacaucaugaccaagaagcaaguuggggaggaaaggguuuauuuggcuuacacucccauacugcuguucaucaccaaggaagucaggacuggaacucaagcaggucagaaagcaggagcugaugcagaagucauggagggauguucuuuacuggcuugcuuccccuggcuugcucagcuugcucucuuauagaaccaagacuaccagcccagagaugguuccacccacaaggggaccuccccccuugaucacuaauugagaaaauaccccacagauggaucucguggaggcauuuccucaacugaaacuccuuucucugugauaacuccagcugugucaaguugacacacaaaaccagccaguacacaucccuaggugagauugguguguucacguuuaaagaagacguuaaagagucuaucucuaaaauaauucaagguugacuuuuucucuugcauauguguguaaaguagucuggugcuuauuagaaauccucuuguaugcccaaaggucugcuucccucauuuaaaaaccggugagauuaucuaacucuuggauagcaagaacccagaaaauauagcaaaucugccauauagguaaauuguauuacuauacacaagcaauuucacuauaaaugcuuacauaguccuucaagcuauauacacuagcagcuaaaaaaaaaauacuaaaguuauuuuaauacucucagaauugcucggaaaccagaaauuauggcagagaaacuggauaaagucccagcagaagguuccuugccaugccaagaugagcagcaagacaaaaauccaacaaagacauuucuugagucaccagaaguucagaaggcagaguuacagguuuguaaccuugacacuugagcagcacggggagccaguuuagaaagugcauuugcaauagaaaguagcagucucgaccucugagcagauacagcauucucaggaggaaguuuuacaucaugguccacagaaagcacauugccauacccuaguuuauauuuucagcuuuaguguaucauucaucagaaccuguuguauguaagcuccuuauaaauuuguauaccuuggcaggaaauuuuuaugcacuuuucccauagcucucaagagaugugagaaaguuaacuccuugucauguuaauaacuccaaaacagguacuuuuaaagaaggguucuuuuuuuaguaaagauuuauuuauuguccuccauaaguacacugucuucagacacaccagaagggcaucagaucucauuacagaugguugugagccaccaugugguuguugggauuugaacucaagaccucuggaagagcagucagugcucuuacccgcagagccaucucgccagcccuaaagaagaguucuuaaccugugggcugugaccucuucgaaggguggaacaaccuuuucacaggggucauagaucaaauauucugcacguaagaacauuacaguucacaacaguagcaaaauuauacuucugauguagcaugaaauaauguuaugguugggagucacuacaacauaaggaacuguauuaaagagacacagcauaaugaagauuaagaaccacugcucuauacuaaggugggcagauguucagaaagguaauuuugaugucugaaacauuucagaucacauuaaccucaaucuguguuuuuuaacaacacuuugaaaauggauaauaaaugccugccaggcuugcaacuacaauuuucuuguuauucagauauaaugaaauuagugauauuuuuugcacaaauuuccuagaaaggggacagugccaugaugaaaucucgggacagugcugaacagagaaagaaagaacaggaaaacauccuccaacauuggcaagaaagauuagaaaggagaaagguaauguucuguuucacgugcuuuguguuaauuaauguuggguacagguuaugacauauuuuucugaaaaugcugaaucaaguauguguuagucuuuagcugugugcccacugugguuuuuucauccaaaggagcugacuucuguacaaaaggcugcccuuuuauugcugguaccucaugacuggcauuauagcagugucucaauauaccaaacccauagcaucaauguucuuuuuaccgggauggcucuagggugacagaaauuaguggaaguuagaguuccuucuaaauggugcuggauugcaguacauauggugggaagaggacccuuccucugucuucuguugguuuaggaacaagaucucauggaaccacagcaucauugaagugcauuguuuucauuacuguuugaugcagcugugcucuaagaguucuaguuaguuugcaacgauauguguuuagucuaacaugaauuucucugcauguggaaaagggaacaugggcuugccauugggguguuuguguugugauaguaagaacaacugcugccauucacagcauuuuguagaugaaacgagaaccagaagacgcccugaaacuuuuguuaagccugugguuuuaggacagucacaggcauugccugcuauacaguugcuucagggacacugucuuuuuuuuuuuuuaaaucucuuucacauuuacauuuuuauuccccuuuaaauagaggguugaggagauaaagaaguggacaaggaagacagauguggauaccucuuagguagucuccacucacaccugaguguaucugacuuccucuugcuuccugcucuugguuucucuucauuuuuaccagauggcugguaaugaaauacacugucacauuuguaugucgcugguccuuaaaacccuagagcuugcuuuucuaacucuaguuugcuuucaucuucucuuguguggaaugcuugcuuagguccucuugcauaaacuuugaaucaguuugucuuuuucuuauguauuuuaauaguuccuugaauguucuagaccccacuuuugugguugcugcugcugcugcuguuacagguuugaggcugucuucuaggaauaugugccuugucuuacucucauuuucuguuagggagaagcuccuaaugauaauguugauuuuauaaacgucgucugguaacuuaaaugccuuuuauauauuuccugaacucacagacauccacuuugaugagccuuuuaccaucauguaugugucuaucugccgauucugucaccugcuuuucuuacugauuugcagggcuuuuuuaccuacucuaaauagaagucuuuuggagguauguguuucuaccuuuuaauaucuuuuggugaaaugaauuuaucccuucccccugucugguucugguuguuugcauauuugcuucuacugacuugucuucugaauggagcacaugcacuuaagacuuaauuuuuuuuguugguuuuucgagacaggguuucucuguguagccuugacuguccuggaacucacuuuguagaccaggcuggccucgaacucagaaauccgccugccucugccucccgagugcugggaucaaaggcgugcgccaccacgcccggcuugaaacauuuuucucuacauucugggccauuuacauuugguuacaagcugcucuuuauaccuaguccuaguuauccccaccauaaagaugcaugacaaaugccugauagcauguuguuuuuugcuaccccacuuuaagcuccagguagacaucgcuguuaccagcccucacccagauucacuuggauccauggauaaaacaacaacaacaacaacaacaacaacacacacacacacacgcuaguuaaucuuaaaaugccuuugcuaacucaacugggaauuccuaaaccuccccugccaccccaggcauaaguggaguggccauuggccacuccaaccaaaaacucucaugguuggcuuuaucuccuguuguuacugccuccuucuuccucuucccccucccccauucucccugcauuuucuugugcagcucuuaagugucccauaucuuuauugaucgaucaagaaccaauugcggaacaggaccuuagcaucagcaccacuccauacagagaagugcuuugagacaccaccucaaaccucauucaacucauugaccuuuuacuagaacaccugcucccugcucucuuguucaucuugcucuuugcuuacuguucccauccuggcuucacuagcauucuaagcagaggaugaaugugaggugagggcuggaggccuggccugaaugguucaagaaaacuauucauuuuuaaguguugcccuagcugaaaaaauuagucaccugccugucaugaggccaguuaaggaaauugauacuuuuuuuuaaccuuuuauuuguaaugucaaaaauuggccaucaauauaaucuuuucuuacuucuuugagaugcuagaccaggaugauuaaauacauauaaucauaacuuucucugcuaaccauaggcuucagaaauaucuuuuucauccgaagaugaagcugaugaugaaggugaaagugaagacucucuugagauauuuccaucagguuugcuugucccucaugguugcacacaugagcaaagggugauacugccgugugauacugccggaagaggauuggcuuuaagaagccugcuaaaaaugcagagcacagugucuagagcccccggcucugcuuuugaaugagaggagagcugaaggcagucaggaccaugugaaaugaaaccagacucaaaggcagaaucagcuaggugggagauugggggcgggguggggggucaaggguaggaagcaaggcuggccuuuggcacaucagcccuuacuagcaaagaaaagaggacauuccuugaagauguguucccugucaucagcagugaauuaagagccaggcaaaugaaugcacaugcuaggcagcccucggcuggccugacaugcugaagcugcucaagcuaaggcugggguucaggcugggccccuuugcccaaacuaaugcuugucuggcccuuaaggucucaggcagggacccccauccuaucacaccaggaucagaaguuuugauuucucuuguuuuugugguugaaguuccagcuuucaugaucuucucuccucuccaggaggaaaaauguuaucuaugaaacucaaaaaguuucacaaauaugccaagacgaagccucaaaagcucguguuuuugcagucgggaacugaugagguugauaccaacaaaaauguauauuuuaauggggacaugaaagcugucaaacaaaaagaccccaaauauucuaugauucaaggaaaaggcucaaaguaagucucuuaacaccuuauucauccaaauagauguggggaaaauaugaaugacauccuuagaguccugaagaacauuuauuacugauugagcacuuaguuugcauacaccaaacaugccaagcaccagacuuaauggaaacaaaauaaugcccacagcagccucuuugggccaagauaauuacccccuucuuuuacagacaaugaaacugagauacaugaaggccuuagacauuugccaaauucaaacccagauuaaucugacaucaaauuguuuguguuugcauaauaauguggauucauuuauuuaguguauaaaacagacaccaccugucuuuauuuucacugccacucagagauugauaaucguaugcuucuuucacauauugguaagcaggcucugagguuaaguugggagaguagaaauugguuguugaaaacgaacacugcccacaugauagccugaaagauuauaaaguugugaggcucacuagaguguguguguguguguguguauguguuguauguguauguguguguguguauauauacauauauauauauacauacacacauauacauacauauauauauauguauauauauauauauguauguauauguauaugcuaagaggcuagguucucguaacaguagcaaaggacuacauucaacccuugcaccaguucuccaguugucucuuaccaucuguguccuugacugacuuuaagaaaggcaccagggagcuagagagaugguucgguguguugcacucaaaugcaaacauaaggaccugaguucaaaucccagcauccacacaaaaagcuagguguggcuauauaccaccuguagccccaguuacgggacccgggaaauagagacaggaggagggucucuaagguguuccagcugccaguuuagcuucagguucagugagaacugagaccuguuugaaaagaaugagguagaaagugauagagcagagcaucaaguauuccccuucggcaucuuagcagauuugugugugagcaugugcacauacauacacacacacgcacacgcacgcacacgcacacgcacgcacgcacacgcgcgcgcgguuccuggguuugggcauucucaguuccucuugugccccgcugucuccaggguaucuaggauacaauuugaaugacacugugucugugauauacaugguuccucugggcccuucucauuguagaauguggaaaggugauugauuauauccaaggcacuucucagaaguuauaugauaaagcuccucucaugguuuuggaauaaacaggauucuaacuacaauauuucauuccagguuaucagcuaaaaaaccaccuacccgcccaauaagaagcagaaaaacaaaggaaggcagcacugccauccguccuacucaaagugccagcagcaaucccaaucacaaguggguuugugacaagguuauagacuuuaaucagacaccuuuucuaaagaccacucuaacaaagagcaacaaagaaaguccagcggauucuaaaauagcuugccaagguccucaggcacauuuggaccauaggaaaagaaccaagucuguuucugucccuuugaccaauguuuugucccaccuccacauaacuggaagagcaucuaaucuugaacaucccuuugcuucugucuauuccagacuggcauuuggaaaagaggcagaagagaguggugagucuauaggaaugaucuagaaaaaguuuuucacuaaauuagauuugaaagaaugcaugacuuuauaauuucuaugccuugcaucuccugccacauauaagauauaaguccuuuucaagaucuggcuuucucugagcugcucuucuggcugccagacaaguacaguggagggcagagagcaaucuuuacaauuuaccuuuuauccuggauuccccaaaccaaagggcuguuguuuucucuuuaagaguuugucagccagguggugguggugcacaccuuugaccccagcauucaggaggcagaggcagaggcagguggaucucugaguucaaguccguccuggucuacagaucaaguuccaggacaacuagggcuauguggagaaacccugccucaaaagaagaggggggggaaggagagagagagagagagagaaagagagagagagagagagagagagagagagagagagagagagaagagagaagaaaaaagaaaaaagaaaaaaguugucagggcugggaaaauguuugucaggcaaccuuuagggccugaguuugaugcccagcaccauguaaaauaaaaagccaggugugccgggcaugguggcgguggcgcaggccuuugaucccagcacuugggaggcagagagaggcgaauuucugaguucaaggacagccugaucuacagagugaguuccaggacagccaggggaacacagagaagcccugucuugaaaaauugaaaaaaaaagaaaaaaaagccagguguaaucuuagcacuggggaggcagagacaggaggaucccuaagguuugcuggccagcuaguguaagccgagucaccccagauucagugaggccuuuauuuuuuaaaaaagucaaagagccaauagaagacacuggacaucuaacuuugaccuccacauucaucaggacauagcgugcguauacacccauccccucccccacaaaacaccuccucuugucaaaagcaguguaggcucuuggagcauugaugaggugagcauuuaggaaagagcaccaaggugucagaauguacaaaggucuugguucaauagucagucaccccaaauagucagucagucacccuaaagggaggccaggggugaguucccauggcaucauaagcaucuaaucuaccuuuuuuuucuucccugguuagauguguaaauccuguggggccuugaagauugaucaucuuucacucuguauuaaaacucccaaggccaagacucaaaauugucuccuuuuagacuugaaccuggcaaaauaaauacguguccaaaaagaaauggaaaacaaaccaaaaauuaaaaaaaaaaaacaacccaucugauagucaccuugagaaaauguucuuaucacuagaguuuuaaguaaaaaaaagguuucuguuuucccuaaaaac

SEQ ID NO: 9509 - RNA, 13848 nt, Mus musculus
agcucuacuggaagaguccuuuuucaggcuaucgcuucggccaaacucguccggagcgcagaggagcccgagguuaacgaggugccaugcauuucggcaggcugcgucccuaaaggccaguucccaauaaguacagacacgcggcggcagccgggcuccgaggccccgcccccuggccgcgcaagcgucgcggaccuuugacgucccgugggcgggucggcgcgacccgcuacguugccacccgcgcggacaauggcgacugcaucagccugagggggacuucgcucucaacucguugccugacguggcggggaggaagcuguggcgccuccggaaccggccgcagcggugacagcgcgccugcgcgcuuccgccucgcccuggccccagcagcggcggcggcgaggcccugcggagcccgccagguggguggcagcgacagcgcugaccauuuguuggcgcaggcgugcacgaggggggcgggcgggagggcggagucugggcggugccucgcagacuucccagggucugcuggggcgcugcgggaggcggcccgggaguugcagugcacaguccaagcucugcagaccucucuuucucugcucuuguccagcgcccucucggccucuucacuucucugaccgcgguguccgggacuacgugagaaccaugaguggcaacaacuugagcgggaacgaugaguuugaugagcaauugcgaaugcaagaauuguauggaggagaccccaaggaaggugacacccagaaugagcccucuggagaagcccauucuuugggacaaccaccagaugacacuccuuacgagugggaccuugauaagaaggcuugguucccuaagguaagaaagaguaucggagucccacugcggagcggggccauaggguucacuggcagcccuugcgggacauuccucuucuguuugcuccacugaaguacuaggucucugaaccggugguugguggcuagucuauugguucagucuauugcauucccgauguauaaaggaaaguaaaucuuaggguggugccuuaagugauuuuuuugugccuuauuaauuuguguauguaugugaaggucacaauucguuuuuaucuugauauuuuuacugcacagaggaagaacaccaaggaaaucacauuaguaagacuuuuauccuguauagccaaacuuaauuuacgcuuccuguacauguuuguguagaaugcagcuuguugauuuacaggguggaagaggugucauucaccucuacugaagaaacuuuucuugauucuuguuuuaucuauuaaauuuuguuccagggcaucugaguucggacccuauaaccacaggaauaugacuaggaaugcacaggaaaugaaugaaagagaucuauacauuuguacuugggaauugcuaaguguuuaauuucaacauggaaauagcacaagugguguugaaccuggucuuguaaacuguaugguaacuguacucuguuagucuuagccucauaggaacuuuggcaucaaagggaacuaacagcgcgacaagcgaccggagaggcaaucacacaaaacuuuuuccauugugcagggggauugauuguugguugaaaaauuucagcuauuuauuugugcauauuuuaagcaucccaaacuguaaaaauuuacaauugaacuucuggacuggcaaugcccacuugacuguacaugugauuucuuuaaagagcgcuuuuaguagucugacaaacaauuauuugguaucuggguacccaaaaguggauucggugaugaaauuacuaguugacuuuggguuuuaccaucucguuuauucaauacuuuuuuuguuuuauguauuggccacuuuagucauauacacuguagagaaguaguaauuuauaaacauguaggaacgggugauagcaucacuuaaaacuaugcguguuguuuuggcagucugugcaccuuuguccuacuuugaucacacuacaugguguccauauaaggagacuggucuuggguuguacuugaauuaguacagcugcuugugguguaaacacuuguuuuaaguuuuagguuauauuucugaauguacagccuuauaccacaguuuccacaaguaaauuaaccuugucugcauguguuuugacuucucuauuuagaucaccgaagauuucauugcuacguaucaggcuaacuacggcuuuucuagugauggugcauccagcucuacugcgaacguccaggacgccaacacuaaggcuguagaagaaccuccacaaaaagaagucccggagaccccugacuccaaaaggaagggggaaaagagaaaggcugaaucuggcaagugguccuguccuugccaaaccugccuuuagaagugagauaggaaaaauuuguaaauccguuuuacauuuugcagaauuauaauagcguugaaagagcgaugaugugacgaguuuucacuuucaaauaggcguaaagucaugaagaacagagguagcccuuuuucuuuuucagagcgauaaaggucauucacagucgaaagguuuauguauuuugcacgcucuguagugauuugaauuagucgucgucuucugaaauaaagagaacauucuaaaacuuugaagaaacugccauugccaagauuucauaauguaauucuuguuucuuucgaauguuuuauuuauuucccuuugauuuuuuuaggaugguuccauguugaagaagacagaaauacaaauguauacgugucagguauuuauacuguugcaaugccguuuucauguuggaaacauuuaguguugagacuuugugcuaagugaguuuuaguuuugguggguuuuguucaccugcuuuuguuagcuaggaauuuacuuaguauggaaugaagaaaaguuaugcaauguuacaugcuguucuuaugccugccuuagauaauuuauagcaguuuguuccuucagauuuagugaaguguaagcauagcauaacugauauuuuuuaguguauaaaauacagucuucacauuuauagauaggaaguuuuuguacuccuuuauacaagucagcuuuguauucacguagagguuucagguuucucauugguaaaaugcuaaaaacuuuuaccuucauuaaauacuuugaaauuguucucugaaauuacaggucucccuccagacaucacaguggaugaauuuauucagcucauguccaaauuuggcauuauuaugagagauccucagacugaagaguuuaaaguuaaacuguacaaagaugaucaagggaaucuuaaaggagaugggcuuuguuguuaucugaagguugguauuuggucaagucucucaucccuuccauuuuuaacccaggaagcaaggcucgaauauuagagauacuagcccaaaccaccaaccauccaaagcaaaauacaaagaaaauaggucaccuuagugacacuaggauuauuugcuuguuuuaagaaacuguuugcuacaagaucagcaugcuauauaaauagguaauugaggggcuucucuuuuuuuuugguuuuucgagacagguuuucucuguauagcccuggcuguccuggaacucacuuuguagaccaggcuggccucgaacucagaaauccgccugacucugccuccguagugcugggauuaaaggcguguuccaccacgcccggcgaggggcuucucuuaucuucaagaauuucacugcaaagaccucuuccucaguguauguaaucaagaguguaaaaaucugagaagaaaaaagccauugacauuuuauuugcacauuggagugaacuggaauggagucuagcaaagucgugacugcugucuguuuuugcaaauacaguuuuguuggaacacaaccccacuggcucacuuauguuuuugugucuggcuacuuucauguuucaucagaagcauugagugguuguagcgauaacccugacucucaaagccuaaacuguuuacuaacuggcucuugacaaaagguguuuucuaacgccaaauuagacuagaaaggagauggugaauuauacuuacugcuucaaacaccagggaagagaauuagaauggaaauuggcagaacuguguauagucuuuucacugcaaauuguacaggccuugauugaugugaaaggaagcuaucauuucugggaacaccagucagucagucaucuucguggcacuugucaucucaccuggcacaaaacaaauggccacaauuaugacauaugcauuugucauagaaccugaaaauaauuacaaaucaaguaaaaaaugauaaugugguaguauaacuaucauagguguguaguuagugggaucagaagaaaguaggcuugagauggcaagguuugggguuaucaguuuuuaaucugguaagugaacccuuccaugaucauuugggauguuaaucuucuauguucauauguaaaauuugagaauuuuaccagcacaaaguugacuaaaaaucugugaauugaauuuuaaaaagaacaggguguugaugggaacuuaaaaaaaguuuuucuuuuauuuauguauauacauggggggcauuuauauaugugcuuaugaaugcuguugcauacagaggccagaagaagauguuggaccuguggagcuggaguuauagaguguuaugagcuacugggccugcugggagcugaacauggguccucugcggaagcuacccauuauggcuucugggagcugaacaagggcucuuaacaguugaacggucucuuccacuccaugauuggauuuuuacagaauaauauuguucuaugaaacacuuuuagauaaaacuuagggcccaugaaaguaacaaauugucaaaccaauaaguugcacuguagaaaauaaaguuaauuauuccagaauccauauuuaauugagcagcuuaggucagugguccuuuuuccuuuccucaggccuuuuguucuuugacucugaguaggggugacaacuaauguguuuguguaggacccugaauccauaacugcacuuaauauauaagccauucaauaauuaucgucuacuaagcauguuauuacagguguauauucuaguuugaagaagcugaacacuaaagacuggcuguauuacuuccagcuccuugaucacccacuguuagguagcuguuauagaauuucacaacuggacugugccacagauauuacucaguucacuccucucauucuacagaugagauauuugggcuccuagagacaaaacuuacccaguaauauaauuuacggaacaccuacuguauguuuugcccuaaccuuuccauaaacuauuucaccuaauuucuaaggagcccugugaugaagauauuuuagcuuuaugcagauggagaaauuggagguuuagagaacuagucauguaccuacguuaacacaggugugugagguauauguggguuugaacaaagcuuuucuuuaucccaaaguagguggcuggcauuguuuauaucaaaagauuaaguuucaugucaguggucaacuuaaugaguauuuuauuuugccuuuauaaagaaagaaucuguggagcuugcauuaaaacuuuuggaugaagaugaaauuagaggcuacaaauugcauguggagguggcaaaguuccagcucaagggugaauacgaugccucaaagaagaagaagaagugcaaagauuauaagaagaagcugucucuacaacagaaguauguauuuuuuuugaaauuacauagaaauauuuuaaagcauuguuuugauaauagguacuuaguuuuguuccaucaaacaugucuacaaauuacucuaaaggaauuucauuagcuagucagggcucauuggcagucucuuccacaggcugauuugguaguggucaggaggguugucuuuuucugggaugauuaaaaaaagaagucuguucuaggcuuuuuuauucaaaaacaaaauggugagugaugggcuccuaaugaacugaaugucauugucccuuccuccucucuucccauauuuccugccccucucuaccuucugugcuuccagucuucaguaaguaaaugaagaacuuaaauuugggggugauuauuuaugauguaaaaggggacuuaauuuaguucaguauugaccaucaaaugaagaauugaagcuuuuauucuagaaccaugacuucauuuuuacuguggauugaaaucaauugccaggaacuaaauuuguauauacagguuuguuaguaaaaguuagaaaggugaaaguuguaucauugcauuuaccauauagaugucuguuuguauauguauauauaaaaugggacauguauguuaauuuguuauuaagcacauuuuaggacauuagucaaaauaauaaauacuuucaccagugaauucuguuaacauucuagcauuaugcuuaaacucaugauaaaaugaucaucauauuuucuuuguguguggccaucacuuuucucucccacaaaucugaacccagauuucauaucacuguuacuuuuguuacauuaggcaguuggauuggagaccugagagacgagcuggaccaaaccggcugcgccaugagcgaguugucauucucaaaaauauguuucaccccauggacuuugagguaagaaauguuguuuuaucauguaaaaauucuggauuuuuuuuuuuacaagagggugcuaagcuuaccgugcccuaucacuguggaggcauauuucugaggucaugguaggauaggaaaauggaacaaagaaucagcccguauuuagaauucccugugucuauccuguucuuauuuugauuggauuccggauaagacuguuacuagucauacugugggccaaaaucacagcuguuugcugccugaaauccaagauugaugggaacagccuguggcuuuguaguacagcugauuuuggcggagaauaccaguuccacacucgcaucugaaaacugagaaaaguuugaucuuuaaaggaaucugauguuccaagaguggugguuguuuuucuggaccacauuuuaauauccauguaaaaauccccaaaccagcaaguaagguguuaaauagaaacugucaugauagcuuucauuggguugugccuucugauauuauugcuagcuaccauagaugcauacuaucaguaguagaaaaauaacuuuuuuucucucuaguucuggaauuaaugauagcacauugcacacaaggaggaaaaauucauaauguuaaaauucaguuuuggaaacauucuaguugcagucucuaucugaucuuguucuuuuuauucacguugucaacagugucacaauggcucuuucaguuuagccccuuagcaugggccuucaaauggacaggucauugcugaacaguccgaauaaagcccuggaguuuacagugcacuuguggagucugaacaucuuuucaugauuagauggguugcuuaaugucucuuuucaccugaaauccagaaggcucuugacauauauauacagcuauuuuaaauuuacaauaguaaugaaguacaguugaaaaucaaaugcauacuccauagagagucucugacuugcacugccuugagguuuccccaaguuuaaaauggugugacagcaguugugcaugcaacaggagccaugauugacauuuuggauuuugagauuuuugucaggcuaaugacauuugauacgauccuuucucacaauacugggcagcagcugcaagcuucagggcuccaucagccguuugccaugagggucagcagugaccaugaggucuacaguguaccuaucagauguucaguaaacuagcugaacuaucuaacacugugucagaaaaucagaaacuauguuuugugagauguuuagcccagcuguaagcugacauguucuguguguuuuaaagguggaggacacuacacugcuacauuguauccuuuauacugaguaaauugucacuuuugccugggcuuaguaagacaagugggcuaccuguacuugcuuuuugaaauguugucauugccagaggagguuuaaacaauacugcacguaauccacuagaguuacugccuuuuuaucaugucuucuggagaaugagugcuugcuuuaucaggugggaugcauccauccauccugcuuaugccaaaagacauaacuguaaacuucaucccaaccaucucgcccucugcaaggaagucuaauugcaucugcucuuucuucuuccucugaccuugcucacugggagaacuuucuccaauaaaacugucacacuauguacacuuagguuuuccuagagcaacccauauaauuucccuccuaaaaacuacuuuguuuuuucgguuuguuuuuuuuuuuugagauggaccuucacuguguagcucaguauggucuugaaguugcuuuguagcccagacuggccucaaacucaaaaucaucuuguuuccuuccaccuccuggagugcuacagccuuaugcuguauauuuguuccuggccaaugcaaacuccuucugguggauguuuuugaagacagaagcuucaaacuuauugaugacuguuucaaaaucaguccaggacccagcaagaugguuuacuugguaaagguauuugccaucaagccugaccaccugagucugauccuuugaacccacaagguagaaggagagaaccaacucucaugaguugucaucugaccucuguagguguccuuuuguacauaugcacgcaugaacgagugagugaaugaauggaugagcuaacaaaucaacaagcauacauaugucagcauauauguauguguguaauaaaaauccuugguuuguuucucgcugguacuuuaaaguuacaaagcuuucaucuuccuguuugguuuuccuuccuaguauuucuuucccacugccacacacacugugaguuccccaagagccaggacuuugucuacuuuguuugcugcuguauuucugauguacagaauuguguuuuucacuccucuguacuugagcauacauguauuauuuugucgugaauaguuuuguggugcucagauuuaaccagggccuugaaugugaagcacacauuccaccaggaaacuuuaccccaacccuucccuuuauuuuugugugaagaguaauugaagggacgagugagguccugugacuuccaagucuagcuuuccauugccuaauagaagagacgguuacucuuuagcaucuuuguaaagaagggcaaguuuguaccgcuagugcugugcugauagaggggcaagacagucuguucuggcagugguaaaguucagaauugucagggaaagaaacccuuguuaguguaugcucucuuuguuugcccagaugccugaucuccagugaucuuacuagcuugcugagagccuguuaacaagaaacauggcagucgucuugcuuuuuuuguucgggguuucuggaccuggaccucaaaucaggucacuguagaccugcauagucuuaaguagaguagacucuagccacaauuauuagaauucagauuugucucugcaguuaaacaagacauguaguagcuccuguguugaguaguacagacacauagaagaacuguaucaucacagaaaagugcuggaugauacugguauagaugcucagguugguuucaagccuacaauccugcuacuucccaugagcugggaucacaaggaugguccuguggucuugauagaaggauucaggaggaauuuuagggacuguuuaauuugacuaaggacugguuuugaaccuaaagaauagacaccgacauucaacuuuuuagaggaaaacaaaaacaacauuauugauuuaccccaauguaucugaaagaacucauuuggaaggguugaguaauguuagaagcugcguaucuaaaaauccucugugguaucagaguaaguaaugaaggacaguuuuguaauguaaguucuaaugggucaaguguucacuucaaagccuuaucuaaaacuuuauuuagccuggaaaguuugacuaucaagaaaugaagaaucagaacucugacaugaagggagguuccuuuuugugcacaucagcaugcucuaauacagugugagaagcuaaggugaagcuaggaagauuaauuuuacuaaggacaugccuaguaauccauggucauuauccagcauuuuagucagugggaaguugagaucagagaguuccaugucuagcucacuagguuaaagagucuuccuggagacaggaagcaagcguuaggcuacuagagcagaggugaaguaucuguuucugccauuugcaugcccugaagcuuggaggucugguuuucccuuacugggaauccugaagacuugcagaggucugggaggagagucguccugaaucagggaccauuggggucagcagugcuucacauuucuguagcacauucacagcagaaaagcaacacacacacucacacacacucacacacacacacacacacacacacacacacacacacacacucacacacucacacagugaugucuacauauauaguuucccuuugcuacuguggacugcuucucucagccacacuugucuacuucuaccuucugacuuaggccugagcuacugcagugagugaagacuuccaucucuagucuugauucuuucaucuauuacugcagucugcagacaaauguaccuaccuuuaagcaaaguacuguuuuucauuuguuaauuugucccaguaauaaauuugguucuugaauuaugaagaaggagggaacuccauuuuaagcacguuuguuuuugcaggaugacccauugguacugaaugagaucagagaagaucugcgaguagaauguuccaaguuugggcagauucggaagcuccuucuguuugauguaaguucacugagugcugaagccucacauccuuucgagcugaggagugagugagagugccgugggauuucgaugccuguuuuucuaucgaaggccugcugucugucagcaguagcucagugaacauggcuccuauggcaaggccuugauugauuugaugugccgaguuuacuucccuuccuccugacuguuuaaaagagugagcgcaaguagaaggagaaugugugcagaauuaguuuucucgaggcucuugacuuucucugaauuauucaccugaucacaguuaaggaacaaaagcuuccuuguguauuuuccccuguacuuccaaaacugauaggaaguacuuaagugaccauuuauuacaguguauugaugcugugcugauugugaggggcuuuauguauccaucgcaaucuucagaaguggguagcuaugagcccuacagaugaggaagccacaucuuucccugugugaguccuuacucagugcuccuucagcuccuaacaugcaguguuuagucccagggcaaaucugaucucauuucacacuuaacaaucacaugcucuggccucuuggguaguguugguaacagaaccauuugugagaacacucuacugggguuugcuaaacaaggaacagcuacagacucagcugagcauggggaaugggguggggaagagggagcucuuccauccuguagcucagagugucaggagaaugcuacuccuaaccuggcuuagcuaaugcgagucugauugcuaaccuugucauucaguccuccuuacucuugucuuuuuagagacacccagaugguguggccucuguguccuucagagagccagaggaggcugaccauuguauucagacucuggauggaaggugguuugguggccgacagaucacugcucaagccugggaugggacuacagauuaucagguaaauccugcagcugucaagagcacaugaacuugcauugucacaaguuagugugggaguugguguaaucuguuuuguauaaugcaacuuguaaagaauguuuuacauuggaggagagagaaaaacuuuucacuucucagcuuauaagucugaaauuuugagacuuucuuagaauaauaaaagaaaauauuaaacuaaaguauuccacauccuuucucauuacagagaauggacaaagcugacauaguaauguuuugggaaaagaaauauuuccaugaucccaauaauuacuuauauuuauaugaucuucuuuaagguugacuguguguaagguugauuaaccaagguuuugaagacuggagagcagggaaaugcuuggcuugcuuuggaaaaguugcuuuauaagcuaggguacuugugucaguauuagaaaugcucagagaaguuccugcuucuuuuuugccuuaaacucauuuuaauacuagcuccuguuugugcacagguagaggagaccucaagagaaagagaggagcggcugagaggcugggaggcauuccucaaugcuccugaggccagcagaggccuccggcggauggauuccaucgcugguucagaaaggccagggccuuccagaaugaggcauuuuucagagcacccaaguaugucuaauaugaaggcucaggaagcuacaacuggaauggcauuugaagaaacuaucgaugaaaauaaguuugaaaaggcagaagaagggggagaauccgaaggagaugcuucugaaaaagaugccaaagaaggugggucugauggggaccacccugagagagaggguggagaaggcugcuccaagaaagagaaugaagagggcugcccugagagggcgcuugagccugaggaggguaauccucaaaccgaggcucaagagaauggcccugaaagggaagcuaggaagaaaagcaaaauggauuaugagaagaauggcuuuucaaaagagucugaagacaaugaccuuggcaaggagucugaaggggaagacagccucaagaaagagucggaagaugaugauucagaggaggaaucugaggaagacagcucagaaaagcaaucucaagauggcucugacaaagaaauagaagaaaaugguguuaaaaaagauguugaccaggaugucucugacaaggaguucccagaagauguugagaaagagucagaagaaaaugagacugacaaaucagaauuugaugaagguucugaaagaguguuagaugaggaaggcucggagagagaauuugaggaagacucagaugaaaaggaggaagaaggugaugaugaugaagaagaggucguauaugaaaggguuuuugaugaugauucugaugacauugaggaggaagaagaagcagaugaaaaggagugugaagaugcugaugacaaagaggaagacaaugauauagaugaaaagcucuuugaugacuccgaugagaaggaagaugaagaagacacagauggaaagaaagaugaugaugccagugacaagguauucgaagacaauuccaaugagaaguuguuugaugaggaagaaggucccaaugagaaguuguuugaugauucugaugagagagggacuguggggaaugugaaggaagaugggucucaguccacagacagcagcuuugcccucaguaguagugaugaugaugaugaugaaguguaaucuuuuccaguugcuucuuagggagagcccugcaucuccauuugcccaugcuucagggucaauaguaguguuacagcaacaugugcauagugguaggaugccaucugacuaaugucucgaaggguuuuguucucaccuguaccaguggauuuaaauauguuuauugguucuucaguucaaaacuucacaguuaccaugcaaguaaacuggauaucugucauuuuguuggauuuguuaaaugcaugcaaaagaauauuuuuaaaguauucuaauuggaguuugugauauucagaaauaaagauuaaauugguaauaugcagaaccugaaaugugg

SEQ ID NO: 9510 - RNA, 5071 nt, Mus musculus
agauguuuguaaaaauugcuuuauugaggugucauuuugaaagcacaaaauucaguuauaauuguaacagauuuuuuuuuuggcaaguuuacaaagcugcaugaccaucuucaaaaucuaauaugaguuuuggaauagaugaaauuugguuauaaggaauuuccucugaugaaauucuacccacagcuaauuuuuacuuccucaagacuaagagaauucugucucuauaaauucaucauucuugaauauuuaucauaaauggaauauuagacaacaugguucuuuguagcuguugagcaccugcauuuacauguaugcaauauguacauccaguacccagaggacaggagggggugcaagaaccccuagaacucgaguuacacacccuugugaguaacaucagcccuucuguugcuuuuguggcuucacauguuguaauauguauucauguguuccuuuuauugcaacauaguaugccaccaaaugacuauaugacauuuuguuuauucagugacaagucuaaacauuucgaucauuucugauuguuggcuaauuuuauguauuuucuuucagacaggauuucacucucuaguuugggcuagccuuauauucguggcgauacuccugccccagccuuccaaguccuaggauuacaagcgugauccaccaugucuggcucuaguugggaauuauaaagcuaguuugaguauauguuuuaccuuucauuuaaaacuggaaguaccugauaauauuuacuauauugcuuaugagccugcaaugaggucccauaucauggcuguagcauggggcaacacuauucauccaaugccugauacacaaaagacacaggauggggcuggagucccaauauuccccuaaauaacuuucauccuaaggccagaugaacuuaauccaguccugccuuuuuaaaauuuucuaucauguaccagucauucuggaacaaaaccuuuuaacacuuguacuuucuaguucuauaacaagcgcugugugaccauuguuaaaauccaacaggacauuuccaucuaacauucaagucuacacuaaaacgaucuaguuucugccucuagaaauccucucauauagcccaggcuggccuuaaauucucuauguagcuaaaacuggccuugaacuccugauucuucugccucauucccaaauucaucaauccuuggcugggcaugguggcacacgccuuuaaucccagcacucgggaggcagaggcaggcggauuucugaguucaaggccagccuggucuacaaagugaguuccaggacagccagggcaauagagagaaacucugccucaaaaaaacaaaaacaaaucaaaacaaaccaaauuugcugauccuuguacucaagucugaggccagccucacauugagugcaggccauccagagcuauaaaggugaacgaaaccuugcuucaaaaaacaaaaacaaaacaaccgcugaaagaaagagaaaaagaugaagagaaaaaggggagaggagcuacgugagacccuaucucaaaaaaaaaaaaaaaaaaaagguuuuuuuuuuuguuuguuuguuuuguucuuuuaaaaaaaggagaccauuguuuugggccacaguaacuuuccuugcucccaguggagcacaauuuaggcuuuguuaagccucgguacagagaacagcucuuacucagggacagguucucaagggugguggcuuuucaacugaaugucuggguguuaagcugacuccacucuggcuaggucagagucucaagagcugcgacacuguaugaccucuaggauuucucuucuuguucaacuccacagcagcuagaauuguuucuaggccuggaaaaaugucacccugugaauguucaagcuaguuguuaaugaaugacccacaaggaaggcuccaagagacagcugggggacccugugcuuuucuuccucucugaaacuccaguucugaccucugccccagguccagcaacacuuacgugcugugcucagacucuacuucccugugagaugcuaucagcaaaugugucccuaggcgggaggaaacaugaggcuucugucacaagguucccuucucacagaauggccugggaauccgcgcgaacacucgugucugcuauaaagcaaaguuucaagagaugcuuuaaguaugcauuauguucaggauaaucucaccuauaccuccccaaagcuuggcuucuucuccuuugcuuuacuucuacagccauguaacauacgauugaaugguucuguuuauuuccacaaaauuuacagacaaaauaugagcaaaaaaaaaaaauuuguuuuguaaguucccuuaaugacuauuuccaguuguauccaguuuccuauagacaacaugauuuuaaaaaaugccuuuucuacauguagcacagauucucuaucuauuccucucuuggccaacuaggcugguuuccuaacuuaguuguggugaauauagucuacagcuauguagaaguaucucuccaagaguugauaggaaguccuuagaguaaauagccagguaugguauaguuuggcuucuauaguagcugcccaagcuuaccuucacacaagcaauaaggaggguucccuuuuccccacauccuugccaguauucauuguuacuccuuccuuaaugaguaccauucuggggguugguuagauggcucagcggguaagagcaccgacugcucuuccaaagguccugaguucaaaucccagcaaccacaugguggcucacaaccacccguaacaagauuugaugcccucuuguggagugucugaagacagcuacaguguacuuacauauaauaaauaaaucuuuaaaaaaagagugucauucugaauaaguaaauagaaucucagcaguuuugauuugcauuuucuuaugguguugaacaucuaucuuuuacaauuuauuggccaagggaagauagagaugacucagcaguuaagagcacugacuguucuucaagaagauccaccauauggcagcucuuggccaucuauaagaugaucugacacccucuucuagacuacucaggcaccagucaagccagugguacacagaugcacauaaaagacuccuaugaauaaaauacaaacuuuuaaaaagucaagccagggcugggauauaucucuacaguugcuagagugcuugccuaaagccccaaguucaagucccaucagcacauaaaacugagcauggugguacacagcugaaauccuuguacuugaaaggauaaguucaaggcuagccucaugagaucuugccucaaaaaagguaagcaagguauggugacuaaugccaauaaucuuagcaugugggaggcaaaagcaggaaggucaccaagagcuuaaggucagguuggucuacaauagaacauucuaggccagccugggcuaccuagugaaacugucucaaaacuaaagauauaacucaguuguagaauguacaaggucauaggugaaucccacaauaaaacaacacauaaguagacuauaaaaggcuccacccacaaaguaaugaugucucaacuacaacacuaaauaaaaugcuaccauuaucuaaaaaucaagaaacuaugaaauguauccagccugauccucuagucucuacaucacaaauauuaugauuacagguguggaucaccaugccugccuaaagugcaugcuauuccacaacuaaguaagguauuguaguguuaaggaauggggcgagaacauaguucaguugguagagcgcuagcacagcaaugcaaaaagcccucacuuccauccccagcaccacauaaacuaguuacaguggugguacaugcuugcaauaccagcacuggggaaguauggguagggggucaaggucaaucuaggcuguuuaguucaggcuggucucaauuguauagaaaucuaguugggauuaagauuuuaaaauguauauaaucaccaugccuggcuaugacuuauuuuaauuacaaagaagaaaacauuagaauuaguuuaggugaccaccaguacccuuuacagucauuuuuaacugccugacucucaauucauucugucucaaugaaaacgaauucugagccuuugccagcuggcccaguuggagguccugucagcaaaguauuaguaagccgccaccgcaggacuuggguuugguuccugcuuccacagcacagacgucuguagccugaggagccugucuggguuuuaugcuccuucagggcacauauguucuggacucuguaacagaguccccagaaacacccauaggcuguuuuuuuacaguugaguacaucuggcaagacacuucccuauguaguuccuccagcaguagagagcagauuucuaguagguucugcuacugugguaccaguaucccuuaaacauuuaacaaguccuaaccgugccucuccauauuugauuaaguagguggugaggcucuucauugaucuucuagaauagcccuacaguaggucuugaagaauagaaaggugugugugggggggucucccuugggcacucuaaucucaacccuaccagaagcaacuagaguaauuuaagguuuguuauuuuauccggcgauccuauacucuuuauucuccuuuacuucuauuacucuacccauucagaaacccauaccaaauuuuccuuguacagaauaguguuuucuccuccucgaauccagccugagguaaacgcacaauauggggucuguuaggcaaugucuucagacaucccagugcucuuuagaaagggaaaugagcugccacaaaugucuggcaggcaggcucauaaucaagcuaccuuuugugauucguaaaguaccaacugaaaucccaagugcacuacaguagcaguagggaugaccuucaaacagagaaugcacgaagucuugacuuuuacuugcacuuacaaagaaaauugcaagcucggguguauuaaguuucagcacaaguugcucugagaaucagagcuucccgauagcucuacaaaagcuuacuucuaauaaucuccugacagauacugcugaguaucggcugggaugaacucag

SEQ ID NO: 9511 - RNA, 5071 nt, Mus musculus
cugaguucaucccagccgauacucagcaguaucugucaggagauuauuagaaguaagcuuuuguagagcuaucgggaagcucugauucucagagcaacuugugcugaaacuuaauacacccgagcuugcaauuuucuuuguaagugcaaguaaaagucaagacuucgugcauucucuguuugaaggucaucccuacugcuacuguagugcacuugggauuucaguugguacuuuacgaaucacaaaagguagcuugauuaugagccugccugccagacauuuguggcagcucauuucccuuucuaaagagcacugggaugucugaagacauugccuaacagaccccauauugugcguuuaccucaggcuggauucgaggaggagaaaacacuauucuguacaaggaaaauuugguauggguuucugaauggguagaguaauagaaguaaaggagaauaaagaguauaggaucgccggauaaaauaacaaaccuuaaauuacucuaguugcuucugguaggguugagauuagagugcccaagggagacccccccacacacaccuuucuauucuucaagaccuacuguagggcuauucuagaagaucaaugaagagccucaccaccuacuuaaucaaauauggagaggcacgguuaggacuuguuaaauguuuaagggauacugguaccacaguagcagaaccuacuagaaaucugcucucuacugcuggaggaacuacauagggaagugucuugccagauguacucaacuguaaaaaaacagccuauggguguuucuggggacucuguuacagaguccagaacauaugugcccugaaggagcauaaaacccagacaggcuccucaggcuacagacgucugugcuguggaagcaggaaccaaacccaaguccugcgguggcggcuuacuaauacuuugcugacaggaccuccaacugggccagcuggcaaaggcucagaauucguuuucauugagacagaaugaauugagagucaggcaguuaaaaaugacuguaaaggguacugguggucaccuaaacuaauucuaauguuuucuucuuuguaauuaaaauaagucauagccaggcauggugauuauauacauuuuaaaaucuuaaucccaacuagauuucuauacaauugagaccagccugaacuaaacagccuagauugaccuugacccccuacccauacuuccccagugcugguauugcaagcauguaccaccacuguaacuaguuuauguggugcuggggauggaagugagggcuuuuugcauugcugugcuagcgcucuaccaacugaacuauguucucgccccauuccuuaacacuacaauaccuuacuuaguuguggaauagcaugcacuuuaggcaggcauggugauccacaccuguaaucauaauauuugugauguagagacuagaggaucaggcuggauacauuucauaguuucuugauuuuuagauaaugguagcauuuuauuuaguguuguaguugagacaucauuacuuuguggguggagccuuuuauagucuacuuauguguuguuuuauugugggauucaccuaugaccuuguacauucuacaacugaguuauaucuuuaguuuugagacaguuucacuagguagcccaggcuggccuagaauguucuauuguagaccaaccugaccuuaagcucuuggugaccuuccugcuuuugccucccacaugcuaagauuauuggcauuagucaccauaccuugcuuaccuuuuuugaggcaagaucucaugaggcuagccuugaacuuauccuuucaaguacaaggauuucagcuguguaccaccaugcucaguuuuaugugcugaugggacuugaacuuggggcuuuaggcaagcacucuagcaacuguagagauauaucccagcccuggcuugacuuuuuaaaaguuuguauuuuauucauaggagucuuuuaugugcaucuguguaccacuggcuugacuggugccugaguagucuagaagagggugucagaucaucuuauagauggccaagagcugccauaugguggaucuucuugaagaacagucagugcucuuaacugcugagucaucucuaucuucccuuggccaauaaauuguaaaagauagauguucaacaccauaagaaaaugcaaaucaaaacugcugagauucuauuuacuuauucagaaugacacucuuuuuuuaaagauuuauuuauuauauguaaguacacuguagcugucuucagacacuccacaagagggcaucaaaucuuguuacgggugguugugagccaccaugugguugcugggauuugaacucaggaccuuuggaagagcagucggugcucuuacccgcugagccaucuaaccaacccccagaaugguacucauuaaggaaggaguaacaaugaauacuggcaaggauguggggaaaagggaacccuccuuauugcuugugugaagguaagcuugggcagcuacuauagaagccaaacuauaccauaccuggcuauuuacucuaaggacuuccuaucaacucuuggagagauacuucuacauagcuguagacuauauucaccacaacuaaguuaggaaaccagccuaguuggccaagagaggaauagauagagaaucugugcuacauguagaaaaggcauuuuuuaaaaucauguugucuauaggaaacuggauacaacuggaaauagucauuaagggaacuuacaaaacaaauuuuuuuuuuuugcucauauuuugucuguaaauuuuguggaaauaaacagaaccauucaaucguauguuacauggcuguagaaguaaagcaaaggagaagaagccaagcuuuggggagguauaggugagauuauccugaacauaaugcauacuuaaagcaucucuugaaacuuugcuuuauagcagacacgaguguucgcgcggauucccaggccauucugugagaagggaaccuugugacagaagccucauguuuccucccgccuagggacacauuugcugauagcaucucacagggaaguagagucugagcacagcacguaaguguugcuggaccuggggcagaggucagaacuggaguuucagagaggaagaaaagcacagggucccccagcugucucuuggagccuuccuugugggucauucauuaacaacuagcuugaacauucacagggugacauuuuuccaggccuagaaacaauucuagcugcuguggaguugaacaagaagagaaauccuagaggucauacagugucgcagcucuugagacucugaccuagccagaguggagucagcuuaacacccagacauucaguugaaaagccaccacccuugagaaccugucccugaguaagagcuguucucuguaccgaggcuuaacaaagccuaaauugugcuccacugggagcaaggaaaguuacuguggcccaaaacaauggucuccuuuuuuuaaaagaacaaaacaaacaaacaaaaaaaaaaaccuuuuuuuuuuuuuuuuuuuugagauagggucucacguagcuccucuccccuuuuucucuucaucuuuuucucuuucuuucagcgguuguuuuguuuuuguuuuuugaagcaagguuucguucaccuuuauagcucuggauggccugcacucaaugugaggcuggccucagacuugaguacaaggaucagcaaauuugguuuguuuugauuuguuuuuguuuuuuugaggcagaguuucucucuauugcccuggcuguccuggaacucacuuuguagaccaggcuggccuugaacucagaaauccgccugccucugccucccgagugcugggauuaaaggcgugugccaccaugcccagccaaggauugaugaauuugggaaugaggcagaagaaucaggaguucaaggccaguuuuagcuacauagagaauuuaaggccagccugggcuauaugagaggauuucuagaggcagaaacuagaucguuuuaguguagacuugaauguuagauggaaauguccuguuggauuuuaacaauggucacacagcgcuuguuauagaacuagaaaguacaaguguuaaaagguuuuguuccagaaugacugguacaugauagaaaauuuuaaaaaggcaggacuggauuaaguucaucuggccuuaggaugaaaguuauuuaggggaauauugggacuccagccccauccugugucuuuuguguaucaggcauuggaugaauaguguugccccaugcuacagccaugauaugggaccucauugcaggcucauaagcaauauaguaaauauuaucagguacuuccaguuuuaaaugaaagguaaaacauauacucaaacuagcuuuauaauucccaacuagagccagacaugguggaucacgcuuguaauccuaggacuuggaaggcuggggcaggaguaucgccacgaauauaaggcuagcccaaacuagagagugaaauccugucugaaagaaaauacauaaaauuagccaacaaucagaaaugaucgaaauguuuagacuugucacugaauaaacaaaaugucauauagucauuugguggcauacuauguugcaauaaaaggaacacaugaauacauauuacaacaugugaagccacaaaagcaacagaagggcugauguuacucacaaggguguguaacucgaguucuagggguucuugcacccccuccuguccucuggguacuggauguacauauugcauacauguaaaugcaggugcucaacagcuacaaagaaccauguugucuaauauuccauuuaugauaaauauucaagaaugaugaauuuauagagacagaauucucuuagucuugaggaaguaaaaauuagcuguggguagaauuucaucagaggaaauuccuuauaaccaaauuucaucuauuccaaaacucauauuagauuuugaagauggucaugcagcuuuguaaacuugccaaaaaaaaaaucuguuacaauuauaacugaauuuugugcuuucaaaaugacaccucaauaaagcaauuuuuacaaacaucu

SEQ ID NO: 9512 - RNA, 19038 nt, Mus musculus
ccaggacuuucaaccuggauguaacuauugcuuucaaagcagaaacaacuuggcgauagguaaggaguaguguaaaaguuagaaaagaaaacuagauacucuauauuacucuauaauugagacccauacaauuaacagaucauaugggaacuagaguguuuaacuguguccaugaaggucacugauacuccuccuuccuagggagcaaauuucaaaguccuguguauguauauacauauauauaucgcauugguuauaaauuguauagaaaccaagaagucaguuuguuucuguagacaguagagaaucuuuuuggcacuucaggaagaugagagagaggaaaaacuggugaucuuuucuaaaguggagaaaggauauuuaagugauaagauggaaaaggacuuuuccagaguacuuuaaggccauuaaguugcccuuaguccucacaagaacuugaccuuuagcccucuucaacuaguuuguacugagguguaugcauugggguagugaagacagggcuggacagagucuggacucaggaauuucacuugauuagcugucuuggagacaucuaggacuuucucacugaaauuagaccuuccugcuuucgaagccuucuuaaugaauuugagauaaccaggagaaagugugagaaggagauugcaaagggccaggugggcauugaacuuggguccugaaagauggagcaaagggaugcuagagccagagcacacaacacagccaaagcaaauagggaaagagcuugagauauauauggcaugguaggaaaaaggucaagacaaugcuccgggcugaaucucaagggcugucuaugccugcaguguauuugguggguagggauaaggcaccagcaagagacagugaucagaccuccugcccaugugaaagcaucagucuuuucugauggcuccugugguuuuaaaagaaaaagagcaugcugagccauauuaggaagcucauagcaucucuuuuuagaccuucaagccacucugcuucaaguugacuuuuccacaauuaccaccuuuggaaaggccuaacaugcaggaaguuuucuccacucacuuucccauguggcccauggauaggccacacuuaaguaaguuccuugauaugacaauuuauuccauccauacuauaauccugaaaguaggauagccaaauaagauacaagggacacacacacacacacacacacacacacacacacacacauauauauauauauauauauauauauauauauauauauauauguacguacacacacacacacauacauacacacacacacacacacacacacacacacaaacaaacaguuagauaguuagauuguugaaaaugucuucgaaucuuuucaguaauuuauuugguaauugugcuuuaguauuuucagaguuggggguaggaccuaggaucuggagugugauaagcauucagucuacuaguaagcuauccccuagcucaucccaucuucauagcuugaagacagaggaagugugggaaggagagcuaaaagucuacuggcuaaaggcauuugucaggggagaaagguagggugugauuccaggagagguguguguguguguguguguguaccccaugcccugaccuaggagggcagaguugaguuaagcagaagcaagacacugaccucuguguuccuaaaggccccuugggucuagggaauggaggucacuucccccuggcuuccugaaggcaagcagcucagcugccucagcuuggacucacaugcuuugcuuugguugguggcugugguugccccucaggguucagucacgcagaaagggucaauaaacuauguauuucuagccaaagaagagagacaauaaaaccacccucagggucagaggucaccuagucacugauugagauauucacaacucuuuuuccucauuucucuuccucauccccucuuuccucuccaaggcuaccguuccucugacuuuuuuuuuaaaccuuucuccaaagccagagugauucuuauaauugagguguugccaggaaaaaaaucauaucuaauaccaaaugcauuuugaaaauaagggguguguguaaaaccuaacagaauaugucuuuuucucugagacugcagucauuccccagcccaggggucagcagaccuuuccuguaaaaggcgcaauagaaagcgguuuaagcucuucaggccaccugcagucuguguagcauaaucucuucucacuuuucuucccuuuuccaccucuaacccuuuaaaggugauuuaagaaccauucuuggcuccuggaccacuggaacacaacaggcuaggcauugcaugucacaguuugccauucaaguccaaaccagacauuugucuaacacuccuugauucugucugguuuagagguaggacagaaagaggaaagggaggcccugggcuuuguuuuaauaucaaagucccuaccuccuauccucucacuaggaaaggacccccaaacaagugcaauuugauuuuacaaaaugucacuccugaacuguguaaagucccucugggaucugagagaauuuuaaggggucaagaaucugugcuuucaacuccuacagaagaaaagcuagccaagaaaacagcagccucugcccauagugaggagaauguuggaguauuggaauaggcccgaauaggggaaauggguucucuagaacuaaacacagugagagucacuacuagcaacccuacguaguccagaaaucauuuucugucacuuaaggagcaagauuuauucucaaagcagagaaauuagugagcaaauaugucacaagagucuaaggcuucuuuacuggucugcgaacugagcuaaucuacauuuucgaacuaacugaacauuuaggagcuuagcuuggcauucagaguaaaugcacauuaguguguguucuauaaugguagcaaacuugacuugaaauccuucucucuuaguccaucccacuuagucucuggagaagaacuuguaagucaaauauacuauuuagugacuaaaauaguucauuuaaaacuguaccauuguacaccucuucugguagucucugccugucuucuagaucugccacaaggcauucuggucucaaaaaaaaaaaaaaaaaaaaaagggaauucuuuuucaaugugacuuguccuuuuugacauccaagccacauggcuacuggagacaaacaauuggguaccucuuggagguauaaaggagcucuuuggugacagcaccuaaggagacaggaucaucauuuaucuggaaccuuucaccaggcugggcucaugaguacugccuccucagucuccuggacuucgggaacuaccugcuugaucugaaguggauuuucauagccuugcuuuaagugccugccuugugucuccaaguuuagccccauuuacugcaaccuggaucuccgaaguucaaggguauauaucuaucuguacagcccugauugacaagugcagugaagagucucagcccugccuuguuggcauuucauuaccuugagcagcaaugugucuugaaacugcauaggacaaagacaaaacaauuuuuuaaggaggggaaaagguugauuaacaauaccuaucuguugauucucuauuaauuuuaaagguauuuaggacuuuuaaaauauuugccagaugaccagacuguagugaaaacugggggagucaguaaaagcuggagcucagagagcgccuggugaguguggccgcaggucccagaguccgcucagcucugccgcugaggccaauuaagagcuuuaucuuagcauauaaauaaaggcgaguuaaacacauucuuacccuuauuuucuucuuccuucauuuuuuuauugccauuugcggguuuacccccuuuucucuuucuucuucuucuuguuuuuuuuuuuucuuucuuuuuaaaagaucugggacucugaagagaggguggagauuuauguaaagaaauugucauuuaccagaaaaauaaaaauaacaacaacaaaaaaaccuuugaaaaauggugaguuucagggacacguuucaacgagaaauacuuuguacuccauuggggagaaucaggggcaccaaauucagcgucuuggaauaauucccuuccuggauucaaagauucauuuauugaaauaaaucaggaagcauuggcagaacggaaauccgcuugcuggguuuaaagggucuuuaaaauguugugaguguuagauugcaagucuuuucuaaauauaaaacagaagaaaagaccgcaguguuucccuuggacuuaaagaaaauugcuaggucucugacuuaggaucauuucguguccgcuacagaauuuuuuaaaaaacacugcaugauaacacaaugugcggcacauguuuuguuuuuuugaggcgacuggaagggaagaagggcaaagugcugccuacugaggcucuggggucuauggagaagccaguucuacccuguugccccucacagcgguccuuuuucucucuccuccuccuccaagauagguucuacaaagacucagacucaaaagccuugcucguuuggcaaugauaggcuucucugauuuuauuuauugcuuuagauuuggguauaaaaaauaaucuuuucucccuuuacuguuugaacucagugugagggaaaggauccuauuauauuuccuauccaugcagacauguggauauuuagaccagaccacauacaacugggggacacauaaaagagauuuauugguuaauuuaggcugccuaauacacauguaaaccccaguaagccaaaguugcugagggagcuucgguuauaguggaaaauaagaaccacgacccagguucgagugguccugucugacgccaugauuccuuccugcaccugggagagggggaggggaggggacacgacuaagaaugcuuuccaccucuggcccuagcuucuguaugggggaaguuuuugcucuuucuagucgccacucggcuggcucuuggacucagcuccccaaagcucuagguccaccccccaccgcaagucuuucccagagucuccuuccaaaaaagcaacuugagagagaagcugcaaguccugagaaaaguuaacuuuucucuugcccaacaacacugugaggcguucugugaggcgcagggaacuugauuuuuuucaugcggugacuugcuacaacuggagacauacugcuuuccaucgcgacuaagagucagggcuuccccuccccaaauauggaaacucccacccauaccaaccacaacagaauucgaaauggucuccuugugcccugcugcucauagaguccccagucucauccuuugggaaauaucuggaaccccugagccucacugaacaacugcacuccuaaggggccuggcugccuugggaagagcuccucugccuggguuuuggccuagcugaaccgccucaggucugccccuuaacugggacucaccccucccccuucccaccuucccacuucucgguugaugaucuaauugaauuaugccuuuuuguuccagggacugcagagcacgugcuggaggcaauuaauuaucggaauguggccgcaucaaaacggacacucgguacccgguaggucagcggcggcagcauccccuugcccugcguucgagacuccuccccaaaaagaggaaugcuaguccccaacuaccaacccucuucuccaagccauugccggguagcuugcucagacuuccaauccuucuagacccucgcuuauccggguaucugcagggacugccgggaaacucuugcagcagcgguagcgggacagcugcuuucccugagucuccaagcugacaggauccaaacuuuuuacuaagcagcuagacgucuuggggugguaggggugaggagagguacugggaugcucagaaggaaauuaaggaaaaauaagacaaagggaaaaaggaagaaaagcaaaccaaccuuuuuugcaaaccugacuccacggaauucauuugcaugauuuaaguauauuuguauauuucucuaaaacuccccacuccacccgcaaagaaacucuguagagggagaagagagguuucuuuuuuuuuuuuuuaagagcuuguuuucgguaaaugcaauaauuuaaaagucaucagugcacucucaccuugcaaucuggggagugggcucuaaauguggagugagauuggggugaauuggcugugaaggggugacuuacuauaagaugugccaguagcaccuucucuccgcaaacuaucuuagaaggugagguguuggccagaucagucagauaggaggagggcagaaccggaaaagcugcaguucuaacgcgcugcuugaggcggucucuccuggcgccucugaacuugaucaguuguuguuugcuacagagagauggcggccaggcugugagccugccucaaggcauagacuuuuagaggcuuugcccugcuugggaugugacaaucccagccaccucucagucuuuucuucccacucacuuucuuccacccuuugcuagugcuuugccgcacaaaucauggguggauuuauaacccugcuucuggucauuuuguucagagggggaaaaaauacaaaaaacaacaacaacaacaaaaaaaaaaaacaaaaacaaaaaaccucucaccagggggaagagugguggguaaagaggccacuccagcacaguucccuggaaagcaauuccuugagggacugacugcuucccugagucacuaggugcuucacuggauaggcauagaagagagcaaagcccgggauguuaagaggggaggaaaauuccauucccuguuguccuuuuaacacuucggcauuucagaauguugaguauucaaagcuuguugcuccagccacacgaaaagcacagucacugucuaguauguuuuuacucuguguuuuguauacauaggcuguguucuuacacauuaauuuagcaucuaugcuuguuucugguaugugucuauaugcucucugugcuuuguuuaguguugauacuguguugcuuacuuuauuuaguauguucugcgucuuucaggaggugugcuugcuuucuguguuucauucguguuuccugcuauuugcuuagguuguguuguacauggcuguuguauuguugucuguucuaucacgggacaaggggauguugcugagaagcagugaguacagccgcuaaucacagaccacacggucacagucugacuccgaauuaccguuaguaggcucuaugagcuaucguuucuucuaguuugggcaguggacagcuaccucuaguuuggggcacaggcagggaagaaacugaaccggccuggguuuauaaucuaaugggguguggggugaaagccacagcugaucaggaacacagauuugccccacucaugcgggaauuuguucucgguaccuacggaaggaaaacguucucaagguggugaggcagcagggucccaaguggguaccacagugucuucuggaccgaaagggaacggcaacgacaaguaucuucuugggucaaagaguuucuuuagucuaggcggguacagagcgugcgaggggugcuugcugccggcuuagagcagggccaagccagggagaggcucagcucugucccgccgcuugcggaagccuggccccaguuccccacagccucgcaaacccggcggaucccuuucagggacgcugagcagcggcugccucaccugccgggcgcuccgcagcuacccaaucagcuggggucgcccggcagcggcugccauguucuccgcuucgcgcugccaaucauugugucgguggccaaugggcgacagggccgggggucaggugaucucaggccagcuggcuccccauuggugcgcgcugcccagccucccgcucgguuuaugugcgaggagugagugauugacuuuaucaguccaaggacauuacucuggaggugaagaggcuuggacucgcgaagcgagcagugagguucgagccugcuuacugcaggcugccugcccucuggccacguuccgccucugcuucuuggugcaguugcuccugaaagccgggacccgaggagccucuggccccgugguuccgcgcucuugaguagaggagggguguccgggacaggauugacaaaccccgcccuccacuuauuauuuugcuuauuuuucuuugugcgcuccuguuaguuuguuaagcagauuuaguccuagagucuuuucuccucccuucuccucccuccuccucucccaucgcccuccccccaauccuuuuucuuccccuccucccucccgucccucugcaggagacucucgcagccuaggaaaguugcagcuccggguagcgccuagggggucuccaggcaguguucaaccgccgccaucccuuuccgacuacggcccuucagggaucuccuucgccugcacccuugcucacuucggccggaucuucuguguccagaacacccuaccuaugacgaugcuccuggacggaggcccgcaguucccuggguugggagugggcagcuucggugcuccgcgccaccacgagaugcccaaccgcgagccugcaggcaugggauugaaucccuucggggacucaacccacgcugcggccgccgccgcugccgccgcugccuucaagcugagcccagccaccgcucacgaucugucuucgggccagagcucagcguucacaccgcaggguucagguuaugccaaugcccugggccaccaucaccaccaccaucaccaccaucacgccagccaggugcccaccuacggcggcgcugccuccgccgcuuucaacuccacgcgcgacuuucuguuccgucagcgcgguucugggcucagcgaggcagccuccgggggcgggcagcacgggcuuuucgcuggcucggcgagcagucuucacgcuccagcugguauuccugagccuccuagcuacuugcucuuuccugggcuucaugagcagggcgcugggcacccgucgcccacagggcacguggacaacaaccagguccaucuggggcugcgcggggagcuauuuggccgugcagacccauaccgccccguggcuagcccgcgcacggaccccuacgcggccagugcgcaguucccuaacuauagccccaugaacaugaacaugggcgugaacguggcggcccaccacgggccgggcgccuucuuccguuacaugcggcagcccaucaagcaggagcuguccuguaaguggaucgaggaggcucagcugagccggcccaagaagagcugcgaccggaccuucagcaccaugcaugaguugguuacgcauguuaccauggagcauguggggggcccggagcagaacaaccacgucugcuauugggaggaauguccccgcgaaggcaaguccuucaaggcgaaguacaaacuggucaaccauauccgagugcacacuggcgagaaacccuucccgugucccuucccgggcugcgggaagauuuuugcccgcucugagaaccucaagauccacaagaggacccauacagguaagggggagcagacaggugggcgcgggucuccccaggggcacccugccaccaagcagacugaacagccagagagggagagggguggaggccaagccgaggggcggcgccccgccgagaccuuucaguaccaagcgcugucacagccucuccaccccucaccccccaggaaccugcggcgcuuuugccgaguucuaaguuccugagcagacugcuguggucucaggaacuaauugggaccuucucgcgcccaggaaccaacuggcgccaccucuuuuuguguucuuuucuggguuacuaagaagagacuccgaauguguugggaguauauugcuuacaagcgacuuagcucucugaacacauucggggaaggcaaccauagaaaugcuaaugaaaacuaacuuugguuacuuccguucuuuuuuacacuugauuggcauaucuccuaauuaaaugacugauacuuuugucaaacuauuuuuauuuggaguuccagguuguuuaguucuuuggaggaaagauaaaguagagaaggcacugguuucuguggcuugcucagcaucucuuguaaaaguguguguaguccccggauuuauguaguguucucuuuuuccgaaaauuaguaagacuaccaggcuuagcaaaaccgcuacauuugaaagaggcaaaugaaaagacacaaagaaggggacggauaggacugucccauucccggcccauuguccuacccagcuugguuacacugcugagguggugguguuaugugcccgcacauugggagcccugguucuuuggaguggaagcacaacuuaggguaaacuucugacgaccccccccccagcuuucugcuccugagagaacaaagggauggauguucggguucugggccggcccuacucuaccccugccuaagaucaccacuccccaacucagucagcucaaucaaagcuaugguuuuuuuuucccccuccggggaaaacagaugcuauguccuuccacuguccgcgcuuccccucugcagaaagaccaccggacuuuucaaucucccgcucaccacucugagaaguuucuggguuuaacuauauucucucccucccccuauuuugcauuuuugccuuuugcaggugagaaaccuuucaaaugugaauucgaaggcugugacagacgguuugccaacagcagcgaccgcaagaagcacaugcaugugcacaccucggacaagcccuauaucuguaaagugugcgacaaguccuacacacacccgagcucccugcgcaaacacaugaagguaauuaccucuuuauuagcggucggcgguuuguaaacauucggccugauaccgggccgcagaacggaagcgcccgcgcugccaacccucuauccuucacguuaaauccgauuugcuccagcacugacaccuugaaccccuuuugaggauggggguggaggggggucgagaaggagagagcugaguugggagggggaagagaguagagggaacaaucaguuguuuacugggaagcucuaacggagcucgccagggcuugagcuuucuguggccaccucauccuaucucaacccaggaugggaauccggagugggcgcuccgaacccgggguagugucauucguuugcuccuccgcuucagauaaaacaauagggccaaggagcgcagucugauuccaacacauuugugugggaauucagagcacccaacccccaagccaccucugugucacucaucucuauaccugcuuucccaggccgaauucugaaagugaaaucuggagugacuauuuuauagggcuggcagaauaacuacuugcccaauccauccacggagaaagcauuuuuguuuugaaguagcacgacuaaaauggaauucuuuauuccuuuuccagccugguuuuuggugggaaugcuagggguaucuaucucgauaucaguaauauggaaaaacaauuuuuuuaaauccuauuucucguuuaaguggccagcgggaggucuugcucucuuauaguauucaaaucugaucuuguuuuguuguuauuuggggguuuuauuuauuuauuauugcuuucacauugccaguuggaauuauauucauuauaauauauacauguuaauuuuagguucaugaaucucaagggucagauuccuccccugcugccaguucaggcuaugaaucuuccacuccacccgcuauagcuucugcaaacaguaaagauaccacuaaaaccccuucugcaguucaaacuagcaccagccacaacccuggacuuccucccaauuuuaacgaaugguacgucugaggacaaccaaaaugcauuuaaaaaagaaaacugagacaaaucagauggaaauggaguuuuaaagcaagaggccauauauauagggcuacaucuugguaacugcaauuguucaggaagguuuggggcaagauccaaaaguagcuaugcccuuuucucaggauuagaaaauauguuuuggcauuugaaggaauuuuuuacaaaaucuuuucacugcuuuuccugccccccuccucuugcucucuguacaccccguucuggaacuccuucaaaucauuuuaauuaacacuguccuguuucuugaggaaguuaucgauggcuuggugguggugauguuaaacugaugaaaagucuucuucgccuuaguggugauuguuucuuaaaccaugccaaaguccuguuaugucuugaacuuuucuucaaagcauuacacuugugaauguaucuucgucuaauggggucgaaacuuguuguucaguauuuuuucaggcugaggauaugauguuacucuacacagauuguaacguuuaguauacaguugccuuuuguaauaacuuuucuuuuuguaaauacauauccguugaugccauauuuaucguuuguaauuuaauuauugcugcaagugccgggaacugaacaauauuuauggauaaauguuuucuaacaaauucuguacagcuuuugauuauaacugcuuuuagcauuaaacaauuauuguuuugagaaaaggaacacaauuuacaauuuuugaaccauacugacuuuuuguuuuguuuuguaacagccuccuacaaauaggagaugugaguaaauugaauuuuguuuguugguauuuauaacucacucagaucccuuuuuuaauuguuaaauuauuuuucuauugcagucuagauuccuuacaaugucaguuuccaucuggggaggacccuccugucuuuaucucuagcucagaugguuguuuaacugggaguuuaaauguguuuguccuggauuuucggcaugcaaaucaaauaauacugaucaauucacuuaguggccaugacaucucaaucuuguacuucaaagacugagaggcuggguuuaaucauuccugcccuauauauauauauacauauauauauaaacagaagguaaccuaauuagcuuuaugucccuuaguucuuuauuacuuuacauaaaaaugaaaauuauggcaggaugcaugucuguugagagaucacucauauaccuauauguuuguaucuaugacguaccuaaucugccuaucaaaucuauuuagcuucaaaggauagcacaccucugaaauggcaaugagcaaggccaguugaacagugcuucucaugguuaaagugcuucuuaaaaaaauuaaaaaaaaacaaaaaacaaaaaaaaacaaaaaaacaacagucuuuaaauuuuggauggcaaaggcugauuuguauauaguucaauucaugauuaucacaauuacucauaacguuuauauagcgguguaauaacugcagcaguuccuaaaugauacuguggaaagaaaaacauuugcaaaauacuuuauuuuuaaaguucauuacuuguaggcaaagauguuaagagcauuguuuccauuaaaaucaguaacaaugaaaaacgguuguuuguuuugugauaaaauguuaacaauccauuuaaucuucagugaagcaacucauuuggacaaacaguucuuuuuacaaugggucuguggaaaagaaacugaucaguauuuugggggguugaaguggguagaguuuggagaguuuuuuagggugcuguugguuauugagagcccaaucucugcaugaauaacagaaaaguggagauaaggaauuguaaaguguuuagaaauguaaugaauagguuuaagcaccucuuucgcuuuaaggggcaaugcucucaguuuuugguggcagucaauuugauauuauauaaucauuuucaauucuagaauuuuguugauuguucuuucugaagaaauaaagucuuggcacauccuauuuauguuauaacuuuuuuuguauuuggugcccaauauuuuucccauguucaaauaaaucaaucuaaaauugaaaugcuuagagaauuucuggugcuuuaaaacaaacuuugauucccaagauccauucaaauuauccauuuuguuaucugguuuuguuuuguuuuguuuuugucaacaacuaaguauugacaguuuuuucuuuggaggcaauauuuuguuagugaaaaauggugucucuugcacuugcgcuuugcugguguccaccugaaggccaugaauagaaauugggaugaucauacaugugcugagcagguaaaccuggucaguucaucacaccccacucagacaucccaaucuugaccuugacaaugaggguuuggacuacauccauauuucaggcuuuccucuuagaaaccagagacaauuuuaaaugcucagcaauuuuucagagggcuuuucugacuaaauuugugugauugugaaauguaaauggccagccucucuucuacauauucaaugagcuuccacaauuuacuguuucuccaugaguccccucccugcugaccccaguccuaaccuagcuuuaaguagagauagguugaguaacacuggcuaaaacccuugcuuaauuaaauaacacgaaauauuucauuaguggcuugaaaauauucuaccauagauuuuuacagaaaagcacuucaguguccuaugagaggaaacugacaaauaacaaugauaaccuaauaacuacuaaaaaaugugcuucucaugauucccuccugauuuguauacagcaaaugucuugaaauuauguuuaugcauuucuuuuucacaaagaaaacuugguuucuuugaauccuuugauuuuuuuuuuucuugcccauaaucuagcauagggaaugcauauuuauauucuugaaugcaaacgaagcaaccuaagacaguaaccacacaccccaagucacaaaugcuaaagcuccaaguccaagcuugguccuuaguaauauacuccuugaaaaugaguagguuagcauaauaucucaagaugaggggaaagggggugggggugggguguuuccaagcauggcuggugagcucuggccuccaucaacuuuggaaggcucaaagaucagcaucuaggguaagacugucuaguagguuccagacauggugugcuccgaauuucugcuugacuucuuguugccuauuuuaccccuggcuuccauaccccgcuuuccuaagaaaucugcccaaaccagcgguccuuguaaguccagugccuuguaaguuuuugaaaggcucugccacaaugugaauggaggguaccacuguaacuaguaucuaagcuuguuuucugucacuggcccugaagcuccaaggcuccaguugggcucuagcaugggggaaggcgaggagagucacucuagggauuucagaaguccuuggggagccccuguccacacaccaaauucuucuaaaucuccgcuugagguuugggcagggaggaggggaccucauuuccuagggucaauucucucgcgguuucugcccgcugacccuuugaccuccaccaacagggcccuuggcggccauaagcuagcggaucgccuugggcuccgaggacgcuucgcgccccaucgccucucggccucauuaggccggcggggcuguaaagcagaaaucagcuucggccuaaucccgaccuggggucaauucgagcccaaacaauagcgaucuccuaagacuacagcauagcgcugccagcaaacuuuguguucaauuccuuuuccacuggcgguggggguuggggggaggugaggacgcugguccgcgaaggaagaacacuugcgacauccgcaucacucggcaaacgcccucuugcuaggcucuccaaagagcaucugcagugccgggaauggaggcggcgaggcuccugcauucccugaguaugaggcugauccaaaaggggccuccucggcacugcgaacacacuuugaaguggguuuuuagcgcgcacgugugagagcucggccggggccuuagcugggacccgcagggaggaaagaggaggcuccgguccgggcuucaaccccgccccugcuccccguggcuucggccuuuucaagccgaggccggggacuuuaggacuccccccacccccacgcccgcggucgcggcgcgcaggcgcaaagccuugcagccgucgagcaggauuuugcggccaggggguugcgggggagguugaaagcagccuagcggggagggcggccucggcuaagguggggggggggggcaggaaaggagagggauguggaaaggaggguugguuugggggcggcucuggagucgggaacauggcggccggaugcgaacccccgcagagcgcugcacaacgcagacuacggggcugccgugcuguguuguccuugagauuucccugguuauuccucagcgcuggcgccucgcgggacaauguaggucguggcaguuggacgcaguuuaaaaacaaacagacaaaaaacggaagcgaagaaguucuuuuugggcaaucuggugggaaauggaugugcucuuucgggguuuugggggcucucaaaauauuugggagaacaaaaacccaacagaagaagcuccgggcacacacaaacccuucucauguggugugugugugcgauuucgcguuaaccgugcccuuguuggaauuccacagcaccuucgaguccuuaaaaaacgaacaacaguggacaauguguucucuucucaggacaauggucaauccaguuuggagggaaacagaggcuugucgacccaguuguaccuuugagagauuauauucuauccuuuccccgggccuuguuuucugcacaacucauuuaacgaacgcaccccccgccccaaacacacacaaaaucagcaccuuuaacucuuuuguguguguacacagcugguacucuuagguuaaaggggcccgaaauauucaaaacuuuaauucaguuuuuggcuuaacugccucaugccagagugugaaacucuguggucucgagcuccuguuuccugcacaggaaaauaaaaaugccacggauucaucuuuauacgggucgcagugaggaaaaugacaucuuaaaagguggacuguguugacuucccucuucucuaagcaaauaaggugcacgaacucuucuaggugcuccuaaagaccagcgucugagcgaaagaacaaccugcuugggguuguccacuaucaagcauuccagcuucuggagauguggggcaguuccugauggccaccuugggaagggccccaggugggugggcaggucauuagcaagucuggcacugaucugggggaaaucugcaaaacagugccuuuaucugcagagaacaaucggugggguugucuuuccuucuuuucaaugcacaaagacagaggcuuuggagcaagaauuuggacuaugcauuuaaguugugguguuuugcauugaaaaccucugggcaauuaaaauuagcaugcuccauaguauuuucugugcuuuuaugugugauuucugcaugucaaaggagcuggagacucuucagcaguuugaaaacuuuuuugaaauugccaccaaguuaauuuuccccccucuuuccugugggugaaguuuccuucccaggcuuggccacccuauaugaccaagguggaaugaucuacugacaucuuugggagaacaaaugaaauaaauugaguuugcuugauaauugcuuuucugucugaacucugccugaauuuguuagcuuuuuuuccccuccugauuaaaucuugauaucaaguuuggaaaaaaaaaaaaaaggaaaauucuuucaauuggaaaaguguucgccauggguuagucaguuagggguuugagcuuggauucucuucaguugacuuuaaaaucaagcuaagaauccuugggauuccugagcugucuuuggggucacuucauauauaaauugguuggcauuucuuucuuuuuuuuuuuaauaggaauuaugugaauggaauuucuggaaaauggggcaacuuaucuuugugacuccaaaaggcagugcuuuucucacugggguuuuuguuucucuccuaacuaaugguugaacuguacagcuugaaaagcuuaaguuugcaggaagcauuugaagagagaacuguucacaccacuuggacuaaugguaacuuaacacaggcgcaaaaggucuuugaaaauuagaggaacuuuuguuucaaaacacauguuacaacuaaagcagcuagggaacucagcaauuuugugucuuucucaugugauaccacuucaaccugcuugcuaauccgcugacuagagaagcagaaacuuuauagcagcucuaaaacaccuuucaacaaauggcaaguuuauaauauuugcucucuaguaggcuaugugcauugucuaaauugcguuuugaaaaugcaaucuauguagagaccauuuggagcuaagccgcuagaaauaagacauugcuucuuguuuuacuauaaacuagcaguuuaaaacaacauauccacguaauauuuuaugaauuuuuuuuucuguaagaaaauuugaccuaucugcaguucacuuuuuguuuucuugccaguguuguccugcuugguaucugggacagucucuaauuccugaugaagaacuugauacugacguugguaugcagcaaccaguccuccauaacacuuccuauccuaaaugcaggguuaaugccgaaccuacugugcaagaaaugauuuacugaugagguucaaagaaaaccacaucaauuuggaugucuguuaccuugaagugaucauuuuaagaguaguagugucuuccuuagaucuaaaaaaaaaaaaaaggacuauuuuucucuuuugguguauugcauucuguguugagcaaucauuucugaaaugaaaaaagcaaaaaggcuuccccaccaauuuaggauuuauaaaugggaagaugcuggugacgagggacccuguucagaagccaguaggcacaauucucaugcacuguugcaaaucucuuucuaauaucugaucugaugcuuaaaacuaaaaaguggaguauuugcuuuguuacuuucaccauguuuguauucaaaaagcaauaucuaggcuccugaaaauuguuguuugacuuaauaaaaccguuuaaauuau

SEQ ID NO: 9513 - RNA, 19038 nt, Mus musculus
auaauuuaaacgguuuuauuaagucaaacaacaauuuucaggagccuagauauugcuuuuugaauacaaacauggugaaaguaacaaagcaaauacuccacuuuuuaguuuuaagcaucagaucagauauuagaaagagauuugcaacagugcaugagaauugugccuacuggcuucugaacagggucccucgucaccagcaucuucccauuuauaaauccuaaauugguggggaagccuuuuugcuuuuuucauuucagaaaugauugcucaacacagaaugcaauacaccaaaagagaaaaauaguccuuuuuuuuuuuuuuagaucuaaggaagacacuacuacucuuaaaaugaucacuucaagguaacagacauccaaauugaugugguuuucuuugaaccucaucaguaaaucauuucuugcacaguagguucggcauuaacccugcauuuaggauaggaaguguuauggaggacugguugcugcauaccaacgucaguaucaaguucuucaucaggaauuagagacugucccagauaccaagcaggacaacacuggcaagaaaacaaaaagugaacugcagauaggucaaauuuucuuacagaaaaaaaaauucauaaaauauuacguggauauguuguuuuaaacugcuaguuuauaguaaaacaagaagcaaugucuuauuucuagcggcuuagcuccaaauggucucuacauagauugcauuuucaaaacgcaauuuagacaaugcacauagccuacuagagagcaaauauuauaaacuugccauuuguugaaagguguuuuagagcugcuauaaaguuucugcuucucuagucagcggauuagcaagcagguugaagugguaucacaugagaaagacacaaaauugcugaguucccuagcugcuuuaguuguaacauguguuuugaaacaaaaguuccucuaauuuucaaagaccuuuugcgccuguguuaaguuaccauuaguccaaguggugugaacaguucucucuucaaaugcuuccugcaaacuuaagcuuuucaagcuguacaguucaaccauuaguuaggagagaaacaaaaaccccagugagaaaagcacugccuuuuggagucacaaagauaaguugccccauuuuccagaaauuccauucacauaauuccuauuaaaaaaaaaaagaaagaaaugccaaccaauuuauauaugaagugaccccaaagacagcucaggaaucccaaggauucuuagcuugauuuuaaagucaacugaagagaauccaagcucaaaccccuaacugacuaacccauggcgaacacuuuuccaauugaaagaauuuuccuuuuuuuuuuuuuuccaaacuugauaucaagauuuaaucaggaggggaaaaaaagcuaacaaauucaggcagaguucagacagaaaagcaauuaucaagcaaacucaauuuauuucauuuguucucccaaagaugucaguagaucauuccaccuuggucauauaggguggccaagccugggaaggaaacuucacccacaggaaagaggggggaaaauuaacuugguggcaauuucaaaaaaguuuucaaacugcugaagagucuccagcuccuuugacaugcagaaaucacacauaaaagcacagaaaauacuauggagcaugcuaauuuuaauugcccagagguuuucaaugcaaaacaccacaacuuaaaugcauaguccaaauucuugcuccaaagccucugucuuugugcauugaaaagaaggaaagacaaccccaccgauuguucucugcagauaaaggcacuguuuugcagauuucccccagaucagugccagacuugcuaaugaccugcccacccaccuggggcccuucccaagguggccaucaggaacugccccacaucuccagaagcuggaaugcuugauaguggacaaccccaagcagguuguucuuucgcucagacgcuggucuuuaggagcaccuagaagaguucgugcaccuuauuugcuuagagaagagggaagucaacacaguccaccuuuuaagaugucauuuuccucacugcgacccguauaaagaugaauccguggcauuuuuauuuuccugugcaggaaacaggagcucgagaccacagaguuucacacucuggcaugaggcaguuaagccaaaaacugaauuaaaguuuugaauauuucgggccccuuuaaccuaagaguaccagcuguguacacacacaaaagaguuaaaggugcugauuuuguguguguuuggggcggggggugcguucguuaaaugaguugugcagaaaacaaggcccggggaaaggauagaauauaaucucucaaagguacaacugggucgacaagccucuguuucccuccaaacuggauugaccauuguccugagaagagaacacauuguccacuguuguucguuuuuuaaggacucgaaggugcuguggaauuccaacaagggcacgguuaacgcgaaaucgcacacacacaccacaugagaaggguuugugugugcccggagcuucuucuguuggguuuuuguucucccaaauauuuugagagcccccaaaaccccgaaagagcacauccauuucccaccagauugcccaaaaagaacuucuucgcuuccguuuuuugucuguuuguuuuuaaacugcguccaacugccacgaccuacauugucccgcgaggcgccagcgcugaggaauaaccagggaaaucucaaggacaacacagcacggcagccccguagucugcguugugcagcgcucugcggggguucgcauccggccgccauguucccgacuccagagccgcccccaaaccaacccuccuuuccacaucccucuccuuuccugccccccccccccaccuuagccgaggccgcccuccccgcuaggcugcuuucaaccucccccgcaacccccuggccgcaaaauccugcucgacggcugcaaggcuuugcgccugcgcgccgcgaccgcgggcguggggguggggggaguccuaaaguccccggccucggcuugaaaaggccgaagccacggggagcaggggcgggguugaagcccggaccggagccuccucuuuccucccugcgggucccagcuaaggccccggccgagcucucacacgugcgcgcuaaaaacccacuucaaaguguguucgcagugccgaggaggccccuuuuggaucagccucauacucagggaaugcaggagccucgccgccuccauucccggcacugcagaugcucuuuggagagccuagcaagagggcguuugccgagugaugcggaugucgcaaguguucuuccuucgcggaccagcguccucaccuccccccaacccccaccgccaguggaaaaggaauugaacacaaaguuugcuggcagcgcuaugcuguagucuuaggagaucgcuauuguuugggcucgaauugaccccaggucgggauuaggccgaagcugauuucugcuuuacagccccgccggccuaaugaggccgagaggcgauggggcgcgaagcguccucggagcccaaggcgauccgcuagcuuauggccgccaagggcccuguugguggaggucaaagggucagcgggcagaaaccgcgagagaauugacccuaggaaaugagguccccuccucccugcccaaaccucaagcggagauuuagaagaauuugguguguggacaggggcuccccaaggacuucugaaaucccuagagugacucuccucgccuucccccaugcuagagcccaacuggagccuuggagcuucagggccagugacagaaaacaagcuuagauacuaguuacagugguacccuccauucacauuguggcagagccuuucaaaaacuuacaaggcacuggacuuacaaggaccgcugguuugggcagauuucuuaggaaagcgggguauggaagccagggguaaaauaggcaacaagaagucaagcagaaauucggagcacaccaugucuggaaccuacuagacagucuuacccuagaugcugaucuuugagccuuccaaaguugauggaggccagagcucaccagccaugcuuggaaacaccccacccccacccccuuuccccucaucuugagauauuaugcuaaccuacucauuuucaaggaguauauuacuaaggaccaagcuuggacuuggagcuuuagcauuugugacuuggggugugugguuacugucuuagguugcuucguuugcauucaagaauauaaauaugcauucccuaugcuagauuaugggcaagaaaaaaaaaaaucaaaggauucaaagaaaccaaguuuucuuugugaaaaagaaaugcauaaacauaauuucaagacauuugcuguauacaaaucaggagggaaucaugagaagcacauuuuuuaguaguuauuagguuaucauuguuauuugucaguuuccucucauaggacacugaagugcuuuucuguaaaaaucuaugguagaauauuuucaagccacuaaugaaauauuucguguuauuuaauuaagcaaggguuuuagccaguguuacucaaccuaucucuacuuaaagcuagguuaggacuggggucagcagggaggggacucauggagaaacaguaaauuguggaagcucauugaauauguagaagagaggcuggccauuuacauuucacaaucacacaaauuuagucagaaaagcccucugaaaaauugcugagcauuuaaaauugucucugguuucuaagaggaaagccugaaauauggauguaguccaaacccucauugucaaggucaagauugggaugucugaguggggugugaugaacugaccagguuuaccugcucagcacauguaugaucaucccaauuucuauucauggccuucagguggacaccagcaaagcgcaagugcaagagacaccauuuuucacuaacaaaauauugccuccaaagaaaaaacugucaauacuuaguuguugacaaaaacaaaacaaaacaaaaccagauaacaaaauggauaauuugaauggaucuugggaaucaaaguuuguuuuaaagcaccagaaauucucuaagcauuucaauuuuagauugauuuauuugaacaugggaaaaauauugggcaccaaauacaaaaaaaguuauaacauaaauaggaugugccaagacuuuauuucuucagaaagaacaaucaacaaaauucuagaauugaaaaugauuauauaauaucaaauugacugccaccaaaaacugagagcauugccccuuaaagcgaaagaggugcuuaaaccuauucauuacauuucuaaacacuuuacaauuccuuaucuccacuuuucuguuauucaugcagagauugggcucucaauaaccaacagcacccuaaaaaacucuccaaacucuacccacuucaaccccccaaaauacugaucaguuucuuuuccacagacccauuguaaaaagaacuguuuguccaaaugaguugcuucacugaagauuaaauggauuguuaacauuuuaucacaaaacaaacaaccguuuuucauuguuacugauuuuaauggaaacaaugcucuuaacaucuuugccuacaaguaaugaacuuuaaaaauaaaguauuuugcaaauguuuuucuuuccacaguaucauuuaggaacugcugcaguuauuacaccgcuauauaaacguuaugaguaauugugauaaucaugaauugaacuauauacaaaucagccuuugccauccaaaauuuaaagacuguuguuuuuuuguuuuuuuuuguuuuuuguuuuuuuuuaauuuuuuuaagaagcacuuuaaccaugagaagcacuguucaacuggccuugcucauugccauuucagaggugugcuauccuuugaagcuaaauagauuugauaggcagauuagguacgucauagauacaaacauauagguauaugagugaucucucaacagacaugcauccugccauaauuuucauuuuuauguaaaguaauaaagaacuaagggacauaaagcuaauuagguuaccuucuguuuauauauauauguauauauauauauagggcaggaaugauuaaacccagccucucagucuuugaaguacaagauugagaugucauggccacuaagugaauugaucaguauuauuugauuugcaugccgaaaauccaggacaaacacauuuaaacucccaguuaaacaaccaucugagcuagagauaaagacaggaggguccuccccagauggaaacugacauuguaaggaaucuagacugcaauagaaaaauaauuuaacaauuaaaaaagggaucugagugaguuauaaauaccaacaaacaaaauucaauuuacucacaucuccuauuuguaggaggcuguuacaaaacaaaacaaaaagucaguaugguucaaaaauuguaaauuguguuccuuuucucaaaacaauaauuguuuaaugcuaaaagcaguuauaaucaaaagcuguacagaauuuguuagaaaacauuuauccauaaauauuguucaguucccggcacuugcagcaauaauuaaauuacaaacgauaaauauggcaucaacggauauguauuuacaaaaagaaaaguuauuacaaaaggcaacuguauacuaaacguuacaaucuguguagaguaacaucauauccucagccugaaaaaauacugaacaacaaguuucgaccccauuagacgaagauacauucacaaguguaaugcuuugaagaaaaguucaagacauaacaggacuuuggcaugguuuaagaaacaaucaccacuaaggcgaagaagacuuuucaucaguuuaacaucaccaccaccaagccaucgauaacuuccucaagaaacaggacaguguuaauuaaaaugauuugaaggaguuccagaacgggguguacagagagcaagaggaggggggcaggaaaagcagugaaaagauuuuguaaaaaauuccuucaaaugccaaaacauauuuucuaauccugagaaaagggcauagcuacuuuuggaucuugccccaaaccuuccugaacaauugcaguuaccaagauguagcccuauauauauggccucuugcuuuaaaacuccauuuccaucugauuugucucaguuuucuuuuuuaaaugcauuuugguuguccucagacguaccauucguuaaaauugggaggaaguccaggguuguggcuggugcuaguuugaacugcagaagggguuuuagugguaucuuuacuguuugcagaagcuauagcggguggaguggaagauucauagccugaacuggcagcaggggaggaaucugacccuugagauucaugaaccuaaaauuaacauguauauauuauaaugaauauaauuccaacuggcaaugugaaagcaauaauaaauaaauaaaacccccaaauaacaacaaaacaagaucagauuugaauacuauaagagagcaagaccucccgcuggccacuuaaacgagaaauaggauuuaaaaaaauuguuuuuccauauuacugauaucgagauagauaccccuagcauucccaccaaaaaccaggcuggaaaaggaauaaagaauuccauuuuagucgugcuacuucaaaacaaaaaugcuuucuccguggauggauugggcaaguaguuauucugccagcccuauaaaauagucacuccagauuucacuuucagaauucggccugggaaagcagguauagagaugagugacacagagguggcuuggggguugggugcucugaauucccacacaaauguguuggaaucagacugcgcuccuuggcccuauuguuuuaucugaagcggaggagcaaacgaaugacacuaccccggguucggagcgcccacuccggauucccauccuggguugagauaggaugagguggccacagaaagcucaagcccuggcgagcuccguuagagcuucccaguaaacaacugauuguucccucuacucucuucccccucccaacucagcucucuccuucucgaccccccuccacccccauccucaaaagggguucaaggugucagugcuggagcaaaucggauuuaacgugaaggauagaggguuggcagcgcgggcgcuuccguucugcggcccgguaucaggccgaauguuuacaaaccgccgaccgcuaauaaagagguaauuaccuucauguguuugcgcagggagcucggguguguguaggacuugucgcacacuuuacagauauagggcuuguccgaggugugcacaugcaugugcuucuugcggucgcugcuguuggcaaaccgucugucacagccuucgaauucacauuugaaagguuucucaccugcaaaaggcaaaaaugcaaaauagggggagggagagaauauaguuaaacccagaaacuucucagaguggugagcgggagauugaaaaguccgguggucuuucugcagaggggaagcgcggacaguggaaggacauagcaucuguuuuccccggagggggaaaaaaaaaccauagcuuugauugagcugacugaguuggggaguggugaucuuaggcagggguagaguagggccggcccagaacccgaacauccaucccuuuguucucucaggagcagaaagcuggggggggggucgucagaaguuuacccuaaguugugcuuccacuccaaagaaccagggcucccaaugugcgggcacauaacaccaccaccucagcaguguaaccaagcuggguaggacaaugggccgggaaugggacaguccuauccguccccuucuuugugucuuuucauuugccucuuucaaauguagcgguuuugcuaagccugguagucuuacuaauuuucggaaaaagagaacacuacauaaauccggggacuacacacacuuuuacaagagaugcugagcaagccacagaaaccagugccuucucuacuuuaucuuuccuccaaagaacuaaacaaccuggaacuccaaauaaaaauaguuugacaaaaguaucagucauuuaauuaggagauaugccaaucaaguguaaaaaagaacggaaguaaccaaaguuaguuuucauuagcauuucuaugguugccuuccccgaauguguucagagagcuaagucgcuuguaagcaauauacucccaacacauucggagucucuucuuaguaacccagaaaagaacacaaaaagagguggcgccaguugguuccugggcgcgagaaggucccaauuaguuccugagaccacagcagucugcucaggaacuuagaacucggcaaaagcgccgcagguuccuggggggugagggguggagaggcugugacagcgcuugguacugaaaggucucggcggggcgccgccccucggcuuggccuccaccccucucccucucuggcuguucagucugcuugguggcagggugccccuggggagacccgcgcccaccugucugcucccccuuaccuguauggguccucuuguggaucuugagguucucagagcgggcaaaaaucuucccgcagcccgggaagggacacgggaaggguuucucgccagugugcacucggauaugguugaccaguuuguacuucgccuugaaggacuugccuucgcggggacauuccucccaauagcagacgugguuguucugcuccgggccccccacaugcuccaugguaacaugcguaaccaacucaugcauggugcugaagguccggucgcagcucuucuugggccggcucagcugagccuccucgauccacuuacaggacagcuccugcuugaugggcugccgcauguaacggaagaaggcgcccggcccguggugggccgccacguucacgcccauguucauguucauggggcuauaguuagggaacugcgcacuggccgcguagggguccgugcgcgggcuagccacggggcgguaugggucugcacggccaaauagcuccccgcgcagccccagauggaccugguuguuguccacgugcccugugggcgacgggugcccagcgcccugcucaugaagcccaggaaagagcaaguagcuaggaggcucaggaauaccagcuggagcgugaagacugcucgccgagccagcgaaaagcccgugcugcccgcccccggaggcugccucgcugagcccagaaccgcgcugacggaacagaaagucgcgcguggaguugaaagcggcggaggcagcgccgccguaggugggcaccuggcuggcgugaugguggugauggugguggugaugguggcccagggcauuggcauaaccugaacccugcggugugaacgcugagcucuggcccgaagacagaucgugagcgguggcugggcucagcuugaaggcagcggcggcagcggcggcggccgcagcguggguugaguccccgaagggauucaaucccaugccugcaggcucgcgguugggcaucucgugguggcgcggagcaccgaagcugcccacucccaacccagggaacugcgggccuccguccaggagcaucgucauagguaggguguucuggacacagaagauccggccgaagugagcaagggugcaggcgaaggagaucccugaagggccguagucggaaagggauggcggcgguugaacacugccuggagacccccuaggcgcuacccggagcugcaacuuuccuaggcugcgagagucuccugcagagggacgggagggaggaggggaagaaaaaggauuggggggagggcgaugggagaggaggagggaggagaagggaggagaaaagacucuaggacuaaaucugcuuaacaaacuaacaggagcgcacaaagaaaaauaagcaaaauaauaaguggagggcgggguuugucaauccugucccggacaccccuccucuacucaagagcgcggaaccacggggccagaggcuccucgggucccggcuuucaggagcaacugcaccaagaagcagaggcggaacguggccagagggcaggcagccugcaguaagcaggcucgaaccucacugcucgcuucgcgaguccaagccucuucaccuccagaguaauguccuuggacugauaaagucaaucacucacuccucgcacauaaaccgagcgggaggcugggcagcgcgcaccaauggggagccagcuggccugagaucaccugacccccggcccugucgcccauuggccaccgacacaaugauuggcagcgcgaagcggagaacauggcagccgcugccgggcgaccccagcugauuggguagcugcggagcgcccggcaggugaggcagccgcugcucagcgucccugaaagggauccgccggguuugcgaggcuguggggaacuggggccaggcuuccgcaagcggcgggacagagcugagccucucccuggcuuggcccugcucuaagccggcagcaagcaccccucgcacgcucuguacccgccuagacuaaagaaacucuuugacccaagaagauacuugucguugccguucccuuucgguccagaagacacugugguacccacuugggacccugcugccucaccaccuugagaacguuuuccuuccguagguaccgagaacaaauucccgcaugaguggggcaaaucuguguuccugaucagcuguggcuuucaccccacaccccauuagauuauaaacccaggccgguucaguuucuucccugccugugccccaaacuagagguagcuguccacugcccaaacuagaagaaacgauagcucauagagccuacuaacgguaauucggagucagacugugaccguguggucugugauuagcggcuguacucacugcuucucagcaacauccccuugucccgugauagaacagacaacaauacaacagccauguacaacacaaccuaagcaaauagcaggaaacacgaaugaaacacagaaagcaagcacaccuccugaaagacgcagaacauacuaaauaaaguaagcaacacaguaucaacacuaaacaaagcacagagagcauauagacacauaccagaaacaagcauagaugcuaaauuaauguguaagaacacagccuauguauacaaaacacagaguaaaaacauacuagacagugacugugcuuuucguguggcuggagcaacaagcuuugaauacucaacauucugaaaugccgaaguguuaaaaggacaacagggaauggaauuuuccuccccucuuaacaucccgggcuuugcucucuucuaugccuauccagugaagcaccuagugacucagggaagcagucagucccucaaggaauugcuuuccagggaacugugcuggaguggccucuuuacccaccacucuucccccuggugagagguuuuuuguuuuuguuuuuuuuuuuuguuguuguuguuguuuuuuguauuuuuucccccucugaacaaaaugaccagaagcaggguuauaaauccacccaugauuugugcggcaaagcacuagcaaaggguggaagaaagugagugggaagaaaagacugagagguggcugggauugucacaucccaagcagggcaaagccucuaaaagucuaugccuugaggcaggcucacagccuggccgccaucucucuguagcaaacaacaacugaucaaguucagaggcgccaggagagaccgccucaagcagcgcguuagaacugcagcuuuuccgguucugcccuccuccuaucugacugaucuggccaacaccucaccuucuaagauaguuugcggagagaaggugcuacuggcacaucuuauaguaagucaccccuucacagccaauucaccccaaucucacuccacauuuagagcccacuccccagauugcaaggugagagugcacugaugacuuuuaaauuauugcauuuaccgaaaacaagcucuuaaaaaaaaaaaaaagaaaccucucuucucccucuacagaguuucuuugcggguggaguggggaguuuuagagaaauauacaaauauacuuaaaucaugcaaaugaauuccguggagucagguuugcaaaaaagguugguuugcuuuucuuccuuuuucccuuugucuuauuuuuccuuaauuuccuucugagcaucccaguaccucuccucaccccuaccaccccaagacgucuagcugcuuaguaaaaaguuuggauccugucagcuuggagacucagggaaagcagcugucccgcuaccgcugcugcaagaguuucccggcagucccugcagauacccggauaagcgagggucuagaaggauuggaagucugagcaagcuacccggcaauggcuuggagaagaggguugguaguuggggacuagcauuccucuuuuuggggaggagucucgaacgcagggcaaggggaugcugccgccgcugaccuaccggguaccgaguguccguuuugaugcggccacauuccgauaauuaauugccuccagcacgugcucugcagucccuggaacaaaaaggcauaauucaauuagaucaucaaccgagaagugggaaggugggaagggggaggggugagucccaguuaaggggcagaccugaggcgguucagcuaggccaaaacccaggcagaggagcucuucccaaggcagccaggccccuuaggagugcaguuguucagugaggcucagggguuccagauauuucccaaaggaugagacuggggacucuaugagcagcagggcacaaggagaccauuucgaauucuguugugguugguaugggugggaguuuccauauuuggggaggggaagcccugacucuuagucgcgauggaaagcaguaugucuccaguuguagcaagucaccgcaugaaaaaaaucaaguucccugcgccucacagaacgccucacaguguuguugggcaagagaaaaguuaacuuuucucaggacuugcagcuucucucucaaguugcuuuuuuggaaggagacucugggaaagacuugcggugggggguggaccuagagcuuuggggagcugaguccaagagccagccgaguggcgacuagaaagagcaaaaacuucccccauacagaagcuagggccagagguggaaagcauucuuagucguguccccuccccucccccucucccaggugcaggaaggaaucauggcgucagacaggaccacucgaaccugggucgugguucuuauuuuccacuauaaccgaagcucccucagcaacuuuggcuuacugggguuuacauguguauuaggcagccuaaauuaaccaauaaaucucuuuuaugugucccccaguuguauguggucuggucuaaauauccacaugucugcauggauaggaaauauaauaggauccuuucccucacacugaguucaaacaguaaagggagaaaagauuauuuuuuauacccaaaucuaaagcaauaaauaaaaucagagaagccuaucauugccaaacgagcaaggcuuuugagucugagucuuuguagaaccuaucuuggaggaggaggagagagaaaaaggaccgcugugaggggcaacaggguagaacuggcuucuccauagaccccagagccucaguaggcagcacuuugcccuucuucccuuccagucgccucaaaaaaacaaaacaugugccgcacauuguguuaucaugcaguguuuuuuaaaaaauucuguagcggacacgaaaugauccuaagucagagaccuagcaauuuucuuuaaguccaagggaaacacugcggucuuuucuucuguuuuauauuuagaaaagacuugcaaucuaacacucacaacauuuuaaagacccuuuaaacccagcaagcggauuuccguucugccaaugcuuccugauuuauuucaauaaaugaaucuuugaauccaggaagggaauuauuccaagacgcugaauuuggugccccugauucuccccaauggaguacaaaguauuucucguugaaacgugucccugaaacucaccauuuuucaaagguuuuuuuguuguuguuauuuuuauuuuucugguaaaugacaauuucuuuacauaaaucuccacccucucuucagagucccagaucuuuuaaaaagaaagaaaaaaaaaaaacaagaagaagaagaaagagaaaaggggguaaacccgcaaauggcaauaaaaaaaugaaggaagaagaaaauaaggguaagaauguguuuaacucgccuuuauuuauaugcuaagauaaagcucuuaauuggccucagcggcagagcugagcggacucugggaccugcggccacacucaccaggcgcucucugagcuccagcuuuuacugacucccccaguuuucacuacagucuggucaucuggcaaauauuuuaaaaguccuaaauaccuuuaaaauuaauagagaaucaacagauagguauuguuaaucaaccuuuuccccuccuuaaaaaauuguuuugucuuuguccuaugcaguuucaagacacauugcugcucaagguaaugaaaugccaacaaggcagggcugagacucuucacugcacuugucaaucagggcuguacagauagauauauacccuugaacuucggagauccagguugcaguaaauggggcuaaacuuggagacacaaggcaggcacuuaaagcaaggcuaugaaaauccacuucagaucaagcagguaguucccgaaguccaggagacugaggaggcaguacucaugagcccagccuggugaaagguuccagauaaaugaugauccugucuccuuaggugcugucaccaaagagcuccuuuauaccuccaagagguacccaauuguuugucuccaguagccauguggcuuggaugucaaaaaggacaagucacauugaaaaagaauucccuuuuuuuuuuuuuuuuuuuuuugagaccagaaugccuuguggcagaucuagaagacaggcagagacuaccagaagagguguacaaugguacaguuuuaaaugaacuauuuuagucacuaaauaguauauuugacuuacaaguucuucuccagagacuaagugggauggacuaagagagaaggauuucaagucaaguuugcuaccauuauagaacacacacuaaugugcauuuacucugaaugccaagcuaagcuccuaaauguucaguuaguucgaaaauguagauuagcucaguucgcagaccaguaaagaagccuuagacucuugugacauauuugcucacuaauuucucugcuuugagaauaaaucuugcuccuuaagugacagaaaaugauuucuggacuacguaggguugcuaguagugacucucacuguguuuaguucuagagaacccauuuccccuauucgggccuauuccaauacuccaacauucuccucacuaugggcagaggcugcuguuuucuuggcuagcuuuucuucuguaggaguugaaagcacagauucuugaccccuuaaaauucucucagaucccagagggacuuuacacaguucaggagugacauuuuguaaaaucaaauugcacuuguuuggggguccuuuccuagugagaggauaggagguagggacuuugauauuaaaacaaagcccagggccucccuuuccucuuucuguccuaccucuaaaccagacagaaucaaggaguguuagacaaaugucugguuuggacuugaauggcaaacugugacaugcaaugccuagccuguuguguuccagugguccaggagccaagaaugguucuuaaaucaccuuuaaaggguuagagguggaaaagggaagaaaagugagaagagauuaugcuacacagacugcagguggccugaagagcuuaaaccgcuuucuauugcgccuuuuacaggaaaggucugcugaccccugggcuggggaaugacugcagucucagagaaaaagacauauucuguuagguuuuacacacaccccuuauuuucaaaaugcauuugguauuagauaugauuuuuuuccuggcaacaccucaauuauaagaaucacucuggcuuuggagaaagguuuaaaaaaaaagucagaggaacgguagccuuggagaggaaagaggggaugaggaagagaaaugaggaaaaagaguugugaauaucucaaucagugacuaggugaccucugacccugagggugguuuuauugucucucuucuuuggcuagaaauacauaguuuauugacccuuucugcgugacugaacccugaggggcaaccacagccaccaaccaaagcaaagcaugugaguccaagcugaggcagcugagcugcuugccuucaggaagccagggggaagugaccuccauucccuagacccaaggggccuuuaggaacacagaggucagugucuugcuucugcuuaacucaacucugcccuccuaggucagggcaugggguacacacacacacacacacacaccucuccuggaaucacacccuaccuuucuccccugacaaaugccuuuagccaguagacuuuuagcucuccuucccacacuuccucugucuucaagcuaugaagaugggaugagcuaggggauagcuuacuaguagacugaaugcuuaucacacuccagauccuagguccuacccccaacucugaaaauacuaaagcacaauuaccaaauaaauuacugaaaagauucgaagacauuuucaacaaucuaacuaucuaacuguuuguuuguguguguguguguguguguguguguguguauguauguguguguguguguacguacauauauauauauauauauauauauauauauauauauauauaugugugugugugugugugugugugugugugugugugugucccuuguaucuuauuuggcuauccuacuuucaggauuauaguauggauggaauaaauugucauaucaaggaacuuacuuaaguguggccuauccaugggccacaugggaaagugaguggagaaaacuuccugcauguuaggccuuuccaaaggugguaauuguggaaaagucaacuugaagcagaguggcuugaaggucuaaaaagagaugcuaugagcuuccuaauauggcucagcaugcucuuuuucuuuuaaaaccacaggagccaucagaaaagacugaugcuuucacaugggcaggaggucugaucacugucucuugcuggugccuuaucccuacccaccaaauacacugcaggcauagacagcccuugagauucagcccggagcauugucuugaccuuuuuccuaccaugccauauauaucucaagcucuuucccuauuugcuuuggcuguguugugugcucuggcucuagcaucccuuugcuccaucuuucaggacccaaguucaaugcccaccuggcccuuugcaaucuccuucucacacuuucuccugguuaucucaaauucauuaagaaggcuucgaaagcaggaaggucuaauuucagugagaaaguccuagaugucuccaagacagcuaaucaagugaaauuccugaguccagacucuguccagcccugucuucacuaccccaaugcauacaccucaguacaaacuaguugaagagggcuaaaggucaaguucuugugaggacuaagggcaacuuaauggccuuaaaguacucuggaaaaguccuuuuccaucuuaucacuuaaauauccuuucuccacuuuagaaaagaucaccaguuuuuccucucucucaucuuccugaagugccaaaaagauucucuacugucuacagaaacaaacugacuucuugguuucuauacaauuuauaaccaaugcgauauauauauguauauacauacacaggacuuugaaauuugcucccuaggaaggaggaguaucagugaccuucauggacacaguuaaacacucuaguucccauaugaucuguuaauuguaugggucucaauuauagaguaauauagaguaucuaguuuucuuuucuaacuuuuacacuacuccuuaccuaucgccaaguuguuucugcuuugaaagcaauaguuacauccagguugaaaguccugg

SEQ ID NO: 9514 - RNA, 1140 nt, Mus musculus
ugcccaggagacaaguaacuauggccuaccacagcuuccugguggagcccaucagcugccaugccuggaacaaggaccgcacacagaucgccaucugccccaacaaccaugagguacacaucuaugagaagagcggugccaaguggaacaaggugcacgagcucaaggagcacaacgggcaggugacaggcaucgacugggccccugagcauaaccgcauugugaccuguggcacagacagcaaugccuauguguggacgcugaagggccgcacguggaagcccacacuggucauccuccggaucaaucgagcugcccgcugugugcgcugggcccccagugagaacaaguucgcugugggcagcggcucccgggucauuuccaucuguuauuuugagcaggagaaugacuggugggugugcaaacacaucaaaaagcccaucagcuccacuguccucagccuggacuggcaucccaacaacgugcuccuggcagcaggcuccugugacuucaagugcaggaucuucucugccuauaucaaggagguggaagaacggccagccccuacaccguggggcuccaagaugcccuuuggggagcugauguuugaaucgagcagcagcuguggcugggugcacggugucugcuucucggccagugggagccgaguugcuugggucagccaugacagcacuguaugccugguagaugcugacaagaagauggccguggcaacccuggccucugagacauuaccacucuuggccgucaccuucaucacagaaaauagucuaguggcagcaggccacgacugcuucccggugcuguuuaccuaugacaaugcugcggugacauugagcuucgguggccggcuggauguucccaagcagagcucccagcguggcauggcagcccgagagcgcuuccagaaccuggacaagaaggccagcucugaggggggugcagccacuggggcuggccuggauucacugcacaagaacagcaucaaccaaaucucggugcucaucgggggcaaggccaagugcucacaguucugcacuacaggcauggaugguggcaugagcaucugggacgugaagagccuggagucagccuugaagaaccugaagaucaaaugaa

SEQ ID NO: 9515 - RNA, 3597 nt, Mus musculus
ggaccgggcaggcuucccgggcaagcugcgaaugcgaccagcucgagagaacgcaucaggugagagaagcccgcgaguucccgccgacuuugcgcggagcccuucggcuagccugcccuucccgccugagcugccggcccgccggccccugagcaccacuccgacggagucccccggccuuuucacgguggccgcuccagcccccggagcgccgucuccucccgccacgcuggcgcaccuccuucccgccccggcgauguacagccugcuggagacugaacucaagaaccccguggggccgcccaccccagccgcgggcaccggcguccccgcagcucccggcgcugcaggcaagaguggcgcgaacccagccggcggagcgaacgcaggcaacgggggcagcgggggcgcgaacggcggcggugguggugguggcggcgggggcagcgaccaggaccgcgucaagcgacccaugaacgcguucaugguguggucccgcgggcagcggcgcaagauggcccuggagaaccccaagaugcacaacuccgagaucagcaagcgcuugggcgccgacuggaaacugcugaccgaugcggagaagcggccguucaucgacgaggccaagcgacugcgugcggugcacaugaaggaguacccggacuacaaguaccggccccgccgcaagaccaagacgcugcucaagaaggacaaguacucgcugcccggcggccuccugcccccgggcgccgccgcagccgccgccgcugccgccgcagccgccgccgccagcagcccggugggcgugggccagcgccuggacacguacacgcacgugaacggcugggccaacggcgccuacucgcucgugcaggagcagcugggcuacgcgcagcccccgagcaugagcagcccgccgccgccacccgcgcugccucagaugcaccgcuacgacauggccggccugcaguacagccccaugaugccacccggcgcccagagcuacaugaacgccgccgccgccgcugccgccgccucgggcuacgggggcauggcgcccuccgccgcggccgccgccgccgccgccuacgggcagcagcccgccaccgcugccgccgcggccgccgccgccgccgccaugagccugggccccaugggcuccguggugaagucggagcccagcucuccgccgcccgccaucgcuucgcacucgcagcgcgcgugccucggcgaccugcgcgacaugaucagcauguaccugccaccuggcggggacgcggccgacgccgcuucuccgcucccaggcggccggcugcacggcgugcaccagcacuaccagggcgccgggacugcggucaauggaacggugccgcugacccacaucugagcuccggcccgcgcucccagcucuucgcccccaccccgccccacaccccccacguugggacgccuugcuguuuagcuuugcucgccugggaccguugccuuguaccgaagaugaggaggaccgaaaguuuggccguaacugucgggguuuuguacaaaagcgagaagucccgagcagcggaaaugggacuugcuagagccgcuggcuucugaccacugccccucccucccccucuggcugggaaucgcugugguguuugcggagaaaccgcggccccuuccucuucccggauuccuagguucuucuguugcaguugaaaaugucuuguuaguuugcuauuaaucgagaacugagugagguugcccgcccccaagaacugcaaugccuccacccccagucguauugcuucuguuuuccucuggcuuuuuuuuggggggggggugcuggccgcgccaauuggcgcgacagcuaaagccaauguuaauuuauagccaggugugcguguguuucccgccuugccgccccuggccgcgggacagcucuguccagugcgcguuuaggcuguugaguuugugauuucugcagugaucuauuugcuauuucguguacgcauuucguucgggugguggggaagggguuauuuuguuccagguuuuuucaaaguuuuguucuuaauugcuaagugagagaucaauaaauuuuauaaccaauaugcuggaguccugauaauuuugcggguccgaaauuugaagugcggguugggaauggggauagucuuaguuuuauaacugaguuugcagaccugggcgggggcgggggggggagcaugauguaaaaugauuuccuuuaagcuauuggagauccaagcuacaaccgcccccaauacucucaagugggaacuagucucaaguggagaaaaccucugucuucugggagcaccuacccagaggcagcccacgcuaccugagccgcacaccccacgcgcagucuugcacuuguugauugcgguggugagugcccgggaucgagugucugcuuccgcagcgaugcagagcgggaggcagacaccugcggcugcggaagacuuaccaaaagcugagcacuuuuaccucugugcacuggggcgggaagauacucgcugaguugaaauauuuacaaaacgaaagcccuucggaaaucucaaugaucgucuuuaaaauaaaugguuacagacgucccccuuaaggaaaugaguauuuccaccgcgguagcuaacgcgggagagugagcgcucaacaccgaaagauuggauuuuaaaaguuagaugguagaugggucagaguuguacaacuccucccaaggcuugcuuugaacuugucaaagcaguuuacuuacuuguuuucuagaaagaggcucccucucaugucgagccuagagcuugguuuuuacuucccuuuuccuacuuuacuccaucccauaaccacugaccauuccaugguaccaccccuaaggguccuucgagucguauggagccccagcguagcuguuuggagccuaggaaggaaacaaauagaacccguguuuuuaacccccuccucagcuguuugaggugauuuccuuaaucccuuuaauccuguuaccucgcuaucccagaauaacuaaacucggcuuuuccaauaagcuuggccuggugcacuguuuuuauccucauccacuccugaccacagguuucuuugcuugaggucuguugggaccauaggcgacaguccucuguaaauugguccgaauuccacguuuccagccagcuuccuuuguguggaccagccauucaccugcgggucugggcgggccccagggggaggggcggggguuucugaggcuucgggggucgugcccgcuuuuuacacaucacugcagaucccggagacuaaagccaccccgccucuccaagaaaggucgggucucccugggaagaaguuugcacagccauccccacucccgacacacacccaucccccacuguccagcaugaggugggagggggccaggguugauuuacagaugcagucccaucgcccucuucgcagggcucuuccugggccugcuguguucagacugggccucuucccuccucuccucauccuaaagcuauagaccucaagccccucuugaccgaugggagcuuccauccuuuacugcagugauuggagcaaagcggcaggcugccugguagg

SEQ ID NO: 9516 - RNA, 1686 nt, Mus musculus
uaugccauacuauccauacuucagccuugagaagguuuuccaggaugccuuugaaauauauauauugccugaugaagaacaggaagaugaagaggaagaaauggaagaggaguuggaagacauagaggaugaggaagaaauggaggaggaggaggaagaggaagaggaggaggaagaagaggaggaagaagaggaggaagaagaggaggaagaagaggaggaagaagaggaggaugacaacgaugaugaagaggaagaggaggaagaaacaggagaggaggaggaaauagcagaaguugaggaggaaguggaagagguggaaguagcaggagauguggaggaaguggaagaggaggaagaaguuguagaggaggaguacgaagaagagguugaggaggaggaaugggaaaccauugauggugauacugugucuuucacauuaucugccacauuaaaaaucucuuuacccuccuguccaucuccaccuuccaccuuuucaucccauccucugaucuggggcaaucccagugggguggaugggucuguugccuggaugaugaauauuucccaaagucaucagagcuuguacacccucaugucaugcagcaacuuggaugaagaauacagcagccaggaagaagagaguuucacuuucgcauggagaaaacuccaaaaccaaaagguuacugaacuggugaaucuuaugauccucaaauauagaauaaaggaacccaucaacaaaguagaaaugcucagaguugucacagaagucuuugagaaugaauuccccauuaucuuugaggaagcuucuaagugcuuggagaugauuuuuggcauugauauaaaggaaggugaugcaguaagcagcuccuauguccugaccaacucacugggccuuacauaugaugaugugaaaacugacagccagagacugcccagaaauggcuuccugauaguuauucugggugugauauucauagagggaaacugcgccucugaagaaagcaugugggaauuucugaauaugaugggaauauaugaugggaaggagcacuucauuuauggggagcccagggaguuccucacuggagauuuaguguaccaaaauuaccugauauaucagcagguaccugagaguuauccuccacgcuaucaguucuuaugggguccaagagccuacucugagaccaccaagaugaaaguccuugaguuuuuggccaagcuuacaaguagggccccaacuuauuucucauccuuauauagugaagcauucagagaugaggaagggagagccggaguuggccccuuggcuuaguaccaugcugauaaucaacaagaggcagccuaauaucugguuugaaagaggacaggcacaauuuucaguaaaggaggaucaaguuuagucuggguaugauuaaaacaguguggggcaacuuuguguucuguuuuuuuuuccuuucgcguacuuucuccaauuguaauuguaauuaaaauguguuacauuaucuuugcaauguaaguuuaugagugaucauaauuucuuuccugucuuaccagcuuuugagaaaauagagggaacuauucaaugguuaaucuuugaguuccuucaaucuguuuagucaacucuaaaauauguaccuagauugauuugauuaauaaaacaggaaaaugguaauaaauccuaag

SEQ ID NO: 9517 - RNA, 2048 nt, Mus musculus
caugguuguuggacuugaucucacagcccaguauggacgucugauaaugucaaguucagguuacccucccaaccaaggagcuuucagcacagagcaaagucguuauccuucacauucuguccaguauaccuuuuccaguaccagacaccagcaggaauuugcaguuccugacuacugcucuucucguauugaaguuagucaggcaucaaagcuuuuacagcagcagcagcaagagcagcuucuaagacgaccuuccuugcuuucagaauuucaccaggguucugacaggccucaagaaagaagaacugaauaugaacaguuucacacagaacccucaccgguggaucaugauucuuuggaguccgagcgcccacgucuggagccgauuucugaugcccauuuccagcguguuagugcugggguuuuaccuuuaguucacucgcugccagaaggcuugaggucgucugcagaugcuaagaaagauucagcauuuggaggcaaaaugaaguuccauccucuccuuuggcugggcaaccauguggagaugaucaaaaugccucaccuuaaaagcuuucaaaggaagaguuaauacagaguacaucaucagaaaggcucucaugggacguuuggaugauaaaguugaagaucaugguguugucaugccucauucugugggcauuaugccugguaguggcagcaccucaguugagacacggagagaugaaggagauccaucaacucaugcagggguaugcaaaccaaagcugaucaacaaaucaaacagcaggaagucuaaaucuccuauuccugggcaaagcuauuuaggaacugaaaggccaucuucugucuccucuguacauucagaaggugauuaccacaggcagacaccaggaugggcaugggaagacuggcccucuucaacagguucuacucaguuuccuuacaaccuucugaccauacggaugcucagcaauacaccaccuacacuggucgcaugcgccccaucugccaucacccaagcagcuccacaucaacagaaccacauuugggagagggaaccugcccugcuccucucagcgcaguaugagacacugucugauagugacgacugagcugugcgugggagagcucucuggcuuugguuuuuauugaagauuaaaaaaagaaauuauucugcccucccaugauuugugcccagagacgucucaggagagccagggccauggauaaggaagaaacgauggaaauuuauuuggaaaaucaaaugggaaaaaacaaacaaaaaaucugccucuaauacaggcacuucaauggauuauaacagugacggguugaaggguagaguauuuuuuaaaguggacaauuccuguucuuacaucuguuuguaaagaaaaccaugauguauuuaaaccaaucuucuguaaauagaugaccuuuuugcaguguauccccuugcuguaguaucugguguacuuaaauuuaaaucagcgaauuaacucgggagaauuuugaaaauucuuuguguaucuuuuuaaccccagccucuaaaccucacacagcccaguuccacagugcuggcugucaugggcauuguacuuuuguuuccucuaaauucagcuuucccagugauguuuaaaucuuguggaaauauuuagguuuuuaacacauaccuugucauaaagccuguaugagaucagaagacaggagcaacacaacugucauauugugaguuccagugaaggcuuggcuuucauugguagcacugaaaaaaauuacuacauggguauguuauaguucaguuuuaaaguuuaaaggcuuuuuugaggcauaccuuaauguuuaugcacacugguaauuuaaccacacccccuaaguauucuucugcauuugaugcagcccaacaaagcuucuguucugaaauaaauuuugacuauccuguccauagcuacaguacaucauuugugauauaagagucuucauuucucagguuucaaacaagaaguauacaugcuuuucuuuagauacagaauuggcagaguuaaaaagau

SEQ ID NO: 9518 - RNA, 1619 nt, Mus musculus
uagcacugcuaaucacucuuuuaaaaccuuuaaaagcaccaaauuuuaauaucuaagucaauuugggggugagaggggagaaacacuaucaggaacuucucuccagaacaaaacaaugauguucauuccuccacauguccaaauuaaaggucuacugaaaccaaaaugaaaacccaaaccccacacagagaaaaaaaauacuaaaaucacauucuagggggucagugcauucugcagucuuugcugggcugucuaauuguccuucggcugacuuuuuaaaauuaacauccuaacucaucaaaauauacauuuuucccauuggcuuuuuuaaauuaaaaauaauaauuaaaagugaaaaccacuagaaggaauucaugagcaguugccugacacauuugauggcauauacggcauauggaggucaggaagguggcucgcagcacacgucauucucaucuuuaaggcuuagcuuucuuccaaacaguguaaaacacccacaauuccaaguaugaagggacacagacaaucucuuuugagaauuccacaggacaauacagacgccccagcuguucuucauagagcgacagggcuucagucaaguugacacaguuccccugugugaaguauuuuccauccuguuucagaaccuucauugacaggucgagaaucagucugaggaaaucccauguggaaucuucuucuggagauguagagauagggacagcugucaaaucauuaaucacauaaucaaacucucucccuucuuuggcguacaucuucaguacugggauacagucuucuauaagaaccugauagcagucuccucuaagauugucuaagacaucuccacauguucuccgcauguauuucuuacauccaucaauuaccauuuggucaaucucuaccauagugaccaucuuugguuucaguuugacaauuucacacaauaugccuccaucgccgccucccagaaucaguacaucuuugccaguguagucuucuuuaccacugcccaugauggcacggguauaugccaagucacucucugccaaauuaacauccccgcugaggaugagaauauucccaaacugcuucgaguguaggauuuugauguucugauauggugaaucuucaucauacaccacuucaucuaugucauacucaaccaggcgcccaucagcaguaggccaguaucugucaauggccccuccgcgaacuaugggugguaaucgcuucacccgcccaguacugucuugacucaauucuuucauuuuuucuucuauuuuguucaaaaggcugucaguuucuuguuugccuugcacaucacugucguaacucugaagguccagcaacaccaauccauguggauaaauucgcaaauuggcaaagcugccauucuuguucguguaaguugcuaaauauccaugguccugccaggugugcacugacucugucauccccugcuccugaaaaauggacugaaggccuuucagaauggccucaccaucagcuuuggcgccgagcuugaagucgagcgugcugugucuugcugcugccauaguguggcgaggcccugugccaugccuggggaggcgaccgcaggagacugagggacccga

SEQ ID NO: 9519 - RNA, 2339 nt, Mus musculus
ugaccgugggcccgagagcgcucuugaauaaaaauccucuugcaauuugcaacaagaccguuuucucguuggugauuuuggggugucgccucuccugagucagaacgugggggaguccucacguuguggcucuuucauuuggugcguuggccgggaaacgcgaccaccccucacacccgagaaccgucuuggagguauggggauccccucuugugugugugccggccgguguaucuguuuugagugucuguuuucugaaacgaacauuggaacaugugcuuguuauguuggguuguuugugucuuguccuauguuucugaagcacggcaaagucugaguuuggauccaucugaguuuauugaauuugugucuugguuucaggguugcgagaucguggguuccagucccaccucgugcuuugguuucaggguuacgagaucguggguucgagucccaccuugugccuugguuuuacaccuggcagagugaggaacaagugugcuucucugguuuuggucgucuagguagaaguggacgacgguguuuguagacgauggggugaugggguuuucugaaaugcgcgcgucuguauuugcagcuguccuuuugggccguaaggaccggaggacuguggucggcagacgugcuaggaggaccacaggcuguggcccugggggacgcccugggagguaaggagagccagggaugccuggccgucuccggaucggucagagggaccgaguucuguugaagcggaagcuucccccuccaacaucgucuaauucuuuugccugauuguggaggacaagaaagggucgagugugucuggauuuguugguuucuguuuuauguguuuuuguguacguguuuagagcuaugugaaaaucuagagaaacaaagguaauucucauaggugcuuuauacccugacuagagauaguuuacaccugagaugugagaaaauggguuuugagaaaagcaguacucuccgacuaucuggagauaauuuaguaauaaaaaaauaaaauaaacaguauuaauuggucuuuggaacccugcaccuguaguuaggaaucuaguguggcuagagaagcccugcuaggcacugauuauaaaugcuguucuuauagggaccagcagcuucucaaaguucuaugguaagggaacagauggcuguuuuuccuacaaaaauuggauucaucaggugacaaggugcuccucucuugaaauuacagcuagaaaaaaauuaagaauuuuguuugguuuaaaugggcaaauguauauggccauuucauuuuuguuucuaaauaguuucaaaaguauaaauauguuuuauaugucuugguuauagauuaguggcucauaaguuauugguuaugauuaaaaauuuguaacauugguaacaaaaaguugacuuaaaacugguaacucuggguuagaguaauuuagaacuacaacaugcagcaugagaaaacccaugggaacaggucucuaaagauacgccugaauuggguaauauucuguguaauucuuauccuagaaaucugauuuauaaaagauaagauuuaggguagugucuuugagauauauuggcggcuacaccuucuuguguuugugugcaggaacggacagccaaacuuuguagcaaguaauguuuuuagaguucauuuuuaaagaaaauagauuguuuacacuguuaaaauuggguuuugcuucucaaaauugugguugugcucucauguuacaagagaaauugaaggcuucuccuaaauuggagccaccagcuaaaucggcuccucuaaaaucuauaaagccuccugaguggccuaguccacaaccuucccuuuauccacagccucgaccccagccgccgagggaaccccaaaccccucggggcguugagaggcggaccgcugugaguacauggagccacagcgacccacagagcagaguccgggcggacucugguggacccgcccaaacuuuaaacccuucaguacuggucauuuuccucugcugguauuuauaacuggaaaacuaaccacccccuuucucaggauccccaacgccucacaggguuggcggaguuccuuauguucucucaucagccuacuugggauuacugucaacagcgguuacagaugcuuuuaacaaccgaagagcaagagagaauucuguuagaggcuagaaaaauagccugggagccaacgggcggucuacacagcuacaaaaugagaucgacaugggauucccuuugacucgccccaguugaaacugcaacauggcuaaagguagggagagcuuaaaaaucuaucaccaggcuccggucuccaaggugcc

SEQ ID NO: 9520 - RNA, 7130 nt, Mus musculus
uucacagcugacugauugcaguuuguuuuuccagaacuucgagguagucugguuccgauugcgguuuagcuugcaguaaaggguggucuggcuuugacugccccacaaagcauuuucugggagucccauauaaaacgguuuuauugauucugucuugguuuuggcgucgagauucauaugaaggggcaaacugccuuuuagguaagguacaaaaguuauaguggacuaggccugcacugggaaguucuuuaacucgcucagcaauauucugauacagcagcucaggcucucuugguguggccuguuuuucuagcaacucaguggcacuuauuguguaagcaaguguggcagguucuucuuuuuuuuccuccagguugccauagcugaaguccugcagauuucgguaauaggccacugggucuccuuccuucugcauguagaugggguuuuggcacaucugacccacagguggaggaauguaguuauagacguggccaucagcuuuaucauuagucucgguguuguaagacccauauuguaacuggaaggaacuuacaucuaaguugguggcauuccugggaacauuuggcacucccuuucgacgcuucagaacaaagacgaacaaccccgccccaaaacagacagacaggauaaaaaccacaagcaauccuaaaauuaaaacggagaguggaacuucaguguguaguucgggguaagaacuaggagacacacuaagugaucuaggugugucuguguugugauucauugacaaaauagucccaucugacagguuaggauuuucuggacaaauagccucccuucccaggaauuucaguaucuccccugcaugcuuagcgggagacucacaagucaccucauugaugaugacaggagaauuggcauguucgguccaguccuuuagccccaugaugucacaggugcagucccauggguucucuugcagaucuaucuggauaaaagcaggaagcugguccaggaccccuuucacaggcaggugagaaaaaugauuguuucucagauucagccuggugagggcugugcccccaaauauauuaucagguaaggaccucagcagguuguuauucagaaacaggagcuggagguuaaucaaagcaucaaaggucagaggcuuaauuuccuuaaugacauuauacucuaaauagagauacugcaagcucugcaguccaucaaacauagaaggauacagcacuucaagguaauugccauucagauaaagucuucguaaacuggucagguuuguaaaggcaccuuccugaaugacugcaauccuguuguuuccuaaaugcaacaaauccagugaacuguauucuaagaggucauucuuauagacuguuuggagauaguucccuguuagguagaguuucuuuggacugguagguuugggcuguaggucagagauguuagugaacuuccuuucuuggcaauucacauuuagaccauugucugagcucugagaaguacagacacagcugcugggacaggugagggccacgggggacuuggucugguacaccaugaucgggccaaagcucugccggucuuuugacacagucacucgaggagucggacgauuucucauuuuggguggccggcuggcuuuuggagcucugguuggguugagagcaggauuuguuguaggggucagccuuugaacaugugugucugaauggcugcuccucugacuagaaucaccacuugcacuuuuucugggacagaggucuugucuggucagcugggucacaucuuucccauguaaccugaaagggguuucacagacaaucucccccacaaaaacaguaaugguguccagccaugccuugagaggaaguaagucacaggugcaauuccacggguuuucuuccagcugaauuuccaugauuccuccaauauguucaaggacaccagcaaaaggcauuacuuucaaccuguucccccucaggucuaagugagucagcaggacaaaccgaaacacauuacugggcaaagacagcaaaagguugucauucaggaugaguacuuucagcuuauucaguuugcugaaugccccugccucgauggugcugauguaauuguagucagcuuggagguacuccagacucucuaggccuagaaaaguguccucucgcaauaccuccaguuuguuguuauugaggugcagucuuuugagaguuuucagaccacuaaaugccccaggucggaucuccugcagcccauuguuaccuagaugaagagucaccgcauuugaauaauugacaaacucauuuggauacagucuggucaagagguuuccguugagaaacagcugauagaugcgauacuggggggguugaagcaaacugacaguuguaaauccuuuguuuucacaguuaauauucaguacguuuuccuucucuucgcacaagcagcggaucuugcaaaugucuuuggcaguuuugcgacucucggucuguaagaucccggccacuguuaacacacugaggaaccaaacgccgcucagcaucuuuaagcaccuucgaugucagcucagguacuuacaggcaaaccuugauugagggacgggggagaaagcgggaugcagggaaaaaagaaacaaggaagcccgauuaaaauggcaaagcuaggaggcaggcgggugggagggagggagagugaggggguaggcagcaaggaagaaugaaaucauugcguauuucaaagcaguuucuuuucuuucucucuacccacuacccccagcccacccacacaacgcauccuggaacacacaugcuugcaccugauuucccugcgggucacagccagccacggagucauuaguaaucgaguuguccuacuaaauccggcccaucuccuccuccccugggguauuuugaagaaaucucaaguggauugcccgucuugggcuugcaguagaaauugcuuuacuuuuuuuuuuuuuaaacugcacaaaaaagggguggaaaaauuaagagucagggagcuggcggaggggacagaaugagagugcagagaaagcucuggcuggggguuacucacacaucaggagaagacggggcuccucuccucuucaguccaccaguaguuuagcaucuucaggaagagaaagagagcaaaguaaaagaagaugccgcuugcagugggggaagcuuugcuuuuuuuguugcuugaauuaauuugauugggcagggggguggggugcgcagaaauuagaaauccggcuggcggccagagaggaagaggaggauuggaacagaaagaagcugcgcuguggggaaccagggaugcgauuacauagggaggucuuucggacugggucacugcgggcggcugccacagcggcgccugggcgcgcgcuuucaauccaguggcagcagcagcagugcgucuagcaguuugaauuugagagguuuugcaggcuccucgggacaggacuaggggugacgucacggaggagaggagugugggcaguguauccagggcgcuuggugggggaggguggggcagacgcuucccuucccugugagugaaagcuuugcacagcucaauucccagcugcgucaguugcuucagaauuacucuaucuccagcccggcuggcugcaagagaagcuccuucugaacaggaguuuuguuucucaagcaggcggcccagcccccuuugguucuggccucagcgaaacuccccaaauccagaccaguucuagugaucuccuucacuugaccucccucaccuacacauggcauaaggacagugacuuggccauuaagacucaucucauggcagacucccaaggagggguccagagccucccaggaacuuuguguguguguguguguguguguguguguguguguguguguguguguguguaggacugaugccagcuaggcagacugcuagcugggaagacucuuuaggugcagagugggguguuccugcgcuagugugucugugugggagugagaagaguucuccuaggggaucaauacuuuauauacggagaaagcucuguuucagugcuuagggaauuacuuccuuggugaugaccagccaaacagcuauuugccuggacucuggaaagccagcucaaacaguaacugguagacugagccaaacaaaaauaaaaugcuucucccccugagauuuauacuuagccagauaaugagucuuaaacgugugcuuuuuugccuggaggaaagugaaguggagugggugucagaaaagcauugccaggcugaggcucugcuaggagugggagccaaggcaagaguuguugagcccucuaggcugcaagggcugggauccucuccccaccccccaacccuccccccccccaaaaaaaaaaaaaaacagggaagaaugcagggcaggagaaaugacuccuccuaaagaaaaggguacuaggaaucuugagcugagacacagaauaccaggguucuugaucuaacucugcagccaugccugucacuacuuuuaggagcuuacuguuuccauuugcuaaugccaaaggagugcugauccucugggcccugauguugcauuugguuucacauaaccuuucuagagcaucacuaauuggcuagguguuggauuuuugccugcauuaucucuuuucuacuuaauauauuauuacuccuuggguccaggagucucaagaggggagcccauuugcaugugugaauaaugucuacuguugcuuggaggagcuacaggccaccucugauagaaagagagaagugaggaaaaccgagggaaagacacagugaagaaagggacugauuaaaugugccugcugcacaaacaauucaccuuccucuccucuuuagaucugcuacagaauuuaugcaggauuucauugccuagccaaaauggaagguaggcaaugccccaggcaaaauaagccauucaugaaugggaaaccacccguuuuauccuguuucucucccuguuaaagcagaaaucuuugaccuguguagcuuauacaaauuccuuccucucuaauaaagauuggggcagucuauaaaguuuggcacuaaggccaccuguggcauugugaucuuccuuccugcuccuuucaagaaaagccuuugaccauacuucuggauucccucucaugcugccauuucagacuggagccuuaauuguccuucucugggccauagagugaccgaccaugagacaagcacagaagcccugggaguugggagggcagugguggauagccucccauucgacugcacgugcaucauuaugugcaggcugaguaauauguccugagcaaaaguucacuucuuucauaaggaaagggcacuuucuauguauuucuaaauauuaaaaguacauuguuccuagggagauaugauuuauucacucgggcuuuaguuuaacaaacacuugcuaauuagguuaucuuacugaaguaaaauccacugugacagcuguacaaaacccaacagaccggaauuauuuuacagaucaggacauuccucagccaggugacuugcugacuugguuaacuucaagaagcuaaaauuagaaacaacacaguacugcuuaauaugaauuagaggauuguauaccuaaacucaguggggcauuucacacaauuguaaaguuuuuacugcuaaaauaaauauaauuacuauuaguucucaaauacaguaaaauauucaaggcauagauaauucugugcacacucucuggagaccagaauugguuugcuagaaaggaaagagaaagauagaagagggggagaaggagaagagaggagagaggaagaggaaagaagagaaaauaagagaugaaaggagaggagacaggaaggaaggugaggggaagaaaaggaagaggagaggagagauagggaauuuggaggucuugaaauuguuaccacuuacacaaugaagcaaaccuggugguaaugaugagcccuaccaaggucccugaguuccaguuuuucauuccaugauuuccuuucugcaagagucaauuugcucagccacucuauuuucugccugcuuuugagcauccacagacccuuuucagaaacaugacuguuauuuggaagcaaauaagccucacauucgacaaacacuuuuaaguaaguuucauuugguccaggguaucucuaagaacggcugaaaagagugagcuuuuaagaagcuggaaagguucagggugaacugggaacucaagaguagcaggggcagaugcuuaaauaagcaaaauguuuguucuucuuaagaagagggaaguugacaugcauauucuauugcccaggccuucuuugucacuaaccagccaguuugcccaagcuuuuuccacaagucaugaagggggccaggcugcaacucagagcccaacuucauuccugcaguucuuaggccauagccaggucagaagucuagcaggcccgcuucagccugcugggugcuccaggcuaaucucucuucuagggagacacaggcucuaagggaguucccucuuugaaugggucaggacuaaccgccaacccuagaguagccccaccuuuccuacaccuuaaaggcuaacaucuugaugcuagaggaugaccucucaaucccaaaagccacucugcccuugccguugggcuuggacacugccagugaaugguucauuucacuagcagaagaucuugcaugggucauuccuggcaguagcaguggucuccuagcuuugggauuccuggaucccuaucacagccuuggaaggucaggggcaaaaaggagagagccccgaggguaccgaggggagagggcgauucacaagggcugacugaucacgguggguauagucuagccucucccugcucauacccacuuugaggccaaagaaacccggcucgugggucucauugccacggcauucccgaguauuccgaacuuacccagagagagcgcuccgccucgaucuuccccuggaggcucccgcagcauccgcgucucugagaggcucagaagccagcaccuccuagguaccagucgggcgggccgugcagugaguggcacagcagcgaggagcgcaggcgguauccccccacccacccaccccaggguaggaagauccuuacu

SEQ ID NO: 9521 - RNA, 1296 nt, Mus musculus
uacugaguucaucaguccuaacagaagcgcagccagcaugucugauaaacugccauacaaagccgcggacaucggacuugcugccuagggacugaaggcccuggacauagcugagaaugagaugccaggauugaugcgcaugcgggagauguacucagccuccaagccacugaauggugcucgcauugcuggcugccugcacaugaccguggagacugcuguucucauugagacucucguggcccugggugcugaggugaggugguccagcugcaacaucuucucuacucaggaccauucaguggcugccauugccaaggcuggcauuccaguguuugccuggaagggcgaggcagaugaggaguaccuguggugcauugggcagacuucaaggauggaccccucaacaugauucuggaugacggugucgaccuuacuaaccucauccacaccaaauacccacagcuucugucaggcauccgaguuaucucugaggagaccacgacugggguccacaaccucuacaagaugaugcccaaugggauacugaaggugccuaccaucaaugucaacgauucugucaccaagagcacguuugacaaccucuauggcugccaggagucccucauagauggcaucaaacgggccacagaugugaugauugagggcaagauggcgguggugacaggcuauggugauaugagcaagggcugugcccaggcccugagggguuugggggcccaagucaucaucaccacgaucgaccccaucacugcacuacaagcugccauggagggcuaugagguaaccaccauggacgaagccuguaaggagggcaacaucuuugucaccaccacaggcuguguggauaucauccuuggccggcacuuucagcagaugaaggaugacaccauuguuuguaacauuggacacuucguuguggagauugaugugaagugacucagugagaacaccauggagaaggugaacaucaagccccagguggaccgcuacuggcuaaagaaugggcaccacaucaucuugcuggcugaaggcuguauggucaaccuggguugugccaugggacaccccagcuucgugaugagcaacuccuucaugaaccuggugauggcacagacugagcugugaacucacccaagaagauggaugaggcggugacugaagcccaccugggcaagcugaaugugaaacugaccaagcucacugagaagcaggcccaguaccugggcaugcccaucaacggccccuucaagccugaucaccaccaccacugag

SEQ ID NO: 9522 - RNA, 1296 nt, Mus musculus
cucaguggugguggugaucaggcuugaaggggccguugaugggcaugcccagguacugggccugcuucucagugagcuuggucaguuucacauucagcuugcccaggugggcuucagucaccgccucauccaucuucuugggugaguucacagcucagucugugccaucaccagguucaugaaggaguugcucaucacgaagcuggggugucccauggcacaacccagguugaccauacagccuucagccagcaagaugauguggugcccauucuuuagccaguagcgguccaccuggggcuugauguucaccuucuccaugguguucucacugagucacuucacaucaaucuccacaacgaaguguccaauguuacaaacaauggugucauccuucaucugcugaaagugccggccaaggaugauauccacacagccugugguggugacaaagauguugcccuccuuacaggcuucguccauggugguuaccucauagcccuccauggcagcuuguagugcagugauggggucgaucguggugaugaugacuugggcccccaaaccccucagggccugggcacagcccuugcucauaucaccauagccugucaccaccgccaucuugcccucaaucaucacaucuguggcccguuugaugccaucuaugagggacuccuggcagccauagagguugucaaacgugcucuuggugacagaaucguugacauugaugguaggcaccuucaguaucccauugggcaucaucuuguagagguuguggaccccagucguggucuccucagagauaacucggaugccugacagaagcuguggguauuugguguggaugagguuaguaaggucgacaccgucauccagaaucauguugagggguccauccuugaagucugcccaaugcaccacagguacuccucaucugccucgcccuuccaggcaaacacuggaaugccagccuuggcaauggcagccacugaaugguccugaguagagaagauguugcagcuggaccaccucaccucagcacccagggccacgagagucucaaugagaacagcagucuccacggucaugugcaggcagccagcaaugcgagcaccauucaguggcuuggaggcugaguacaucucccgcaugcgcaucaauccuggcaucucauucucagcuauguccagggccuucagucccuaggcagcaaguccgauguccgcggcuuuguauggcaguuuaucagacaugcuggcugcgcuucuguuaggacugaugaacucagua

SEQ ID NO: 9523 - RNA, 39425 nt, Mus musculus
cguuugacuguuuacaggaggcgcagcggagcccuuggccucagucagucaggcgcuggggagcguuucgguuucacuuccggugaggggccgcgccugagagggcgggcagugaagcaaacggacggcgagcgcgggcgguggcagugacggcggcgccgcugccggggggcgugcgguaacgcggcggcggcggcggcggcgacggcggcugggccucaagcgccugcagcccaccucccggaggcgggcucccggcgcgaggacggacgagaagauggaggagcuggugguggaagugcggggcuccaauggcgcuuucuacaagguaaccggcuaccggacaggcccgguccucggccucccucccucccucguguccaggguggcgggcgggccccucgggcgcggcgggagcggcgggcugugggaugugagggagcggcggagucggggccuagagcccgccucagcguuccgacucccgccugaggccccggcgccuggcggaacgcgcggguugccgagggcgguugagcggccgaguuugucagcgaagcgggaaugcgaggacaggggauccgaucggccauggggccggugccgcgggaaguggcggcagcggcuuaguccagcuuucccaaauaauccucucccaguggguucggggccugacacgcggggagccgugcgggaaccgggggcgcuucagcccggccgccgccagcccugcuggacgaacggccguuacgaggcuugggcggccguuaggagguuugggcuccgcguucggcccacaguccagacuuuggagagcuccccgguucugggcgaggggugugcagggaguaguaagaagcgggcggcagcucggaaucacaauggcaacugcucuugaguggccucuuugugaauuuccaaggaggguuuuagaucuaaaaguuucggaaagaccaugacaucugagagagcgguuucaaacgcuagccagagccgguauauccacggccuccgaggcucuuucuaacugggagcaauucagggauaagcaugucgcggcuucuaaaaauauuaccaagucugcuuauuuuaaauuucccuuuguguuuaaguucucgaggacccgaauuugugccacagaacuucaggaaauuaacggggacuguacgauugcuacugaauuuuuaccaggacgguuuggaauguuuguucugugcgcugaagugcauaaacuugaguauauucgcuuugaguuuugcgguguuacagugagcuauauuugagguuuuaaaugggcauucauggaacuacugagaguuuuuuuauaccauugaauaucaaguaacaucguauauuuuucaaggaacuuuaaacuuaaguauugugugauuuuuuuuugauacugcauaaauguagaucuagcaauauuauaaauucuccuuuugugaauguuuauaagcucucuaaggccccaccucacuagaauauuuuaguaacagaaggugcacguggaaggaagcauggaaaauagcuuuugccauuguccaauaguuuuaaguuuauuauagaauaacuuggacauuucaagugggacauacuaagcuaaacucgggaaagugacuuuaguaaauuaugcuuuugccaaguuuauggagacauuuaguggaagauaaaauucucgaaucaaggaaauuuguaaaauacuaauuuauacuaaaaauacccuuuuguuguaauauaggagacagaaagaacacaacauuuauguuacuaauuuuaccagugcaguuauuuuucaauuugcuguaauaaaaaaaauguuccgguuaguuuugguuaguuugcauuagaagguuucuagguucuagaaugacaguuuuaguugcuagaguuggggcacugagacacagaugagcaagggauaauaguuaaguaguauuuuuguucaucucuaauaacagcuuagauuugaguccgcuguuaguggcuuuuaaugaaguuggcuugccauugagggcaaguaccacauccuacucuugaaggauuuauuggccccaguaauuuuccuugaaaacugacuggaauauauuuuuuuaaagugcucuguuuccacuauuaauccccuugcuuuuuuucuuggcuuuguauuccaacaacuucuugauuugaaggugaacaaaaaaggaauagguuaugaauuauccuuugauucccugaggggacauguagugcuuuuuaaaaauguauauugaaaaauugcuauuguguuuaaguuugguuuugguguuguuuguuuguuuguuucaacuggucuauauaaagggaaggguacugacuauccugaaagagguucaaauuuuacaacacuuagaauauugacugugaacaggaaaaauaaaguggaagcaugcugagucguuuucuggugaaauugauuacaaaaaaugagagguaaagaccauuauggaaaaacugggguccuuguucauuaaauugguagaaauaaaaauuuaaagugaaguaagucaaauucaauauaauugaauucagucuuugauuugcuuacuagaacuacuguauugugaaggauaguuguacaucuccugagaacauuaaguuagcagaauaacuauauagaacacauauuagcagugauuugauucuuucucugaggaucacuaaaaugaagauuucaaaaucacaaaucaugcuacuagcaugauaacagccaaccaguucuaauuuggaucuuuuucuuuugguguuuaauuuuuaaaacuauuagguuuauuugugacuaugugagggugaguggaugcuuauuugcaucccaugccacacuugucaagaggacagauuucaggaguugucugucuccaccauguggcuacuggggauggaucucaggucugcaagccuuuaccugcugagccaucucaagauguggcucuuuuuugguguuuauuuuuuaagauuugacccugcgugguggugcaaaccgggagugguggugcacgccuuuaaucccagcacucgggaggcagaggcaggcggauuucugaguucgaggccagccuggucuacaaagugagugccaggacagccagggcuacacagagaaacccugucucgaaaaacaaaaacaaacaaacaaaaaaagauuugaaacuuagacucagcacucaccagaauuucuaguuuuaagcuuuguuuuuuucuuuaaccuggaaaaaguuggucacacguacuaguuuuuaagcccuucagacauguuauauuuaaaaucugaagaaacuuugauuuguaucucacaugaucuuuaaaaagccaguaauguugcaaaacacugcuauacaucuuuauucaaggugcaucugccccauguaguuuuuuuguguauuacaguuuggguauguugagaaugauaaugcauuaaauucauuuugauauagaauguaugcuguucagaugugagaauacuacauaugcaaagauuucuagguuuuauauucuaguaucaaaauuaguaaaccauauuagagacguauacaaaacguuuaaauuucaaacuauaauggcuaauaucuaauuauuauguguaaugaugcaaauucacaaauauauuaucaucuuaauuuuaagcucagcaucugagaauagacucccacuagcugaauauuguugccauauauagugguuuauuaauacacaauaauauacagucaagacauuuuuuaaugccagguuugguagaucucaccuauaauccuagcaccugggaggcagagacuaauggauuucugaguuccaugccagacagggcuacauagugaaacccuacuuugggggugggggcuuacaaaguauuuaguacccaaccuauauaucauuuuagcuacauuggcuuguagaaguaaauguuuuaccauaaacuuucacagguuuagaaauuuauaagccuacauaaaauuuaaaugaacucacauucauaguuuucucugaaauccagcaaucuugaaguaugaguguuaauuuacauguuaaagagaugaauuauguaaauuaccauauuuuagccucccaaaucaaagcacccuuuguaagauuuagugucuuugugaauguaacaccccaccuuagaaaugugcaauuccaguucuauacucauguauucugauaaccucaaaauuacuaauuuugugcaaaauuuugugcaguguaguacuugggaguucagauucuggccugcucugggagauguuugggaucaugguuaugguaauaguuaccaaguggggagucuuaggcacuacuuugccucuauuaacuuccucccacuguuuuaauuuauauaagggauauagauauauagggagaugaaauaaauaauuacuaauguuugucagggugcuaaaaguuuuggaucugggauuugaaaucagacuugauaaugaaaugauaaaauuuagcuugaagaaguaaaguagauuacauuuguugcucacuuuucaauuucauuauaaucuuugcucauauuuguacagugacauugccuuagcaucccauaacuacaauuguuguauaaucuuuuuuaacuguagacacaaagaugucaguaaucuccaguuuauguauccauauucuuuuuuuauuaaccuucuggcuugaaauauuuucccauaaauucuuaguaaggaaagauaagguuacucugcuguaaagcuugcuuuuguuaguuacccuaggagcuuacuaaaccugaaaaacuguaacuuauaugaacaguauauaaacaucaggaaaacaagucaguggaugcuguuuucuuuguaccuguugucuuuaguuagagugaaucauuuuucuuagaauuuauggaagaacuguuguuguuuuacaaaguggggagaauaaagauucaauguauauaugaagccuuggguuugaauuauacaucuuauauggcccuauaauuuaucucuaggaggaaaguuuuuacuuauuuuauguguaugaguguuuuaccuacauguaugucugugcaccaaggaagugauagaaaaggguaucagaucuccuugggauacagaugguugugagcuggaauguagguacuagguuuucuaaccccuaguuugauaucuuaaaacuuaagauaugugaagaagucaugauaggggaauaaaaguuuacccaaauaggacuggacucuuuguccuuuguguacugcuuuaauaaagcaguguuugcauuagauaguuuugguuuuuauauauccucaggacuaugacuugguccaauuguaauuaaaugaagggaugcuaugaugacuuaaaacuucuguuuuuccccuggugaacaaccuuaguguguuuuggucacugcuuuuuuuuuuuuuuuugcuuuuuuuuuuaaucacuucuuucaaacccuaaagcuuuuuuuuuuuccuuucuagagugaaaguaaccauuauuauuuaguaauuuuguaggacuaucccuuucuuguucuaucuuacuuuuuaagccuuuauuugaccauuaagacuuucauuuacuuuccuaaauagcagucuuuggaucugucaugauuaugaguggguaagucucuucucuccuuaggaaaacauuagcacuauugagugacugacauccuguggagaacuguaaucuuuagucaugcccuuaagaacuucugguuugauagccccauuaaagccuuuuuuaaaguauagagggaguacuuaacauucugaaaugcaaaggcauuuauaguucuguaucuuuuaugaaaauuacauauguauauuuacguuacaacuuuaaaaggcuagucucuagguccuuaguuuaaaaaugaggaggaaucugagguucccaaauccugcagcuauuauaugauagagccaagauuuuagagccuauauuuaauucauaacaaaacucaaccucuaaguucucugaucccauuaauagcccuacaugucagauccagugaagcucuuugggcauucaucuaaucugccuuugaauauaucacagaaaucuucucagccuguuguuuuuacaucaacuuagcaugauaggaaagaauuacagcaaaaugagguuuuucaaguugguaggugaggugcuagcucucuagaggaaccuugugaaugaguuaagagagagucggagaguuuuuaaaaagcauuauuggaaaaaguaugaugagaacacauagaaagauaugaaaccuguggggaagguuuacuaaaagacuuuagaacugacaggaugucuuguccuauccuuaguaugugugcggggcagaguccacagaugagauucuuuuauuuacuuaguaaagcaguaaccagaagguauuaaaugcauucuauaucaguuacuaugcaaacagugacuaaaaugacugauuuugaaacaaucaugcaaauaucuauacauagauaagccucauuaacucagaggcaguggcucuguuggaugugaugauuacucaaacuauuucugacacuuuucauccaaaauuauauucuaggacugugaaaacauuucuuuuugccucuuauuuuuuggcuguuuugcuuucugucucugucucucucucucucucucucuuuauaccauuuacagcucuccuuugaaagggaacacuucauuuuuaagaaauaggcaaauguauugaaugcauaugauuaagcuagauaauaauucaggcaaguagggggaaauaagaauacagcuauaaagucauaagacuaaggcugauuuuuaugguuaguuugaaaacucuuaauguuguaaauguuuuaaaucaauaggauaugcuacaaaccccacugaucuacccauaguucuugaucccucaaaauguggaaggugaaugggugacugaauuuaauuguaguuaauuuuaauguaaauagccauaggucacuucugguuaccacagacaaugcaaacagcaaagaccagcuuuggaaagacuuugcuuuacaaaggacaauuuucuacccagcuguaccaaaguucaguuugcugacuaaagaguuuaacuuuuucagcauauaauguacuauaaagaacuagugcugugcucuuaugcucuugccucuuuuuugccucuuucccccuugcuccccaaccccucccccccuccacauggccagggccugccucugcuucucuccucucugccuuucucugccucuaucacccucuuaacuccccuccccauacccuaaauaaacucuauacuaaaaaaaaaaaaaaaaaaaaaaaaggaaagaagaacuagugcuguuauguauguuguugugcugcugccaaggcauacaaacaucauacaacuuucaaagaggaugaagacagaaguaguuaccuuuuccuuuucuuagucuugauuuuaguuggcagucuaauaaucucccccagaaauacauuauuaacuugguauuagcuacugucugaggacaaagaacaccuuccccuucuccauaaauuuguuuuauaguauauaaaaccaagauccugagugaacaguucucacaacuuuuuauucaaaaucaggaauauuuguuguugaauaggacaaacaaucccuuagcacacuggacgcaugauacauacuugcuuaugaaauagggcauauucuaaaguaucagaauaauauuaaaccagaguuguucaaauauacuguaaaauuuuuaaugauuuaaauauauauuuaaauauaaauaaauauuuuuaaugauuuaaauauaucugagaaauaagcaacaucaaguggaugggaaagaaaauuuggguucaucaucauuuaaaccuguaaauauaaagauauaaauauaguacuugcuccuuguacuaaugacuucauaguccauauuccugcuauuugugaagucuccauuguauuguuggcuucacaacaucauuuaggggcuccaauagggauuuuaucccugauacacauaucacuugccuggccuccaauauuucuuuugcaauuugggugggacuuuccauaauuuuuauuauacauauaaaagcuggugaaucaccaaggugugcuaccaaugccauauugcugaaaugaauccuggggaaauaacuuugucacuaguuugagcagaguuucucuggugcugcugccuucucaaaggaacauuuauugcuugaguuguagagauaagagauauucauccaaacagacacaccccuaacacaugcacacauauauacaucauggguuuaaaauucuauucuuuguucugucucagcuuucuuauuguuuuguuuuguuuuuuuuugaaacaaucucaagcuguuuuuuguugucuguuuuuacucuugcuucuccauccuccaacuaguuguuggcuaguucauccuuacacuuuaagggucaguagaaacuucaccuuuccaguaugucuucccuuuucaaaguaacagcacuaccaaaaaaccagaccuuacaccaggucuagaagagaagcaucuuaggcagcaguccacuuaguagauguucauugaauucauucuaaguauuuccaagauaaucaugcauauacuauauuuaacuuaguuguaguuucuaccugaauugaaaccuaaaaagcaaauagaagauaguuaagugaaaagagggaaaggacaauagagcacuuauggauaaguuacaggcuuaucuuuacugcuaggcaugugguucuagaauaaguuucuuaauuuuuaauaauguagcuuaaagcguaccucuuacuucauauucaacacugaauuuuaauggccaguguaacuaucucuuugagauguuaaacucuuaagauaauuuuuucuuauuuaguauuguaauuauuuguauucuuaaagccuaauauauaguaccuagcaaaauagauauggugaagaagggggcauuagaaacggauuuucaaucaaagauccauuuuauucucuuuuuuuuuccauuuuuuauuagguauuuagcucauuuacauuuccaaugcuauaccaaaaguuccccauacccacccacccccacuccccuacccacccacucccccuuuuuggcccuggcguuccccuguacuggggcauauaaaguuugcguguccaacgggccaucuuuugauacauaugcagcuagagucaagagcuccgggguacugguuaguucauauuguuguuccaccuauaggguugcagaucccuuuagcuccuuggguacuuucucuagguccuccauugggaacccugugauccauccaauagcugacugugagcauccacuucuguguuugcuaggucccgucauagucucacaagagacagcuacaucuggguccuuucaguaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccacuucuaaggaggggcauaguguccacacuucagucuucauuuuucuugaguuccauguguuuaggaaauuguaucuuauaucuuggguauccuaggauuugggcuaauauccacuuaucagugaguacauauugugugaguuccuuaaauucuuaaauaucucuaaaauuuaauuucauuggucuucaagcuuaaaaguuaauuuguugugguuuuuucuugcaggcauuuguaaaagauguccaugaagauucuauaacaguugcuuuugaaaacaaguaaguuucuuacuauauaaucuuaauguugaagauuuuuaauguuuuaugcucauuuuuuucuucauuuuuuaaauugaagucugauuuuaguggguuuuuuuuuccuauuaugaaacaaaguucccagagagcucaggauuaaaucaauggaaggcccucuuuugcuaaugauugaccuuagagguccuuacuauauaaucuugauccuuaaguccauuugauuaugaaaacaaaagauccauucgucucaaugaacuaaaaguuuuaaauaguuuguaauuuuauuaaaaguugaaaauaugggaauuuauggauguuuacaauaaaaaugauuauagguuuuuauacugauuuuuaauuauaugguuuauuuuaucagaagaaauuauguguccucauuagguuauuuuuauuuuuuucauauauuuuuaaucaauaauuaugacaguuaaucuuuacugcuuuuuguucuagaucauaaaacaguacuuaaauaucuagaaauaugagcuguaugaaaaagucaauaguauagauauuaucauuucauugggggaaaaauucuagucacuaaauucauuaaguauuaauaaagaccauuuucagguagccauuugagacucugaaguacauauguuuaguauugguauuaggauuuuuacuaaacuuugguaagugacaguuacaacauuuaguuuuucucuaccauaauaauaguacauccaaggcagucugaaaaucuguagauuaaaaaaaaguaguauagugauugcuuagacuuguuaggaauguguaagaaagguuauaacuaaagcauaaaauacuuccuguuguggagauaaaaacauacuauaauucacuaacaauaauuguauauuauaugacaacacacuauacacuauugaauuugugaauuaugugguuuauuaauuauaucuuaguaaauuucccaaacugcagucuguggcacagaguuacuaaggacuaaaaacaaauaccuugguucuaaaauauuaagaauagaccugcaauucacugucuagaaaaaucuaaaguuagaccguaagcuuagauucuuuaagcuaucaauaagacaaaguaguaaccuuugaugccugauacacauuuagaaagauacagaugaaaguacuaacagaauauuaagcccucuuccaugcuccagacuaauaauguuaguuuacaaguuuaaauaauagaauaucuuuaccugaauguauaaagacaaaaguuccauaauugccuuuuuacaucauuaaacaauagacaacuauaauaucgcgucucuauuuaaggucucauggguaacuaaggggauaaucuuuuuuguauuuaaacuauuauuuuuacuuuaauuauguuucugaauguauaucuuuguaugguaugugcaacaagagugcagauguuaauggaggcuagaagcaucaacucuggagcuggaguuagagucaguuauaaguugcccaacaaggaggcuaagaacaaauuaagguucgcuguaggcguuauuuaauggcuaagccaugcuucuagcuucguugcaauuauacuuuuaucuuuuuauuuccuucacuaguaaaacacuguuuuuaaaaauggccauuugauucucuacucguaguucugaacuguaaacucuuaagcagaaucuuuguucguuuuguguuuccucuuuuggcuuccacuaaaaagggggguaaaggaagagaaagauucaucaggaauacugaaagaaaacacaguauuucauagaauaggaucuuuucauuuagaaagaauagcuuaguuagggugcuuaguuuuuaaccuguauuuaacgucuucaaaucuguacgauuaaagaguuaaagacauuguuacuucuuuggaaccaagaaauguauauuuugcauuguaugucucacaagugaaacguaacugacaguucauaacauguuaaaggucacuaauuaucaguggguauaaaaaagcuauucugcuguauuuuaauuauacccuuuucaacuguauucauaaguaauggggggagucaguguaaucucaucauucaacagauuucuacaaauucugacuuauuuguccucuugugcaguaguucuuuguaaacagaaagaaaaaaaagagacaaauaaguauuccucaagguuguuuuauuaaaauguccucuaucaaaauauaggcauuuuaugaagcuaaaaagguuacucagcaguuaaggauacuuguuguucuuacaaaggacuaauauucaguucucggcaccugaaacuuuaauuccaggcuaucugaaucucucuucuggccucuguccaugcacauucuuagacacacaggcauagaaguuuuuacacagaacagaacuguuuucuuaauggaaaaagugacugcucuaaaugauugaaucacuaguguucuuauaaaauuuuguuacuuaguauuuguuauaucuuuguaaguaaaaaaaugguguuuuaaaacuauucaauauuuuaaauuaagaaauuaggcaauuuaauugaacuccuguaggcugucuccauuggguuucuaugguuuaggagaccccccacacacacaccaauccaguccaugcugauacaucgguagaucagcauccagcuaccuauggcaagaauugacuacuucgugggaucuaaaauuuaagggggacaagugaguugagaauugcuaaugugcugacugccauuuugcuuuggaaaguagaggauaguuauugugguugauggaauguagucagaauuacuuugcaaguagaacuauguugaugauaauacuaacaauugucaauacuaauuuaagcaucaaaggaauuucuguuguagacuuggguuucuaaagugugaguuaaaauuauuagaagaaaaaccuuuuaaguaauaguuuugaucuguugucuuuagaaaaacuguguggaaaccuagguugcuaugcugcauguagacuucguuaaaaugucugugcacugccauuaugcaccacucagcaaaaacuggccauuugaaggcauuugcuucuuuaaaccaagaaagagucacauuuaaccaaaguugauugcagcaugcucacuauuugcauuaaacaccaaaagcuugucaaauaaugauauuuuguuuauuugcagcuggcaaccagagagacagauuccauuccaugaugugagauucccaccaccuguagguuauaauaaagauauaaacgaaagugaugaaguugaggugaguucccaagccauaaaauaaccagcgacuaagggcauguguguaauuuucuuugacuuuuaaaauauaccuugcuuuuaacaguauuuaaacuaccuugaguuaaaguuaaaaucccuuuuaguuaauuauuugaaauguuauaugguuacuuauauuuggcuauucagccacacucaggaaauaucuugucccaaguuucuuuaccccauuagcauauccuugccucaucucuaaaucuuuguguagguaauacuuuuguuagaaagagucauuaagugagcccaugaaaugcgacucagguugcugucugcagaccagagcacuucuaguuuuucuccgcuguuucugcucagaguucugcaacuucugcaaucucuagugcugucugcuuucagggaaagggcgccuaguuacaggucaugugacuuacacauguugggagaagacugugcuaucaagagucuccagcccacuucucgugugugcgugcgugcgugcaucugugugucuguguauguguucugggcacugaggauugagcuagggcuucauucauagaugcuguacacgugcucccuaaugaaccacaccccagccucacauugacaaggaaaugcagcauugaguguggggugaaggugggguacacagagcagauaaacaugauugaccugccuccuccuacagcgggaggcagaucugucagcaggcagcuuuuacauccuguagugccugacagcaccaguuccaaauauugguaucaacagcuccucccacaucuucgugguaccucaauccuuaaauaaaagccauugcugauauuaaugccaguaguccccuccccgaaacucacagugccucgaaauccuuaaauaaaagccgugguugaucaucaaaaaaaaaaaaaauuuguugcuauucuauucacuuuuucagcaaaaugaauuuggaaaaauaguuuuacaaaggaaaguaauaguucuaacaaagcaugaauaugauauuauaugccuaugaucuuaaccguuaggagguggagguuagaggaucaggauuucagaguuuaucauuggcuacauagcaaguuagaggccaguucuucauacaugagagccuuaacucuaaaagaauuuuuuuaagaauucuagagccagugugguggcauauggccuuuaaauccagcacucaggaaacaggcauguggaccucaugaguucgaggcccaccaagucuaugguacugaguucuaggacaaccaagucuacauaaagagaccuuguuucaaaaaaaaacaaacaaaaaauaauuuuauauaauagacuaguaauauaaaauuuauuuuaguaguagugaaucuuucugauauauauuuuucaaaucuguaucuuuuauaucauauauagauagauagauagauagauauauacauauaucuaucuauauauacauauacauauauauauauauauacauauauauacauacauauauauauauauauauacauauauauacauauacacacacacacacauauauauauaucccaaauguccuuuaauaggccauacuaugaacuacaugcucaucuaccauugagcucuuagaauaaaaggugcuguugaaauuugaucaaaaucauuguauuuaugauucucuacucauugaaaauugguuuucuauuauaaucuuauuuaucuuacaauuuuguagucucuuuuaccuccuacuucccaagccuuauuuugaggucuuuuuaaaaaugcauuaauuuuuauaguuucaugcauguuuguaguauaaagcaaauaaauagguacuuguuaagagguaagcaacgugaaguuagguccuuaaauguuaauuuucugcucaggcuaucagguacaucaauacagucuuccuuugaugagguuacauucuagcuggaauagcuaaugucaugacaggugaaaguuauaugaaggaagagaaagcuaaauggaagauaauacaggggcagcaaugcuauuucagagucuaguuggaggucucugaauguucaaaccuauguucuuuucucugcaauuuaaaugaggaauaacauacuuauaauaaauacuuauaauaaauacuuauaauauaaauacuuauaauaauaauauaaauaauaauauaauauauuauauauaaauaauauauaauauuaauauauaauauauuauauaauauauaauaauaaauaacauaaauaaauacuuauaauaaauaauaauuaauaaauaauaaagccuaaaacuguacuuaguguauucuggauuuggcuuugcaagagaucuuaauuguaaauacagauguuaucuaaaccucuacaggccuuuaagcucaguagauaacauguacuuguucccagggcugacuauaugaguuagauccccaguccuggcaugguagaaggagagacacagacacaugggggauuguccucugaccuccaauuguacaccuauaacauuaccaagugaauguauguguuuguucucuuucaaaaacccucugguaucuccuucccugugggcuucuugcuguguuaaagcaaaggccaguuuauguguauguuuuuauggcaagacuuuggagggguaaagaaaaccauuuuguuuuuuucaacuuaguugcaugacaguugaagcccaaugagaugcaucauaaaacuuaccucagaagcuagugagauggcacagcagaucauggcaacuuagguucuauuaauauuuauuuguuauugucuucacaaaagauugcaugcuacacauugcaaaugaacuugaaagguuuccuaagagauaauuauuagagcuguguaugaaagccagaaaagugauauucagaagauugcuggaauagauuugucuuuuuucauggagaggaggagccagaaaagcagaguagccuucaaaagagaugaaggccaggacccuaguaagcugagugaucagugaacucacuaaccuaucugcuuagaguacagguaguuauugccuuugucuguaacuuuggauugguuuuccuuguuauaauaaaaaugaugcuuacaugguuucagauacauuuuuguagauuauugaauagcuacagaagaaaaucuagucaugcuauggauaucagcuuuucucaaguguucaugucaagaguacuaaauauuacugacauagaucagagaaguaaacaaagugcuuuuaaccgugaguucucaaguuguuuccaauuauguauuuuugucuaagccaacauaaauguaaaguuugguugaaaucauaugguauaugauuucaaagauaaauauggacuuuuuaagauuuccucacugucuagugucugcugcuuuugaauuauguuaaucauaaauauucuguuuuauaauuuuuauguagguuuauuccagagcaaaugaaaaagagccuugcuguuggugguuagcuaaagugaggaugauaaagggugagguaggaaaaugcauauuguucauacuauuuacauuuucuaagcccacauuuuaauuuuggugucuauuuuuaauaacugccuaacuuuaagucauuuuauaaaaauguuuucaauauagguuuacuauaugcuugcuauauguuucuauugauuaaaguuucccccuccccaagaguuuauauuuuaaaaugauaggagcugggcauggugauccauucccuuaaucccagcacuaaguggcugaaucacaaagaucaggguuaaaagucauccguggcuauagaguaaguacuaggcuagucugggcuauuaugaguuccuuucucaaaacaauagucaaaguuauguagguuucccuucuuuuaaaaauauggcuaagaaugacuuguuuauuucucucaguuuuaugugauagaauaugcagcaugugaugcuacguauaaugaaauugucacaauugagcgucuacgaucuguuaaucccaacaaaccugcuacaaaagauacuuuccauaagaucaagcuggaggugccagaagauuuacgacaaauguaaguugauacauuaaaaaaaugcuauaucagaagggcagugguggugcaugccuuuaaucccagcacuugggaggcaggggcagguggauuucugaguucgaggccagccuggucuacagagugaguuccaggacagccagggcuauacagagaaacccugucuugaaaaaaaaaaaccaaaagaaaaaaugcuauaugaaaaaaugcugggaacaugcaaggguguguaguuuuacaaauauacauuuuauauacacauacauauguguauauaaauuaaaauauuauauauagguuacugcauauauaaauuaagauguuauauccagguuacuaauucagaauguaaauuuuaaaaugauauguuuuguaucuuugucaaaaguaguuugguuacaguagugaaggaaaaaaauuuuuuuuccuaguuauauaaucaagcaaguccuguauuuguuuaaacuuacuugauauauggcuaaaguguguaaaucuacacugaguucucuaaacaaagauuuuuuuuuucauaagcuuugaagauuuugaaaaugauagaauucuaucaaaagucacauuguucauauuguuguuccaccuauaggguugcagacccccucagcuccuuggguacuuacucuagcuccuccauuggaggcccuguguuccauccaauagcugacugugagcguccacuucuguauuugccaggcaguggcauagccucacaugagacaccuauagcacgguucuuucagcaaaaucuugcuggcguaugcaauggugucagcguuuggaggcugauuaugggauggauccccaggcaggguagugucucuagcugcauauguagcagaagauggccuaguuggccaucauugggaaaagaggccccugggucuugcaaacuuuauaugccccaguacaggggaacgccagggccaagaagugggaguggguagguagggaagcaggguagagggaggauauagggaacuuucgggauggcauuugaaauguaaauaaagaaaauaucuaauacaaaugauaaaagguuuuuuaaaagguaaaaauaaauaaauagaaagucacauuguacacuacaaaauuuucuccugaugcuuucccuuuuagagaaaauauuuucagauaaaauacauacuaaguuaaagcuaaagaggcuuggaaaagcccuguuucuaaucuuuuaucuagaaugauguuaaacaauucagagaagagauuaauuuuuaaagguacaauaagucugauguggacuacuacccuagauaaaagucauauuauaguucagaauacauagaaauucuauuuuuaagucuagagaugauguaugcaaguaauuuuuauguuuucaucuuuauuucaacagauguaacuguucuucuucaagagagaaaggagaggauuaagauacccauagcuuaucuccauaauuuuucaguuugcucacagaaaauauugacuuauguaaagaaaaucaagaauuauacagaaaaaaaagugguuccuauaaauguggcuucuucaacaaucuaacccuaauagcaauuccuuaagagcauaacuguuuagccagaugugguacaugucuguugucucaguacuugggagguagaggccagccuaaguuguguaauugaguuuaagacuaaccuaggauaacaccaugcaugugcauacacagaaacacauggguaaauaaaugcuuaaaauaauagcuaaaagggcacaggagaugggggucauauagaugcagugcucaagaauaaaauuuuccaaaaaaauaaaauauguuuuaauuagcugcuuuuuuacccuuuauugugucaaauguuugcuuuauuucacagguguacaguaaaaguacauaacuuguaaauagaacuagcauuuacauaaaagaaauuuaguauaaauccuugguuuuuaguauaauuuuaucugcauauauuugugcuagugauuggugaucauucauguuaaugaugaauauguuuuauuucuaggugugccaaagaaucagcacauaaggauuuuaaaaaggcaguuggugccuucucuguaacuuaugauccagaaaauuaucagcugguaauuuuggugaguguuuuuuaauugucuaguuugguuuauuuccucuggggcauuugcuuugguaacaauauuguuaacuuuaaaucacucaguccaucaaugaagucaccucaaagcgagcccacauguugauugacaugcacuuucgaagucugcgcaccaaguugucucuuauacugagaaaugaagaagccaguaaacaacuggagguauguuccuuucccuagcacuguugguaaggcuguccagaaauaacuacuguaugguucucaaauucaaguauggacagcuuguuuuauuauuuccuauuuccucuaguuuggaaauuuaaauuguacaaaauauaagcauacuaaaauuuucaugccugaaauuacacaacagucauauauuuuaaggaaauuuuagacauuucauuuuuaccaaaaguuugucaaagcugcuauaaagugagacaaugcuucuucuauguaacauguuaucauuaaaguacuagagaauauuuaaauaucuaaucuuauuccuuucauuauguauguuuaucucuguuuaaaaggguauagaacuucuucauucuaauugguugucacucuuuaaaacuccugucuucagauuccugccagaggcuauuucccuaacuuacuauuucgucucuuaaggugcauuuuaucuacuuuuauuaauucuccaauaauugccaucaccaugcauuuauuuucauugauaacuaucuaguacuuccauucauuaccauagaaacuaaauggaguuuguuuuaauguaccaacucaaguagauuacugucaauuuaaagagucucccucaucauuauucauuucguuagggagaaucaucaguugauauagcaaaagaaaaggggaguuucaaauuguaguuuaagaaaaaagguagucaaggcuaugaaaauugccaauuaccaacuuuguguaugaaugaugaacucuuaacagaaaaggaaaaauuuacuuuuguuugccaaauggcuguugaggucuguuugauuaguuuuuuuucucucauucuuuauugaugucccccauguucacacuuuugugguuuagcgauuuucucauaacuuuuaggccacagcagccuucuuaauuucauugugaguauuaugaacguguacucauauaucucuucuuaagcaucuaauucuucuugaauguucuuuaccauaccuuugguuuacauguauccauaaauuaucaaugggaaaaaugaaccaggguaaucacgauccaaaaacgugacuucuuggaaaaucuucgaagauuuuauauacuuuacuaccauuaccuuugaaaacaacuauuguucuuuuaaaauugcuuacauuagauauauuuauucauucaaauuaucugguguguugaauaaugauaaacuaugugcaugccuauuuucuucacuacuaauauuaaagagguucauaaacccuuuuaagaaauacccauuuucaacaugagccacuaaucuguuugguuuucauuaauggcaugcuagaacuaaacauucaguuuugauaugcuuuuuaaagacagugauuauccacauaauaugggguaucauuggaacauaguuuugucauugcugaauauuuuaaagaguucaucaagcuuuuguggauucagaucacaaagucuaacagacucugaauauaaaaguaauauaaaauugauauuucuguauucuacgaguguucacuuuacuguuaaaccacagaguuuuagggauuuuuuucccuggguuugaggagagaggguguugucuuaaugucacauuucagcugaaggauguuuagauccaccauaccugguuauauauuaugaaaauggcaccauuucuagaaaaaguacuuauauauccauaauaagugcagugaauauuuuuuuauuaaagauaccauuuuuaauuguugcuuaaauugaauugagucugucagaccuagugagcuguucuuaauugggaauauuuugucugcuucuuaauuauuacauuguggauaucauugaauaacaaaggcagccuugcaaauagguuugcaaacauaaccuugaaaaacugucaauaaacuuuuuccuguuaacaaaaaaaauguuuuaaauggcauagaccuucauuagccucaaaagaacuugugugauucuaaaauuaguuuuucuacuaugauaauuuauaggacccugauauauagggucaagauaauuuacauggcugaccuaaaugaaauugucuuaauaauugauaaaacauguuaaucaguugugcauuucucuucagaguucaaggcagcuugccucaagauuucaugaacaguuuaucguacgagaagaucugauggguuuagcuauugguacucauggugcuaauauucagcaagcuagaaaagugccuggcgucacugcuauugauuuagaugaggauaccugcacauuucauauuuauggagagguaaauauuucaccauauaauccaacuucccccucauagaaacaaacaaauaguauuucaaaugccaaaucuuuugcuuugauauuacacccacucaaccuucuuuauuaggaucaagaugcagugaaaaaggcuagaagcuuucuggaauuugcugaagaugucauacagguuccacgaaacuuaguagguaaguaaaaaauaacuuuauauauaccacaaaaaauaaaauccuaguacacaacuucuauacuaguuaaaccucguuucaucacugaaaguguaaucugauuaagucaaucuuugagauguagccuguucuuacaguguauagaaaauaauacucaaagauuauauuuucagaagauauacaagaaauaguucagacuuauaugucugaaaggauaauuuuuaccuagccuccucaagguauuuuuuuaaucauagcauuagauuuuuuucuaaaaugacuaaaaauuuaagcuuuuauaguuuggugauauuugagaaaaugauagcauucaugucaguuaucucuggguucaaaaucuggauaugucuagcauagacauaguuugaaagauaaauucacaccaacugucuuuggauuuuauggagucaguaguagcuccuuauaaauugauaaauacuguuuccuaaucaucacugugauggcuguuagcauaggaacuuuucacuaguauucccaaauuauucaguugucuuuaguagaacaaacuaaaaccagguauggguuuauuuuuuaaaauguguuuugagcugggcaugguggcgcacaccuuuaaucccagcacuugggaggcagaggaaggcgaauuuuugaguucaaggcuagccuggucuacagaaugaguucuaagaaaaccagggcuacacagagaaacccugucuaaaaaaaaaaaaaaaugugguuugaauuuauaaauaaauuuggggcauauugcuucuuaauccucuuguagaaguauaaagugaacaaacuuccuguguaguuuauguauauagcuuaaaacauucauaggcuacauuuugucaaaauagaauaguaaucaucuuacagugucauuuaaaauuacuagcaauagcccagcauucaggagacaggcacaaagaucacaaauuuaaggauaguaugggguagggauagcaagauccugacuccaaaauaguguccaagagucaugguauuuuuuaccauuaauuaaaaaaaaacuugaagguaaagaacaaaugcuaaugaaauuaguuuacauguaugcugcaacacaagaaugugaauguaguguuaccaacacacauaccaguuguauagaagauacaugcauagcacaggaugaacuaaugauuaugauagaaccaugguauccauuaaauuuugauagugcuauaguaggugaaaauauuuacacauauuugauaccauugugacuuugggugacugacuuagcucuugagagaaugcuuuuccuucacuuaacaugauaucaacgugguauucaaggucuagaugcuuaaugagguguuguuauguguaguacuuagcacaguucuggguacagaaggaaacuccauguucucuuuuguuuauucauaacuucuucauuucauuacagcagauuuauaguaaauucuguuggaauuuggaaguaacugcaauauacaaguaaacuagauucaauuagauuaccaaagaagaaagagauuauaccuauagucuugcauuagguguagaggauguuuaaaguugguuugcaccaaaaaaaaaccuauugcagaauugaguuuucuuuacguuuauacuuaguaaaacaagagaauucugguuugaugaggaaugcugcaacacuaggaauacugggcuucuucagaaaucaguuuuuguuaguucgguuugcugggcagguuucagggugacgucuuaaucacuauuacuugagucucaucuacugauugauuaccuauuuuucacaagccuucuucaguaugcacaccaauuuaucuugccuaaaaguuuguguguucuaucuaaacuuugacagugaguuuguuuagacgaaguacuuaguuauuucuuaauagaaacaugcuaaaguccuacuuuucuuuaugcuaauuugcaucuuuauuaaaaucaacuuucaugguuauguaaggauuuuacagaaaaaaaaaaaaaaacaaacucugagaauacuccagguagggauuuuuguacguucuucauuucauuugaagaagaauagaacagacauaaugagauuuuuagauuagaaauccugguuuaguggcaugaguuuuguuuucuaccacugaccaaagagcucaagguggaagaguaugaaagccacacacagcaauaaugucaaaacuguggcucugauuauaagaacuaugaguccuucugcaagaccuuuugcuaguuuguuauuuaaaguagcuaggaagcaacuucucucuuuucaucaauuugccugcgcugaggaggcaaaaugagcauauagaagcauuucacccauggcuuaucuaagugcuuaagucccccuagaaucugguuugccucauguguagguuucuagaauuaguagugcuuaauuuguaaauucuugcuuuacacucauguaugauaguggcuaugaaagcagccauguccuaguuuuauauauaauugaauuuugcacaguggggcaaacaauugcuauuuagaacuacuacuagauuuuucugaauuucaacagauguuacuaaagaauacguauaagccuuuucaugguaguuuuggaguuaucugaaagugugcuuuaccuaugaauauguaugcuacucuacauugugaccaaugcauagaacuaauauucuguuauuaacauuggcuugaagaauuuuuguuccuuuuagauauuuagauagcuuucuaagcuccugaaacuuaagagcauauuuucaaaugugucauacauaauucuaaaaauaguuccuauguauauaugaggaaaugugaaucaaagcuagaugagaauugaaauugucaaguaagcaaauacauuuauuauccuucuuuuccuuaauuccuuuuguagagcuuuacagagugcuaaauaccacaguaccaguuaguuuaaaguauacggucuuaugugagauaagggguucucuuugaguuaccuuuaaauuuucagaauuacccaaucaguucacaaguauuaaucagcuguaguaucugaccaaaugaguuuaaaaaugaccuaaucaacgagaauaauuuauaauuaaacuauuuuuuuaaaaagcuucuguuuugaaucuuauaauccaguauguauauguauuugaauguguaagauaguuuauaguggagugugcuuguacgauuugagugauguccucgagucaaacaugaauuauuuauuuuaggcaaaguaauaggaaaaaauggaaagcugauucaagagaucguggacaagucaggaguugugagggugaggauugaggcugaaaaugagaaaagugucccacaagaagagguauguaauagugcuuauuuuucugguuuugucuaagagaaagaguuuuguuugucuuguuuuauuuuuuuaauguauuaauacagaggcuccuguauuacaugcauauaauauuuuuuuucuuuuugugguacucagaaucaaauccaggacuuugauaauuguucugacuauuggacaugcuuaauacuauagauacuagacuaucuguuuugguuuggcuugguuuuuguuuuuugaagacagaauuccucaguguagccuuggcuauccugaaacucacucuuagaccaggcugaccuugaacucagaguucugccugccucugcuuuacaaguucugggacuaaaagugugcaccaccacccagugacuauguuuucuaaugcuggacuuuagauaaguaaauuuauccuguauuugucuucauuuugugaucuuauaauggguagucaugaguuugcuauuauaagguguauaucacugguucagccauuaaugaaugacaaaaagcgugcauagacagccuuuauaaaugcuuuugauugaguguuaaugugguaaaguaaguucauucugugugugcuuuuucugcacaugaucacuucccccaacaugacuuugauaacucucaguccuaucuaccuggacauaugcuuauugguguaaccuuguaaguauuuguauggaaaguggaaagggacaguauaacccuugaugcaguuguacucucaaaaugcuguccacgcacaagcuuauaauuuucacauuaauuagcugucuuuugugaaagauuauuuuaauugauguuaaaucaauuuaguguuuuuuuuaagguuuaauucaauaaaguuugugugugugaguguuuggagggguugggagaagagcucaguugugagcugcuaagaaccaaacuugguuccacuguaagaacaguacaugcucuuaaccucuacaaaaagccaucucucucuaaucccugauuugguuuuuaauugcauaauuuuuaugcucuaugggagcuggugagaugguucagugguuaagagugccgacugcucuucuaaagguccugaauucaaaaucccagcaaccacaugguggcucacaaccauccguaacagaaucugaugcccucuucuggagugucugaagacagcuauaguguacuuauacauaauuaauaaauaaauaguguacuuauacauaauuaauaaauaaacaaacaaaccuuuuaaaaaaauuuaugcccuguaauuuuauaugucaaaacacuuuauaguaaucuauagucuuaaccaucauuguuaaugggaaaagaugaacuucaaacauuguuccuaauauguugaauuaucagauuucuuuauaaauaauuaaguggauaugcuuaacaaaaaauaucacugacaugguaauagaaccaaguucucauaaaauuggaauuuuuuguguuuuauguuuuuuuaucaaggaaauuaugccaccaaguucccuaccuuccaauaauucaaggguuggaccuaacuccucugaagaaaagaaacauuuagauacaaaggaaaacacccauuuuucucaaccuaacaguacaaaaguccagaggguaagaauuugucaccucuaaccacacuaaaaguaauuucuuugacgcagauuccacauuugguauuugggcuguuuuuucucguuagauuuguaggcuacucuuacucuauauuuucacauagguuugguaccauaugagauuacaaaacaaaguaauacauauuuuuucaauuuauucacagugacaaaucuuaagcuauaaaccuaauggggucacuuuuuuucuguugaggguggacuuuuuuuuuuuucauacuauaacuccuuaaauuuugcagguguuguaacucaaaguguaccuucuauuagauguguuaguuacuucuuaaagccauauuuuagaaacugauuuucacuauuugaacugaccuauuuagaaaugcauuuagaaguccugcagugaaaguccugcguucaggcuucuguguaucguucauuauaguuaaucacaucacuugcauuccuuauacugcuuuagguguuagugguuucaucaauuguagcagggggaccccagaaaccugaacccaaggcuuggcagguaggaaacuauuccuugaaaaauacauuuuaaguugauauuuuaauguuuauuccccuuguuaagaaagacuacaaaugagccucaugguugggggcugguggaggaguauuuguggguauuuggauccacagcccuaggcuaaaucucaaacaucuucauuccacuuagaaguucuucccuuacauguccagugucauuuucuaccagucuucccacugugucuuauaggaagcuugauuccuucugaaguucuuggaauucucuaaaauugaacauacuuuuugcugcugcuuuauguguggguuuauucuacccagacuguucuuuuuccuguauuugccuuaucacuuugacccuguuguaugugaagcuuuccuuguguacuuaccacagguuuccuaccuguuccaucuuccugugugcucacccagagcauguuuuuagauguuuucuuguuggucucuucaaccacauuguaagcuccuugaugucaggguccuuugccugguauaugagaauugcuuauaauaaggaugguauaacucagaaaagacuaaaagcaaaaaugccauuuuauaccaagaacuaaaacugcaagugaauuggacacuccuuucuguuggacaucccuuucucaucuuagaaaagagaaucacuuuguccuaauauugguauucuauauuuucaauuuauucagaucuucugauuagacauuugaguuguccuuggguacucuaacaguuuguaccauguuauaagagaaaauugguuuaaauaauguucuucaaauucuaccuaauuaaaucuacagcacaaaauuaaaagcuuauuuuggugauuacuuggaaagcauguauuauuucgugacuugauauuuggcacuuggaaaaaguacaauuaaugccuuugugauuaugcuauugagaaaaggaauaauauugaaggagggcacuuuuuauauuguaguacaaaaaagaaaaucuuuacaaguucuuuucauccccugauaguucagauagucacugcuacuaggaagcugugccuugccuacuauaugauaaucagcuuacaagcaauacuuucugaugguucaguuuuauuguucaucaacaguagcauucuuuacaaggauauagaaaauccuguguccuucccuuccuuucuugaaccuacuguauacugaauauaaacagggaaagcaucccaacaauagcuacauguucuaagaaacguucuuuaggaaagagugacacuuugcucgagggacagauucuuggccuccugcauuuuugccaaacacuuguaacuguaauacuuauuacuuauuaguauuacaguauuagugugugaguaccaauaaucauguauuucuucaguagcaaaaugauugaacuauucucagcuuagaaugugucuuauuuauccccucuuuaagcuagacuuuccuacugguuauuauauugaaugguuugggguuuuuuuucuucucuuaugcugaugagaaauauaaauauuuagauuauaucuuuaaaacaaucccuauauuaaaaugcuauacauagaagaucaaaguauuucuuaugauugaacuuuguaagauuauacuauauuuuugaaauuuuauggacuuauuaaauauuaugcuuauaauuuugccuugguuuuuguucuucuacaaacuacucaguguauuuuaauuuaaauucucauuuuuguucaugauuuggauuuuguugauuugguuggcaaaauugagguuuuuaaauuuguaucauugguaucugauuuuaaauugaauuugauuuagguagaacuuacagugagugaauuaaagcauaacuauucaucuugcuuaccacaguaaagauuguauaauucuuaguuaaauguuuguuauuuugucaacauuaaacaguagucuuuaaaacaaugugaugucuaagaaaucacuauauugaucugcccuugguuuuacauauugauuuauauuuuaaauagauguuuguguguucgccagaccuuguacuagggauuuagucauuagguguuuuuguuuuuguuuucagaugaaccaucacuaguucuuuagguucacuguuacaauuucuuuuucaggguaugguaccauuuguuuuugugggaacaaaagacagcaucgcuaaugccacuguucuuuuggauuaucaccugaacuauuuaaaggugaggacaggaugacuuuuaacuucuaaucuucuugugcugaauuauuaaaaacuguauaguaaauccuuccaaaacuaggauccuucuaagcugugcauaacaguauaugaccuuguaaaaauaauagauaaaauacauuguuucaguuuauuucuucuaaaaacuuaauuuuucauuguaaaucuuacggcuaauaucccaguucucaauacauucauauauacauauauauguacauguauauauauguauauauauguguguguguauguauauauauuuauuuauuuauauauaguuauucugcuaaacccuuagauucaauuuagguaaugauguuauauauacauauauauguguguauauauaugcauauauauauauauuugaaccuucuagcuuuuauggauguuuucugauccaaauuuuguguguacuugccuuuguugucccuccuauguuauuuauuaaggaaauucuagcauuucaugaaguccucuuuaaauauuuacucuucauacuuuucucuauauuguguuaaucaaaauauaaacuacuugugcuuucuuguauaugcucaucuuacugauuuuacuguuaugcuuccuuagcuugcaagcugggaaguaggaacccagaggcuauuauauuaguaaaaauagcaugggauuggcaauacaucugugaaguagcuauguguacuuuuucaauuucccuuuggcccaaauauaaaauuuaaugaaaugaaaucuuaauuguuuuuaguguuauaaugucuuauuuguuaaaauauaugccagaauuauucuauaggucuuuuuuuaaagucuacaaaauaaucuaaguucuauuuuauuuaugauacuaacuuaagaauguguuugcugacuuaaagaauaaaaugugaaucagucuucuaguaaguaagagugaaaggaaaaaaaacggugcaguaccuggucauuuuguucauucuuaaugguggucaguuaauaaauaaaagugggaagguuucauccagcaagguuugcauggguaggaugccacuuugauuugcuuauuuauuuuuuguuggacaguguuuuaugugcaaucuguuguauguuuuccuuuauaaucuucacuagaaauaauuauugugaccuagauagacagagcugcauuauaucaugucccuuguucuuucaauuaaugcuuuuucuuagauauuuuauuuuucucuauugaauauuuugucuguuacuggcagcuguucuguugccauucuuaucaucaccaaaucaucuuuugguugggucuagcaucucaccaaaacuaaguacaauaccuaagugcaauaacuggaauaccauucucuuaugcaauuucuagauaacacauuccauuagcuagaaauauaccuuugcaggaagccacuagucuuuccuuuuuccuacccaguuuaucacagauucugguuuagagagcaaguucucuguggauucucagucugaccguuuuucaccccccaccccaugucagaaccaaaauuugacaacuuuguuucaaugaccucuucuugauugacacacugaauauuugcuguaguuacagaucuuaugcccuguagcuaauaagugagaugcucauggauaugcuagaaaggcaaggauuaacgugaaaguuucaucuggauucgacagaucccauguuuuuguacaugcuauguauaagggucuaucaguggauucuggaguugauauauuuuguucaacucaauguauauuguuuguaauacuuguuuaagcagaguuuuagcauuuuaaaaguuuuucaaggcaugaugugagaacuagguguuuugaugugagaccuagggauuuccuccccuucauauaaaggaauauuagcauguuuaguucauugaaaauaagugauccguaauuauaucuaaaaauacuacaugcucuuuaaaaaauauaccccaaguacaauacuuaguaaauuagaauauuaacugacaaaauaauuucauugagcucauuuaugugugauuuuuaaagguuaguugauuaaaucuuaaaugucugucauuuaucuguauuuuuauacuuuuuaguauuguuuuagucaaucuuauuucaaaaaguccccaaacuaauguaucucugccuuauccauagacuaauugaauagcagugccaaaucacucaaauuuauucaauauaacuuuaaaacugaguguuuuuguuauauuucuaagucuugacaucaguaaguguaucaauaguaaucuuucuuuuuaaggagaccauucaauuuccuaauaauucuggguuaacaguguuuacuauaaauuuagaacugaagucgaaauauuuccaguauacuuuuuuaucugaugaaaaggagaaagguaauacuaaguaaaaugucaaauuauuuuuacuguuaucuuguauauuuuaaauaggaaguagaccaguugcguuuggagagauuacaaauugaugagcaguugcgacaaauuggagcuaguucuagaccaccaccaaaucguacagauaaggaaaaaggcuaugugacugaugauggucaaggaaugggucgagguaguagaccuuacagaaauagggggcacggcagacgcgguccuggauauacuucagguacaaacuaagcauuuuccucaguuacuuuaucuguuccuagacuuaauagcugcuaaucucuaauauucauuagaacuccauuauaacaauuucucacuacauguuuuccaacucacagugggucaaauuguguuucaagagacauguagaauaaaagcccguuaaugacacacauaguucacagggcaguugugaguucuguccauauucuaauuggggauaaaucugcuuaagcccuuauguguugaugaccuaagaccucuccugauuuuauuacuguauagccaaaacuuuuuucauuuguguacuguggcucauuuuuugucaggcaugugcuggucauacuugcuggauggacuguguaaaucaggggucugcauccuauggcucauaagaugauuuugaguggcauggccaaagucagccauaggcacagucaagaaguaggggaagugacucuuugccuucccagcuuuucuauccuugcugcuucuuucuuuucucccaguaacuuucagugacaccagugcccagcuacgaguuccuacugucuuucuugcucgacuauguaucuauguaacuugcuaaugaugguauaagguguaauccaucucacaaauauuugcauuucaaaagggaacucuuuaagauggaaaagccuucaagauccacaggagugacgcuauaauggugaagcuauaauugcucauuagcuccaacagaggaagagagagagguaguagaggugauauuccagaguggggaaagacaccuacucauaaggccaaucuugaaccuaacccuuaacccuccuccuaucaguuuguucuuuugaccaaugaauuuccaucucacuguggagcucuuccccccacucccauucccuauaucauuaacccccucagauguaaacaguuguuuuauagugaucuuuuguuuagcccuucccacugggagugggagggagauuguggggcaugcaucaggaaugcauauccccuuucauuggggauaaucccacaguagccccuccccugagacacaacaaucaugguggccuuuauuggcugcuuuuagaguuggccaaauuguacauccuucugucccugugucuacuaaaagcucucauuauagaaguuuugcuuaucaaaguauuacauuguuauagacaauuuuuccucuauugaucacagcuauuuaaaaauauggcacauucagaucugaacuuagacagcuaacaaaacaccuuuuuaaaagaugucuaacaaaaauuacuucaaauauggcaagccuuuuacuuugaauuuaaaacacagauaaguauauucuuugguaggcuucuaaauugggaagaauauugaaucaccccugaaacuucaucucuggaagcuucuguuaaccuuuuuuuuaaagucagacaaugguauauaacuuuuaacucucgauaggaacuaauucugaagcaucaaaugcuucugaaacagaaucugaccacagagacgaacucagugauuggucauuagcuccaacagaggaagagagggagagcuuccugcgcagaggagacggacggcggcguggaggaggaggaagaggacaaggaggaagaggaagaggaggaggcuucaaagguauagcugagaagaaaagguuaaggccagugagauggcucaauggauaaagguacuaacugccagucuuaacccuaguucaaucuccaggacccacaugguaaaaggagugaagugacuccugcuacuuaucucuuagccuauacaucaacuaugguauaugugccucuacaaagauauauaagugguuuuuuguuuguuuguuuuuguggguuguuguuuuguuuuuuuguuuuuuuguuuuuuuuugagacaggguuucucuguguagcccuggcuguccuguuacuuuguagaccaggcuggccuugaacucagcaauccgccugucucugccuccaagugcugggauuaaaggcgugcaccaccacugcccagcuguaaguguuuuuaaagagagaaagaaagauuaaaaguaaacuguuagcuguuugaagcugaguaaagaaucuuggugauauagucuguuuugggcuuaucaucaucauagcaaaugauuacuuuuucauuuguuugacagaauauuacacagccuuccuugugauuuuuuggaaacuaugacuaaauagugauaacuaauuuauauucuucguaguuccuuaccagcaucugguuguuaauccagacagauugaccuguugaaucaaccuucagaauauuuuguuucuuguuaccagaauagauuauuuacuuguacaauuggaauugguaggcucuucauuacauuuuagcuucuauuguuggucugaauggggaaucugaaaagagagaauuuugagcaaauguuuuaagagucacuaacuguuaaacauuuuuaaaauauacaggaaacgacgaucauucccgaacagauaaucguccacguaauccaagagaggcuaaaggaagaacagcugauggaucccugcagguaaaaccuaguuuccaucuaaguaguuugaauaugugcuuuauuuuucagcauguucaaagaugauaaauucauacuauaugaaauauuuuucuucagcauuacaguuguagacagucucaguccucugugacaaauguacaaguaugaggauuuuuccagugaauauaugguuuuaaguauuugugaacacuuuggcagccacauuguaauucucagacucaguggugguucucgaacccucucaaacaaaauauucugaaugaaauguacuaaguggcucaagucagguacccucucccuuuaacugcagagauaaccuguuguccuuaucugucuuguagucuugauaagaucgggcuucugguguccagcuuuccaugcccuguggaucagcuauuuauuuaugugcacaaucuagucugaggauccauuuucaagugagcuauugucagugcuuaaacgguuguuaaguaauuucagcuuuacucccugaauacauccaggcaucuuuacuaagugcuucauguguauuuuaucucacuuaaucuuacaauaauccacugaggcaagaaguuuuauuauccaauuuuuaggugauuaaguagaagcugcaguucauugcccacaguuacuuaccuagcauaugguagagugaugaucauucaaacuuugguaugugaucucuuucacuuuaucuguaaugauaacucuaaauuuuuuaagcaaguaauaagaguuccuuucugcugggcagugguggcgcacaccuuuaaucccagcacuugggaggcagaggcaguuggauuucugaguucaaggccagccuggucuacaaagugaguuccaggauagccagggcuauacagaaaaacccugucuugaaaaaccaaaaaaaaaaaaaagagcuccuuucugccuauaaaccaauacacacaauuagcuaauuuuaacucaaaaugguacaguagaaucuucugaauccaaaccaacucuaagggagucuuaacuucauggcaugguccauucugaaggaccagacagaaaaggcuaauauuguuugccauugacacuuaaaauaguuuauaccccuuagaauguuauacguuaaucuucauaccuuccuuggaucuuaguucuacaaaucauuguuuucagauuucuccucgugauucuguuuuucaagauucaaguuagagagccaucugacucuucuuacugaaguacaaguuccuagacugauacaaacuaaaaucaaaaguguaugcuagaacauuauuuggaauuucaguguuuuucuguguuuuuuccauguauguauuuauguguaugaguauguagguacaucaggcauuggauccuuugaaacuggaguuacaggugauugugagccaccaugugggcacaugggaacugaacccagagccucuggaagaacaggggcucugaacugcugagccaucucaccagcccccacuauuuagacuuugaaggaguuguaaaagagguuucuaaaggaugggguggaacuuuugguauagaaaaacuuacugauacuauaauauauguguaugggaacuaaagguuagcucaugaauggguuaguugacuuuucauucaggugaagcuaucauaggaaggcaugcuuuuuuugucucucuuggauuuuauaguuauugcugaauaagccauuccuuuugaaauauguuguugugaggugugcuuugugugugugcauguguauccauaugaucugcuguauacuuugccuauaccuuauauauuuucuauuagccaauaauaguaacuuaauuugaauggccucacugauuuuugcuuagaauauaaaggugacgaauacaaagugagauuuuuuuucuuauagauuguacacagugagauggcuacuguuuuccagcuaaauaauauuguuuuaaaaaccuaaaccaauaaagaaagagccuaccaugcuuuaauuucuuacaguucuauuuucaucugcauccuccuucuauuuuuuugagacaagauuccacuuauguagcacuggguagccuagaacucagauccaucugccucugcuuuccccauuaacauguggcguauguauuacaggcuuaauauuucuugugaggccauuuauauaggaucuaguguguauguauauauaacaaguauaacuuguuuuagaucacaguuaacugcaauaaugaaaagacuguccauacuaaaccauuacagagugccuccagugaagggagccggcugcgcacggguaaagaucguaaccagaagaaggaaaagccagacagcguagaugggcugcaaccgcuggugaauggaguacccuaaauaagcuacauaauuccgaaguuauauuuccucuaccauuuccguaauucuuacuccauuuuagaaaacuuuguuaggccaaagacaaauaguaggcaagauggcacagggcaugaagugaacacaaauucugcaaagaauuuuuuugauauuggcaauaaucaacaaucuuccagauuugcacaaaaagaucuugaaauuugaugcauaacuuuuaaguacacuuaacacuucagggcaggauuuuacuuuuauuuuuuaaaaauacuaagcagugaucuuuauuaacuaggaccauuuuccugaauuggacuauauaacucagcaguauguuucagucuuucggaguaaaucacauuugugauaaucauacuagaucucugucuucagucucauuuaaagucuucaugaaaugcugugccauuucauguccugugucaguuuauguuuugguccacuuuuccaguauuuuaguggacccugaaaugugugugaugugacauuuguuauuuucauuagcaaaaaaaagaguuguaugaucugugccuuuuuuauaucuuggcagguaggaauauuauauuuggaugcagaguucagggaagauaaguuggaaacacuaaauguuaaagauguagcaaacccugucaaacauuaguacuuuuuagaagaaugcaugcuuuccauauuuuuuuccuuacauaaacaucagcuuaggcaguauaaaaaauaggacuuguuuuuuguuuuuguuuuguugcacugaaguaugacaaauaguguuauuggaagggauguguaauuuuucuguauagacaggagaagaaauaacuaucuuuucauuugggagaggcuaaagauguuuucagcuacuugcaaaucuuccuggucgaaaguuaguaggauaugccugcucuuuggccugaugacgaauuucaacuuugaaacauuuucuuuuguccuccccaaauuuugucaaguuuuuucauucauauuuuacauuaaagcuuauuuuggggagauaugaaggucaucuucauaaauacauaacaacccucaaaaguauauagguacuuugucugagaaacauugaaagcagguuaaauguuuuguaacuuugaaauacaaagucuaaugcauaagcagaaccgaaaagcagaccgacaauugguuaacaaauaauucuuuuuuuuucuuuuuugauguguugagucuuauuuuugugggguuuuuuucucucuuuuuuuuuaaaugacugaaauucacugaagaaaaauaugugaaggaccuucacucugagauguuauauuuuuuuuuaaaaauaacucugaguagggguaccacugaaucuguacagagccguacaaaccgaaguucugccucugauguacuuugugaauuuguuucuuugaauuuucauuuuucauuuaguuuuccuugcauacaaauaagcauauaaaauggcaacaaacugcacaugauuucacaaauauuaaaaugucuuuuaaaaaguauugccaaacaguaauguugauuucuaguuauuuauucugggaauguauaguauuugaaaacagaaauugguaccuugcacacaucaucuguaaacuguucaguuuaaaauacuguagauaauuaaccaagguagaaugaccuuguaauguaacugcucuugggcaauauucucuguacauauuagcgacaacagauuggauuuuauguugacauuuguuugguuauagugcaauauauuuuguaugcaaacaguuucaauaaaguuugaucuuccucugcuaaauugauguugaugcaauccuuacaaugauugcuuuuaaaauuuuaagauaggaaagaaaucuauagaaaguguucuguuacaaaauguaacuguuaccauuggaaauuucacaugucaaaggagguuagccguuauuuaccaacuuucaagaacguaaucuuguucaauaaggugaaauaucaaugauugguacacagucacaauguaccguuaaaauaugcacuaagucucuuuuuuuuacaaaggcugaauucagcaaggcgcuaacuugcuuaaaugugaauuacuaacuucuaaaacuguaauuugauucacaucuuuucaaauggaguuggaguugauucauauuacaauauuugugugcaaaauguguauguuuuucaguuuaaagucauguuuuuaaaaucuuauuaaaguuucaaaaaucugaagauuguuuaucuuaucuagauguaaauuuuuauuaaaaaguugcacuuaugaaaaagcaaaau

SEQ ID NO: 9524 - RNA, 42731 nt, Mus musculus
ccucccugagaguuuuaagucccaggagguucuggacugcucgcaagcgguggugcgucacuaucaccucagguuggcugguuagagaccuccaacaugccuucggaucgaaggccaagucagagaaggaauagaucuaagagccgugauuaucguggugcacggucaaagguaacaagagcugauacgaggaacagagacgauacucuugcccucaguauguaucaggggccuccgagugccgaccaggggaacaacauggcggaugccccucgguuuggcuucuggacuucaguaagccagugucugcaauacuugugggccaggaggcacuugggccugcuucuacuuuuauucuggacgcuggugauccuguuccguccugugaacacuggugaguguugguucuaggcuagagaaggggugacagggacuugggaagugugagguagggccugggaggggauuggaguaaaaggagggugauuggggugcuagucagcaaggguaagggggccaaagguggcagggcgagaccgagagcgagggagguugaugggggguagugaggcagggauagagggggaugaggcacaggaguugggcugaugcagcgggagccuauaaggcagugcuggggauucaguggcaaauucugguccucugaaacaaaauugcucuuaacuaccgagcaucucacuagcaccuauaaucguaguuauuauaguaauuauagaaguuagcaauauuauacaaauauuaauauuuauuaauaauuauaauucuaaacauauuauacauuauuaaaaugugcuguucuuauuauuucucacuagcaauaucaauaauaucaauacaauuaugauaauuauaguauuuauauuuuauauuauuuuauauuaugccaacuauaauuaauaaugacacaauauuauagaauaauaaaaaguaauaauguuauuauuauguggggauauauguuugugugaguaaauggauguuuauguauaccauagacugcauauggaggucagaggacaacuuuguagagucauaucaguucuauucuuccuaucuuuauaaguaucuuccaaggaucaaaugcagguugucagacuugcuuggcaagugcuuucucaaugacucaucuugcuagcaccagaucagauuauuuuacuuuuggcucucagauuggcuaauaauaacaaaaggugugaggguacaagcaaaguggcauuuaguuguacuauugucacagguaugcuucaggguguuacuggaacauaauaacccagugguacagugugcaaggcccuucuugaguuuaauuugaagcaucaaaaagaaaaaaaaaucaccaaacaaaacuaauaauaacaagauaaugaauaauuuaucaaaaagauuuuaaaauauuagcaaguauauagcuuuaauauucuaagcagaugauaaucauuggaauguucuuugaaauaaaaaugaguuaaaaacauaaauguuuuccuaaauaauaauugagccauauaaaggaauaacugaggcauaauuaaagagaugguuggagagugguuuuucuuacaugggagagaauuaugcaagugaagcuaaaauuggguucucuguaguagaacaaaagagggcugaggaagacuuucuguaucccuguguaaggacaucagcaguuuucaagacuuugggucauagguucuaauuuaguuggaaugccuacuguuucugauuuuucuuuucuuuuuuguuccugauuuuuccauugguaggccuuuaaacacuaagcuuuuuguuaggcaaaaauuguuauuuaaaucauuguucagaaggccaacaauaugugugagacagcauguuaaauauuugcuaauuuuaauacuuuuucaguuuucuugcagaaucacaaucugauuaccaaugcuccuuaugcucuuacagauuaaaacgcaacaucuguuauauuuccagaauuaguuuaagcaaagguuaauuacuauuaaaacuucauugaaaaaaaugacaaauguuuuuauguacugggauuaauaauuuuacuuauuaacacuucucugucuccaaaagcgaaauugcccauucuugcugaagcugcagaacuugaacccccuuugggaaauauguuggacuuuuucuuuccaacaaguaaguucuugauuuuuuaaaacuuaauguccuuguuuuaaaauagcaauuaaguacucaggaaggaguguacuuucucaauauuggagugaaacagucauacauuugagacucugcccuuugccuuaggcaagauaaucucucuggaauuaguguuuucaucuuauaaugaaaauauuuaccccaagaauugggaagauaaagugggacaauaauuacaaggcaaauguggcagauaaaggcuuaaauuuguaauuuagcuuaaaauaguuuuauuuuagaaauacuuaaagccuuuaugaauuaccugagugacauggccuaauuuagucacugacccaguacugugaaauugaugucuucuguggcauuaaacaguggcucuguuguuauggaauauaccagauguuuuucccaucuguguuaaugauaaagaguucagguuucaagucacaucguuuugugaucuguauauggugguuuuuguuguuguuuguuuuguuuaguuuucaaucaagcauaugauggccuuugagaacuauuaaccacaaauauacaugcuuuauuuucugcagcaugugguccccuuucaaagugacguuucucauaaauugucaugauuuuacuaaaaccuauguagaauuuauucuaagaaaauccagcguacuuaaaguuaaauccauuguugaauuccauaucucaccacucaacuuuccuguagaaaaaaaaucucuuuaaacuucucuagugguuucaucaaguauaaaauagcuauuguaacacuuacuaccugugagaauagcaaaauaaaugauucuuaaauuaaagcuacugccauagccaaguugaaugaacaagaaaauaagucuggaaaguguuauuguuggauaggcuaaaagaagggcuuauugaguauaacaaaaauaaaugauaguuuaagcuuuagagcuuugaaaacaaugaggaauaaacugucaaacacuugccuaggaugguugcaguaguacaaacacugaaaaagugaccuugaaaaugcuucaaauaaaaauuauuuauuuauuuaauuuuaauuuuccuaaccuaacacaagaauuuuaaucaaaaucaauuguauaaaacuuuuuuuuuucuuuuucgagacaggguuucuuuuuguagcccuggcuguccuggaacucacuuuguagaccaggcugaccucaaacucagaaauccgccugccucugccucccgaguccugggauuaaaggcgugcgccaccaugccuggcauauaaaacuguuuuuccucaaaucaaauaguuucuucuucuuuccuccuuuuuuccccuucuucccuacauuucuuccuuuuacuauuuuugacaaggaccgacauagccaaagguaauccucaaauucuuuauguagucaaggaugauauuaaacuuauguuccuuuugcuuccaucuuccaaauucuauaauuagagccacaugucaucaagccuggguuuuaugugguacuggggaauccaacccagggucacauguauauuaggcaggcacuuuaucaacuaagccacauucccaguccugcuucuuuuuuuuuuuuuaauaagaaacauuugaccuacuuugauuugcauguuugaaaaugcaggauuaauauuuaucaauuguacauguuaccuguuuugaaaacaauaauuaugaacuaugcaauggaaaggauuggaguauuuucagcacaaagaaaugauaaauguuuaagauuucauauaauauauauauauauauauauauauguauguauauauauaugaaugauacauauaucaauuacucugaaauaagcauuaugcauacacuauauacauauauaaguauagauuuauuacaaggucaccaagcccauaaauauauacaauuguugugugucaguuaaggauacauuuuugugauucugaaaugaguuuuacauauauguguuucuuaaauuagccuuuuaaaaguagcauacaaaggacuagguuucagucuagcauuuguguacuucguuuguuuuugcugcucuuuucuggcuggccuuacuccucugccugucuccuccuuguccuccuccuucucucaguaacccgcuuuugcuucaggucauaguauuuuuaaccauugauuuuuauuguuuuaauaauguaucuguauguuaguaugugauuauguacauguauguguguaagggcccaaugaaaacaaagguauuagauucuucuggagcuagaguuacaagcaguugugauccaccugacauggacgugagaaaucaaacucuggucaucuggaugugaccuacucuuugucaggguacucugguggagucagcuugugaggcaaaaaugccaaaaagcugcucaugagaaauaaauuucuaggacucuccuccuggauauucuggcgaaagccaacucuccaguuuggaucgguuugucaggcgaaaagccuggaagcuguuucacgaggauaagaguccagggaaauuuuccucccagaguuauggcaucucuuucccuaacccauuauauucaaauuuccaccacauuagucuaguguauagauucacgugcacucuauuaagcaucaccuuauaguaaaugccuuuuaagauuguagucuaacauagcuaaagccuuuucucaguauucuuagacuccagauagcagcaaggagcuuaacccauucaguagcuaauaaagcacagucauuaauucaguugucugcagagucuaaaauucucacugagauagaaauucguauuauagacuacauuccaugccaagagaaaauuuguauaccauacugaaaauggauagucuucagauauagauaagaauuaacgaggccuagagaauuuuggggucagugacacuacauuauucuugaggcgugucaagaguuaacuacccuggggcuauuaacucuaaguguaaaacucuugccuggcagaaagugcuaaucucuaauguaaacauuuaucuggucccuacaaauucccuuuguagucacuccccuugcaucugugcuaaucucuaguguuauacauuuaucugguuccuuuugaagucacuccuuuugcaccuggaaaaauucaaugugccuuguucugcaauuuauucuguauuauaaaagucugaugcucgacuggaaaauuacauucagauucaacaccucucuuguguguuugacugauugucauuuucauccuaaucucugcccaucuacucuagagacucuuuccuauucgggcacaggggaccagagggccugcggcaacucuuaaccucugagccaucucagucccucacauauguucaacuuacuuuuuccuucuuuuuuccgauucccuuaagacuuuuuaccccuugacauaagucuccuuucauacucaccauguacucacacuguuguguuuuauaaaaaaagaaagaaagagccaggauauguuggauaaagugagauauagugagguggagggggugcuccucugccccaugcugagacaucccuuuaaucugagguaccaguauggaguagaguuuauuuaggacaugggaaaaggaguugaggauggaguagaggcagagaaaggugggggagggacaggggagguagagaaagaagaggagaggcaggucagaaacauguggagagagaagggggacaggaauggagagagaagggacagaggguaagagacuaagaggauaagagaguaagagagugaggagagggcaaacagucccuuuuuaaaaauauuuuuuauuacguauuuuccucaauuacauuucuaaugcuaucccaaaagucccccauacccuccccccacuccccaacccacccauucccacuuuuuggcccuggcguuccccuguacuggggcauauaaaguuugcaagaccaaugggccucucuuuccagugauggccgacuaggccaucuuuugauacauaugcagcuagagucaagagcuccgggggauacugguuacuucauaauguuguuccaccuauaggguugcagaucccuuuagcuccuuggguaauuucucuagcuccuccauugggggcccugugauccauccaauagcugacugugagcauccacuuuuguguuugcuaggucccggccuagucucacaagagacagcuaguaagucagucacaccugccuauugccagguaaacuguggggcagagccuagaaggaaugcuaacacacacagauauaaagauuaaauuauaggaugugugugugagagaugacacagauacaaagaucaaauuauaggauguguguaugagaggugacauguauguagcauuuguuuuucugaguuugaguugcuuuacuuaaaagaauaauuacuaguucccucuauuuuucuguaaaugugauuucagaaucacagaaacuauccuuaaguauuauuuaguuccuucuuuguuguuuuuuggucacuaccagccacuuuguggcuuauaggucuuuuaaaacuaucuuaccaggcuagggacuuauuucaauucguaaaauguuugcccagcaugcacaaaacucugaguuugagccacagcacgacaugaaacugggcaugugguauacaucuguaauccuagguugaggcaggagacucuagaguucaaggguauuuguggcuggagaccuggucucaaaaagauaucccauuaguuagcaauuuguauauuucaacaguuuacccaggaugaaaaguguacuguuaaaauaacugugguaacuuuuauuuucuaauuuuaacuuuagcauucaucauuauuuauauuuuuuaauauacuguuacauguuugucuuuuuucuccugcuuuguauugauuuguaaaacgugcuuauuaaucaagcuaacuauucuuucuuggauuccuaucucugaaagccugcaucauaagggacaaccagguggugguggcauguaauaaccagccguaucuuagcgagagugaauguuuaaaauccaagugcuguucuucaacaucugggacuauaaucaaaugcuaugccccaguaagggacaguaaguagauccuaucucauuucuuuauuugcuuuaaauaaugaaaagaaaaacuaaguauaaaaacauuuaaauaacuagguggugugguuucaaguauaucuuuauauauuucccagcuuaacauuucuaaggaaccgccaacccaagaccaacagcauuaauacaaauucugaaggaauucccuugaaguuucuguuuagucccuagacaauaacuaaccauucagaauuaaucuaaccuguucaguugguucaguuacuccauuuuucccccaaagcaucuuaagcuuuuauaugaggugugacccuuuuccugagagacaguacuaucuuggugugaaaaagaguauaguguaagccauuucaugaccaacuaggaagcagagguggagaaugcagggagaaggucuuggcaagauguucuacuugggcccugcuucuaauuuucacuaacucccccccaccaugccauuaguaaacuauaaauuuagcaagugauuaagccauucauuaguugcaggagagcuuucaggaucuaaucugucuggagauuuucuuaaaaauacacucugugguuugaaucacuuaaucuuucuguuuuuucugaagcuggucaguugccagucaacacuuguguaauuccuucucacucaauguaaagagucguagaugcuaccuauaccuauaccaaaagagaguaacaggaggaaaaaucucacaaauguauuugaucauaauuuuaugugacauugaaccuuuuuuugaguuaagaguugaugauguaaggcaacauugaauauacuuagauucuaugacgcaugggcacauguggaaaugauuggaccaaaagagauuuaacugaggagacaugacauuucugcauaguauuccuuccucuccgguaucuaccucagggccuuuuugaaauagaagccccaugaccuacuaagucaggaauuucuuucuuucuguucucucuuccugucuguggauuuugcuuuuuguuugauugcuugcuuuuauuucuuaaaguguggucucaugaagcucaggcuugccucaaauuugcuguguaguugaggaaaauguggaacuuuucauuuuccuauaucauaccuucagauguucaaauuacaguccugugccauagcagccagcuggucagaggauuucuucaucuccaagauugaauuuaggaggaacaguuuggggcucauggcuggcuuuagggaaaaggacuuuugcuuucucugaccugucaugaggggagugaggagauauggagccaggagaaaaucagaaugcuuuuuuucugacuucugguaugacuuugaacuuuguuuguagcagaugugacuuugaaucugcagugagauuauaagcauguacuacuacaccuaguuuaagccauggugcuaacgaucauaccgcaggcuucauguauacuaaguaagcacuuuaccagcuucugggccuccaaggcuacaugggaggccuuucuucugggcuuaucgcuuccuguuuagcccuaauaauaucaguuuagcaugacuuagcguaaccuuuuauuuucagguucucaucccguguaaaaauuuucccauguauuuuguguucaacaacuuggcauguaguaguagaugugauuguuuccuguuaggugccuuuauuagcuuuucuuuguucucuuuuuuuuuuuuuuaaagauuuauuuauuuauuuauuaaauguaaguacacuguagcugucuucagacacuccagaagagggcaucagauuucguuauggaugguugugagccaccaugugguugcugggauuugaacucgggaccuucagaagagcagucggcgcucuuaaccacugagccaucucgccagccccuuuguucucuuuucaaaugauccaacauaaaauuaccccuuaagauuuuuauuucuuagggcuggagagauggcucagggguuaagagcacugacuccucuuccaaagguccugaguucaauuccuaccaaccacaugguggcucacaaccaucuacaaugugaucugauaccucuucuggugugucugaagacagcuacaguguacucacauacacaaaauaaauaaauaaaccuuaaaaagauuuuuauuucuuucugaagaaaaagaauuauaccaccuuuuuuccuuaccuucauuugcuaguggggacacacuaucugcaggucugcugguggauggauuugaugugauagagcacgaaggaauaauaacaggauccaugcagaacaauaucguagauuuauaaaucccuauucaauuuagagcucuuuguuguauaucuaauauuauagaugaaaacuaaagccugaucaugaauauacuauugcaguuuuaaugugucauaugguacuuagaauucauucaucaguuuacuguuucuauuaugugugaagaaacaguugguucuuuuaguggaaaaaauugagccgugacuuacaauuccccaaucacauuagaaugcauuucccagugcauaugggucuaaaguaugccuauuugccugcaaauuuuugaugccauguuuaauugagugcuguguaauuuggaaguaaacacugaagaagccauuucuuccuuaaguuaacuguucauagauugauuuguucuucagaugcccuaggauucagaacauauggccuuagaacaaguacacuuagggccauacaaagaaucuaguauuaugaaucauaaguugccaaagaaagcagccugauuguuuuguuaugauacugugggggucauguuuuggaaguagcauuuaguugcauuucaagaacuccuaccugaagcauaacgagacucacauuuuauuuuucuuuauuaaguuacaguuuuugacauacuucagauuugcuucucuugccuggucauaaaaguaacaggauauaauuaaaccaacagagccuacacaggugcuacggguguuuggccuugcugcgaucagcauucuaguccugggauuucugccuaugugcugcugcuccaugugcuggaggagguaggaaacauaacccuuucuuugcuaauugcuaacuauaugugcauauuuauuucagugcuuuaaauaugaaaggauuaugguugggucucucucucucucucucucucucucucucucucucucuuugagaaaaccuaaaaauaaaauuaccaaauuuuucuuugguuauuuuucccccacaaguacaagauguaccauuuaauaggcuuuguauauuucaucauaaaacaaaaucccaauucaaaggaaaaagaacucugcaagcuggagauguauggaguuggaguaguuauuaacugcaaaugaaagggauuccuggaaguguucagcugccuuguucuucuguccuuggucguaaaacauuggucugucuuuacaagcagucaugccagauguuugucauagacuucuacaaaaucucaaugguaaacuagcacuugauguuuucagauuuguucauuuuuuuguagaucuccagccccugcagcagaaugggugugaagguacauaguguagccagaaugaguaugaaagugugaggcaggggaauagagcuuaagaguguaguccuuccuuugcauggggcucggauguucaaugccuggcacugaaaagaauccuagggagcuggaagcauaguguuuagggaagucacauauucagauucaaguacagcgucagcacaggcgugacugacggcacguaucuccuaugucgccagccuugccuuuuuucuuuuucucuccagccagggucucauugaguuguccagucugccuuggaauuuaccgcauaggucaggcugcccuuguacuuucaguuuuucuuccucagcuucugcacaggugcaacuuuaacacauaauuuggaguuuuucuguuaagucacagcauuucuacuauuccugcuugcauucaaggccauucuuuuucucagauuucauuuagcuucagauuuugaguggauaauuuugucugugguauauguuugugcauaugacguuccaugugccugugcuugggacuaggccagagaaugcuagauguucuggccugucacucuauacuuuauucauuugagacaggcugagguuacagguacacaaagcugugucuagcuuuuuuguuguuguuguugcuaauaacccaauccaaguccucaugguuggguaccaaguaaucuuauuuguguguaugguuucuauuccauaaccucucucuuccucuccuuguuugucuccaucucuuccucucucuuucuuuuaagcaaacucaugucaucuuuuuucuuuuaaaaaaagaaauauuuauguguuuaguuguguggguguuuuaucugcaugcgugcaugccugcaccguguacuuggcaggucccaaggaggccagaggagagcaucaaaccuucuaggaccagcauuguagauggaugcaagccaccuuaugugugcuuggaaucaaacccauguccucuggaaaagcagccagugccaacacagguucaucuuuccaaccucuuguuuucuuuucucaugcucugccccagguaaucuggaguaagaguggagauuuuuguuccauucuuucuuucaaagcuugcuuauauaugaaaauaccuuaugaauaaaagugaaaucuuuguuagaauucaauggauagaauuaugccuuacaauuuagagaugucucaauaguaagauugguauaauuucauuugagucauccauuacacauuuaccaaugaguuuuaugaagacauucacacccauuggauuuuucuauuuaaaaugaaaugcaaagauuauccucugauaagaacauacuuuauuuuuuuacauaguacaaacuauuugagagacucugucacugagaauaagaucaugaagugcauaugcuuugguuuccuagcuguugagguacuauuuuguauaagaggaguaugcuccugucauucugaggugccuacuguggccucagaacaggugacacuuuagccuagguauuuagcucaguuucuagggcccauaguugaggguaaaugggacacugucagcuucucuugguagacuggauagacuagcacuuccauuuauccaggagauaaauggaagccaaagguuucaaaacuccccuugaagggcauucuacuuccuuaggauaacccuguucacucccugucuccauuucaaauaauaugagacauaagauguuaaauuagucaaaauaaauaaccccaugaaaugaaaauggauguaacaguaaaauccauauauagcuauuuaaaaaugaaaagagagagugcagagaggguucagcaauuuaaaaugccuaaugcccuucuuucaacaaccuguaauuccagcucuggagauaucugaggucucaggcuuccaaagguaccugaagucgaaugcacacacuccccccucccacacauacauucacacaaaguuacauuugaaaguuaaaucuuuagaaaggaaaagaagccaaacacaauuguuuaaaucaaagaaacuaaaagccaagaacagaucugcaguaacauuaucugggucucuguugaaagaauccuucugcccauuuagcauuggaagguacacuuguucucauuuguuuucaauuuuuuauuagauauuuucuucauuuacauuucaaaugcuauccugaaggucccccuauacccucccuccccccacaccccccccgcccugcuccccuacccacccacuccuacuucuuggcccugguguuccccuguacuggggcauauagaguuuguacgaccaaggggccucucuucccaaugauggccgacuaggccaucuucugcuacauaugcagccagagacacaagcucuggggguacugguuaguucauauuguuguucuaccuauaggguuacagaccccuucagcuccuuuggguacuuucucuagcuccuccacuggggggcccuguguuccaucuuauagaugacugugagcauccacuucuguauuugacaggcacuggcauagccucacaugagacagcuauaucaggguccuuucagcaaaaucuugcuggcauauacaauagugucuggguuugguggcugauuaugggauggauccccgggugggguagucucuggaugguccauccuuucgucuuagcuccaaacuuugucucuguaacucuuuccaaguauauuuuguucccuacuuuaaagaggaaugaaguauucacaagguggucuuccuucuucuugauuuucuuguguuuugcaaauuguaagcuucuguaaggcaaaagauacugucaaucaauaagacaaaaaggccaccaacagauuggguaaggaguuuugcuaauccuaaaucugauaggggacuaauauccaauauauacaaagagcucaaaaagcuggacuccagaaauucaaauaaccccauuaaaaaugggguagggagcuaaacaaagaauucucacccgaggaauaccgaagggcugagaagcacuugaaaaaauauucaccauccuuaaucaucagggaaaugcaaaucaaacaacccugauauuccaucucacaccagucagaauggcuaagaucaaaaauucaggugacauccucagaaaauuggacauaguacuaccggaggaucccgcaauaccucuccugggcauauauccagaagaugucccaaccgcuaagaaggacacaugcuccacuauuuucauagcagccuuauuuaugauagccagaagcuggaaagaacccagaugccccucaacagaggaaugaauacagaaaaugugguacauuuacacaauggaguacuacucagcuauuaaaaggaaugaauuuaugaaauuccuaggcaaaugguuggaccuggagggcaucauccugagugagguaacacaaucacaaaagaacucaaaugauauguacucacugauaaguggauauuagcccagaaacuuaggauacccaagauauaagauacaauuugcuaaacgcaugaaacucaagaagaacgaagacugaaguguggacacuuugccccuucuuagaaaugggaacaaaacacccauggaaggaguuacagagacaaaauuuggagcugugacgaaaggauggaccaucuagugauugccauauccagggauccaucccacaaucagcuuccaaacgcugacaccaucgcauacacuagcaagauuuugcugaaaggacccagauauagcugucucucgugagacuauucuggggccuagcaaacacagaaguggauccucacagucagcuauuggaugggucacagggcccccaauggaggaccuagagaaaguacccaaggagcuaaagggaacugcaacccuauagguggaacaacaauaugaacuaaccaguaucccggagcucuugucucuagcugcauauguaucaaaagauggccuagucagccaucacuggaaagagaggcccauuggacuugcaaacuuuauaugccccaguacaggggaaagccagggccaaaaagggggaguggguguguaggggauuggggguggguggguaugggggacuuuugggauagcauuggaaauguaaaugaggaaaauaccuaauaaaaaaauauauaaaaaaauucaggugacagcagauguugacgaggauguggagaaagaggaacacuccuccauuguuggugggauugcaagcuuguacaaccacucugaaagucagucuggcaguuccucagaaaauuggacauaguacuacuauaagauccagcaauaccucuccugggcauauacccagaagauguuccaacugguaauaagaacacaugccccacuauguucauagcagccuuauuuauaauagucagaaacuggaaagaacccagaugucccucaacagaggaauggauacagaaaaugagguacauuuacacaauggaguacuacucagcuauuaaaaacaaugaauuuaugaaauuccugggcauaugaauguaucuggaggauaucauccugagugagguaacccaaucacaaaagaacucacaugauaugcacucacugauaaguggguauuagccuagaaacuuagaauacccuuguucucauuuuuaugacauucuuccuuacauaugagccaguaaaauguuccuuaggaagaaaacuguugaaacaccucuccaagucuucaguugcaaaccaaaacaagcaagguuuugauauuuucuuggcuuuuaaauuugagcaguauuuuuuauuuauauaccaccaagagagcaacuggagcaaggaaaaugagaacaggugggagaggugaaagcaguguugaagacuacagcauucuccagaaccaagcauauuacuucaggacuugcuuuguuauguaauguacaguguccagugauguugaagauggaugccauuuuaaaauauaaaauauguguuuauauguguaugucuuugugugugugcauuugugugcacauggaggccagaagauggcacuaaaaguccucugaguuaacucucugcuuauucccuuaaguuaaggcuuuaucucugaaauugggguucauguuuucuuggauagccuggaaaccaaugagccccaugaaucuuccugucucugccuaucucagagcugguguuacaaauauuuugagggacauuuggcuuaugaugugggagcugaguuaggaacuccuguccucaggauuuuagacaaaacacagaaguaaguggggauagagaguguguguggaggggugcaacuugaacucagugcugaagaaaagacaagauuuaaauggggagggugccuuuccacagaauuccuuacauccagaaggagauuuccuuaguauaggccuuuuaacugccucuugucacuuuuaagcagagggugcugaauaauugguaucauuggcauugagucucuaguuuacuucuagacuugaggucagauuugauauaauccaaguacacaaaaauucaagccugcuugaagugguugcaagugccauagggaggacagaacagaaaugaaaaucuuucuaagaauuugcugcugaauagcuuaguuaaacuugcauauacgauguguuuugaaauucccugcacccugaagguugcauaacaucuauucuuagccucauuaauagggaucagaagcuucaguagguuuaagugccauugauaggcuuaagaaugccuuacaugaagaggaaggaaaagaccaacuggauggggacagagagaaacaggaggagagcucuaacgguggcagggguagagggugugugugggggaggagugagcagaggauacuuaaaucacagccauuagauuaagugacaaaugacaguaguaugaaguaacaaauucacuuccuaaucuugaacuguuuuuaguuuaaauuuaugugcaaagugcuaacuauuucuguuagaaaguauaugacacuuguagcuauaccuaaaguucauaaggugaacuuucagauacaguaccacgccaggcaaauucagauaaagcacauuuucauauuuuucuucaugcuggauuagauuuguaauuucacauuaaaaaauucaguacuuagucugaaaaugacauuuucuuuuccugacaacuaauaaaaguuuuuuaaaagacuauaucucauaagugauguauggaguacgaaucccaaguaaaucccgaaaauauucauguguagacggaugugcugugggagucucacauucuaaugugcuucucauugugauuauagucuaacuacugcuuaauuucuuagaaugguucauaaagaacugggaauaaauauaccaaagauuguuuuacaucauuguauaaaguagacauuuauguauuuaaucccugugacuuuauguuucauuuuacaauacaauauuauuaguagugcuuuuuuugauaagcuuuaugaaauaacuaugcagcauuuggaagguuuggaguucuuagcauuacauucacauaaauucugaagaagaaauuagaucuauacauuuuauuuuuuuaauuggguauuuuauuuauuuacauuucaaauguuaccacuuucccaguuucgucucagcaaacccccuacccuauucccccuuacccugcuucuaugagggugcucccacacaugcacacuccugccucaaagcccuagcauuccccuacacuggaggcaucaagccuucacaggaccaagggccuccccucccauugaugauagauaagaccccuucagcucccuucagaccuuccccuaauuccuccauuggggucccugugcucagucugaugguugacugcaagcauccacaucuguauuggucaggcacuggcagagucucucaggagacagcugcaucagguuccugucaguaaacuauucuugacaucagcaauaguaucuggguuuggugucugcaugucguauggauccucaaguagggaagucucugauggccuuuccuucagucucuguucuacucuuuguccuuguauuuccuuuagacaggagcaauucuggguuaaaauuuuggagauggguggguagccccaucccuuaacugggggaccaugucugacuucugaauaugguauccacagguucucccuucccuuugucgggguauuucagcugaugucaucccuguggggucuugggaagcucuugcuuucuuggcuuucuggggcuuucugguugcuacgccccaguucccuaucccccauuccucauaccucuguuuaguuuccugaccuguacaucucuguauaucuccuccaucuccuuccauaccugacucugccccucuuuuucccuuaccccacuucccuuccuuccaagucccucccaccgccugcuuccucuugauuauauuguuaccccuuguaaguaggacugaagcauccacucuuuggucuuccuuccuuuuaagcuucaugugguccaugaguuguaucauggguauuccaugcucuuugccuaauaguugcuuaucagugaguacauaccauguguguucuuuugugacugaguuaccucagucaggaugauauuuucuagauccauucauuugcaugugaauuuugugaagacguuauuuuuaaauucauuguuuuuaauagcugaguaguacuccauuguguaaauguaccacauauucuguauccauuccucuguugagggacaucuggauuguucuaaaaagucuuuacuaucuuuauuucuuccuugaccaaguuaucauugaguaggguguuguucagauuccacguguauguggacuuucuguuuguuauugaagaccagccuuaguccuuggugaucugauaguacgaauagggcuauuucagucuucuaguaucuuuugaggccuguuuugugaccaauuauguggucaauuuuggagaaguuaccaugaggugaugagaagaagguauauucuuuuguuuuaggaugaaauguucuauagaucuguaaaauccauuugguucauaacuucuguuaguuucauggugucucuguauaguuucuguuuccaugauccauccauugaugagugugggguauugaagucucccacuauuuuugugucaagugcaauuugugcuuugaaauuuaguaauguuucuuuuauaaaugcggggacccuugcauuuagaguauagauguucagaauugagaguacuuuuugguagauuuuuuucguuugaugagugugacguguacuuccauaucuuuuuuugauaacuuuuugguugaaggucaguuuuauucaacauuagaauggcuacuccagcuuguuucuuaggaccauuugcuuagaaaauuguuuucuagccuuuuacucuguguuagcauuugucuuuauuacugagaugcauuuucugugugcagcaacaugcugguuccuguuuacauauccagucuauuagucucugucuuuuuacuggggaacugaguccauugaugugaagagauauuaaggaaaagugauuguugcuuccuguuauuuuguuguuagaggaggaauuauguuuguguggcuaucuucuuuuggauuucuugaaagaagauugcuuuuuugcuuuuucuagaguguaguuucccuccuuguguuggaguuuuccacuauuauccuuauagggcuggauuuguggagauacaguguguaaauuuguuuuugucauggaauaucuuguuuuuuccaucuaugguaauugagaauuuugcugaguauaguagccucaguuggcauuuguguucucuuaggguguguaugagaucugcccaggaucuucuggcuuucauagucucuggagauaagucugguguaaucuugauaggucucccuuuauauguuacuugaccuuuuucccuuacugcuuuuaauauucuuucuuuguuuugugcauuugguguuuugauuauuaugugaugggaggaauuucuuuucucguccaaucuauuugggguucuguaggccucuuguacauuuauagguaucucuuucuuuggguuagggaaguuuucuucuauaauuuuuuuccauggacagcauggauggaagcuuuauuauuuuuacauacaugguuaugauauaauacgucggauagaguuuuuauacucacauauaauacaacgggcagaauguuaacaauauaauaggaguuuuauacccugacaaguuuaaauauaaauaaguuggggccaccuuuacugagacugcugucuuccuuuaugcaagaaaaugugggagggaccucuugggacucgggacaauucuuuuuuuuuuaaauuaauuuucaguuuaauaacagacauugagcuaacagucuuauaggacaaaauucaaugauguuuggaauacccauccuguacaaauacaacauauugcuaccugcuucuagaauauuuucuuuuuuaauauuuuuauuagguauuuuccucauuuacauuuccaaugcuaucccagaagucccccauacccuccccaccacuccccuacccacccacucccacuuuuuggcccuagcauuccccuguacuggggcauauaaaguuugcaaguccaaugggccucucuucccaaugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggggcccugugauucgggacaauucuuaagguucugcggcaagauugugcaggucagaagacaagucccugcaaacccugucagacuugauauaauggcauaaagaaacugagcagacuuuuggauccuuggcagcacuggggugagcuguaagccacguuguguuugcagaggggaggaggcuuggucuggggggcucacauaugcuugauuaugauaacucaugcucuagcuuucggcaaauuugggguucaugaccguugucguagcacucuugaagaggggguugucauugcaccauugggacuugaguuucuccuucuuaaagcaccuguacucccugaggucagucaggugggccagggccuuccagaugaucaggaggaggacaccaaucaguacgacaccuaccacggugcccccuacgauggcagccacauuggggcccuucacacacucuguauauacagcagaagaggacugguuucacagugggcagagcucaaguaucuucuucuauaauuuuauugaagauauuuacugccccuuuaaguugggaaucuucacugucuucuauaccuauuauccuuagguuuggucuucucauuguguccugcauuuccugaguguuuuggguuaggagccuuuugcauuuugcauguucuuugacuguugcaucaguuuucugugguauauucugcaccugagauucucucuucugucucuuguguucuguuggugaugcuugcaucuaugacuucugaccgcuuuucuagguuuucuaccuccaggguugucucccuuugugauuucucuacuguuucuauuuccauuuuuuagauccuagaugguuuuguucaauuccuucaccuguaauucuucaagggauuuuuguguuuccucuuuaaggguuucuaccuguuugccuguguuuuccuguauuucuuuaagggacuuauuuauguccuucuuaaaguccucuauggucaucaugagaugugauuuuaaauuauagccuugcuuuuccgguguguuaggguauccagggcucacuguggugagagaacuggguucugaugaucccauguagccuugguuucuuucuguugcuuguguucuugcacuucccucuugauaucugguuaugucugguauuagcuggucuugcugucucucacuuuggcuuguaacuccugcaagccugugugucagucaguacuccugggagaccaguucucucugggaggaauuugggaguuguggcacagggucagcucugagguacagacagaaaccagaaggauccugauccuggcuauuccuuaguuccuguguccucauggcucugggcgggucccucuuggaccaggaauuugagcagaagugguggucucaccuauguucucacuccugggagaucagcucucucugggcagaauuuggcuauggagagcuguggaacaggguuagcucuggggcacagauagaaucugggaggcaaucuauaaauuuuaaaaggaugauucuucuguaggaacuuuguuaaaauaugucaguguggaugaaaugaaacucuuguaacacuaugguauagaaauuguauaaagucaguucuuuugcaagguguucagaauaaauuguucugaagcaauaauauaaccucauuauaugaggauuacaaggguaagauauuccuaucacaaggaaucccaaagcaguauuuuugagaauucuggaguaauagauacuauuaaaagaacagucugauaaucuguugccaagaaacuaauaacauuuuuguagaaugcaguggccuuuccccaaacuccauguuuccugaccuucuguuuauuuaccacuguugacugcuuuguucuuaaaacuuuccuccuuugguuuuauuuuuauaauuuuuuccuucuguugcugggcaucaaauucagggccuugcucaugcaaugcuagcccucugucacugaacuacaucgcuagugcuccaugauggugaguucuguagcuaaaaggcauagaaucuaauauugucccugacagagauaggcuagaggucagcaguacauaugucaucuccucuaaggaugggaucuauuaaccaggagcuaaagauaaugguccaggaagggaagagucuagcauaaacuuccugagugagcucagcuuguacagauagcaaaaaggucaccagguauuaacaauauccacuccuggccaucugagcagaaaacagcuauuuccuccuucaaggaaacacuccuucaugauuaccauccugguuuccauugugaucugggcaaaaccaccuuuguacugccaaugauuuuguuuaauuuucuuaugaaaucaguguuuuuccugucuguuuugggguuacaguggcaguauaguccaaaucuugacugcucucuugucauaagcagauaguuucagaagaguaaaagggaggcaaggaucucaucuaaaggcuaaaaccaggauugauucccagagagggcauuggaauguauccaacucaagguguucuuacuagagacacaguaucuagaaugaggcugcaaguagguuguggaagauggguggggguagggguguccugguuuuuagugaaacacuuugauuuugcccuuagguaaagagggagaaaggcugcuuggcaagucaguuuggauuuaccuguaaugcucaucuacucuucuuuagucuaaccccgaacuguccuucugauugaucucuuaaaagcaguacuauuauuugauuucugugacuauccaaugcauuucaauauaugugggaguuagacgccauguucaaugccgucaggaacaaauagucaaguguuuacaaacaugcugauaaagcagugaucacacaccauuuuucugagguucuugcuaagcuacugcacuaaaaaagaaggaaaguguguacauucagaauagcaguaccgcgccagucaagccaccagaaauguacccacucuuuugaaagggcuguggccuucaaacuugucuuacuggaaaaaaaucuguaaugguaaugucuucuaauauuccaucuguguauguuuugucccagcaaauaagcuguuuuuauuuuuacuuuuuacuuuuuagggggcagcuuauaccagauuuuaagauugcuuauauuuuuuuauauaccuguaguuaauuugcuaaggguuuauuaaggucauugauuuuucucuuuguuucauuuuggugguggugguggugguggugguaguuguuuauuucuguuuuauugauuucagcucugaauuuuauuauuucuugcccgaaacuacuugcauuugagcuuucugaugugucauuaaguugccaauaugagauauuuaauguagguacuuaaugcuaugaacuugccucuuagaaucacccuuguuauguuucauagguuuggguagguuguauuuccauuuucauucaauucuaagaaauuuuuguuuccuucucaaucugucuugacccauuuuuuuauuaaguacgaguuguucaauuucuaugagguuguauacuuucuguuguuuucuauuguugauagccagcuuuaguuagaauguggaauguuauuucaguuuucuucuaucuguuggagcuugcuuugugucugagugugcugucuuaguuaacuuucuauaaggugugauaaaauaccaugaccaaaagcagcuuggguggcaguuauuuggcuuacagaucuaggucagugauggaaaucagagcagcaacucaauaaaaaacauggaguuacuuuagcaggggccaaggaagaaugcuggcuacugguuugcuccucagggcucauucagcuugcuuuuuauuaccaucuaggaccaccugacgaccacccauguuagcacuaccuacuuuggaaugggcuaaccgacaucaaucauuuauguauuuauuuauauuuaaagauuauuuuuauauuuuacaguccagcauuacccccucccaguccaccaucucauagcuccucaucccauucccccucccacuugucucuccccccaccccaaaucaagccucccuacucccuggggccucaagucucucuagaguuaggugcuuauucucucacugaggacagaccaggcaguccucugcugaaaugugucuggggcuuuacaccagauaaugugugcugccggguuaguggcucccugucugagagaucucaggggucuugagacugcuggucuuacuaugagucacucaucuccuuagcuucuuccagccuuucccuaauucagucccaggggucuucaacuucaguccauuguuuggguguaaguauuuguuucugucucagucagcugcuuguugagccucuuggaggacagccauguuaggcuccugucugcaagcacaucauagcaucaguaauagugucaggcuuuggagccuccccuugaaaugaaucccaaguugagcaggucacuggacugccuuucccucggucucuucuccauuuuugucccugcaguucuuuuagacagcaacaauucugggucagagguuuugacugugggauagcaaccccaucucuccacuugacacccuggcuuuugacuggagguggacucuacaaguucccucuccccacuguuagacauuucaucuaaggucccucccucugagucuugagaggcucucaccucccaggucucugguacuuucuagagccccaccccaccccucaagguugcauauauccagugauucuguuggcccucagggcuucucuccuggccccuaauaccuaaucauguuccuuuuuuuccccacccugucccacccagguccuucccuucccucuuccucccaugauugcuuucuucucucuucuaagugggauugaaacauccucacuugggccuucuguuuuguuaaccuucuugaguucuguggauuguauguauccuagguauuucuguacuuucuuggcuaauauccacuuaucagugaguacauaccauguaugucguuuggggucugacuuaccucacucaggaugauacuuucuaguucuauccauuugccugcaaaacucaggauguccuuguucugaauagcugaguaguauuccauuguguaaaugaaccacauuuucuguauccauucuucuauagugggacaucuggguuguuuccagcuucucgcuaucacagauaaggcugcuaugaacauaguagagcacgugcccauguggcaugguggggcaucuucuggguauaugcccaagagugguauagcuggcucuucagguagaacuauuuccaauuuucugagaaacguccagauugauuuccagagugguuguaccaguuugcaaucccacuagcaacagaagaguguuccucuuucuccauauucuggccaacaggugcuaucaccugagauuuugaucuuagccacucugauggguguaagguguaaugucagggucauuuugauuugcauuucccugaugacuaaggacuuugaacuuuuaagugguucuccaccauuccagauuccucuguuaugaauucugucuaguucuguaccccauuuuuugaucugcugaagacagaccucaacuggguccucgauaaccaggaaaacgggguuccgguacuggugggcaaagaguuggcaagaaaugacaaacaaauacaggacacaagagagugugcuguaucugaauguaacuugucaaaucgagcaucaaacuuuuuauacagaagaaaauagggaaguuaggugacacauaggcaggguacaaugaggucacuggaugcuuaaugacucuuacacaaaacagaggaaugcaaacacaaagacuggcaggaacugggcaauaaaacaacugagacaaugucagcccuaucuaaggucagcuauauucuuagaagccaguugugaggucuuuacacuccugggacaagggcuuucaugccuaagccaugguucuaauuugggaguuccgcucuagcuaacuucucaagaauaaugcaauacucuaaaaucacagccugaucuacucucuaaaccauuguaaauugcuguauaugggagcaacuuggcuuuuauucuaagugauaguauggggggacuuucuacuaauaaguaauguagugugccaaacauaacuauaauaagaauuuuaaacuuauuuugcuaagccauacauaacuauaauaagaauucuaaacuuacuuugcuaagcuugcccugagauuucuaacucuauguaguggauaguaaugccugauuucuuucacuaucucucuuacaauacuagaggcaguucuguaugucacugaauaggcaacauucuuauugaauucaaagcccauggucggcucaaggacuaccuagggcauuggugaaggccaggaagcaaaguucaauuuugccuagguauuuggcaagucauugcuuuuaggcacgcauaauaaagcaauacugaaagaaagcacacagauguauucgcaaggacaaguuuggaacauucguuauaugguauggcacaguuccaggagacuaaguuuccgugaacuuuucaccucaggacuguguccagguuucuacuccugucacacaugucacuaauggaguggauguagcauugaucggguuguuugauuuuuuuuugggggggggagguguuagcuucuucaguucuuuuuaaagauuauuauuagucauuuuauucauuuacauuucaaaugauaugccccugguuaccacucaacagucucccacuuccucccucuccccucucccuccuaugagggugcuccuccaccugcuuacccacucccaccucacugcucuaacaucccccuacacugggcaucaaaccuacacaguaccaagggcuuucccuuccauugcuuucagaugaggccauccucugcuacauaucuaucuggagacauggaucccuccauguguacucucugguuggugguuuagucucugggaacucuuggugguccuguuaguugauauuguuguucuucauaugggauugcaaucuccuucagccacuucaguccuucccuuagcucuuucauugggguuccugcuuaaguucuguauacauuuuggauauuagccuucuaucagaugugggguuaaugaagauuuuuuuuccccaucuguagguugccgauuuguccuacugauuauguccuuugccuuaaugaaccuuuucaguuucaucaggucccauuuaucaauuuuugaucuuagagccugagccauggaaggucuguuuaggaaaugucccccacuccaugccaaugaguuccagucucuuucccacuuucucuucuauuggauuuaguguaucuguuuuauuuauuuuuuuuauuuuuuagauuauuuucuuuauuuacauuucaaguguuauccccuuuccuauuuccccucugaaaauccccuauccccuccccgcucccucuacuccccaaccuacucacucccauuccuggcccuagcauuccccuauacuggggcagagagccuucacaggaccaagggccacuccucccauugaugaccgacuaggccaucgucuguuacauauauagcuaaagccacaaguuccaccauguguuuuuuuuauugaugguauaguuccaaggagcucuggggguacugguuaguucauauugauguuuguccuaugggacuucagaccucuucaucucccuggguacuuucucuggcuccuucauuggggaucuugugcuucguccaauggaugacugugagcauccacuucuguauuugccaggcacugguagagucucacaggagacagcuauaucaggcuccugucaggaggcucuuguggcauaugccuagugucuggguuuguugguuguuucugggauagaucccuaaguggggcagucucuggauaguuguuccuucaggcucugugccgaacguugucucuguaacuccuuccauggguauuuuguuccucauuuuaagaaggaacgaaauauccacacuuuggucuucuuucuuuuugaguuucauguguuuuacaaauuguaucuuggguauucuaaguuucugggcuaauauccacuuaucagugagugcauaucauguguguucuuuuguaauuggguuaccucacucaggaugauauccuccagauacgugcauuugccuaagaauuucauacauucauuguuuuuaauagcugaguaguacuccauuguguagauguaccucauuuucuguauccauuccucuguugaagggcaucuggguucuuuccagcuucugucuauuauaaauaaggcugcuaugaacauaguggagcauguguccuuauuacaaguuggaauauuuucuggguauaugcccaggagagguauugcaggaucuuccgguaguacuauguccaauuuucuaaggaaccgccagacugacuuccagagugguuguaccagcuugcaaucccaccagcaauggaggagaguuccucuuucuccacauccucaccagcaucugcugucaccugaguuuuugauuuuagccauucugacuggugugagguggggucucaggguuguuuugaguucuauuucccugaugauaaaggauguuaaacauuuuuucagguucuucucagcccuuugguauuccucaguugauaauucuuuguuuagcucuguaccccauuuuuuaauaggguuauuugauuuucuggaguccaacuucuugagauauauauauauauauauauuaggauauaaggccacuaucggauuuaggacugguaaagaucguuucccaaucuguugguggccuuuuugucuuauugacagugucuuuugccuuacagaagcuuuguaauuuuaugaggucccguuugucgauucuccaucuuacaaaacaagccauugcuguucuguucaggaauuuuuccccuaugugcauaucuucaaggcucuuccacacuuucuucucuauaaguuucaaugucucugguuuuauguggaguuccuugauccacuuagacuucagcuuuauacaaggacauaggaauggaucaauucucauucuucuacaugauaacugccaguugagccagcaccauuuguugaaaaugcugucguuuuaccacuggaugguuuuaggucccuugucaaagaacaagugaccaucgguguguggguucauuucugggucuucaguucuaguccauugaucuaccuuucugucauuguaccaguaccaugcaguuuuuuaucauaauugcucuguaguacagcauuuuugacaauaguuuuugcuauccuagguuuuuuguuauuccagaugaauaugcaaauugcccuuucuaacuuggugaagaauugaguugggauuuugauggggauugcacugaaccuguagacugcuuuuggcaagauagccauuuuuauuauauuaauccuaaaauagccauuuuuacuauauuaaucuugccaauccaugaguaugacagagcuuuccgucuucugagauuuuuuuuuaaauuucuuucuucagagacuugaaauucuuaucauacagauguuucacuuccuuagagucacaccaagguauuucauauuauuuguaacuauugugaaggguguuguuuuucuaauuucuuucucagccuguuuauccuucucuacauaagaaaggccacugucuuguauauuuuauauccagcuacugcacugaagcuguuuaucagguuuagaaguucucugguggaauuuuuagggucacuuguauauacuaucauaucaucugcaaauagugauguuuugacuucuuccuuuccaauuuguauccccuugaucuccuuuuguugucaaauugcucuggcuaggacuucaaguacaauguugaauagguagggugagaguggacagccuugucuagucccugauuuugugggauugcuucaagcuucucaccauuuacuuugaugcuauuuacuauugguuugcuguagauugcuuuuaauauauuuagguauaagccuugaauuacaaucuuuuccaagacuuucaucaugaauugguguuggauuuugucaaaugcuuucccagcaucuaaugagauguucauguguuuuuugucuuugaguuuguuuauauaguggauuauguugauggauuuccauauauuaagccaucccugcaucccugggaugaagucuacuugaucaugaugggugaucauuuugauguguucuuggauucgguuugcaaguauuuuauugagaauuuuugcaucaauauucauaagggaaauugguuugaaguucucuuucuuuguugggucuuuaugugguuuagguaucagaguaauuguggcuucauagaaugaauuggguagaguacuaccuucuguuucuauuuugugaaauaguuugaggagaauuagaauuaggucuucuuugaaggacugauagaacucugcacuagacccaucugguccugggcuuuuuuuguuugggagacuauuaaugaaugguuguauaucuucaggggauaugggacuguuuagaccauuaaucugauccugauuuaacuuugguacuugguaucuaucuagaaaauuguccauuucauccagguuuuccaguuuuuuugaguauagccuuuuguaguaggaucugaugauguuuugaauuuccccagguucuguucuuuugucucccuuuucauuucugauuuuguuaauuaagauacuguccugguacccuguaguuagucuggcuaaggguuuaucuaucuuguugauuuucucaaaacaaaacaaaacaaacaaaacaaaacaaauaaaacagcuccuaguuugguugauuuuuguguaguucuuucuguuucuacuuaguugauuucagcagugaguuugauuauuuccugcaaucuacucuugggugaauuugcuuccuuuuauucuagagcuuuuaagugugcugucaagcugcuagugugugcucucucaaguuucuuuuugguggcacucagagauaugaguuuuccucuuaggacugcuuucauugugucccauaaguuuggguauguuguggcuucauuuucaguaaacucuaaaaagucuuuaauuucuuucuuuauuucuuccuuuaccaaguuaucguugaguagaguguuguucagcuuccuagucgacaguggcuuucuauuauuuauauuguuauugaagaucagccuuuguuuguggugaucugauaggaugcauggguaauuucaauauuuuuguauuuuugaggccuguuuugugaccaauuauauggucaauuuuggagaagguaccaugaggugcugagaagaagguauaucauuuuguuuuaggauaaaaugauuuguagauaucuguuaaauccauuuguuuuauaacuucuguuaguuucacugugucuauguuuauuuuuuguuuccaggaucugcccauugaugagaauguaguauuaaagucucccacuacaauugugugaggugcaaugugugcuuugagcuuuaaugaaguuucuuuaaugaauguggauguccuugcauuuggagcauagaauugaguucaucuuggaugauuuuacuuuugaauaugaagugccccuccuugucuuuuuugagaacuuggguuggaagucaauuuuauuugauacuagaauagcuaguccagauugguucuuuggaccauuugcuuggaaaauuguuuuucagccuuuuacuuugagguagugucugucuuugucccugagguggguuuccuguaugcggcaaaauauuggguccuauuuauguagccagucaguuagucuauaucuuuuuauuggguauuugaguccauugauauuaagagauauuaaggaaaaguaauuguuacucccuguuauuuuuucuguuagauuugggauucuguuuuuguggcuaucuucuuuuagguuuguugaaggauuacuuucuugcuuuuccuaaggugucauuucccuccuuguguuggaguuuucccuguguuaucuuuugaagggcuggauucguggaaagauauugcgugaauuugguuuugucauggaguacuuugcuuucuccaucuaggguaaaugagaguuuugcuggguauaguagccugggcuggcauuuguguucucuuagggucuguauaacaucuguccaggcucuucuggcuuucauagucucuggugagaagucugguguaauuuugauaggccugccuuuauauguuacuugaccuuuuucccuuacugcuuuuaauauucuaucuuuauuuagugcauuuguuguccugauuauuaugugucgggaggaauuucuuuucugguccagucuauuuggaguucuguaggcuucuuguauguucaugggcaucucuuucuuuagguuagggaaguuuuuuggguuuuucgagacaggguuucucuguguagcccuggcuguccuggaacucacuuuguagaccaggcuggccucgaacucagaaauccgccuaccucugccucccgagugcugggauuaaaggcgugcaccaccacgcccagcuuggaaguuuuugucuauaauuuuguuaaagacauuuacuggcccuuuaaguugaaaaucuucauucucauuuauacauauuauccuuagguuugguauucucaugguguucaggauuuccugaauguuuugaguuaggaucuuuuugcauuuugcauuuucuuugauuguuguguccauguuuccuauggaaucuucugcaccugagauucucucuuccaucucuuguauucuguugcugaugcucgcaucuaugguuccugauuucuuuccuagauuucuaucuccagaguugucucccuuugugauuuccuuauuguuucuacuuccauuuuuagauucuggauaauuuuguucaauucuuuccccuuuuugguaguguuuuccucuaucuaucucuuuaagguauuuuuguguuuccucuuuaaggguuucuagcuguuuaccuguguuuuccuguauuucuuugagggaguuauuuauuuccuucuuaaaguccuccaucaucaucaugagaagugacuuuagauccacaucuugcuuuucuggugugaugguguauccaggacuugcuauaaugggagaguuugguucugaugaugccaaguaaccuugguuucuguugcuuguucuuauguuugccuccugucaucugauuaucucaagugcuugcugcccucaauauaucugauuggagccugcccuuccuauaauccugguugauucaggaauccucagaguccagcuugcucugugauccugugauuccuggauccugugaaucugaaauucuagguaugucagagaccuuggcagucaagcuucuucugagacccugagauccuggugugaccuagcucaugguauccugaaauccuaagauuguggucauguuacagcuccuggaauuugugucuccucuggugacuguggggcugucugguguguucgaagccaaguuauaccagcacugaucugaaguaacccaaaccgcuggucaggcaggucuccuguguccuugcuccugcugucacaggccugucacgauuggcuuggaacagguguuguguuccacucaccagugauccuaagguccuuggcgugcuagggugccugugguguggagaguccucugggcaggugggacuguccaccuaguucacgcccaaggugguccggagcuggcggugacuggaaggggaguguauuugguuuuauguugagguccuugauccacuugaucuugagcuuuguggaagguggcaaauauggaacuauucucauuuuucuacuuaccaauugacaguuagacuaguaccauuuguugaagaugcuuucuuuuuuccaguguauacuuuuggcuucucuuucaaagaucaaauguccauaaguguaugguuuuauugcuggguauucaucucuauuccauugauuaaucugucugucucuguaccaauaccauucaguuuuuucacuauugcucagggauggugauuccccuggaaguucuuuuauuuuuaucuuuauuuuauuugagaauuguuuuggcuauccuuggcuuuauguuuguccauaugaaguugagaauuacucuuuccaugucuguggagaacuguguuggaauuuugauggggauuguguugaaucuguggauugcuuuuaguaggauggccauuuuuacuauauuaaucuuaccaauccaugaacauaggagaucucuccauuuucugaggucuucuucaacuucuuucuugagagacuugaaguucuugucauauagaucuuucccuuguuugguuagaguuacccccccccaauaaauuuuacauuauuuuugacuacuguaaaggguauuguuuccuuauuuucuuucucagccuguuuaucauuuguauacaggaaggcuacugauuuguuugagguaauuuuuauaucuagugacuuugcugaaguuguuuauaagcuguacaaguucucugguagaguuuuuggggucaguuauauauacaauguaacugauuugcaaauaguaauaccuugacuucuucuuugccaauguguauccccuugaacuagcuagaacuuagaauacuauguuaaauagauacagggagagugggcagccuucucuuguccaugauuucagugggauugcuucaaguuucucuccauuuaguuugauguuggcuguuggauugcuguagauugcuuuuauuauauuuagguaugggccuugaauuccugaucuuucuaacacuuugaacaugaagggguguugauuuugaucuucccugguagaaggcgggcuggagggaagguggaauuugaacugggaggauggauccuaagucuacugggcuccuugggggggggggucccagcuacuucgauuauuugggagggucccuugccuguugcccugccugcagcagaucuucuggaaggccuucaggcugugaggucuguugcccuggguccagcagaucuccugggaggcagucagauuguggggucuucauaggggcagacaagcugaugagcugccuuggcagaaggccuuacuuauucauuuuauugauuuuuuuucuuuauuuacauuucaaaugcuguccgccuccccagucuccuuucugcaaagcccccauccaucucccuccccuuugccucuaagaggguacucccacccacccaccccggucccaccacuacaucaaucauuaaucaagacauuuuuccauaguuugucuacaggcaaucagaugggggcauuuucuuaauuaaggauauucuuagauggcacuaggcgugcucuggugacaaaacaaaaaacaacagaaaacuaacuggcauagauguguaaguauauuaucccauuaagaggauaauuauuccucacaugucgaagacauguuuucaaguauuucagcuuuucugagagauguuuuccugaucaggugauugacaggcauaguugaauugacucuuaagggggaguacaguaguguauaauguuuuaggcuguuuauagugccaugacuccacccaaggucaaagguaaacuuagccuucccuuaacggaccucaggaaacccagcuaccuuuauuuucucauaaggugcuuuaaguuguuuuuuuuuuuuuuuuagauucaucauuuuauuuuauauaugugaguacaucggauuccguuacagaugguugugaggcaucaugugguugcugggaauugaacucaggaccucuggaagagcagucaguguucuuaacugcugagccaucucaccagcccccuaagucuuuuuaaaaaaagcaucacaaucacagccccucucacucuuacuuuuccagucccacuguuacaaauauccccuccuuccuccucuacacaaauaucacuccuuccuccucuacaccccaccuugugacauccagucccagcaggacugggugcuuuaagccuugaaggacaauuacaaugcuucccuuucauuguuuuuuuuccuuuuuaaagguuauuuuuauuucuguguaugugucugaguaaguguauuucauauguauccagaugcuaauggaggcuagaaaaggguguuagauucucuggagcugguuacuaguucuggcaacugaacuaaggccuucuagaaaagcaagacacaguuuuaacuacuggguuaccuuuccaaccccuccaucuccuucuuaaaauugguuuguuacuagggaaauaagaggugaguuucgaaggaugucaugagaagaggaguugaucuccaguggcaucuaagccugcuaaugccuauagcuuccuguguuaggauuuacuagaggaacaaaaccaauagaguguguauuacaaagggagucugcuaaaugucuuaaauguuucaguuuggauagcugaauggcguucugcaugcuguagaggcugagaaccugauaguugcuuagucugauuggcuuggaggauuucugcagaacugcugcuuuucaauccacaaugaaaggguaaggaagcuguguucugaugucaguaaagggugacaguacuaauggcagccacaagucacucaaccaauaaagagcaaaggcaagcagagaacagcagcaguauuuuuuuccucagaacauuuuuguaucuugaucacuuccagaaaguacugucuacucugggagacauuuuuuacccacucaguuaauucuuccaggcaauauucucucagacuugcucagaggcuuggcucuuaguuagcugcagaucuaaucaaguuaacagccaaaguuuuaaccaucacacuagcaaagacuugugguccuucuuagugauucgagcuacaccgcucuacuuugauguucccagacuauauggcaugucaccauucagucacugacugacuuguugcuauguuucuccucgcucucacucuuccucucuagcucaacuccgauuagauaucacuuguuuuaggaagauuaguccaagucuuuugcccauacuggacuugguuucuuucuguuauuuucuaccauugucuaccuaccucuacagugacugacuucaguuuguugaaauuaucagcuuaugaaucugccccuuaggguauacagaacaaaucauuuuacuccuaauuucucuuuugggcauuuucaauaaauaugagauagaauauuuaacuuucaacaucagaaaucaauguaaguuauauugucaguguuuuggggguagagggaaaggaggcauacugauacuacuaccuucagcagccugaaaaguuuaacaaaagauuuuagaaccauaaugcagccaaaccagaauauguggcuucgaugcuggaaagaauuucaggacagaauaguuuaugcaucagaauuauggauuuuuauuaaagauaauuugaauauagguuuaagcaccaggacaagaagaaacagugcugauaagaaaguaagacauaagauaccugacagcauagcaucucugcauccauuccauaaagguucugggguugguuuguguucuguuuuuauuuauuuauuuauuuauuuauuuauuuauuuauuuauuuauuuauugagacaagaucuuacuauauaguccugacuuacuuggacuuugauagcuuuguagaccagguuaguuagucuugaacucacagagauccacuugucuuugccccuagaguguugguacuaaagguauggaaaugcaucauguagcagcaaggcaagguuuuuuuuuuuuuuuuuuuuuuuuuacaguagucauauauaguauuguuuugaugggguucaaaguuacugucuuaucacugggugguuucuaacgggccucugguaggauaaaaguuaauaagguaaaagucuagcacacagagauacaggaagguaaacaaggugaaggauuucagaguuucagauaaugcuugggaaaguaaggaccuauagccaauauguguguguaauaccuauauauggaaagaauauuagcuuuaugccagcagccuuuacagcagaugguaauugugcuggaauuguuucuuagcuugcaagaggcuccaauuacacucuaggauauggcgcucuaaucaugcagggcuuuaaucaugcauacucugucuuuuauucagucauaguaugacaaguuagugauaaggaugaacugaaaaucaaguccuuugaaaucuagaugaguuagugcucaugugcuugcucucugucucacucugucugucugucucuuucucugugugugugugugugugugucucucuuucuguguacauguucauguguguaugcacccaugugcauaugaguguauaucaaagcacacacagagaucagugugcuuugaucccucaucagauuaucuuuugacccagugucucacugcauguagaagucuccggaaaucuacuuaucuccccuccccccacuaguguuacacauacaagagaccauauuuggccuuaaaaauauguuuuaucuuuauugagauuuucauccaugaguauugugguguaauuuccacccuucguucuccccuucugauaucacuccuuguuccccuacucccacccaaauuuaugacuucuuuuuuauuauaacuuguuauaagucacacacacacacacacacacacacacacacacacacacacacacaaauagaaccuucugagugcauuuaguguacuguuguauauuuguguuuagagcugaacacuugggacuggauaaccuaucagggcuuuucuuuggagaagacugauucaccagggaacaaugaauugaccuuuguuuguuuguuuauuuauuuguguuuuuuauuugugggaccuugcuauauucccucuguccacuuuugaaugccaucugguguuaucauuguccagguuuuguuuagacaaccauauuguuaggauuucacacuuggcucuuuuauguggguguuggggaucaaaacucagcucucuuuauuuuuacgugguauguauuucaacugacuuagccaacuccucagcccacaguaggcuucaaaguaauaugacuaugccauauuuuuaauugguaguaaaugugaaauguauaccaccaauuuuaaaauaaaccacaugaauaaaggacaccuggccauuuaugaugaaaaguaagauauauuaauguuacagaaucaggaggcuuauacaaauaagccuuaacuuacuuaauuucuuauuuauaauuuuugauguuuaaaaauuuuauaaaccuaaauauuucuucuaaaucauuuaagcaacagcuauugaucuaaucugaucugaguuuuuucuagccuuauuuacugcuuaaacugaauaugcauauauuuuauuauagaaauguuaacauauuuuauuaugaaaugcugcccaaggcuccuuggaagugucaaaaaguaaucaguaaauuacaucaugcuucuuaaaaaaaacuuuguauucugauccauagcuggcucuaauagauugagaacuauguaguuuuaguucucuucccccaagacugcaguuaacaacauaacaacauaaagagguaauagguaaaucauauaaauauauuuuuggccuucacucacuauuuuauuuuaugccuggagauguuuugaugauuaauugagggaaaaguguuucuucccuucacaucugucuuaccuauuggagcucagugacagcccaguaauguaguuuuagcaaagaaaagugaguauuaccugcaaaaccacccuuucaaaggcagccuuauuuaucucuagcucccacaugcucagagccacgcugcucuggacaguuugggguggcuugacguucuauuccuuaugcugcuuagcacugaguuaaaaagauaggaaaucuguuacuuucucuuucuaaucuuauaugcuaaccuucuuucucucuucuuuggguuucccuacauaaucucugccaugaaaauugcccccauuucauguauguuugguucuuuagaaacugaaaguuuuauaaaccauaaucaacauuucuuaauacaaaucaacuauuauuucugagguaauguucuauucuaaaggaauuacaugcccagaggggagaaaguuauagcuuaacagagagauagggaaaaaaauguacuuuacauguucuagguuuggacaugaauccuggcccauuaaauaauguggcaaccuuagggcaguuacuuuccuuauuggugucucaguuucuuuaucuaaaaaauggaaaugacaaagcuagugccugugcuugucaucaggaaaauuaaaugagguuuuagauacaaguacuauuauauggacuauaugauuuaaagaucacagaugugaggggguggacaugggagagcuuuggaggaaagaaaggggagauauauaauuauauuuuaauuuaaaaagauaauaaaaguuaaauaaggacauuaauacacauaaaggcauuagugauauacucuguagcaugccugaggguagcauguacuagcuggugugacaguacagugauaccugguauaagugcuaguuugauaauuuccaaauaggaaauccaguauuucuaggauuuuugugagaauuaagugagauaaacuauaugagguuucugggcaagaucuugacacacaaugucuucguugcacaaaugaccccaaaaguaaguuaaaaugcauugaaaaauuguaauagugaugcaguauaaaccauuacuauugauuugacagucauaggacggaauucucucuggaggaggagugaaaaggaagcuguccuagauuagagaauauguaaggagauuuuugaguagguaccauucaugcuacagaggaauuugaugccacacugauuguggaggaucauaugaccacaaugacuagugagaaugauaguguguaaugauaaauuugaaggagccaaaugaaguauauuucuuuuuagaaugaaguaaaaaaaauaucagacaggaaaguuuuguaaugugggcaaauaguguugcucucuuaguacuguucaagaguaaaggugcccuugaaguuuacauauuguaacaugcuuuaauccuuuaaggaagaggaugaacaggauguugaagguuuugaagaaacagaaaucaaaagggaagaagccuaaaggaaggaaggcgucagaagagagagguaauaauaggaggaggcaggaggucggaguuaacugacaggaacauauaagugcucacugauguuacuaacuuuuuuaugucuaugauuaauauauuugacugacacuuauuuuuuauuuuauuuauuuauuuuuuugagacaggguuucucuaugcuauguaguccugacuguccuggaacuuacacuuauuuuuacaggcaaauauuucagaaaguuuuaucaccugaaacuguaugacaacuagggauauuugaugacaguaaaauagugaauagaaguaccaaguguuugggugcugcuuugcuaaagaauacuuuauucgcaguaaauaaagaaauggaauugucuguuuugacucuuaauucuccaugcuauucaauaacuuaucauggccacaguuaccaauaugucuugagcauaauacuuaccgaaggaaaggcuggcacaucuuuaagacuuuaugugaguucauggaaaauaauuaugaggugagguccccuuuuucuacuccuuuuaauuuugcauugugcauauuuaaggagcaguaguauaaaaaacagguaaaagugcaaaauaagauccauguguuuaucagacauguugaucauuauauacaguuuauuaguuugaaacuugaguugcggucauuuacuuuuauaauacauuaugauauaugugucuauuaguccuuucaaguugcuuaacucuguucuguuuuucucucauagcuuuacugucccauugaaaaugcagaucugccauggcagaagagaggagacuuugucauccaaaucuaauuaaauuuugaaaggcaacuuuuauuguaguuucaaaucaaauuaaaguuccauugcaugcaucaaaucagaau

SEQ ID NO: 9525 - RNA, 4242 nt, Mus musculus
uuuuuuuuuuuacaauggcacaagaguuuuaauacaaccaccagucuucacaaaauaauuuuaauacuuugugcccaggcuagcagcaucuugcacugugacauuccuauacauacauaagcauuuuaucugaguacaaauguuaaaaguagaauaacguaagcaauugccuauacagagguaaagagacacauauguuacuguucuugagucauuuuugcugcauaguaaauugcaauuacaugucaguaucauguuacugauugagaaaacacuuugaacugugagguaugguagcucccuguaagagagcagaacauguaaaccugaauauuuugagugauuuuuuuuuuuagcugccauggaugggaaagacaaaagaauuauccagcacucaagacucuagaaacuuauuuuccuaauaaaaauaaauaaacaaaauccuugaguaauucucagcuauuuccuacuauuugcucauuggaguguuguugaauggacaaagauacuguaaauacugacgugaaguuaugcuuuaggauugugaauuaaaccgguuauuuaaaaagauccaucagguaacugcucauuuacuuuacaucaaguugacauccuaauauauacauccaacuucauaauucaagauugcacuuaaauacuucuaauucaugugaauuccauagcaguuaaacaauuaagaaccuuauguuuuauuacaaaggacaugcuuagcauuuucugacauuacuucuagacucagauuaaguagauuaaguacagcccuacaccccuucaaaugaauauucuguucuacaggcgguugaaaguugguagcaaaguuaucacacuugaacauuccuacuauagaguugguauaacaucuaauagacaagaaacuagcaugaaucaguuaaacuaggagaagacucccuucuccacuccaguuuccaggagcugucucaaacuuucaaauggggaguaaugaaguucccuaaguuuugauaagaaaauguauaguuuuaauuaugaacccagcuuucauauuuaauacugaaacuggguggacauucauacauuauucaaguugucuagagaauaaaucaugauuggauaaauuuaucauaguuaacuuacaaaacaucacuagaaauggaaccuaagacagcuacugacaguaaauacagaggaagaaaagaaacuuggaggcuucuuaugaaaggacaaacuucaucuguccacaucaacugugcucaacaugguggcagucccuagugucugagacugucuccaguauaucgugcuggauaggcacuuuaugugagaagaaaaaaaugacaguggauagaaaaauggaaaauuaccagcuacaaaugaaugucaauaaccucuguuuuuggacagacuccuauuuaaagaggaacauguauuuuuauaaaacuuauuuuaaaaaguuacuucacaugucucaucuugaaaauccaauuuuuuuaaaauagagauugcuuuaaucacaauuucuguucagugagccauggauuauggguugacuccaagagagaucuuuguuggccuguauguauacagggauuuuugaauacccaauguaaucuuggcucugcuagaccaccaugccugugacacaacagaauuaaaagcaaugcuuuuuuucagagcugaaagauaggagaugggaugggaaaccagaagaggcuagaaaucaagguaacaguaauucugguuuauauucaggcuccuacugugaaggacaaagaaccuuucuauacuguugaugucauaggguggugagcaaagcaaggaacuuaagugcaaccuguuaccuuacacagugccucaugguacccugggagugugcgggcaucauucccaaccguaaagcaccucgaaagagggcugagacacgugagcuauauauauauaaaggagcuguguuugugcuacccuaaagucaucauguacaaaaguuaaaaacacuucucucuucugcacaucacauuuacaguaguaaaauguuuuuuguagaacaacuuuuauacauauagauaaaaacauggaaaacuaaagagccauaaaaugauuuugcuaaugcaaauuaugguacaaauuugaauuaauuuaggaacaaguuaaaagaguaaucuacaauacacugaagccacccacaaauugcuuuccccaauggauacaucuucaaagcaaagcugucagcugaaccucagagaaauaauuaacagaaaauagaaggaagugucucauuccaaauaauuuacuuucuucaagcaucagauuuaauuuaugauuuuaaaacaagaaauuacagaaaaacguuaauagcuguucacugcuuuauauacuaauuuagaagucaugaggauuugcuuguuuguugaugcaaggcacuuuucuuuuggggguuucauauugaagaaacagugcuacauugguuuggucuacuuugaaccauuuuggacaaaaguuagaagagcucagcaacucugaaaagaccaagucuacauuuggcuuaaacagcaaagagaaaaaagucauguggaaaauauaacacuauccuuauuuuuuggaguaucugguuuuagaaaguaagaccucuuucuuuaaucauuucaacuuuucucauuuagaauaagggaggcaauuagaaaggaaguauuaacuguauuaaauuguaaaguaggcuaguuggcuaaagucaugauuuaaagauacgggaccaagaaguuuaaaaaaaugguaaucaaguuacugaauuauacuaaaaaauguggacaaguucuacauuuuguuaauguuuuuguaagaggcuucaucauaaaauugaacuguaaaauuaccuuaaauguaauauauauaacacaaaaugaguuuuuaggaaacauuaggaaauuuuuuuguuauaaauuauccaaaaucuauaaacaaaucccccuaacuuguauuuuguuuaaaguaauaacuuuauaucauacaaauaaauuucaaguaugaaaagugcauuauugcaauaauaccucuuugcaaguccaaaauucuugguuuauaauaaaaccauaaagguuuuuuuguuucuuuuuuucucuuuuuuuuaaguaaacccaucacccaucagugccaucuacugcauaaguccaacaucuuaaaguguugcagagaaacaugucuggaagcaauguauaauugaaaagaaaguauuugugaguuuaccauuucacauuaucaucacuaggauccucuccuuuccagauggaagcucacacccauguaacaguccucacaggucagccguucugugcgguugccacuugcauguuuccaaagucgucaucuuccucauguguucucuucacacuaccugugguaccagaaugaacagcuaaggaccuuucuauuuggaguggugacaucaucuguauuguuaauuuugcuaaguagauggcuucauauuccugaaguugguggacaaauccagcauuaggauuaauacaaaaucuccuuucuuggacauaagcaaaugcaucucuguauuucaucccaaacgucuccaugauguaugcaaugacaaaggcagcacuucuagagauaccugcauucccauggacaagaacuuuuccuccauuuuguaagcuuccaucaauaaacucuuuagucauagggaaaaaacguauuauguuuucaacuggauuaucagcaauauccaaaacuaaauaucuaaauaauuguugaaaguuugguuuaauaaaguuugcuucaauauuuugccguaugcaaauuauaugaguuaugccauguuucugaaguauagguagcuugcuuuucauagcagaagaguaugggccuaagaacaauccaggcaaaacuuccugcaucucucgucucauaggguaaguccacuccucggcgucgucuuugcacugcgggagcgaggggaacuccaguuucacguccuccauggucccagggccccggugggugggcgcggugcgcccggccgcccuccgggcuggcagaggcgacaagggaaggagggcgggcgggcggugggggggcugacgcgcggcaggcucacagcaagcacucgcggaccacaggauccaagcggcugugacaggaaggcggagggcagggcggugcgcugccggccgccaugcugcggccgugucccucccgcaggucuccgcgccccucagagagccgggauccggccuccug

SEQ ID NO: 9526 - RNA, 1412 nt, Mus musculus
auuuuuuuuuuuuuggaaggguauuucucauuuuacugucugcagcacauuugugaauagucacguguaacaaaaaaacaugauggagaaaaccugucuuugcuacacaagcuaacuucugauacacaccaaaaacuaccuucacaccuaagcgggugcauacaaaucaguaccagugacugggaagcaugacugaggccuagguuuaaucccuuccacuaccauucaccaagaaugcagccacugccacuguaggggcagggaggcugguagcgcauggcugauaccuuuugggacagaaguuaaucuuuuuaacaaguuucaaaggcacaguguuuuuuacuuuaaaggcuguguuucuuuaauuauuaaucuuaguaauuuaaggccucuucuaugccauccuacauuuuaauggucuccaaauguuauuuauuuaccuugggguagaagcucaauacauaguaauuugaaaauaaucacucuccccauauucuagcaguccuauagauguauuccuucugucucaucuuucccaucauuuaucuaguuacacuauuaaugaaagccaaugaaagauucaaggucauuauuuauuuguugcucuuaaagacucauuuuugacuggacucagacuuagaaguagaagcucucagugaggacagccuacgucucuuggcaaucuguuccuggcgcuuuucuuuggcuuccuucauucucuuggccaaaaguuuagcguauucugcagccuccuccuuguucuucuuaguacguugcuucuucagagcauuacgucggcguuuguguugcaggacacgaggaguaacaagucgcugaaucuugggugcuuugguccugggcuucuuaccuucuuuguuuaagggcuuccugacaacguacuggcggacaucaucuucuuuggagagauuaaaaagcuuucggauucuacuagcccuuuuaggucccaaccgacgaggcacaguaguaucugucaguccaggaauauccuucucuccuuucuuuacaaugaccaaguugagaacacugagauuagcguccacaaugcauccgcgaacagacuugcgcuuccucucuccaguucuccuuggccuguaacaggaaugccccuuacucaacagcaggcgcacucugccaugggucagaacaccuugcuucaugggaaaaccuugcuugucauucccaccgcugauccggaccacauaacccuuccacucuucaccaagagcaucagcggcuacuuccguggccaugcgcuucucauagaaggugcggagcuugcgcucgucauccaccucgaugagcuucugacagccgguggcggggaaggagauguucagcuucaucuugacacagccgagcgccugggaggcgucacgaaaaagagcccagag

SEQ ID NO: 9527 - RNA, 22116 nt, Mus musculus
ucuagcuucaucauauuuuuaccauuucacacaauaagcauacauuacucuuauaauuagguagaaagacauuaacauuaagaaccccaaaaaauuucaaaggaaaaugaguauuuauucaggucccaaauagaguuguucuacgcuuagaacaaauauacaggaaaaacugucacacaggaaaagagcaauuuacuuuauuacauuaaaagguaagauccauaacaugaccacacaaagucacacaacugucauacagagagcauaaugguucaugucguuaaucagcaaagaaucagauauuaaagcagaauacaacucucaucuauuauuauaggacuacagacuuuccuuuuugguauuaugguuuuuaauauaggccuuuugaguuucuuuucuaaguuuaauaugcuaucauagcaagagugaagagaaaacggagcuguuuuugaugacuuggcacugagaaacuagccuaugggaauacuuugaaauacguaaaaacacuauauucacaaaauugaucacagcauuauuuguaacacugaaaauuuggaaauaaucuaaauuucuaacaacugaaagaaggcugagaaaauuacaauaaaucuaugcaauaacacauauuaccagcaauauaaaauaucugcaaaauucacuaauaaccaaccauacauaauguucagaaagaaagagcagaaguuguauuauaaacaacauagaggaucaagaaauguaaaacauucauaccccaaaaagaacaaacuauggcaaucuuaguauaaagcacucagacauuuucuugccuuuuaaaaugcauuucugcuuuccaauuucuguauaauuaacauaucaaacucaugaggaaaaaugccuucuaaaaaaauguagcaaauaacagauuuuuaagauguguucauuuucccccauaauacacucuagagaguccugacagccucagcuucuaagcagggggguaggggagccaggcuaugaagaauggcugugaagggguuggagcaaagaagaggggacaaaggcuugaaggaccagggagguaaggauuggcaaggagagucagccaagggaagggguauuguggagccagggaagacucugacugcucaacggaggucuuucuagacccuuaguaggcacugacgguguucuuaaagggcaggggucaagagggauuuuaggaagacacauggauucuuuaaggaacaggggagggaaaaggaggggaaggaaauuucuugggaaggaaagaaagaaggacagaggcaauggugaugagaguggaaggaagaagcugauggccacagcaaacucccuacucuaugccuaaaccaaauauaguuugcucauugugggcaagugcaggacaguagggaccugccaaucagggugaacacaucuagaucgaauccagggcaucuccguccagucugcuaggaugggaagguucuaagugcgaaguaaaacagaaauuuuuuaaaauguuauuuuguguuaaugaauuuaaauuuaaauagccacauaugucauuggaagcagaauucagagggguuuaaacuaaaacuguacuuuggaagauuaaauauauauauauauauauauauauauauauguauauauguauauauguauauauguauguguauguauguguauguauauguauauauacacauacacacacauacauacacauacauacacacacacacauacacacacacuauggccaaacaggaacaauaaauagaugucaaauaaacacuugugucaaaaucugucccucuaugaaggagaugaagcuaaaaaaaaaaagaaaacaugcugugaggaguuucuaaacuaaauuguaaaaugacacugaguagacaucaggagagcaguaaagaucaagaacaaggaaagaugggagcaaagccuuugcaaaagucaguuucagaacaacagacaaaucuacucuacuauaggccagcugguaaaaucaacaaucucucuuugaaauuuuacacacuucaaaguagugucuugacuuuuugguuacaauuuaauacaugacaguaacuuaaucuaaucagcuauuuacuauaguuuuuguuuuaaaaacauuuaccuugagacacugaaucauuuuuaaugaaauuauugaaauuacucauuuaaauacaaaacaaaauacauagaauguuuauuuagaaagcuguugacuccugguaauugaacaguuuucacaauguuagaggaaggacuucugucuggugacaguaaugaaauaaccuaauccuuacuacaugcccauauucuaguuaccuucguacuuagggaacacagaacuacauucugaaaauuacuuauacccuauuaauaaaaaguauccacaacccucaagauaauuuacauuucauaaacauguuuuguuuuguuuuguuuuagcaaaaaguagaauaccuccugccuccaggauacauggauaucugcaguuuucuaaauaggcauaugaauacaaucuggaaugauucaaaucaugggaauaguuccauuugagaugauuucauugugaauaacagaauuuuuaacagauagccacugaguucaagaauuguaguauuuacuaacaaauuauuauuugggccagagaguauugaaauacuuaacugaauuuccuaacuuuaacuauacuuuacuaagcauuauuuauuauuuaaugaagaaacaccacauugaucaucacauggguauuuuaccuuugauucuaaaucuguagucuuagaagcaauaacucuagaagcaacuugaauuucacauuugagaaagaaauaaaucccauguuaacaugcuugacacucugggcuacguaagacauaugguuacuaucugaaaugcacuaaauucaacaagcaaaugauuucuuaaguacaguauuaugucuggcuagcauggucuuuagauauaaagauaagauuauaccuuaguucacuuuguacuuguguaguaacgaagcuaugggagcuuuuaaaauaaaaguuucagcuuagcccaaauccaauggcaaauucuaacuuaagaaggacuacauaaaaagggccaucugccaccuaguccgaggccagauugcugaugcauguuuccacuguuucccacucagguuauaucuaauacaauggguagggggggaaggggacacauaugugcccacugaggcuggcagaacucaaggccucagugaguggagaagaccuccauguugggagucauuauauacauugugauccugcagugggucagaaucgacaaaauagaguuccccggcauggauaucagaaaaguuagccagaaauucacuaggaucgaagccaacccacacaguguaccuguagucuacagugcguauagaauaucccaugaccuuuauaucauuuaagcuuggcuugucagaauuccacugagggaaaucugcaggccggggguacuggcuauaggcgaucaacucccggggauuaccaaacaagucuggcuccucuuccaagucauggagcugcaaaugcuucugaagauucuggccuucucugcaaagcucaacaugaaaagaagggauggggcaccgaggaggaacuggcaguccugcaaguccagcgagcguggggaagagagauacaaguucuacgagguccucggugugccugccugaaacaggaaacagcacgguugcauguaguacacugcagacaccagcgaaagcagaagccugucugagcaccaccucucccccaucucuucuucauacacaacauccauuuguuuguaaaagcagcuuggaagugcuacuugaggacgccacucuucacuaugacacccaauggacuagcaggagggaaaguuacagucucuggccagcuagaagcauuuuuaaacuacuuaaaguuuagagcuagauacuugauucagacacauuuaaucaauuaaagcucuacccgcuguguaaaaaucuguugaagaugacuuguuuuuaaguguuuguauuugauccauauuuucuuuuuaauaugguaaaaacacaaaacaugaacuucacaaccuuaaccaugcuuuaguggcaauaaauguauucauauugugucaucaucaccaucaauucuacaacuccuuguacaccucuguuuccacugccucagaacaucaccaucacuaaaccaaacagcugcccauuuuucuacuaccgucaacugguaauucucagucuacuuuguagcacuaugcauuugacugcuagagauagcucaugugaguggucucaguauuugauccuacaugccucuguggcuuauuugcacuuaaccuaauguccucaaggcucaucuauucuauagcacacuagaauuuccuuccuuuuuaagaauggagaauauucuacuacauauguauaacacauuguguauaucguacuguauguauguauguguguguauguauguauguauguauguguauauauauauauauauauauauauaccacauuguguauauccauccauggauugacagcaguaaacaauucuggagaagggggacacucugaccagcccagcuguucacagguccccucuuagaacugucaagcuuccugcaaccguguagaaaacucuagggacccagcuuuucugagucauacccaugcggaucugggcuuuucagcaaugcaggugcuuaugaguaauuggugcuccugugaguaaccuuucacucagaguccuguuagcagcuccaauaaaacucacuaauugacuaaguuggauucugguguaauuguuccuuuggugugucauggguucccuuucuugggggaguagaugugugugugugugugugugugugugugugugagagagagagagagagagagagagagagagagagagagagagagagagagagagcugcauaccccuaggaaaagucucucauauaaaaaaaaacaaaaaacaaaaaaccccaccgcuaugaaaguaaaagaggcagguguacaucacugaaaaacuguucccacucaaucuagucaagaagacuuaagacugugggacaauggcacaggaaggcuacucuggauacuugucaagaagaaucaaagacauggcaugaggaggcaacaugauaaggaggucauguaaggccuuaauguccauugugaagacauugacucagugugaugggagcacaggaggcuccugugcagggcuguaauuuggagguuuuauauuccauuuugauuuucaucuuugcaguguuacggauaagaagcuagggcuucaguacagccuagacaugaacuccaccaccgagguagaucccgacuucugcuuugaguuugaaaugguuacuugcaaugucacgagaaagaagacucgagaaccaagggcacaugcaaggagacuucagaaagcugcuacagcagaaggcugguggaagggaaacugagaaugggcagagacagauuccgaauggagagggccaugcuugcugcuagauugcauagcauauauggaauaaagaaaaaaaaacauggauugaaaagacucugaacauucuuuuuucaguagcaggaauugaaccuuggcacugaauuugcauacuauguauaccuaggaauugaaauagcaugcuagacaaacacuguagcuuugagccacacccugagcaugcauuuuuguuuugguuuguuguuguuguuggaggggguuugguuuugguuuugaggcgaguucucaguaaauugcagaggcugcucucgccagaggauggccucagacauguccugagcaugugauuuucauacuucagccucugaggagccgucauuacgaggcucccucuacagguauuuuuugguugguuggcugguuagcugguugguuuuguggucugagggccuaugugacaauugucauuucuuuuuuguuuuuuguuuuuaaccuugaugaauuuacuuuauuuuuuuuuccauuuuuuauuagguauuuagcucauuuacauuuccaaugcuauaccaaaagucccccauacccacccacucccccuuuuuggcccuggcguuccccuguacuggggcauauaaaguuugcguguccaaugggccucucuuuccagugauagccgacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagauacagcuacaucuggguccuuucaauaaaaucuugcuaguguaugcaauggugucagcguuuggaugcugauuaugggguggaucccuggauauggaagucucuacauggaccauccuuucaucucagcuccaaacuuugucucuguaacuccuuccaaggguguuuuguucccacuucuaaggaggggcauaguguccacacuucagucuucauuuuucuugaguuucauguguuuaggaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccaaugacaauugucauuucuaagaaaaagugugucaaagguaaggaugaaggugaagcgcuauaaguuuagcucuaggcaugucagacugacuagccaagugggacaaacuguuugaaauacaaauugagguucggagaaaagauaaagacuagagauuacacuuggaaagcacuggcuacacuacaauacagggacuucuauuugcugagugucuuccaacaaguuucaaaaagaacucuuaccuaccagauuugccccaacaauaaauaguuaaauaugccuugaaaguauuucacuuuucucuugguguuuggaaagaaacauagagcaugcaacaugugcaaaaaaggaggaaaaucaaaacucaaaacuccagaaaggccagaauguuuuaaacccaagaucaguuuauacaacagagaacauaaauugcaagacuccagugauaaagauggaguccagggccagccaguccugaaagggggcacgcugguauagcgcaguucacagaaaagcacccuacaaacaacagcugauaaagucaggauacaagucuuagaacccuacaccagccaccucacacaaguuggaaaaggaccuguuuucaaagcauguagaaaucaacguagaugcccuuuccugcuggggaguacagagcaaauuacaugaauguguuuuaguaggucaaugagcuccaaaauugaaaauacucccccaaaauugaaagucuccccccuaaaaugggggauauaagacauaucugugaaauaguccacuuguguguuggggagacuuugucccagcagucuauagccacuuccucuaaugucuaacaugcuguugucacuucuaaacaguucucccaccucugaaaugucacaugcucuuuuggcccccuagacuucccaagagccccauguacaguggcuguucuugucagcucuaguucugccauguacucccaaccuagagcaugggagaugcuaagaaauauauguauaggaaauaguauugagaaugaauuccaacauagcacaaagagggcuagcuuguugucugauaagguaguucgcauauaaagcacagguccucucauugcuaggcauuauuccuucugucugucuguauguguguaccugcauccauccaauccgaggccggaucaaaggggucccgguauggaaagagcuucuggccugccgcaggaaguggggccguccuuccagggacauagagcaucaggggcacacggguagcaacaucaaaguugcuguacuuggcccauucuccguguucaccuagggcccauccugggccauaaaaaagcauacaauauaagaaaaugaguaaauauauuaugcuuuucauacuuuagauaccauuucauuccucaguauaaagaccagaggacacuaaaccucauaacuuaaggaaaucccucuagaauuauaaaauguuccucauauaaaugcuguuuuauuccaaagcagacaucuguucacaaagaagaaaccuucaaaaggacacccuuaaauuccuaaacuauaguuuugggggaaaaaaacuauacuuuuuaaaaguaauaaaaauuaauauacacugaguuuuaucuguuucaagaggcacccaauaaacaugcuuccucugccaaggcaggaagcuguccauacuuuagugccuauuaggcacaugcucuaccacucagcggcacucagcaauucuuccuuaugacagggaccugaaaggcagccauucuacuacuuugcccucuaucagggacuucagguucucuuuguuuaagauuuacuuauuuauuuuauguaugugaguacacuguagcugucuucagacacaccagaagagggcaucagaucccauuacagaugguugugcgccaccaugugguugcugggaauugaacucaggaccucuggaagagcagucuuaaccaaugagucaucucuucacccucugggcuucagauucuuaauaccaggguuguaugagcuacauaacuguacacaagauaaggacaucuuaggcugcagagauggcucagccauuaaaggcuaggcucacaaccaaaaauauaagauaaggauauuuuggguucuuuauuaauucauuuuaugugcacugguguuuugccugugugugugucuuugugaggaugugggauucccuguaacuagagcuacagacaguaugaagacagccauguggguauuagggauugaacccagguccucuaaaagagcagucacugcucuuaaacacugacccaucucuccagccccuauccugaucguuuaaaacacuuaucauauacauucauacgugaagacaaaaaaauaauacaaauuuucagcuccaaguaagaaaaagaaauccuuagcauucacuuaaaguccccauuccaaaagauagugugaauacuacagguugggaauccucaaccagcuuacauauaagcaugcuuuaaagacaaaagugugugacaaugaguguauguuguaaaaauaacgacaaauaccaaaagcuuaaaugaacugagggaagcacuggcguccaccuguacuuuauuuacagucauauuugcugacuuuugccaggagagguugcagagacuagccugcaacuucccuucuucaggcuccagacaaugcuggagcuacaaacaagugccagagccguuaagagauuguggccaugaugcuacacauacagccccgugggcaacagugcuugcugcucuuccaaaggaccggaguucaguuuccagugccugucucaggucaaucacaaccgccucaauuuccagcugcucucugcgcacauaguagauacucacacacacacacacacacacacacacacacacacacacacacacauacagauaaaauaaacuggggcuggagagauagcucagcaguucagagaauuucuacccuuccagaggaccgaaguugaauucuagcacguaugucagacaguucacaacugucuauggcuccagacccucucugucaucugcaggcacuguucucauguaugcacaccaacacagauauauauauauauauauauauauaauuuaaaaauaagaaaacauguuuaaaauguuaagagacaaaaacaaauccucucucacaagcaacuaagauaaaaagauacagcaccugccuccauuuucacauauccaagauggaggugcacaaacaacuaaguugcuuuuaaaagcaccccaugauccuggacucagagcaccccuauggacaugggaauuuuucaaaguguccuuugcaggaaacugagauacucaauucaccaauacccugcaaaacgcuuaccgugaucagaugugaaagcaauaauuguguugugggcuagacgaagaucauccaaagcacucaaaacauguccaaccugaguauccaaauaggacacagaagcaaaguagcucuggcggauuuuccgcugcaaaugaaaaacagaauuacaagaaugaaaacaauuuuauuuaccuuggcauacaaaaugaauagcuaccugaacaagcauuucucccaaucccaaccucuccauucacugauucuuagccuuaaccuaauguuccuucuccuuugccugcagaguccagacuaacuuaaaaucugcagaaccaaacuggcauguuugaaauuuaaucagcuuuuacuuuaggauacagaucauggcaaauggaugcaauuuacuguaccuuucugucuacucugcacauuccagacagucccuagaaaugaauaucuaaacagaaaaugaucccuuaauccuuguaugcucagagccacacauucucugauaagggguaugccaaagauaccacucggcucaauucaagccacaaggugacuugaagaacuagaaauaaauugccucccagccauagauaccaaaaguccaaacaaaaucaaguuuuguggaaugccaucucugaaauuucuacagguaucugcauccccuggcuugcaauagucauugcacgcaguuuccaucuguuucugucacuauccucccuaccugacuccuuucuuaucaggacaauagucaaguuggauuagggacuugauuagaaugacuccaucuuaucuuaaagcaggcuauaugcugagguuuaaggagauaucagauguauaacgacgguucaguauaucuuuuggggaagacacaaauuagcuccaaagagugacccugaguaggccuuuccucugaccacuucuuacccagcaagaaguggaaauggauuaaguucacaaaccacuguuaguuagcucauuuuaacacacucucaaugggcagaagaacaaugaaagacaagagagcagucaaagucccuaaacccaaaagggacuguugggacugcuagucuauacccauaaguaaagaagccagaagcccauccugggcuaacuccucaauuauugcauauaagccuuaaggcaaaagauuauucuucaucuccccaaacaguaauaagcaagauaaccacuuaccagaucagccccaucuucugccuuccucagggccccugccuuaucagacggaccugucagcugcuacuugucacugcuaggauagggacagucauaagacuugucccuucaucugacugcagugauacacaucuaugcuuauagaaagauucugcugaaccacugccuacauauaguuuuuaguaaauaaacuucagucuggagccuagagaacuuuaguucucuugggacucaagauacuuccugccuguuagucguggaaagaaagcaacaaagaaguaggcacaaaccucagaccugcugagcaaccuagcuaauaaaacuacaacuauagauaaguaagcauacacguuaucaggaggaccaaggcugagacauggaaugagccuucaaguuaguuggucaagauaaaugagggaagaccucacagaggaguucccauggcuaucacccaaaugggagcaagaugcuguaaagcaacaguuguuaugcauacaauaaaguagagugacagaagagcaggacacagucagagcuauguaaugacauaggaagacaaacaagaaacagcggcuuagggccagaugaaacagauuuggaaggucuuuaagggaugaaaagucccaggcuauaggccaagaagcuuuuucaagacauaaaaguaaugcaauauaggcugcagguuagcaaaaguccuguggcaacagaagggcagauucuaggggcuuuagacaaaacagcaccagacuacugcuggcccuuaagaagaauucagaaugcuaaaagaagggcugaaagguacaguguauguaccuauaauccuggcacuuggaaagcugaggcagaaggaucaccaugcauuguugucuagauggggcuacaguaaaaaccugucucaaaaaaauaggaaaauuuaaaaaacaaaaugcauugcaguuguccagaaagauguguucagagaacaggggagaccuaagaggaacacggagacaucaaucagguguagauacaggcaaggaaguuaguguuauaggaagaugagaaagccaagggugacaaaaguucacagucagcaacaaaacaggaugaccugcugccaugugauagaaggggacagaguggagaagaaaaggcagaguagggguggagaccuggccaugugggacagaauuagggucuccaucauuaucugccugagaguggcucacaggaagguagacauguguaucugaaagucaggaaggaugccuaagcuagagaaauaguucuuggaucaaucuaacaagaggcuaacuagggagaaugggaagagaggccaauauggagggcugaaauugaccagguagcaauacguaagugggaaacacaggaaggcccuguuaugcauguugaaauagaggaagggcagaaagguuggcaaggaagcccaggaauuggacagcuuagauuagauuagauuagauuagauuagauuaaauuagagaaaguagcacuaagcuucgguggugggguggagauuuaagacagaauuugccaacaaggucagugucugccauagugggaacucuuagugauccaggaaggcagaagcccaugcagagaaagauguccaacaaacagaccaggaagaucauggauguagauagaauaggguacuuuucacuacccuccaacaguagcugauggagcagagcagcaaagagaagaagagagaacuuagcagagcuaugaggcaugguacaaagggacaugagcagacaaagauacugcagagaacauagguaggaacagaccucagcaaacaagcaaagaacuucgcuagguagcugaaaaccucugcuuagcagcaacagguguucuuuccaggagcucucacagcuagacugccucaggaucaggauacugcaaauggaacaucugugcugagaaaaacacaagaacaaggagagucaugccacagggccugccucccaagacacagugggaagaaagguaacaagaaugucaggcaacgaagcuacaaggagaaggggcuagagccaggcuugugaccaaacagguauaggucuaagcauaaaacugggagcugaaggaaggagagaggugacacuuagcaaagacauccaaagcuacaauaggccagggagcauggcucaggcccauagagcaugaggcauggcccuauacacaagauuacccaagugacaguaugagccaugauguuugcugugucuaauaguuagaaguguuaugaagggagacagaacaugaagggguccucuccaugcagcugaaaaccucaagucaauguucucagagaaaacucacccauccugcuucucuuuggcuaaggaaggaaggcagggugacuucagaggucaugacacugccauggggugggaagugaacuuaaaacaaaaugucugaacagacaaaagcaagcauggaaguuugaaguuaggggacuguggggcugaggcagcuccaguuggcaccagcuccaugucccaccaggucgcagagcaguuuccuuaucuaacauugaaguuuucaucuagccagaacaugcaaaugcuuagagcccuuccuggcaccucgucgacuuuagaggggcauuuuaacugccugucacuaauacaauagguauggaccuaaagcugcagcucacaccaucguguuaucagauaacaagacagagcuaggaagaaaguuggcaacauggcacacgucuugcuuuccaaacucucucuacuugccauuuaaaacucaggaaaucacaaaguuguguggaauuuauacaccucacccugaacucuggcugugcaaacucaaggccaaagggcuuuggacaaugaaugagauacauuuuuguguuagacucacuucauuuuaaaaucuauucuccuugcagugguucucaaaccagugagugcaucacaaccaucucauaugcuuucugaggaaaugugguuucucuugccucaucuucaguucuagggcugggaauauaguucaguacuaggguacuugccuaauguaugcgaggcccuagguucaaccacuacuacugcaaaaaaauaaagcaagaagaaaacagggagggagagagaggaagagaaagagagauggauggagggagggagggaggaagguaagggaggagggagggagagggguccauaugcauaggugggccagaacucuguacuuuuaacaagucugccuagcaaaucagauacaggaagugccaggaguagacuuugagaccgcuacccucuuuaacucacuaccacgugcuucagcacuuauguccuaagacuucagaaagaauacggcucugcaugucugcuuuagucaccagagaaagguugagggaugaggaaaggacucaacauaacuaaaugacuaacagggagcaaagagauuugacacaucacagcugauagcacuggccaugauaccccaccuaccucugguccaaggcucagcucacucaagucaccccaagaguaccaggugccacuuuaggcuuucccucagaguaaaucaaagugccagcaaacuaaagauucugcacuuuucuacaaacaucccaacugugaccaauauuaaucccccaugggcuagggggguucacccaaacuacaucugaucccugugccuguuuauaacgagucuggaugccacuucuuaggggagcuaagguacuaguaagaaaacuugaucugcacagcacuacccaugucaauaaauauuaagagaaauccacugcucagaaaaaaucguaaggaaggguuuuguuugucuuuuuaaaacaagaucuuacuauuuagucuagacuggucuugagcucauuauguaaacagguugaccuugaacucaaaaguugccucgccaaugguauuacacaaucacuuaucccccaagcauaguacuaguaccugaaaauccucaggaauugguccauagggaacacugauguuuaaggcuuggacaucuucccucucccugauauccauccagggguuguaggcuacaggugguaggcuaucaggaacauggggaucaggagccaggguuauguuuuccaagggauacaacuucugaaauuccuaggacaagaauauacaaagccacagguugcuagucguuuggcaaaagcacaaaguuguguuuucugaaagccuaugauacauuggcuuggcgcuaaugccuuccggcuacucacccgcucucaccugcucugugccuuauagaucugaacagcaacaaauccuaagccacgguucugacacucgcagcaacaacuguucccuccuacugcuccccaccuuacuuccaacauacaaaggcgggcuugaagcacaguggguucccaaaacuccccuaaccuucagugagucaggagaacucauaggacuuagcacaaggucccauuuacuagagugaaaauauuucaaacccauucagaaaaggaaaaacaaacaugaaggaaaaucuggaggaaaccagugaccagcuucagagucccuucccaggaauuucaccuaggaggcacauggugucccagcuaguugaaagacaguacauguuuaaugcugccaaccagugaagcucaauaaaacuguagcauagaguuuugacaugggucucaucauguaggcauucugccucgaccauaaaauuccaggcuuccauaaggaaaccagugauucagcauguaccaugucugccaaaaccacuuaggcacucccaaaucaaagguccugguugccagacaagggccaacauuaaaagccgacuucugaaaggcuuacaagcuaggcagcuuuaugaacucuuuucuccauggaaacagaggaggcuggaugccauaagcuuuuuccaauggugcugagagcuccugcuaugagggcaagauccacaagguuccucaaagaagaagccuacaacaucaaagggcauacuucccagucuguacucucaguuacaacuaagagacacucuuuauaaagggaaaaugcuaggcuacucaggcccaggaaaaagcaagcagagaaaaccuggaaacgauuaugaaaaagaucuauacauucuaaaugauacaaagaagcauagauuugaaguggccauaagcaauucugucuccugugcccauggagucuaaugcgacagccguuuccuaggauuaucuuccaaagaguauggcuccugguggcuuuaugucaccucuguacgucauuguguaaucccaccugcaugaugaguucaaacaaaagaaagcaaaccuccaggggaggauauucucauuucuuacaagguucuuucugguuacuuguuuguuaguuuuuuaguauuucucgagacaggguuucacuguguagcuugguuguguuggaacccucuauguagaucaggcuggccuugaacucgaagacauaugccugccucuauguaccaccaccaacaagcuuccuccaaaacucuuuacauguucuaagaguacuucuuguuuuugaacuaagauuaccaucauucuaaguucacgaguaagcaccaggcauccugguagguagguuaugaccaccuucaauacacaauauagauauaguggcagcucuaccuugggguaucugaaggggauaugcggcuugugguacccaacugccaggaagaaaggacuagcugaugucuucaucuuuuccaacaaccugauggcuucuucugugcucuguuugucaggcaagguaccuucaggcacaucugccacaucgacaggacaaagcagauuggcguggaguuuuccaucuugucccuuacacgucuuucaaaacaaaauacguaacauucuauuaaauccaauaacuagaaacccugacaguuacacacugaaugauuagcaccaucaccaacccucaauuguuaagccacucagugaacagcaacauuggaagcagaacugaaccagcaagauccaaauagcacucaguuuauugcuaugaauugugucuccagaccagaacuaauuaaaggauacccaaauaaaacaucaaaaggauaucaaaaggauacaacgauccucagcacuaaacuucauccagagugagcaugacaaauccauuaagugaacuguucacacuacugcuuaaaguuaagguuuggauucauuaccuguguauguguacacacguuuaugugugugccacugaacauguagggguguacaugaaaagcagagguuaaccucaguugugccucauuagacuagccuggcuggacagcaagcccgggggagcugcuugugcccccaacacuggcuucuugauggauaguagaaauugagcguggauccucaugcuuucagagugaguacuuuacugagugagcugugaccaugacccaacauaagguuuuagaaugagaaauacucccaaucagcuacuaugccucuaauuccagcagcaugagggaaccugaggcaggaggauuccaagucuggggccagccugggcuucagagcaaguuccaaaccagccugucuagacuauguaguaaaauacuguaaaacaaauuaaucucauaaaaaagcacucauugugcccaucaaagcaaucacuaaagacccuaaugcuuaucucuauaagacaucacaacaaucaauauauuuaauaguucauuuucuagacaaguguuuccucggcccuuguacagaccuaccuuaguguuuucauauuucucugaggauggaugauaagguggaaaagaccagcuauauggauaaucaucacugugauuggaagauauaccuuaaauagggaaagaaaauuguugaauaaaauaugaaaggucuuucaauacccuacugccaaauuaaaauugaacaacuaugcaaguagcuccuccccucuuugggguucaguuuccucaccuauaaaaucagaacggcaagauagauaauguuuccauuaagaucaacugcccaugauuuuaguaauuagcaucuaacuucccaguuacuaagccuuggaagugggcgaucuauaagaaacagagaaccacagggcgugguggcgcacgccuuuaaucccagcagaggcagaggcaggcggauuucugaguucaaggccagccugguccauaaagugaguuccaggacagccagggcuauacagagaaacccugucucgucgaaaaaccaaaaaagaaaaaaagaaacagaaaaccuuaucccuaaaucuaguuaucgggaaagagaucaaggaacaucggagaggccuuguuuaguuucacuucccaaaguauaaucucuucucuagaaaauacucacuucccuccagauauccucaguuaagccaugcuguaccaacuagguaguucaagugauaaucagcuuucagccacacaauaugauuucugauagauuauuuuucaagacugggccugcuuuuuaaaaacugacuacuacuuucaaucuggacugccugguagguucuagaagaaagcuccugagccauaaugauguacaaagaacucuuagagacgcccaagcugucuccuuuggugagaaguaccgucauggucacagcucuagcauuugaacacacuucacacucauggaugucccuacuagcauguucccuucguuaggcaucaagaaaacuacagccccagcauuccagagaaggaaugugagacucaaagaagaagaaaaacuuagccaaagacagccacauggcuaagaaguggcagcacuuagaccaggaccaagugcccacaucccugaugcuauuucccagugaggucaacuccgcuuccacaucaguaaaaagccagaagccuguuaugccagacuacuaugcugucauuaaaaaugaauuuuugaggaguguaauauaaugcgaaauauuuacucucacucauaguguaaaauuauaaaaauaacauagccacaaaucagaauaacacuauguccaaaacacaagaaaauuuuuguuugccacaucaaacacagcuuuccccagggugguucaauuacacacuuacauucuuugguuucuuaaaaaucuugaaaucaagggaucaugugauccuauuaucuguuuuaaaguguuauuuauucuucauuuaggaaguaaauaacuacuuuaucagguaguauucaaagucagaauuugacacccagcugauguccucuuccuaacauuccucacagagaaagcagugccuuucaccacgcugaagcccauacucggacaucaaguccacacaauaccucuggacauuugagguccucacccccaaacuuuacagacaggcauccugcaaggcccagaccagagcuuuaaggaccacccuguggucaagcccagagcugaacugacaccaaaccugccucuccgacagcagcuacaugaaucugacgacauuaccuccaacuucuaaaaggaaaucuguuucuuucuauucuuuuucauuuagaaugugaauaugaaacuagguuaaagaaaugcuuuguuuuguuguuuuucauagaauggcaucaaugaacaaguuaccuaagccugacaagggaaaagccacuacaaggauagucccaaccuaguauugaagcauagaaacaaaaggcccagguuuuaguaauugaacaguaccagggugaaagacuuucccaaccgacauggucacguagccauucuccuugaaguauugggggaugguggaaaaauuuccagaauguacccuccaguaggaauugaagucauacaggcggguggugucaggccuccucccggugaggaaggacacucgacuuggugcgcacacugcuugcuguuaaggagcagaagcaaaugucaacaacgucacagccaaaugugucugcagucuucaagguaacuaagcaaccucucuagauccucagcaacagccuggcagcugagucauguagaugucaaaaccaaccaguaggauuagggccuugcccagguacuggagacuauugucugcccagcaaaggaagacagcaaucaagcucucagaacagcaauuguguuuuccuaugcaaugucaccccuagguacccagaaagggugaugcucuuagagaguagcccugaaaaggagguucagggaggacaacugccauggacugacucuuagccgcccacucucagccacccacaacucgguuggcagacccacagguuggauuuuucagcucccgucaauuccuguuucuagcugaaagcuagccaagccugucuuaagcguguuagggccagggcacugucuccacccaagaaggaggggaaauccugcaaaugugagcuuccuugucugugaagagacuugccuaggccuucauuuucuaaguucugcuuuccccuuucaaggaggucucuagagcagcagcaugcuucucccuacugucuauacacaaagaggcauauauccauaccuaaagguccuuggacauaccugagcaaaggcauucugaaagagaacgcuaugggaugccagcuggucaauguucggggaccucacuagcuugucuccauaacagcccagggaggggcggagaucauccacaaugaucagaaggauguucagagcaucugcacaggagagaggggcuuugguuauaccauaugcaaugacacuaaaaucccccucccuaggguaaugaaaggauaaaggcaguccacccagaaaaggggcgaccagggcucugcuccagcaagggcgggguuggaguacacaaaagcccuauccaaggugagggucuuauguuucaaucaugucuccacaucuaggugaagaagaaggagacaaagacagagacaaagaugggaggggggaucaaagaaggaaggaauagaagucagauggaaagauggaaggaugguaaaauaaaaggguggauagaagacaguagcagaaaggaaaggaggaguagaaggaaggguaaagaaaggaaaauggacagauggagaggaaagaacuguuggcgagauguaauuugcaccaguggauggcuccacacccaugugcauaugggcagcacaaacuggacucuggguuauaaaaucaugggggggggguaaaugagcuugggaauagggugcaucugaguagaguuagggggagcaguggggauguuauaaaaugcauuuaugaaauccucaaaauuaauuuuuaaaaagagaagaaaaaacaugaagggauggaaaggaagaggagggguaggaaggaggaauggauggaugaaagaugaaugcgggggcuaaaaagaaagaugaaugcgggcagaaucgacgaaaggaagcaaagauggauauugaguagggaggggugaaaugugggugaaaaugaugaaggaagaaugaaaaacgaagauaggauguguggaagaauaaacauuagcaggaacagagacaagguugaauaaggcagggagcaaggaauuggcaccuguagcagaguugccuugcgcugcggacuccagggcgaugcagaaggagccuagcaacaagcugaagcuaagcugccgccagauaggcggcggcggcggcggcgacauuucugccucggcgcagucuugcaagaagguggcgugaggcuacagcgggaccauuacguagcaguggccgccgccgccgccgccgccgccgccgcugcagccgcugucaccaccaaagucucugagaaaacugcgcgacaccucugccucgggcccaaaggcccgggcgcuggcccgagcacgaaug

SEQ ID NO: 9528 - RNA, 22116 nt, Mus musculus
cauucgugcucgggccagcgcccgggccuuugggcccgaggcagaggugucgcgcaguuuucucagagacuuugguggugacagcggcugcagcggcggcggcggcggcggcggcggcggccacugcuacguaauggucccgcuguagccucacgccaccuucuugcaagacugcgccgaggcagaaaugucgccgccgccgccgccgccuaucuggcggcagcuuagcuucagcuuguugcuaggcuccuucugcaucgcccuggaguccgcagcgcaaggcaacucugcuacaggugccaauuccuugcucccugccuuauucaaccuugucucuguuccugcuaauguuuauucuuccacacauccuaucuucguuuuucauucuuccuucaucauuuucacccacauuucaccccucccuacucaauauccaucuuugcuuccuuucgucgauucugcccgcauucaucuuucuuuuuagcccccgcauucaucuuucauccauccauuccuccuuccuaccccuccucuuccuuuccaucccuucauguuuuuucuucucuuuuuaaaaauuaauuuugaggauuucauaaaugcauuuuauaacauccccacugcucccccuaacucuacucagaugcacccuauucccaagcucauuuaccccccccccaugauuuuauaacccagaguccaguuugugcugcccauaugcacauggguguggagccauccacuggugcaaauuacaucucgccaacaguucuuuccucuccaucuguccauuuuccuuucuuuacccuuccuucuacuccuccuuuccuuucugcuacugucuucuauccacccuuuuauuuuaccauccuuccaucuuuccaucugacuucuauuccuuccuucuuugauccccccucccaucuuugucucugucuuugucuccuucuucuucaccuagauguggagacaugauugaaacauaagacccucaccuuggauagggcuuuuguguacuccaaccccgcccuugcuggagcagagcccuggucgccccuuuucuggguggacugccuuuauccuuucauuacccuagggagggggauuuuagugucauugcauaugguauaaccaaagccccucucuccugugcagaugcucugaacauccuucugaucauuguggaugaucuccgccccucccugggcuguuauggagacaagcuagugagguccccgaacauugaccagcuggcaucccauagcguucucuuucagaaugccuuugcucagguauguccaaggaccuuuagguauggauauaugccucuuuguguauagacaguagggagaagcaugcugcugcucuagagaccuccuugaaaggggaaagcagaacuuagaaaaugaaggccuaggcaagucucuucacagacaaggaagcucacauuugcaggauuuccccuccuucuuggguggagacagugcccuggcccuaacacgcuuaagacaggcuuggcuagcuuucagcuagaaacaggaauugacgggagcugaaaaauccaaccugugggucugccaaccgaguuguggguggcugagagugggcggcuaagagucaguccauggcaguuguccucccugaaccuccuuuucagggcuacucucuaagagcaucacccuuucuggguaccuaggggugacauugcauaggaaaacacaauugcuguucugagagcuugauugcugucuuccuuugcugggcagacaauagucuccaguaccugggcaaggcccuaauccuacugguugguuuugacaucuacaugacucagcugccaggcuguugcugaggaucuagagagguugcuuaguuaccuugaagacugcagacacauuuggcugugacguuguugacauuugcuucugcuccuuaacagcaagcagugugcgcaccaagucgaguguccuuccucaccgggaggaggccugacaccacccgccuguaugacuucaauuccuacuggaggguacauucuggaaauuuuuccaccaucccccaauacuucaaggagaauggcuacgugaccaugucgguugggaaagucuuucacccugguacuguucaauuacuaaaaccugggccuuuuguuucuaugcuucaauacuagguugggacuauccuuguaguggcuuuucccuugucaggcuuagguaacuuguucauugaugccauucuaugaaaaacaacaaaacaaagcauuucuuuaaccuaguuucauauucacauucuaaaugaaaaagaauagaaagaaacagauuuccuuuuagaaguuggagguaaugucgucagauucauguagcugcugucggagaggcagguuuggugucaguucagcucugggcuugaccacagggugguccuuaaagcucuggucugggccuugcaggaugccugucuguaaaguuugggggugaggaccucaaauguccagagguauuguguggacuugauguccgaguaugggcuucagcguggugaaaggcacugcuuucucugugaggaauguuaggaagaggacaucagcugggugucaaauucugacuuugaauacuaccugauaaaguaguuauuuacuuccuaaaugaagaauaaauaacacuuuaaaacagauaauaggaucacaugaucccuugauuucaagauuuuuaagaaaccaaagaauguaaguguguaauugaaccacccuggggaaagcuguguuugauguggcaaacaaaaauuuucuuguguuuuggacauaguguuauucugauuuguggcuauguuauuuuuauaauuuuacacuaugagugagaguaaauauuucgcauuauauuacacuccucaaaaauucauuuuuaaugacagcauaguagucuggcauaacaggcuucuggcuuuuuacugauguggaagcggaguugaccucacugggaaauagcaucagggaugugggcacuugguccuggucuaagugcugccacuucuuagccauguggcugucuuuggcuaaguuuuucuucuucuuugagucucacauuccuucucuggaaugcuggggcuguaguuuucuugaugccuaacgaagggaacaugcuaguagggacauccaugagugugaaguguguucaaaugcuagagcugugaccaugacgguacuucucaccaaaggagacagcuugggcgucucuaagaguucuuuguacaucauuauggcucaggagcuuucuucuagaaccuaccaggcaguccagauugaaaguaguagucaguuuuuaaaaagcaggcccagucuugaaaaauaaucuaucagaaaucauauuguguggcugaaagcugauuaucacuugaacuaccuaguugguacagcauggcuuaacugaggauaucuggagggaagugaguauuuucuagagaagagauuauacuuugggaagugaaacuaaacaaggccucuccgauguuccuugaucucuuucccgauaacuagauuuagggauaagguuuucuguuucuuuuuuucuuuuuugguuuuucgacgagacaggguuucucuguauagcccuggcuguccuggaacucacuuuauggaccaggcuggccuugaacucagaaauccgccugccucugccucugcugggauuaaaggcgugcgccaccacgcccugugguucucuguuucuuauagaucgcccacuuccaaggcuuaguaacugggaaguuagaugcuaauuacuaaaaucaugggcaguugaucuuaauggaaacauuaucuaucuugccguucugauuuuauaggugaggaaacugaaccccaaagaggggaggagcuacuugcauaguuguucaauuuuaauuuggcaguaggguauugaaagaccuuucauauuuuauucaacaauuuucuuucccuauuuaagguauaucuuccaaucacagugaugauuauccauauagcuggucuuuuccaccuuaucauccauccucagagaaauaugaaaacacuaagguaggucuguacaagggccgaggaaacacuugucuagaaaaugaacuauuaaauauauugauuguugugaugucuuauagagauaagcauuagggucuuuagugauugcuuugaugggcacaaugagugcuuuuuuaugagauuaauuuguuuuacaguauuuuacuacauagucuagacaggcugguuuggaacuugcucugaagcccaggcuggccccagacuuggaauccuccugccucagguucccucaugcugcuggaauuagaggcauaguagcugauugggaguauuucucauucuaaaaccuuauguugggucauggucacagcucacucaguaaaguacucacucugaaagcaugaggauccacgcucaauuucuacuauccaucaagaagccaguguugggggcacaagcagcucccccgggcuugcuguccagccaggcuagucuaaugaggcacaacugagguuaaccucugcuuuucauguacaccccuacauguucaguggcacacacauaaacguguguacacauacacagguaaugaauccaaaccuuaacuuuaagcaguagugugaacaguucacuuaauggauuugucaugcucacucuggaugaaguuuagugcugaggaucguuguauccuuuugauauccuuuugauguuuuauuuggguauccuuuaauuaguucuggucuggagacacaauucauagcaauaaacugagugcuauuuggaucuugcugguucaguucugcuuccaauguugcuguucacugaguggcuuaacaauugaggguuggugauggugcuaaucauucaguguguaacugucaggguuucuaguuauuggauuuaauagaauguuacguauuuuguuuugaaagacguguaagggacaagauggaaaacuccacgccaaucugcuuuguccugucgauguggcagaugugccugaagguaccuugccugacaaacagagcacagaagaagccaucagguuguuggaaaagaugaagacaucagcuaguccuuucuuccuggcaguuggguaccacaagccgcauauccccuucagauaccccaagguagagcugccacuauaucuauauuguguauugaagguggucauaaccuaccuaccaggaugccuggugcuuacucgugaacuuagaaugaugguaaucuuaguucaaaaacaagaaguacucuuagaacauguaaagaguuuuggaggaagcuuguugguggugguacauagaggcaggcauaugucuucgaguucaaggccagccugaucuacauagaggguuccaacacaaccaagcuacacagugaaacccugucucgagaaauacuaaaaaacuaacaaacaaguaaccagaaagaaccuuguaagaaaugagaauauccuccccuggagguuugcuuucuuuuguuugaacucaucaugcaggugggauuacacaaugacguacagaggugacauaaagccaccaggagccauacucuuuggaagauaauccuaggaaacggcugucgcauuagacuccaugggcacaggagacagaauugcuuauggccacuucaaaucuaugcuucuuuguaucauuuagaauguauagaucuuuuucauaaucguuuccagguuuucucugcuugcuuuuuccugggccugaguagccuagcauuuucccuuuauaaagagugucucuuaguuguaacugagaguacagacugggaaguaugcccuuugauguuguaggcuucuucuuugaggaaccuuguggaucuugcccucauagcaggagcucucagcaccauuggaaaaagcuuauggcauccagccuccucuguuuccauggagaaaagaguucauaaagcugccuagcuuguaagccuuucagaagucggcuuuuaauguuggcccuugucuggcaaccaggaccuuugauuugggagugccuaagugguuuuggcagacaugguacaugcugaaucacugguuuccuuauggaagccuggaauuuuauggucgaggcagaaugccuacaugaugagacccaugucaaaacucuaugcuacaguuuuauugagcuucacugguuggcagcauuaaacauguacugucuuucaacuagcugggacaccaugugccuccuaggugaaauuccugggaagggacucugaagcuggucacugguuuccuccagauuuuccuucauguuuguuuuuccuuuucugaauggguuugaaauauuuucacucuaguaaaugggaccuugugcuaaguccuaugaguucuccugacucacugaagguuaggggaguuuugggaacccacugugcuucaagcccgccuuuguauguuggaaguaagguggggagcaguaggagggaacaguuguugcugcgagugucagaaccguggcuuaggauuuguugcuguucagaucuauaaggcacagagcaggugagagcgggugaguagccggaaggcauuagcgccaagccaauguaucauaggcuuucagaaaacacaacuuugugcuuuugccaaacgacuagcaaccuguggcuuuguauauucuuguccuaggaauuucagaaguuguaucccuuggaaaacauaacccuggcuccugauccccauguuccugauagccuaccaccuguagccuacaaccccuggauggauaucagggagagggaagauguccaagccuuaaacaucaguguucccuauggaccaauuccugaggauuuucagguacuaguacuaugcuugggggauaagugauuguguaauaccauuggcgaggcaacuuuugaguucaaggucaaccuguuuacauaaugagcucaagaccagucuagacuaaauaguaagaucuuguuuuaaaaagacaaacaaaacccuuccuuacgauuuuuucugagcaguggauuucucuuaauauuuauugacauggguagugcugugcagaucaaguuuucuuacuaguaccuuagcuccccuaagaaguggcauccagacucguuauaaacaggcacagggaucagauguaguuugggugaaccccccuagcccaugggggauuaauauuggucacaguugggauguuuguagaaaagugcagaaucuuuaguuugcuggcacuuugauuuacucugagggaaagccuaaaguggcaccugguacucuuggggugacuugagugagcugagccuuggaccagagguaggugggguaucauggccagugcuaucagcugugaugugucaaaucucuuugcucccuguuagucauuuaguuauguugaguccuuuccucaucccucaaccuuucucuggugacuaaagcagacaugcagagccguauucuuucugaagucuuaggacauaagugcugaagcacgugguagugaguuaaagaggguagcggucucaaagucuacuccuggcacuuccuguaucugauuugcuaggcagacuuguuaaaaguacagaguucuggcccaccuaugcauauggaccccucucccucccuccucccuuaccuuccucccucccucccuccauccaucucucuuucucuuccucucucucccucccuguuuucuucuugcuuuauuuuuuugcaguaguagugguugaaccuagggccucgcauacauuaggcaaguacccuaguacugaacuauauucccagcccuagaacugaagaugaggcaagagaaaccacauuuccucagaaagcauaugagaugguugugaugcacucacugguuugagaaccacugcaaggagaauagauuuuaaaaugaagugagucuaacacaaaaauguaucucauucauuguccaaagcccuuuggccuugaguuugcacagccagaguucagggugagguguauaaauuccacacaacuuugugauuuccugaguuuuaaauggcaaguagagagaguuuggaaagcaagacgugugccauguugccaacuuucuuccuagcucugucuuguuaucugauaacacgauggugugagcugcagcuuuagguccauaccuauuguauuagugacaggcaguuaaaaugccccucuaaagucgacgaggugccaggaagggcucuaagcauuugcauguucuggcuagaugaaaacuucaauguuagauaaggaaacugcucugcgaccuggugggacauggagcuggugccaacuggagcugccucagccccacaguccccuaacuucaaacuuccaugcuugcuuuugucuguucagacauuuuguuuuaaguucacuucccaccccauggcagugucaugaccucugaagucacccugccuuccuuccuuagccaaagagaagcaggaugggugaguuuucucugagaacauugacuugagguuuucagcugcauggagaggaccccuucauguucugucucccuucauaacacuucuaacuauuagacacagcaaacaucauggcucauacugucacuuggguaaucuuguguauagggccaugccucaugcucuaugggccugagccaugcucccuggccuauuguagcuuuggaugucuuugcuaagugucaccucucuccuuccuucagcucccaguuuuaugcuuagaccuauaccuguuuggucacaagccuggcucuagccccuucuccuuguagcuucguugccugacauucuuguuaccuuucuucccacugugucuugggaggcaggcccuguggcaugacucuccuuguucuuguguuuuucucagcacagauguuccauuugcaguauccugauccugaggcagucuagcugugagagcuccuggaaagaacaccuguugcugcuaagcagagguuuucagcuaccuagcgaaguucuuugcuuguuugcugaggucuguuccuaccuauguucucugcaguaucuuugucugcucaugucccuuuguaccaugccucauagcucugcuaaguucucucuucuucucuuugcugcucugcuccaucagcuacuguuggaggguagugaaaaguacccuauucuaucuacauccaugaucuuccuggucuguuuguuggacaucuuucucugcaugggcuucugccuuccuggaucacuaagaguucccacuauggcagacacugaccuuguuggcaaauucugucuuaaaucuccaccccaccaccgaagcuuagugcuacuuucucuaauuuaaucuaaucuaaucuaaucuaaucuaaucuaagcuguccaauuccugggcuuccuugccaaccuuucugcccuuccucuauuucaacaugcauaacagggccuuccuguguuucccacuuacguauugcuaccuggucaauuucagcccuccauauuggccucucuucccauucucccuaguuagccucuuguuagauugauccaagaacuauuucucuagcuuaggcauccuuccugacuuucagauacacaugucuaccuuccugugagccacucucaggcagauaaugauggagacccuaauucugucccacauggccaggucuccaccccuacucugccuuuucuucuccacucuguccccuucuaucacauggcagcaggucauccuguuuuguugcugacugugaacuuuugucacccuuggcuuucucaucuuccuauaacacuaacuuccuugccuguaucuacaccugauugaugucuccguguuccucuuaggucuccccuguucucugaacacaucuuucuggacaacugcaaugcauuuuguuuuuuaaauuuuccuauuuuuuugagacagguuuuuacuguagccccaucuagacaacaaugcauggugauccuucugccucagcuuuccaagugccaggauuauagguacauacacuguaccuuucagcccuucuuuuagcauucugaauucuucuuaagggccagcaguagucuggugcuguuuugucuaaagccccuagaaucugcccuucuguugccacaggacuuuugcuaaccugcagccuauauugcauuacuuuuaugucuugaaaaagcuucuuggccuauagccugggacuuuucaucccuuaaagaccuuccaaaucuguuucaucuggcccuaagccgcuguuucuuguuugucuuccuaugucauuacauagcucugacuguguccugcucuucugucacucuacuuuauuguaugcauaacaacuguugcuuuacagcaucuugcucccauuugggugauagccaugggaacuccucugugaggucuucccucauuuaucuugaccaacuaacuugaaggcucauuccaugucucagccuugguccuccugauaacguguaugcuuacuuaucuauaguuguaguuuuauuagcuagguugcucagcaggucugagguuugugccuacuucuuuguugcuuucuuuccacgacuaacaggcaggaaguaucuugagucccaagagaacuaaaguucucuaggcuccagacugaaguuuauuuacuaaaaacuauauguaggcagugguucagcagaaucuuucuauaagcauagauguguaucacugcagucagaugaagggacaagucuuaugacugucccuauccuagcagugacaaguagcagcugacagguccgucugauaaggcaggggcccugaggaaggcagaagauggggcugaucugguaagugguuaucuugcuuauuacuguuuggggagaugaagaauaaucuuuugccuuaaggcuuauaugcaauaauugaggaguuagcccaggaugggcuucuggcuucuuuacuuauggguauagacuagcagucccaacagucccuuuuggguuuagggacuuugacugcucucuugucuuucauuguucuucugcccauugagaguguguuaaaaugagcuaacuaacagugguuugugaacuuaauccauuuccacuucuugcuggguaagaaguggucagaggaaaggccuacucagggucacucuuuggagcuaauuugugucuuccccaaaagauauacugaaccgucguuauacaucugauaucuccuuaaaccucagcauauagccugcuuuaagauaagauggagucauucuaaucaagucccuaauccaacuugacuauuguccugauaagaaaggagucagguagggaggauagugacagaaacagauggaaacugcgugcaaugacuauugcaagccaggggaugcagauaccuguagaaauuucagagauggcauuccacaaaacuugauuuuguuuggacuuuugguaucuauggcugggaggcaauuuauuucuaguucuucaagucaccuuguggcuugaauugagccgagugguaucuuuggcauaccccuuaucagagaauguguggcucugagcauacaaggauuaagggaucauuuucuguuuagauauucauuucuagggacugucuggaaugugcagaguagacagaaagguacaguaaauugcauccauuugccaugaucuguauccuaaaguaaaagcugauuaaauuucaaacaugccaguuugguucugcagauuuuaaguuagucuggacucugcaggcaaaggagaaggaacauuagguuaaggcuaagaaucagugaauggagagguugggauugggagaaaugcuuguucagguagcuauucauuuuguaugccaagguaaauaaaauuguuuucauucuuguaauucuguuuuucauuugcagcggaaaauccgccagagcuacuuugcuucuguguccuauuuggauacucagguuggacauguuuugagugcuuuggaugaucuucgucuagcccacaacacaauuauugcuuucacaucugaucacgguaagcguuuugcaggguauuggugaauugaguaucucaguuuccugcaaaggacacuuugaaaaauucccauguccauaggggugcucugaguccaggaucauggggugcuuuuaaaagcaacuuaguuguuugugcaccuccaucuuggauaugugaaaauggaggcaggugcuguaucuuuuuaucuuaguugcuugugagagaggauuuguuuuugucucuuaacauuuuaaacauguuuucuuauuuuuaaauuauauauauauauauauauauauaucuguguuggugugcauacaugagaacagugccugcagaugacagagagggucuggagccauagacaguugugaacugucugacauacgugcuagaauucaacuucgguccucuggaaggguagaaauucucugaacugcugagcuaucucuccagccccaguuuauuuuaucuguaugugugugugugugugugugugugugugugugugugugugugugugaguaucuacuaugugcgcagagagcagcuggaaauugaggcgguugugauugaccugagacaggcacuggaaacugaacuccgguccuuuggaagagcagcaagcacuguugcccacggggcuguauguguagcaucauggccacaaucucuuaacggcucuggcacuuguuuguagcuccagcauugucuggagccugaagaagggaaguugcaggcuagucucugcaaccucuccuggcaaaagucagcaaauaugacuguaaauaaaguacagguggacgccagugcuucccucaguucauuuaagcuuuugguauuugucguuauuuuuacaacauacacucauugucacacacuuuugucuuuaaagcaugcuuauauguaagcugguugaggauucccaaccuguaguauucacacuaucuuuuggaauggggacuuuaagugaaugcuaaggauuucuuuuucuuacuuggagcugaaaauuuguauuauuuuuuugucuucacguaugaauguauaugauaaguguuuuaaacgaucaggauaggggcuggagagaugggucaguguuuaagagcagugacugcucuuuuagaggaccuggguucaaucccuaauacccacauggcugucuucauacugucuguagcucuaguuacagggaaucccacauccucacaaagacacacacacaggcaaaacaccagugcacauaaaaugaauuaauaaagaacccaaaauauccuuaucuuauauuuuugguugugagccuagccuuuaauggcugagccaucucugcagccuaagauguccuuaucuuguguacaguuauguagcucauacaacccugguauuaagaaucugaagcccagagggugaagagaugacucauugguuaagacugcucuuccagagguccugaguucaauucccagcaaccacaugguggcgcacaaccaucuguaaugggaucugaugcccucuucuggugugucugaagacagcuacaguguacucacauacauaaaauaaauaaguaaaucuuaaacaaagagaaccugaagucccugauagagggcaaaguaguagaauggcugccuuucaggucccugucauaaggaagaauugcugagugccgcugagugguagagcaugugccuaauaggcacuaaaguauggacagcuuccugccuuggcagaggaagcauguuuauugggugccucuugaaacagauaaaacucaguguauauuaauuuuuauuacuuuuaaaaaguauaguuuuuuucccccaaaacuauaguuuaggaauuuaaggguguccuuuugaagguuucuucuuugugaacagaugucugcuuuggaauaaaacagcauuuauaugaggaacauuuuauaauucuagagggauuuccuuaaguuaugagguuuaguguccucuggucuuuauacugaggaaugaaaugguaucuaaaguaugaaaagcauaauauauuuacucauuuucuuauauuguaugcuuuuuuauggcccaggaugggcccuaggugaacacggagaaugggccaaguacagcaacuuugauguugcuacccgugugccccugaugcucuaugucccuggaaggacggccccacuuccugcggcaggccagaagcucuuuccauaccgggaccccuuugauccggccucggauuggauggaugcagguacacacauacagacagacagaaggaauaaugccuagcaaugagaggaccugugcuuuauaugcgaacuaccuuaucagacaacaagcuagcccucuuugugcuauguuggaauucauucucaauacuauuuccuauacauauauuucuuagcaucucccaugcucuagguugggaguacauggcagaacuagagcugacaagaacagccacuguacauggggcucuugggaagucuagggggccaaaagagcaugugacauuucagaggugggagaacuguuuagaagugacaacagcauguuagacauuagaggaaguggcuauagacugcugggacaaagucuccccaacacacaaguggacuauuucacagauaugucuuauaucccccauuuuaggggggagacuuucaauuuugggggaguauuuucaauuuuggagcucauugaccuacuaaaacacauucauguaauuugcucuguacuccccagcaggaaagggcaucuacguugauuucuacaugcuuugaaaacagguccuuuuccaacuugugugagguggcugguguaggguucuaagacuuguauccugacuuuaucagcuguuguuuguagggugcuuuucugugaacugcgcuauaccagcgugcccccuuucaggacuggcuggcccuggacuccaucuuuaucacuggagucuugcaauuuauguucucuguuguauaaacugaucuuggguuuaaaacauucuggccuuucuggaguuuugaguuuugauuuuccuccuuuuuugcacauguugcaugcucuauguuucuuuccaaacaccaagagaaaagugaaauacuuucaaggcauauuuaacuauuuauuguuggggcaaaucugguagguaagaguucuuuuugaaacuuguuggaagacacucagcaaauagaagucccuguauuguaguguagccagugcuuuccaaguguaaucucuagucuuuaucuuuucuccgaaccucaauuuguauuucaaacaguuugucccacuuggcuagucagucugacaugccuagagcuaaacuuauagcgcuucaccuucauccuuaccuuugacacacuuuuucuuagaaaugacaauugucauugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggaugguccauguagagacuuccauauccagggauccaccccauaaucagcauccaaacgcugacaccauugcauacacuagcaagauuuuauugaaaggacccagauguagcuguaucuugugagacuaugccggggccuagcaaacacagaaguggaugcucacagucagcuaauggauggaucacagggcucccaauggaggagcuagagaaaguacccaaggagcuaaagggaucugcaacccuauagguggaacaacauuaugaacuaaccaguaccccggagcucuugacucuagcugcauauguaucaaaagauggccuagucggcuaucacuggaaagagaggcccauuggacacgcaaacuuuauaugccccaguacaggggaacgccagggccaaaaagggggaguggguggguaugggggacuuuugguauagcauuggaaauguaaaugagcuaaauaccuaauaaaaaauggaaaaaaaaauaaaguaaauucaucaagguuaaaaacaaaaaacaaaaaagaaaugacaauugucacauaggcccucagaccacaaaaccaaccagcuaaccagccaaccaaccaaaaaauaccuguagagggagccucguaaugacggcuccucagaggcugaaguaugaaaaucacaugcucaggacaugucugaggccauccucuggcgagagcagccucugcaauuuacugagaacucgccucaaaaccaaaaccaaacccccuccaacaacaacaacaaaccaaaacaaaaaugcaugcucaggguguggcucaaagcuacaguguuugucuagcaugcuauuucaauuccuagguauacauaguaugcaaauucagugccaagguucaauuccugcuacugaaaaaagaauguucagagucuuuucaauccauguuuuuuuuucuuuauuccauauaugcuaugcaaucuagcagcaagcauggcccucuccauucggaaucugucucugcccauucucaguuucccuuccaccagccuucugcuguagcagcuuucugaagucuccuugcaugugcccuugguucucgagucuucuuucucgugacauugcaaguaaccauuucaaacucaaagcagaagucgggaucuaccucggugguggaguucaugucuaggcuguacugaagcccuagcuucuuauccguaacacugcaaagaugaaaaucaaaauggaauauaaaaccuccaaauuacagcccugcacaggagccuccugugcucccaucacacugagucaaugucuucacaauggacauuaaggccuuacaugaccuccuuaucauguugccuccucaugccaugucuuugauucuucuugacaaguauccagaguagccuuccugugccauugucccacagucuuaagucuucuugacuagauugagugggaacaguuuuucagugauguacaccugccucuuuuacuuucauagcggugggguuuuuuguuuuuuguuuuuuuuuauaugagagacuuuuccuagggguaugcagcucucucucucucucucucucucucucucucucucucucucucucucucucucucacacacacacacacacacacacacacacacaucuacucccccaagaaagggaacccaugacacaccaaaggaacaauuacaccagaauccaacuuagucaauuagugaguuuuauuggagcugcuaacaggacucugagugaaagguuacucacaggagcaccaauuacucauaagcaccugcauugcugaaaagcccagauccgcauggguaugacucagaaaagcugggucccuagaguuuucuacacgguugcaggaagcuugacaguucuaagaggggaccugugaacagcugggcuggucagagugucccccuucuccagaauuguuuacugcugucaauccauggauggauauacacaaugugguauauauauauauauauauauauauacacauacauacauacauacauacacacacauacauacauacaguacgauauacacaauguguuauacauauguaguagaauauucuccauucuuaaaaaggaaggaaauucuagugugcuauagaauagaugagccuugaggacauuagguuaagugcaaauaagccacagaggcauguaggaucaaauacugagaccacucacaugagcuaucucuagcagucaaaugcauagugcuacaaaguagacugagaauuaccaguugacgguaguagaaaaaugggcagcuguuugguuuagugauggugauguucugaggcaguggaaacagagguguacaaggaguuguagaauugauggugaugaugacacaauaugaauacauuuauugccacuaaagcaugguuaagguugugaaguucauguuuuguguuuuuaccauauuaaaaagaaaauauggaucaaauacaaacacuuaaaaacaagucaucuucaacagauuuuuacacagcggguagagcuuuaauugauuaaaugugucugaaucaaguaucuagcucuaaacuuuaaguaguuuaaaaaugcuucuagcuggccagagacuguaacuuucccuccugcuaguccauugggugucauagugaagaguggcguccucaaguagcacuuccaagcugcuuuuacaaacaaauggauguuguguaugaagaagagaugggggagagguggugcucagacaggcuucugcuuucgcuggugucugcaguguacuacaugcaaccgugcuguuuccuguuucaggcaggcacaccgaggaccucguagaacuuguaucucucuuccccacgcucgcuggacuugcaggacugccaguuccuccucggugccccaucccuucuuuucauguugagcuuugcagagaaggccagaaucuucagaagcauuugcagcuccaugacuuggaagaggagccagacuuguuugguaauccccgggaguugaucgccuauagccaguacccccggccugcagauuucccucaguggaauucugacaagccaagcuuaaaugauauaaaggucaugggauauucuauacgcacuguagacuacagguacacuguguggguuggcuucgauccuagugaauuucuggcuaacuuuucugauauccaugccggggaacucuauuuugucgauucugacccacugcaggaucacaauguauauaaugacucccaacauggaggucuucuccacucacugaggccuugaguucugccagccucagugggcacauauguguccccuucccccccuacccauuguauuagauauaaccugagugggaaacaguggaaacaugcaucagcaaucuggccucggacuagguggcagauggcccuuuuuauguaguccuucuuaaguuagaauuugccauuggauuugggcuaagcugaaacuuuuauuuuaaaagcucccauagcuucguuacuacacaaguacaaagugaacuaagguauaaucuuaucuuuauaucuaaagaccaugcuagccagacauaauacuguacuuaagaaaucauuugcuuguugaauuuagugcauuucagauaguaaccauaugucuuacguagcccagagugucaagcauguuaacaugggauuuauuucuuucucaaaugugaaauucaaguugcuucuagaguuauugcuucuaagacuacagauuuagaaucaaagguaaaauacccaugugaugaucaaugugguguuucuucauuaaauaauaaauaaugcuuaguaaaguauaguuaaaguuaggaaauucaguuaaguauuucaauacucucuggcccaaauaauaauuuguuaguaaauacuacaauucuugaacucaguggcuaucuguuaaaaauucuguuauucacaaugaaaucaucucaaauggaacuauucccaugauuugaaucauuccagauuguauucauaugccuauuuagaaaacugcagauauccauguauccuggaggcaggagguauucuacuuuuugcuaaaacaaaacaaaacaaaacauguuuaugaaauguaaauuaucuugaggguuguggauacuuuuuauuaauaggguauaaguaauuuucagaauguaguucuguguucccuaaguacgaagguaacuagaauaugggcauguaguaaggauuagguuauuucauuacugucaccagacagaaguccuuccucuaacauugugaaaacuguucaauuaccaggagucaacagcuuucuaaauaaacauucuauguauuuuguuuuguauuuaaaugaguaauuucaauaauuucauuaaaaaugauucagugucucaagguaaauguuuuuaaaacaaaaacuauaguaaauagcugauuagauuaaguuacugucauguauuaaauuguaaccaaaaagucaagacacuacuuugaaguguguaaaauuucaaagagagauuguugauuuuaccagcuggccuauaguagaguagauuugucuguuguucugaaacugacuuuugcaaaggcuuugcucccaucuuuccuuguucuugaucuuuacugcucuccugaugucuacucagugucauuuuacaauuuaguuuagaaacuccucacagcauguuuucuuuuuuuuuuuagcuucaucuccuucauagagggacagauuuugacacaaguguuuauuugacaucuauuuauuguuccuguuuggccauaguguguguguauguguguguguguauguauguguauguauguguguguauguguauauauacauauacauacacauacauacacauacauauauacauauauacauauauacauauauauauauauauauauauauauauauuuaaucuuccaaaguacaguuuuaguuuaaaccccucugaauucugcuuccaaugacauauguggcuauuuaaauuuaaauucauuaacacaaaauaacauuuuaaaaaauuucuguuuuacuucgcacuuagaaccuucccauccuagcagacuggacggagaugcccuggauucgaucuagauguguucacccugauuggcaggucccuacuguccugcacuugcccacaaugagcaaacuauauuugguuuaggcauagaguagggaguuugcuguggccaucagcuucuuccuuccacucucaucaccauugccucuguccuucuuucuuuccuucccaagaaauuuccuuccccuccuuuucccuccccuguuccuuaaagaauccaugugucuuccuaaaaucccucuugaccccugcccuuuaagaacaccgucagugccuacuaagggucuagaaagaccuccguugagcagucagagucuucccuggcuccacaauaccccuucccuuggcugacucuccuugccaauccuuaccucccugguccuucaagccuuuguccccucuucuuugcuccaaccccuucacagccauucuucauagccuggcuccccuaccccccugcuuagaagcugaggcugucaggacucucuagaguguauuaugggggaaaaugaacacaucuuaaaaaucuguuauuugcuacauuuuuuuagaaggcauuuuuccucaugaguuugauauguuaauuauacagaaauuggaaagcagaaaugcauuuuaaaaggcaagaaaaugucugagugcuuuauacuaagauugccauaguuuguucuuuuugggguaugaauguuuuacauuucuugauccucuauguuguuuauaauacaacuucugcucuuucuuucugaacauuauguaugguugguuauuagugaauuuugcagauauuuuauauugcugguaauauguguuauugcauagauuuauuguaauuuucucagccuucuuucaguuguuagaaauuuagauuauuuccaaauuuucaguguuacaaauaaugcugugaucaauuuugugaauauaguguuuuuacguauuucaaaguauucccauaggcuaguuucucagugccaagucaucaaaaacagcuccguuuucucuucacucuugcuaugauagcauauuaaacuuagaaaagaaacucaaaaggccuauauuaaaaaccauaauaccaaaaaggaaagucuguaguccuauaauaauagaugagaguuguauucugcuuuaauaucugauucuuugcugauuaacgacaugaaccauuaugcucucuguaugacaguugugugacuuuguguggucauguuauggaucuuaccuuuuaauguaauaaaguaaauugcucuuuuccugugugacaguuuuuccuguauauuuguucuaagcguagaacaacucuauuugggaccugaauaaauacucauuuuccuuugaaauuuuuugggguucuuaauguuaaugucuuucuaccuaauuauaagaguaauguaugcuuauugugugaaaugguaaaaauaugaugaagcuaga

SEQ ID NO: 9529 - RNA, 2998 nt, Mus musculus
caugagaagcacagugcucuggcucuggcucuggcucugugcacuggagcugugccugcagccugcccucccgcaaauuguggcuguaaauguuccuccugaagaucaggauggcucuggggaugauucugacaacuucucuggcuccagcacaggugcuuugccagauacguugucaaggcagacaccuuccacuuggaaggacauguggcuguugacagccacucccacagcuccagagcccaccagcagcaacaccgagacugcuuuugccucuguccggccagccagagagaagcccaaggagggagagccugugcuccauguagaagcagagccuggcuucacuacuugggacaaggaaaaggagggcaccaccaggcccagggacaccaugcagcuccccaucacccaacaggccucaacagucagaguuaccacagcccaggcagcugucacaucucauccacacuggggcaugcaaccuggcggagggacgaaggcagcuacuccuuggaggagcccaaacaagccaauggaggugccuaccagaaacccaccaagcaggaggaguucuaugccugauggggaaauaguucuuucuccccgcccccacagccccugccacucacuagucucccacuugccucuucugugaaaaacuucaagcccuggccuccccaccacugggucaucuccucugcacccagacccuuccagcuguuccugccuaagcggucccagggugugcugggaacugauuccccucguuugacuucugccuagaagcuugggugcaaaggguuucuugcaucugaucuuucuaccacaaccacaccugucguccacucuucugacuugguuucuccaaaugggaggagaccuagcucuggacagaaaggggacccgacugcuuuggaccuagauggcguauuguggcuggaggauccugaggacaggagagaggccucugcugacaagccauagcacuuacccauagagaccgcuaggguuggccaugcuguggugggggauggaggccugagcuccuuggaauccaaucuucauugugaggaggucuacuuuagacaacuugguuuugcccauauuuucucuaauuucucuguucagagccccagcagaccuuauuacugggguaaggcaagucuguugacuggugucccucaccucgcuucccuaaucuacauucaggagaccgaauugggguuuauaagacuuuuuuugcuuuuuguuuuuguuuuuaaccuagaagaaccaaaucuggaugccaaaacauaggcuuacuuuguguguugucucugaguuuguugcucaugcuuacaacaguguauggacuaucuguauggugccccauuuuuagcggcccguaaaguaggcuguuuaguccaggauacuguggaauagccaccucuugaccagucaugccugugugcauggacucagggccauggccuuggccugggccaccgugacauuggaagagccugugugagaacuuacucgaaguucacagucuaggaguggaggggaggagacuguagaguuuugggggagggguggcaggaguacccaagcgucucccaccuuugguaccaucucuagucacccuuucuccuggaaguugacaagacacaucuuaaguauggcuggcacugguuccuccaucaagaaccaaguucaucuucagcuccuguggccccgcccccaggcuggagucagaaauguuucccaaagagugagagucuuuugcuuuuggcaaaacgcuacuuaauccaguggguucuguacaguagauuuugcagauguaauaaacuuuaauauaaaggaacaaaaaaaaagauuucaagaagggacaaagguucuaauucuauacuuauugucuuaguuaggguuuuacugcugugaacagacaccaugaacaaggcaagucuuauaaaaaaaacaacauuuaauuggggcuggcuuacagguucagaaguucaguccauuaucaucaaggagggagcauggcaguauccaggcaggcauggcacaggaggagcugagaguucuaugucuucauccaaaggcugcuaguggaagacugacuuccaggcaacuugggugagggucuuauacccacacccacagugacacacccguuccaaccaggucacaccuauuccaacaaggccacaccuucagauggugccacucccugguccaaggacauacaaaccaucacacuuauguuuggacuugcuuaguuaaugagaauaggagaugaugacgaucauaaggcagaaaaaacuaacaauauuaguguauucuucaugaaaaugacaaguucuuucccacuacccaagaaaaaccuguuugaaugaccugaugucauguaacaugcuacaauuuagacucuuuacuuauguguuuucaaacggaugauggucuacaucauagaaaaggaaauugagugucucauuaauugcauuaauaaguguaaaacaucuccaucuaauguacuuuacaaagcagcaacauuuuggaaaaccaagaaaucacaaguuguccacucaguagaggaagaaugaaaggguucacagucucuuuccaccagcucccaaaugagggcacagcagugagaacaauggcucugucugaccugauguuggauggcaauuuccagugcacuagaauggggcccagucagagcacaaguaccaccugcugggcgaaccugauccagguucucuuugucugauuucucaaagcaucuccauaccugaagggauagccucuaggauuacucccaguuguguuggcaaaaaauuccaagauuuucacuuuggucauuuggguuugugcccaugugccccacagaaacucuuggcuaggagcaucccugucagggaccuggauguaugccggguacccuuccugcacaaaauucccaguagugagacuccugagcucuccacauggaaaggacccucuugaa

SEQ ID NO: 9530 - RNA, 17436 nt, Mus musculus
uacggaagccggaaggagugugggagacaguugguugcucugguuucuccuggcggcggcguuagcgacgaagcugccuuuggcagcaugaacccgcugugaggcgcaggcuucgcggcgcggggggcggggggaagaggaggacgccucggcgaaguucuccgccaugaaccugaggggccucuuucaggacuucaacccgaggugaggcgguuaucccggcgacgccagguuggggcuuggguucggguagcggcugggagcggcgcggcggccaaggcacugcagucugagcacccaggcaccagccugaggcuccuuauggcugccagcugcucucgggaaagcuguguuggccucagagucuguccauccgcuucuuccuccgcaacugguaccaacccgccguggcccaaguugucgagguuggagaaguguccucccagagggaagcccauugaucuccacucguccuuuuucauugguauuucaacuucucugucucgauuuauuuuuucuuauuuuucuucucaccgcuccgccugcccccguuuucuaugccagggccaucucacuugacccugacacccccagccaccuucgcacauguuuccucuaguuucagcauuugggauuuuccuuggauuuaugccugucugccguucuucgcuuauuugucaaacugaugucugagauacugaaauuuuagagucguugccaggguaugguaaaucuuacauaaugccuuugggggugaaccugaucgccuccaacgcauuuucuuagccuucucuauguaaguuuauucgcaggaaguagauauugcccugcuuauuuuccagacuugaaauaccuagugggcaguguggagaaaacacuggcuaaaguauauaaaucucgguccuugcacuugucaaacuguuguaaaaguguucccucugcggccugugagcucccaaagcagaaaccacuuccugguuguucccuugcacaucaccucccacccaucugucauauaguagacacuuauaaaacgucuuuggaacuaaacugagucaagacugagguugggcagucaagugauucucuacuuuaguaagcugcaagaggaguucauuucacugauauuuuucaaguccauuacuauuuaaaaggaauaucugcucauuuuauuucuaagugguaagacacgcacucaaguaagcuagccuuccuccguacgugagguccuaggcuaggcgcuugcaaugcuuggccguccuagccuggaagcaaugggaauaugaacagauaaguagcuguauugugcacuccugaggaugccacuuucuuggcuguuuguuggagacaaaggaacuggggagagaagaggggacuauuuagagugcagucuccuuaagaaugguaaaauuuuaaaauuuaaagccuccucuggccugggugcucuuacugucuuuguguuuauagucuggccuuguuccguggucaucaucaauggcauugagccuucuuaacggagaggaguucauuuagaggaacuaccacagagccaaccauagcuuuucuucuacugcuccuggauuaggguuugucuauaggacaacuguguugguacugaagcuggacaggucuuguguauuuucauuguuuggagagagugacaagaaacagaaauagaggcugaauuuuuuguguucuuggguaacucacuuaucuguuucaucuguagaaugaguauaauugcucacaaggcuauugaaccugaauuaauggcugauugcacaauguguuacaaauagaaaucguuuauuaugggacagauaguccagaagcugcaaggugaucucccaguuaucuaagaguugugaaagcaaaaauagugguccucugauaacacccuuagccaguuuuuccuuuacuuuuuuucccuuccaaauacuaaagucuaaaauuuauaaugagauacuucgaagagauuuauaaugaucaucaacacauuuauuugugcuuaaauucuaaguggaauaaaaugcaucuuucccugaaaaaauuaaaagucuuuuguaccccaccauuguccugguucaaugucauuagugggaaggaagaguguuaccuucuagauguuccagggauacaauggccaggugauauuaagaaguagauuuuucuuagcuggcgauguuucauaaacuguggaugaucuaguuuauaacacuguaucuuaaucuugcaccaugcugacgaaagccuuucagacaucuggagagcaaacuuggggggggguguugacaggaaagcacccugugcuaagaccucagaucugugcuuuugucuaauuaucuguuucuaauucugaaccaguucacacauggcccucuuacuucaggacuuuaucaugcucugcucauuuaauaggacagcuccuucucuccuugauucaggucccauuuaucauugaaauaucuguucauuugguaguugcugaaguaaguuguucuggcuuccucaaccugguccauuccucccugcauguacaaucucuguagaauaucauagucuucuuuagaggccuuaucugugcucuugcucuuuuucucuguuuauuuaauugauauuucucucuccuacugaaauucaaaccaugugaggcuaaacccauagcuuuuauugucaaaauuuauauccaugagauaauggcuggcacaguauuagugaaaugaaugauaacucacccuagccuguaagaaccgucuagagcuccuucuugucaaugacugcuuucuugcugguguaugaacuauuuauuuucccucucucuuccugugccccuucagaguguaacuguuguauugacaagcugggaaagaccuuaacaguacgcacagggcaaugugcuuucuugacucuggggaccauuacagcaacagccauugguauugucugcuggcucccacaccaugcacugugacuccaggccuccucucauaccuugcaaaucuuagucacugagaauucacugcaguuugucaguuuucuagaaauaguagugacacagaaugauugaaaaguguuuagcacccagcugugaagggcugauagcugacccuauaccuauuuccaucuaccacagaucugguugaucacgaacuucuuuucagaauugccuuuuaguuacaaaguuaaacuuauuaaaacauacugugucuaccaagaauccuucuugacugccugaagccucuaauagcuugauugacuaaacagacuauuagaauugacuaaacagaauuggaaaacugauuccagaaugucccuaggagguggagaucuccuccaccuuuaauacacggcuuuaauaggcaaccugacuauaucacaaggccuuggauaaaguuguuauuuguuagagaaggcccuucagccguugguagccauacugcauuggaagacugugagaacucuguuuagucuaccagcucauuagcaguggacuccugaugggagggugguccaucucuuggguauucuagacuggaacaaugaguaagaaaugccuuacugggcuuguguauguggacauguaauacuaaugaaguaaauuauguuugcagaguuccuguaugcuccaucuuaagccauucuuuagucuuuguaagcuguguuuuauuuuaauuuuuuggggaaauacuaaucugauugcugguaaccuuucacuaaaggccucugcaggcaccagguacauaugugguauauagacauacaggcaaaauacccauucauauaaaauaaaguaaaaaauccugaaaauaauuauuuaaaaagaaggauggguauguacugcagaaaauguguguaguguuuuaaagauaaaugauguugagcuuaggguauaguucagugcuauggcacuuguacagggcauuagguuugagucuccagcagaguaaaaaugacaucguguugauuacuccaaguacuccuuaaagauuguauuuuucaaagcaggccacugaucugucaguaugaguguagugucaguauugauaaugaauuacugugugauugauuguacaucuguuguugggaaauauagagcuacugguugucagaauauugucuugacuuuuacugauuaauuguuguuaauggcuauggcuuauuugcauucaccaugugucaacccucacuuggcaguuugguuuucaguauccuuacucuuaacaauagcccuacaaauaagauugcagccacauuuuauuuuauuuucuaauuuaaacacauuuuaauuuauugauuguggagauacauaugacacacugugcuuauggaggucagaaaacagcuuucaggagucaguucucuucuuccugcauguggguccucaaguuauccauuaggccaguggcaagcgccucuagcuacugacccaucucucuggccucaguuucauuuuagagagucuuggaguucucuaaagucauacaggcaguuaugaaccacuccaggauucuaauccaggucagguuccuucugaaguuuuuugcuucauccuucaugccccuuccuccugugacagaguaaauccaguauacugaggagccauucuagcuaguuuuuggucacauugacaucagauagucauuugggaagagggaauuacaaaugagaaaaugccccucagcagauugccuaugggcaagcugguggagcaguuucuugauaaacaauccauauaacagggcucggcccauuaugugccacuuucugcccugcccuggcuaugacuuucuaugauugcuuugcuuagugaugguucauaaguguacauggugaguaaauuuucagauaaaaguacugaauucuagguguaggugcuguagaacugauacuauaugauccaguagugagaaaagugaucaccaaauaaacgucucucuuuaauaauccuacagaaauaaucgguagaacacuuauuauuuccaucauguuuccacuuaccguuaucuuaaugaaucaguauacgaaaucagaugagauaaaugcuguaaggaugguugaguguccaucuucuuuacaaugauuuguuuccucugcauuuugugcauuuguauauauuuuuuagucagaugcucuuaaacauuuguaccuuaauaaaacaaguuaaaauuuuuacuaaaacauuuuucuguaugguaauaaaguuuuauuuagccuaagaggugcaguccuuuuaauaauuugugaaaauauccauaguuugucagcuggagccagucucuaaagucauaaacagaaguaugucacuuaaaguaugguauauguguacggggcuagcuuacuugcauucauauagaccuauaucuauacucuaggcaauagauuuuacuggagaaacccaauggcucuaaaaagaguccagcuguauucauguaauuuagaacuuuuauauaauuuauauauaguuuuuaaacauuauuuagaacaguuuagaacuuuuauaguuagaguuuucucuuuggugaguauccauauguauauguauacacacacacacacacacacacacacacacacacauauauauauauuuuagaaaggacaguagcuuuuaugccuggcccauggcacauugcccagugguaaugcacuuaugcugugaagucagauguggaugauauaacuccauuuuaaagauacaucuaugguuugaauauagaaucaaaauuuuguguuuuggaaacauaauucucacauuaguauuuuuagaaaaauuacuauuuuaauuuuguaugagucucuugccuucauguaugucuguguaccacuuugcauucaauacacacagaugaaagaagagggcauaggagaacuggagucauagaaggcugucaguugccaugugaguucugggaacuuaagcugaggccucugcaagaacaaaagguauucuucacuagugaggcaucuuuucagcccuuuaaauuaaaauccuaauggcaggagaggcaacuugagagauuauuaggauaccauauacuuguauuuuaaaaugucagcuucagaagcaggaaaaaacacaguaauuucauauaucuugacaucuggguacaaaauuauuucauacuccaugugaugaauugggaagaagagccagucuacaguagauugguaaagcaguggucaaguggaggaaaaagcacugcugugcccaauuuucaugggauuggaauaauuuaggagaacuaacaggugagccugauuauuuguuuuagggucucuguuucuccaauugccucuggaaccaguuccauggucaccacuucucuuuuuccuacugccucaggcagaucccauacuuucuuuuccuagcucccaucucacuuuguccauacuaccauuuauacaaauguuacaccacauuauaacuguggcuuucuguguagacuucuaucagaaaacccuuggaagcaggagacuuaauuacucacuuuuguuuucucaaccccaauacaguauguguucuacauggaacuuuuaaauaaauuguuauggaauuagugaguguaaaauguauuuuuaccuuaucuuaugugaguauuuugccagcaugugugucugugcauccagucuguacaggaucccugcaauccagaagauguuguaccaucucgaacugaagcuguagucaaucauuaacugccuuuuagguccugaaaacugcacccauguccucuagaaaagcagcuagugaucuuaacuguucucaucucuccagccuagaauucaugacaagucuaugaacuaaaauguuucuguuauuucuccucauuucacuaucagauauuuguuuaaaaugaacucuuuuucacauuuugcuuuccuucuaguaaauuccucaucuaugccugucugcugcuguucucugugcuacuggcccuucguuuggauggcaucauucaauggagcuacugggcugucuuugcuccaauaugguuguggaaguuaauggucauuguuggcgcaucaguuggaacuggaguuugggcacgaaauccucaguaucgguaaugcugcuuuauaaaacccacuggucuauaucuuaagagaacaaaaucuugaugguucucacuagagauaacauaaagucaauuucuuucuauuugaacuuuuaugagaacugcaguccaacaaauauuccucaucaggauuuugaaaacauagacacuuguuauguauuuucuuacagaacaguguuaaucuggaugguuuaaugccuagaaagccuacaggcguagcaccagacacccaaauauagaauuguuuugccauaacagacuaaaaagcacagaaacacucuguaucuauaguucucuggccaugucuaccaggcaucugacuuggguaguuuacauuuagaacuaggcuuuccuuucuccugcuccucuauuccuguuaguuaugccagggagugaacucgggccaaaggcuaugagucccucaggaacuggagacugagguaaacuaagaaccagauguuaaaaaccaagguagagcuuugggagucauggaaguugugacaaccuaguguggcuggauucugugggaguugcaucauuuccuuucucaaagauaagggacgagagaaaaggaguggaaagagugagagccauuagacaucuacagcaggaagaugagugcagguauuccuaauaggacagugagauacaaacagcuguucaugugaaagaauauaaaagauggggauacuucagcuuuaaaaauucuugauuuaacaacuuuuaaaagaugcuauaguuuauagacuguauaaagugcauaucucauaagcauguagaacuuucaaagagcuccacacaacaaauacuagcaaaugaaggacauuaaugugugaauaugucuuuucuuuuucccucugagaucauaauaugccaggcaguaguggcauacacauuuaaucccaacacuucggaggcagacagaagcagauaaauucugaguucaaggccaaccuggauaauagagccaguucuaggauggccagggcuacacagugaaacucugucucuaaacacagagagagggugggaaugaauaaaugaauaaauauaauauuugaauacuuauuuuuauuauuauucauaugaauguauaucuuauguaugaggauacccauggaggcaagaaaagggugaugaaucccuggggcugaguuauagguggcugugagccacccuaauguggguguugagcacuaaauucaaguguucuacaagaauagcaagcagucuuuaccacugcaccauuucuccagcccuuaucugugguuuuauaucucuuguauauaucucucuuuuuccuccccuccccucccccuccccuccuccuccuccucuuccuccuccuccuccuccuccuccuccuccuccuccuccuccuccuccuccuccuccuccuucuucuucuucuucuucuucuucuucuguguuuuguuuguuuuguuugguugguuuuuuuguuguuguuuugguuugguuuuuuugguuuaucaagacaagguuucucuguguaacaggcccagcuguccugaaauucacuuuguagaccagguuggccucgaaugcauaaauacccacuugccucuaucucccaagugcuaggauuaaaggugagcgccaccaugccuagguuuuauagcucuuuuuuuaugggaaaaauucagauaucuaguucuuguuucucaaaaaaacauucacuaauugauucuuaaaaguuauauguaccuuuuccucgguuuugacauuuuucaaguaagaaaaacaguuguguuuguggcuggcugguuguauggugugcacaaacacaguuauucccuugugugugguauucagcaggaugcuagugaagucuacaggaauugccuguaaccuucuuuucucuuuguucuagucucuagaauauuuaucacccauagggcaagcgggucacaaaucuuuaucuguauuuuuuaaaagguuuauuuauuuauuauauguaaguacacuguagcugucuucagacacuccagaagagggcgucagaucucguuacagaugguugugaaccaccaugugguugcugggauuugaacucuggaccuucggaagagcaguugggugcucuuacccacugagccaucucuccagccccccuuuaucuguauuuugaaugaacauuauaggccuuucaaauacauuguaaacauuuuucauuuuaguuuauuaauaguuuauauuuauauuuauacagcuaauuaaacuaauauuugagcaaaacuuuuaacuuucuuuuuaauuuacagguuuuaauucauuaucauacuaaaauaaagauuaauaaaaguuauuuuauuuuauuugcauuuaaaguagcaccuaagaagauugccauaucuuauugaauguaaccuacacuugcaggugaagcgagaauuauauuuauagaauugcaugaaauaugauuugucuaguuuuuaauucagugagaagugaggaucuugagauguggcagaaguaauuaauacaauaaucuuagaaguaacugauaguugauuaaaguuaggaaccuaaguguuccugaauauuugcaagauuauuaaagauagguuuaauuuagcuuuuuacuucaucuuuuguuuugcauauuuacaguugaaagucagaaugggaauugacuuggcauuugcugugcacuauugugggcacuuggacugaggauucugaauguguuuuuuucuuucucuucuucuuccaucccccuuuagagcagaaggagaaacauguguggaguuuaaagccauguuaauugcugugggcauccauuugcuccugcugauguuugaaguucuggucugugacaggauugagagaggaagccauuucuggcuucuggucuucaugccauuguucuuuguuuccccagugucuguugcagcaugugucuggggcuuucgacaugacaggucacuagaggugagauuuguguuuuacuauaaugucagucccuuacccuucaucaggaacagacuaaucauuaacucuagauugugguuuacaagagaacaaagaccuucagcuuucucccaguguccugucuaauaagcuaccuguguuugucaauccuguuaagcaaccauuagcauagauagaaacauagcuacaaagagagagacuuuagggaauguauccacaugguugugaagcuggcagccuacaucuauagaauagauaggcagccuggggacucagcaggaguugacccucuagguugccuaaauuuccuccuuuccaugauaaagccuccaacuguuugaaugagggcuacuuacccuacaguauuuaaaaacuugaugcugucaaaguaacacauacccuaguauuuaauucgauaucuugguaaaauaguccaccugaauugauacauaaaauuuaauugucucacuaccucauacccuaugcugucacuccuuagcugaccucuaguugccuuauccugauuuacccauauauuuauuuuuuaaucaaguaucuauauauguaagcucuuuaggcccaagaagagaacauauagaauuaaauuaaaaugcuaagacuaguaaugguaauaaagaaaucaauuguggauaauauuuauaguauccuuaaucugugucaaacauuuggauguucaccucacaaauagcagcaacuuaguaaauauuuacaacagccugugagagaggugcaguucuuuuuccaggcagacaauuuauucaugaccacacauuaaggaaaaaggccagaauuccauuuuagucagaccaaauccaaagccagagcaauuaacuagaaaggaacugaagccacaaagcaauauacuaguagauuuagaggagaaugggaagcaguagagggaccucauucaggagauagugagcucacuuggcgaucaguucaaugccaggugcuucuaggagagccauguggcaacugcacacuggaccuguuauucagcaguacggcuagcuugcaggcacauuucagaacuaaucacuaggcaauauguuaaucugcaguguugcugaaacuuuccuccaccccagggagugugaaugagugugugugauucagugaaagggaugucugucugaaaugcuacaaguauagccauuuacggaguggauagaacgggagcccaagaagaacuucucugagugcucacagcaugccaagacuggacaauaugacucuugaaacucaguuauuaguacaagaaggaaggagauccaccuuaaaaugcucucaaaauagccuaguaagauguagauaaaaguauucugcugccuauuaguauugagggccuugguaaauaggaguuguugguagcuuagaauggaagauguggcaauagggccuuaugcaguuauucuugccucacaaagcuggaauguacccaaaaaguggguuaggccaggagugcugaaucacaggagaugugaacuuacuuguauuuggacauuuuggguuuaaugggaaauuggcaauuaguuucugauugggaaagggcaggagcacagucaggauuaaugcugcaacaccgaaucuacaacuguuggcuuaagcugacuaggcccucaaagagcuagaaaagaaggcgugggauuuacggcagaguccugguuagaaguagaagcaaguuuuaggguaccuauaaaucagcuguauacugauuauuagcagaagcagaaaggaggcuuggaggaaaucuauuauagauugccccuuuugucuuucuucuuucaaaagaaggucauuauccggccaacauucaggucuuaacaaaacagccaaggcaccaaccagccuuaagaaugaaacaagacacaugugugcaauuccccucaucaagaccccacugugcauuuccguugcuagaacagucagaagcuuccagcaucauaucauucaaguuuuacaguauucauugcuuaggaguauguuaaacgaacaaccacuauguucaaugcagcuuguuuaacugauucuuuccuuuaucuuuagcuagaaauccuguguucggucaacauucuucaguuuauauucauugccuuaagacuggacaagauuauccacuggcccuggcuuguacguagccuuuuaaaaaucuuaaacaaaucuuuuauuauaaaaguaauucauauuugugucaaaaaauuuggaaaaaaaagacaagcaagcaugagcagcagcuacugaucacaguaccaacccugggagcugacauaguaguggccuuuacucccuuguacauggauaguugacauucauuucuauccagcuuuuuuauuuuaauauaacuuaagcauuuguucuuaacaaauaucauuguaaagaugacacauaaggcuucauugacucauaaguugcauuuaugaaacaugucuaaauguuucaguugcugcucauauuugugauuuuuaaaugugcccguuuguauaucuguguuuaaguuuucuaaauuuguaacgauacccuacuuauauauguuuaugaagaacaguagaaccuuucauuuuguguuuugaauauguaauaaucaaaucaguuucauuaccauauuaccucagauguuuaucauuuauucaugcauggaauuuucaaaaugcuauucucuuuuagcuauuuugaaccauuuaauuauuaucaaucauaauuauucugauguucuaaaaacauuacaagauuuuauuuuugucuccaaccucugguguauuuuuguguauaaaaaaaaaauccuuguuuacuauuuuaauguuuucuuagaaaguauucaagaaaauguauuacugaguuauagauaauuuuuaaguuuuugauauuuuauuauuuuuauguguauggauguuuuccugaaugcaugucauuaaaaccugcaaaucagugaaacauucuuuauacauggcaccaauaauaugagccaugagaugaaauuauaaaguuagacuucauaaaauaaaauaaaauaaaauaaaggaaaagacaggucacugacugaggaauagguuuugcaaauauguauuaaaacuuugacuucuggcaaauagcacagagucaauaaaaaauaaggacuuacucaugugcucagacccacacagacacacacauacacauagauaauugagggagucaguaacugguguucaauaacuccgagugagaauaaacauacagaagugagugcuugaguaagucugaguaaaggauaugagagcauaugugagcaacugaaugagagggaggagggcgucuacaagggaaugccagaauagggcugugggaggaagugugagggaaaguugacagaaugagaauguagcagcgaagaauaauucuuagaggagcagcuagacagagugagcacgaggacuauuugaguaaggaagugugugaaugagggccaugaagaggugaggauggauaugagaguaagugugaagaacugaguguaugagagcgaggagugaggaagaugcaagggaggaaaaggggauuccacucuucuggauuacauacguggggacucaguggggguaggagagaggaguacaugggcgaucaugggugagggagugagcggggugacaugaguaugugaggggcagugaggacaugagugagcagguaaguaagacguguguaugugugagagugaacaugucaguaacugaguuagggagcaagacacugcgaguaagggaguaggaacugagaaugaaggagugugugagugacugagaggcaggaagcaugggaaugaguagaugacaaaauggggggcuugagacugagggaguauauucagaagaaacuuaaaauaugccguguuggaggaccagauggcagguuguugcuugaauggaagacagccuaaugacauuauuuccugcauggaaguccucuggugaaugugguguuucccaugcuaucuccaugacaguccuggacaguaggacugucuguaguccugcuuccccuugacuaccugaacagagccagcaaaaugauaaaggcagcugccagagcugcagggaagcucucaagacaucguguuucuacuccucuccagguugugugugucccucuguggauucucauguccuucuugugccuggugguccucuauuacaucguuuggucgguucuguuccugcgcucuauggaugugauugcagaacaacgcagaacacauauaaccauggcacugagcuggaugaccauugucgugccucuucuuacuuuugagguaagcuuucuacaggaaaucucuugugcucccacauucuaccuuuaucugggacagcaucuaccauagcuagauagguacacugcuguccuucugggagagagacagagggaacuuggaacaaugagaauguacuugcaggacucacagagagcaguaugccucucuacccaugaggcauuuggccacauccagcuucuacucuaaaaggauguuggacuacccgguuuuguauugaguucaguagggaauacuagauauaauugaacaaauuugacuccuuugaacaaauccugggaaggauuucucauaaaacuggcaguggggaucuuucagcuuguagacuuuaguuugacccugggggaggaugcaauauuucccauggucuuuuuuuuuccccuggauggauacuaugguggccuucccucuucucagauaugacagagggagggauuauaaugggaacaguuacacauuugguucauuuuaugaugauggauuaauaccaccuuaacuuugucuuucucuagauccugcugguucacaaacuggauggccacaaugcuuucuccuguauuccaauauuuguuccccuguggcucucauugaucacacugauggcaacaacauuuggacagaaaggaggaaaccacuguacguccacaaacuaagaaacccuguguguguguggucugcacaugugcugcucuuuacaaaaugcuaagacucaggguccugaaugcuccucaauggaauggaaucuuuccaauuugguagagcuagaguacugugucuagauuacucuguucuauggcaugugcuuuggcgguggucuuugaggaagauaccauucucauaaggcugugagcgccacuucauauaacccagagaacugcccaccuucccgccuuggaaguggggaguguacagugcagugcaggcugagcuguuguuuuuauccugggagagccagcacuaagcugacagcuuauugaagcagcacagcucagugaccuaguuugagggguucccaugaggucagacucaacuuuggccaauuccuucuugugucuacucagauuucagaugguuccaggaguccuuagcuuaaauaucacugcaucaccaguuaguuuaaccugggucuagaaaaugggaagaaggugcuaugcucuagguuuugccaguauuugagaaucccuuuccuagucagugguucuauagcuccagcuucuaucugaaucaauggcuagccagguaaagcugcacucuccagccuaccucaccaauuuuucaaccaggagcucugauuacaggcuggagaaugaccaccucucacuggugaugcugccagugcuagccugggcucucacucggggagcuguggagcuggaggucuccacuccugcuuauugggcaguuagagccuggucaagcuuuacuugugaggaaccugggugaagugauacauagugccaguagagcuccuuguucaggaaagcugugugauaugaaagccucgaguuugaaagggaaaauucuuauuuuucagggugguuugguauucgcaaagacuucugccaguuucugcuugaaauauucccguuuuugagagaguauggaaacauuucauaugaucuccaccaugaagauagugaggaaacagaagaaaccccaguuccagaaccuccuaaaauugcaccuauguuccgcaagaaggccaggguagucaucacccagagcccuggcaaguauguccuuccuccacccaaacuaaauauugaaaugccagacuaaaggacgccaccagggccgccggagugugugugcacugagacacacacuccuacuucccuugcccccaaccuagaccuggaaccucggaccaccaucugaagccucguuugcauccagugucaaccagccacucagaacagaacauagguggcagggacuaaggguaucuuaucaauguggaugccagugacacaugagcaaagaaccuauuucuuucguauggguaccugaaauguguucucauuccugugauacccacccagggaugacugcugccuaggcccacagaaagcacaucuguggucugggcagauuuucuagugcuaaaauuccuaucaaaguauugaaugaugugguuccucugggaccacuuccaucuguggcucagcugugcugcuuauggguagccaguagggacuauaaguaggucuguacacaccugcuguguucagauacagcccggcccugcuuuccuugucucugcuguacagaaauuuagcuuuagccaggaugacagcagguuugcagggccucaucagugagcccuucccaauggcaugauuccaugccuauauaguauuuauacagcuauuuuagcacuguaauauacagugucaaauccuaguucuguacagcauauucucuguuaaaguauuuuuuuacaagcuugugcuggagauggauggguuaagccaugggagaagcagauagcucagacugcuguaucucagucagaugccccaccucacuuaccaugcccacugauacccuggaauuucugccagcacagcuacuacaaucaaggaaagcucugugcuuuuccaacauggggugugggagaaauggcuuaaaagcccaagaaaugcccccuugagaccaggacacuagagaagguugccaaggcaggccagaaucagccaggaacuccugcaaagucgagagcauucugccuaccugcaagaagaacacugcauacugggcaugcagguaccaccaccugucagcaguuucuccaggcucugcugguauagccagcccagaacccaucauaccagaaaauaaccuucagucuaaaucaaaugauucauucauggucaccugaucaguggcuucagucacacauaauugaagucucuaacccuaguccuacccuuggcacaggccuccagugagccuguucuguuucagaagaaaggggaagcaguguagcauuuuuuguuuggucucuuaaaaaugugguuaaauccacuauuuuuugcuccuguaguucaauaaagugguucauuuuacauguauacugug

SEQ ID NO: 9531 - RNA, 104927 nt, Mus musculus
cauuacuugcuuuaaaccuucauuuagcaccugggaaaauagaacuuacuggcuggucaggccuccguaaggaggcucccaccucaacucugaauucugugagaaaaugugagagcaguaucaagcagcagcagcaguauucucaucuacaugugagccauacuugcaacucuccacugagcccaugguacaguauauccuugcuaaguguguagggcaaguuuuucuauccuuuguucuuccaggcuuccuuauccccauguuaggcuaaacuuucuacacugaaauuuacucauauagcccauguucauaguuguaguuugggcaacuguacacaguuucauaauuaccaucacaaucaagacacaguacacuuugauuauucccuaaauucuccuguugcuaccuuuggacucaguucucucccauuccuuugcugugaccccaaucaacuauaaauaucacuucuaucaccauaguuuuugucuuuuccaggcuggaguuuaagggguugggaguggugagcucuugccuagaaugccaagacaaugacuuugacucaguuccauaaaaacaaacuauaguaccaauggaauagcaugguauuuacuaauuuguauauaguuuauuucauuuuacaugguauuuuguaauuuauucaucuuguagcacauuuuauaacuuucuuccuuucuauuucugaguaauauaccaguaugugcauauaucaucauugauuuagccauucauuaguaaugggaauuugagcauuuauauuuuuguuaauguuuuuaguuaguauaaaaauuaauggagagauggcucagugguuaagagcacuguuugcucuuccaaagguccugaguucaauucccagcaaccacaugguugcucacaaccaucuguaaagggaucugaugcccucuucuggugugucuggaaacaguuacaauguaaacauauaaauaaaauaaaucuaaaaaaaauaauagguuucaguauagagacaaggucucauauauccaagucuagcuucauauuccuuaugcagcacaugccugcaaccccagcagaggaauacucucacuugauagaugaaaaaugaaaguuuauggagcaguauuugcauagaugaacuaggauuugaacccuggcuccuugauucccagcucucuuucucucucucucucacaucacucuuuucaugaucauccugguagcuuggaagcaucaccuucuugaaauacuuauauuuacccugaauauacaaggguguaauaauccucaaauguguucuaggacuuucuuuuucccagaggaagcuaguucauguuuuugagaagugaaauggcuuucccauagccaucagcuugccuaugaaaugguuggaauccaaaucacuuuuugauuccaagugcauacuucuagggcccuaugucucacagggacauuuuuacucagucuuucuucaaccuuguacuuccuucacaaggaugucucuuccuguacuccaccuuuccccauccugguccaugaaggucagggacugagaaucccagauucucuuacaggccuggcucugccuacuccauucccccaacuucagugaacauaguaauauccagaaggcagaagugagugagucacuuagcucaaguuuuggcaaaaucaagaauuucaaggagucagauugguggugggggacagaaauaaagguacacggguaucagauguacaccucugaaaaauuguugaagaaguagccuuaugucacagccauuaucuccaugaccgaaacaggcaggucagccaucuucccauaaagcucccuccucaggauaaauauguguauaucuguauauaaaguucagggaaacuugaagaaugguuuaaacacacacacacacacacacacacacacacacacacacacacacacguccuauccugaaggaaguuaggacuuggugaacaauacagucaccucacuaaggggucagugguaacuccucuguaacacacaacauuuauauuucacacacacacacacacacacacacacacacacacacacacacacacgaggcuacuuacuaccuguagccucuccaccccugacagaaggcuuuagccucauucuuggacacuuaaaguaugcuuaauguauacaugucuccauucaagcugcugcuuucccuccucccaucuuuauuuuccucuaccccucugaccccaagauugacagacaucgagaauccaguuauuccguaggcaccagggagccucucugaagcaugcaaauuuaaugagaaaugcuuugaaauacagcacaaaugugaauguaauucaaagaacugcacagucuggggaggggagcuggcagaguagacauucaagcggaugaugacaucaguacaaugaaaaggacuccggggggaagcuucuaagucugccuggcuuggaaacaaaugcuauucugcucucuguccagaaguuugaccagucuagaagaaaagaauaguggaaagggcuagaagaaaaacacuagacuaucuagagaauagaaagauuccuguuaacuuggagggacagagagaagcagacuggaagaaguggcuaaagaaugaauuggguccacagaggucucauuucagaucucucucucucucucucucucucucucucucucucacacacacacacacacacacacacacacacacacacacacaccacaaccuccucauaaucacugaggaauauagaucucacacuagaugcuugaaaccauuaaucuagauagaugcaaaaugaaacaguacgacacaugaacuaagcacaguaagaagguaauaacaacagcuagcaauaaaauuauacuauuuuugggcuuuuuaggccauuacgaaauggaagauuacaggaacauaaauccugaaguaccacuacaaucaaucugacaacuuaggcagcaaccaagugacuaccugguaggaaguauauagauaacacaaauaaauguccuggaaaagagagugaaauuuaaaucuuaugaauuguuuauuucugaaauauuccauuuaauacuuuuggaccacaguucaacaaguagacaacugaaacuaugaaaggugaagcuaaaaauggguaggguauuuuauaaugauauuugaauaugugugaauauuugaaugauacuaggccaaaaaaaguugcuuuuagaugcauuuagaacuaaucaacagaguaagaaaaaugaucauggugaaguaauuccuguuuacccaaacuuaucacuuauaauaucggacacaaaauuaagagacauuauuaugcauguucuucuaggagucagaguguguuuauuugaucaaguguugaacugucuuaaauuuucacccgcucccugcuuucacuuuccauuuacuguuuuuuuuuuuuuuuuuuuuuuucgagacaggguuucucuguguagcccuggcuguccuggaacucacucuguagaccaggcuggccuugaacucagaaauccgccugccucugccucccgagugcugggauuaaaggcgugcgccaccacgccuggcaccauuuacuguuucaauggucaucugacccaacucucaaaaagcagaagaaauuuugaccuguuucuuuuuacugguucaguaguguucuugugaagguccuagcacagcgugagauuuaccacagcuauauuguggucuuaugaguugcagguauuguaccagaaucagugauauuuuucaacuucacccacccaauaauaauaguucaacuuugugacaccugcuacacuuuaaucuaguauaguuuucccucuagauuucucccucuuuuuuuuuuuuuuuuuuuuuuuuuuuugacagacguagugagccaguaagaaaguacugggacuaaacuucgcagagccuucugccuagcacugacuccaacuuucuuacagggauggccucuugcaucucugcccuacccauuuccagcaccauguugccaacuacaauucccagaugucucuacgcuccggaccuggcaaacaggguuucccagcagccuuaagggugaagagcugcaagaggcuacuuaggucacccagcacuuuccgcccacccccagaucacguguccauguccugccaaucggaacugggaggagggagggcaucuguagccuggagucuuccagggcucaaaggcggggcaagcguggagggggcgggucgagcguggcgggggcggggcggagcuccggagcugagcagccuggcaacagcgguggcucccugagccggaggugaguucgcuuucuuggcugaccuggcucggagccgggcauugcggggauccaggauuggaaaggucugaaggaaaaaguagggacucccugagacgguuggucucgaggggccugacugucuccgcuggggugggggugggguucgcuggagagccucagcugucucugcaaggcaggguugaggcccgggaguggcaggcaggugccucccucuggcuuccacuguucuacuuguccuagguccccagguggcggccggcgaugauugggacuggaauauagggugggcugagggucgucgaaugcauugccuacacuuugcuucccugucuaagguugucuagugcgcgggacagacgccccaaggcgacugcuccuugcccuggcucugcucacugggcggacacccgcugcaucccccguggccucgccaagugguggcaccuagcacuggccacgaacucuucuucgucgcucuuggccaguguuuuugugucauacacgggggaggagggcggguaugugcuuuugcaacaguugagagaagaucugagaaggaauggcuuaguuccccccauacccagucggaagugugaacagucacuaagaagugcucuuggucggguuaccucccgaccaacugucuuuugcgcuuaggaagugaaaaugaaauuuuacuauuugccuaagcaaaaauaaagugaaucucgugugaaaaauauauuaccgguuugauggauauguuugggauaugagacgagcgaguuguagcuuguuucuaaaccagaucuuuccaagaguggaaucagagccuuuuagaacggaccugacugacauuaacauaguaguucaguuguuuccugaaugggggaauuggggcccaggaaagguuaaugugacauggacuucaggcaaccuaaugacaaaacugaugugacuagucacuucccuggggguuucucggugucugccaagucuggauuccucuuagcacggcucauuuuuguucauugugaaguauccaccuuagaguacugagacugggccugaaguuuuacuaccguucaagccauuuuguacucaccuccccgcccuccccgcccuccccgcuccccccccccaaaaaaaaauaaaaacaguuacuggccaaccuuucauucaucacauauacuaggaaggaucuguguauuugucaaauuugacuacagagggcuugcagucauuuuacgggcucagagcuagauuuuaggagacucccauaugcuggaggagauucaagcugguggcucugaagcaguggaacggguuucugaaguguucaaaaguagcuaugaauucugugggauuauaaguacucucauuaugugauuggucuccuuaaguuaaaguuguaacuuacaucucucuagucaucagaagucccauuccuucauuaaacauugccuaugguguaaccucuagugucuguccuaugcaacaggaagacaagagggaaacacaccauuaaggcauuauggaauugauauaggggggugucagacauacagggcaaaaaaagcaauguuguguuuacuagcggaggugaguuguaaaaaguaaauguucaaagugcacgguaagauaagcuccacaguggagcaugccuuugccagcgcuuugaauuucuaauuuuugauaguucuuacuccaaaaaaacauaaacuuugaaaccgaaauauaucugaguccaagagauucacucuguggagucccuuugcuccugucagugcauauagugacuuuaaacuguuaaggugaugguuuauagaugaauggcugacuuccuaguuagauagaucacuguaaagccagaagucucuggugaagucaggauugcauggugauuucugaccacagucugcuggacuuucagccuaccauacacauggguuucuauucuuucaugcaggcuuguacugugaaccuguuaucugaaaugaacaucucucuguguugccuggcuugaggagauaauaguucacuuugaaauaguuccauacuaaagcagcacuccgcaucugaggaauaagaucccugagugaugaaauggcauugcaagaagucucugagaaagucauugucuaucuaguaccaccccuuuuaauagaccugacggucaggguuuucaaaacaaucuuuaugacuucugaaaaugacuaauguugcaaauaauacuguaauauugcuucaaaugagaaaaggaugaauaaaauguacuugcuuuagaaacaauugaaaacacaugguucuagcuuuuauugaggguucaaaaauaaagagaaaaggggaaacucuucggggccccgaggugacauuuuuaaccaguggccaggugauuacaaaggcuagaguuucuaguuauuucuaaagauuauccagcuuuacaauagcauaaugggugucauuuauuuuucuuuauucucucauuaugauaaugaucucuuacaaguucuaauuucuucauuuccuaguuuuuaguuaguuuauuccucuuuggcagcucucagaggggcaagaacuaucauuugccucaaagguauggacucaggguugagcagucuagaagcuauagugaaugugggcaagcugcuuaccucuaugucucauuuucuuuaaguaaucaaaacaauaaauaauaaucguuucucaaaguguugguggcagggcugagugauucuucuacauuuagugcuucuaacaguuuuguacucaguaaguguucaaggaaagaggguacuuuggcuuucuguucuuggcuguccccugcccuggagcuauggguguagccucugccccaucuacccccuuuggcaccacugucucuaauggaccuggaacauccauagguauccacuccauuuauuccacuucauucauuccaaacaguaacgauguguagccaauaauuaaauaucaauaccaaggugauuccugggucaugaaguuuuaucaucucuuggcaccaaggcuuuccuuuucccaaucaagaccaggccuuggcugcucuguaggacuagaguggaugccuaugguuccuugugaugauaaaaagccauuaugaucugaugaggagccaaagaugagauuguuccccauaucacagccccccaucuguaaaugaggagccuuacuugauacuuagauuuguuucuccguaucucaagauaacucuacaaggaacuuugguauaucuuagacuucuaauaguuuaggauugugguuucuuagcuggacuugacagguaacuccugaauguugcaacauuuuuuuuuccaucuaaggaggugcugaggucucagaugguuuauguaauguguaugaaacuuaacuuggcccagagcucauaguaaguauuuuguaaacaugguuggcuugaaucagaggaguggcaacuugaguuguuugagcauguuaguuugaaucauuuugcuguauaccuacaaacauguuccuuacaugcuaagaaguggagccuaugccuagcucuuuuguccagguucugauaguggaucaauagaaaagucugaauguaguuuugggagagauuucaugcauugcuuugccaccccuuuccucccagcuugauuuuuggacucugacaugaguacagaaucauuuuugcuucguuugcaaguauguuugggacaggaaagggcuaguggaaguugaaguguaauaauuaaaaguaaaaauaaaauuguuuguacauucagcuuucaucccauuguacaaacuuggacaaaaugcaguggugcccauucuuuagcauuggauaaugguuagauuuugaugucacaucuuugaccuuuuggugggaaggaagcacuuuguuccuggagccucuucaugaauacgcuucaccagcagccauuccuuccucuuuaugggcgugacugggacagaggugaguuguaaggacauuccuagcauugggugguggugcuuuaaauucccuuuguuggccuguaaauuucuuuauggcccugagauugcuuagguggggauuuagaauaaaaaggacuuuacuugauuucaguauugccaagaagugaucccagcuguuuuacucagccuuggacugucgcuauacaucagugacccucuggcuaugacucuuacuguaccuccuaguuagugcuguucaacgguaacaaccugcagaaguuugcuguugacuucagggagaccucaggcugugugacuagcagcaaguaugucauuuagaguuuccugguucugagauguuccuugugcgugacaguggggaugugagagcauagcccacucucugacaaauggccucuaccucuagguuccuugccuaaagaaagucuggugguuuuuuaaguagaggaugauaacuuuuugcuuuucagucuuucagcugagaugaaguguaaaucagaggcugacucuuucccuguaggacauuuccuuucuuccuguuaucaaguccaaucauuucuacagagauucccaucauuucugugucaucaaacaauuuuccuuuguugacaaagauuguccagaugcccuuaacccucaacagcugcuccugagaacuuauaaccaacguagaaucacagaucagcuaagaaccccugcagaaucuucaauuucaggugucuccugaugcauaugugucaaugaaagucuaggauagcugauggaagaccuggucacaucuuggcuucccaagccuuugaaacaacauuaaucaauaauacagugcuagauuuaaaaaguaaacaggcaaaauaaauuuaaacauguuuuuguaacggauuauauguaaaauacuaucauuuacauauaauuaccauacuaaugaagcaucacccuuuuuuuuuuguacuagacuuggaaaucauuuguguauuuuucuuauaggacaucuccauuucgaccagccacaugguuggugccagucccuacagugugggacaguaggacgcugagagacgaguucaucagguuggcuuuuagugaccagccagcugccucuguacuaacuuauauuaauguuaggguuaaucucugccaagccuuuagcccauaaugucuccuuugaggguaaaauuauuaacauaagugccaaguuucuuucucaaagguugggucaacagugagcuuugggacaguagcauugagaucuuaaucaagugaugugauuucaggguuuacaacuguggugcucaccugacuauggcaucacuuucuauuacuggauguggguguggugguucacguguguaaucucaguguuuaggauugaaucaggaguucaggcuauccugagcuucauagugagaaacuuucuccaauaaauaaauaaauaaauaaaucagggaugggggaggggcauaaagcaagcucuuguggaaugcuugguguuugguugugugugugaaaguaucuuuaucuuuucccuagcucuucagagagggugucaccucccuaaauagaaauuuccucauuuuaggaauacugcagauuggugguuugcucggcuggcugcucauuagaaccaccuggggcauuuuaaauaccugcugccugagccccacccuccggccuccgggguuaauuaaucugaggugagaccugccugggccuuuuugagaagucauuuugugguagcaggauuauguagcuccauggagagcaccugcuuuaggauccaucacuucuccaacuccacuguggggaggcuccuggacuuccagggccagcacagauucugugccucagugggugucggacgaggcaaggaguccaguagggucuucccauuugcagccaacuucagggcaaugcccaggccgcugcugagcagguuguucuuugauuagccagcagccccaaaaucaccugagggaguuuuacugagguacacguucccuggcucugggccuggagcuucugauucagcaggucugggccagagcccaagauccauguuugagaagugucuuuugcaacauuucaucaucaagacuugggcuuaucuucaguuuccugcagaugggcugcuaacacccauuggggguuaaaaacaaaaguggaauuuuaaccaaucccuuuugugucuugauagugcgacccacagcccucucugaaucugcuguugugggaggcuagucucaguuuuuuccuaguugcacugcagcauucgcucaaucgugcugcuggggccgacccaaugugcacaugcucuugcuuacugcugcauuugauuccauugguaguguugcggugucucccuuugucacugaguuuuagcuucaguuuuugucuaguuuaauaccaggauugacagugcuagccuuaugcagucaguugggauguucccuuucucguuucgcgggaaauugcuaagguugaagcauaucacuuccuugaauguuaauagaacugggccuggaagauuuucaacugucucuaugugauuguuugccuaucugcccccugcuuuaugucaucaucuccuuaggccaaguagaugcucacuauguagcagagauuggccuucugauugaucauccugccuccauauuccaaguacugggaugugguguaugccaccacauggagcuuugccuuuuucuugguuaguuuuuguuuuguuuuuaaucacguuugucaguugugauaauaggacuguuuaucauuucauuaguaauauguucuagcauauuuuuauuuccauauucaucuuuaagguacaucuguaaaguacauuuuuaaaaucugaaaauauguuugccagcaguuuucaguaugauuccucaccucacaacuguagaaugcagggugaaugcuagcaguucuuugacacuuggaugcugggugucucuggcauugcugauuggcugcuugguugugcuguuuauacucaaugauguugugugugucagucaguagcuccugccuuuuacuacuaaguagcaguccaugguucaguaauugauagccauuugagcuacucaguuuggggcugaacuauaaccagccauguaucuuugcacgagcucauguuuucauuugauuuguggaaauacuguacguuggaaagacauugucgucuuucuacaaauacacauuuugauuuuuuaugguuuuauuuuuauuuuuauuuuuuauuuuauuuugagacaaauaucacuagcugacuuggaacucacuuuguagaucagaucggccuugaacucacagagauuuucuugccucugccuccugagugcugggauuaaaaauguacuucauuaugucuagcuuacaaauaguuuucuuucuuccucccauguaauagccaccauuuucuugccuaguuagaaucucuaaauauuguaacugcacaugguuauucuccuuguuucgaagcuucccauuuuuuaacuauugcuguauaaacucuaggcuuacagaauuccuacuuugcuggacaaaucaugauuuguuguuuauuuuguuuguagaagccauguuucagauauggucuucaagaagauaauagagagaaccuaauugucuguauuacagugcucauucccauucccuaagcaugacaccccaacuuuuauucuuagugucaauuccagaauuugugucuggaaccugggagcucuuuugauugcucugagaagcuguccuuauugcuuguccaaagggcaugggaguuguccgauugaauggcugucuuuguucuugaacuggaauuucuuaaucauguuguuuccauucuguuaauagugguuuuaguuccucuucaucuucuucccuuuuugguauuucuugccuuuuccuuggaugauuuuuuuuuuuuuuuacauccauaagaucaccucuuccagugauguccaggucuagacacguuaggcccuuuaacuuuguucugugacaggaauguaugguggcuuguguuuaugccugguaacugcccaaguaggaaaugauugcuuucuguacuuucugggucacuguaagccuuuucucuuugugacuuuccaaagaccuuaauuaagucagucauuggggagucccuuuuggacacucucuuaguguggcaagcugccuguugggcaagugacuacuucugcgucugccuuuugcuagccuccaagguaaacuugcucuucugaauuaggacuauuucaauggaucaggcccagcauuuccaccagcuaagagaugccaagcugcauucccugugccuccaugugaauuaacuuuagagacucgggcacauuuucaaaaguaucuucagugucuauauuugagugaggauuaaacauuuaguucuaggccaaaaucacugugagacacauuuauuaaauauagugggcacugauguuguaggagcauuguuuuugguguaaaaucgagauacagcuaaguuuuauaauaugacaucuuguauagcuuuaaccucugaaggcaauuuuguuuugagccagggucucaccccauagcccuagcuggccuuggauuugcuagguagacaagguuggccuuugcuagguagacaagguuggucuguaaaucacagcuaccuuucugucucaucuccucuaaaggcaguuucaaaggaugauuuuuuuaaaagggaguacuuggaacagaaagagcauugcugaaaugaguauacaucauugaagcauauuucguuuagcugcauaugcucugaggcucacuacuuccuagauguaccccaugggauauucauucuguuuguggccaccaauccacaaagacuguuacaguaccaaguacuacugcaguggacaaauauggggaauauuuuugaaugccucauagauuugguagaaggaaucuccauuuguuuacuucccuuuaaaaugaaggcuucuuucuggaugucagauuuuuuuaaauauggguggaauccccuucuaauacuauauuauguccuuauuuucauuugaucaucuauugaaaaaugguuagugguucagagggcuauguugccucagguugaccucugcaaucuuuuguggacaaguuguucuuguuaacacuugucaguuguuuuaugaaguuccuaguauuacuugacaauuucaguuguugguggaaauugaaugacuuaugaugugcuuagaacagucacagauaguguggcaguuggaaacguggagacugaucagugcccauaagcagauggauagcuuuugcuucagucauacuaucuaucaccuuuguuacuguauuuauucucauaugcucaucauuuucucauauaccuucuuugcugcgauccaacuugugguugcccacugucucccaauuaacuucucaaagaccuaucucgagguuguugcuuuguuauuauuuaaagauacuucauguauauggauauuuugcuuguacacauguuugagugcgacuaaugugccuggugcccacagaggccagaagagggcaucagauacccugaaacuggaguuacagaugguugagaaccaccauguggguacccgaaaucaaacucagguccugaguagauaguaauaaguaacacgcacacacgcacgcaccagauagccaucucucuggccucucaaguuauuuuucaguuucccauuaugguaccuaguaucuauuuguugacucuuuuugaacucuuuggaaacaaaauuaaguaauuacauaugcugaauaaucucucagaaauaaucacuuugauguuacuucuuugucuuaaguauccauaucaauauuuuaguguaaguuaauuuaauaacuucauggaaugcuuauaguugggagagcugaacuauucugaagguaaccaaguacugacaugaucauuuuguaaauugcuaaauuccaugggugaugcccugccuguguaguauguucuuuccaaagaagucuuaacaucuaguacuucauauuguggccuuagauguaaauagugucauuagugauguaauuaaagaugaaaauaaauuagaaaggaagccccugcauguaggaagaagggugccauuacaggagaacacuauaacaaagcagagauacauagguagaagaccauaauugauaugaugccuccacaaaccaaugacuaccaaggacucugguuaccacugguuacuagcuagaugcuucaagugcuuaugucuuagcugacacccucagaacuggcagagaaucccuagcuguuaucuaucuacuuuguaguacuugguuauagcaaccuagaagcguaauaaauugucuaaaugcuuggccuaguguuagcaagccugagaucaugcuuaauuuaaaguuauggauuugccuauuuuaucauauauuguuacgugaaucccaagauuauguuguuuacuaaaacaaaugagcagacaaacaaaacacauguuucuaguugugguguggcucagccuugaccuacaccuuuaaucccucuggcuggaauacagacacagccuauguauacacuuauaguccuaaacaaugaauguaaaguuaguuuguagcacccguguuugaaagugaugucuaaguguguagcagacaaagugaugaaucacagagagauuugacagaauaggauaugccuaacucucaugagaagagagaggaaagagagauacuuaaggaagaacaguauaggaaguaggaggcagguuuuuacugggacaguuguacagagacguugcagagagagagaacaagcaagacacaggugaagacaaaaugagccacagaaugaaaaggagccggaagauuagaacagauugccagaguuaguaugaggccaagcagaacaauugggggaggggagggaaggggaggggaggggagggagggggagaggagagagaagagagaggagagaaaagccugauuggauuagucagcuuaggaguuugauccagaacagcugaguggauccagccagcuauagcucgguaagaacaagaaaagaugaguuuauucaacagucagucucagaggcugaaaccaggcuaggccuagauaagauuguauggaggcuauaagcaaugagccucagagacaauuauaucagguaaauagaaauuacuauuacaguauuaccuaucuucucaauauaauuuaguuuuuagacaaauuugcugcuagauuagaaaaagguauaggaaaaccuggcuccaaaaugccauugcaguucuacacgagugugucagguauaggagggaaugcuuagaacagcacuauuuguaguagugcaacauagaaaccagucaaaggucuguggagagacugcuauucccauuugcuagcagaaaugaguaaagcacaggggcaugcaucuguguuccugauguucacagcagcccuaugagcaaagcaaagagcagaagauugugggcucacucuauuuccacaaaagcucagaaacacauggaaaccaauguagucuuugccaauacauguaagaugauaaagcuauacauagcaacuagaaacagacaaauccauccucaugccuuuaauggcugaagucaaacuucuccaaagucauggaaacuuugaagggugaugcucuuuaccugggugcugugcaccacuaacagaaaacauaucccuugccuuuaggaaggaagcuccagaaaucuaacaggagacccaaaaggucacugugggguauaggucagugugugaugugaaauauuagcaacauguguaguauauaaaaaagcuaaguauguacuugucaugugugugugugaugugcacaugcaugagaugugcacucgugugagauguguguaugagagagagaugugaauuugagugagauaugugugugagaugcgugagcuguaaacuugugugauguaaacacugcaugagaugugugcugugugagaggagcccuaguacagcucuugcuuccaccuuucagugaaaguaccuagaggaacugcuuucaauuucagguuccacccaaagcccuuucuucuccuuuguuucuagaaauugcacgugugcuuuagagugccuugcuguccuccccgugccguuacugcccaaucucugggcuuuucucuggaggccccuuagccugagccugagaaguuucacagaguauaagaaaauguaauugaauggaauguaaaugguguaaaguggcuuucuccauuaccauagaaguuauacuucuuuacuuguuuuuauucuuuagcaacugccauuugaccuuuuuacuuuaaaaauaugucuuuuacauaugaauuuaacaugugcuuuuggagaauaauucucacugcagaagauaacucaccaaaagauuuuguuuuauuguggagagauuagcuggauucaagagucucggaauuggcagguagaugguaacuugaucuugcuccuauuuuaaaacuuuguuuacugucaaguauuugacuguuacacgaugcauuggugauucuaaugguuggcuucaaugucugcccuaucacuauguugccuuuguucauaaaaagaaaauugguuauaguuguugacuuuuuaguaguuuauuugccaaacuaguuuuagcuuaugauaucuaaaauuacucuguucuauggcuaacagcuuguaucacuaaagccaaucaacuguccugaagaugugguauuugucaugagaaaaccaagaaauagaguaaauagaucuauccaaagucugucacuggcugcugggaaaaaaaaaaagauucacacugccuuuucagcugccucugaguugguuucagcuaaagaccuuuggaacauuuaagguuguaaaaguagauucaucuuugagcuaaauucuuauauaugguaagaagagugaguuucaaaaugaaaaccuaccuagcacuuuacgcuuucuguggucucaucaaacuagguaacuuaguucuaagauuugaagcagcuaagauaaacugaucuaacucauaugaguuacuauauauuuggauaauuagccacuugcugagauuagauuaucacauaagagccaucaucuucaucggagcaucugugacuacugagaauuaggcucauugauuauugacauugccucauugaagggugugggcacagugauuauuuccuuuccagaucucaaccauugucuucuguaccucccugcuaguuugacacaauucuauuguaauuccagaugaauuccuggucgggagguacuggagcauagaggguggcagguuacugaagggcaguuucauccaugcagcuguggagaaguugucacccaugcuagagugacacuuuguggugaagcagcugcuuugggaucacuugagcuccaaguaacccucagccauacucuguaaagaagccgaagccacgaguuggauuuuuaucaaauugaacuuugguuuguuguugguguucuuggaagagugaguagacauuuguuugacucuccucagggcagaguuucccuccauaucuaauuugaggaaugccuuaagaauucauggaaagccucuagcuggagguggaagcugguauacugcaccagcugagguuuccuuuucauguccacuuccccuucagccagaacaguauuucaggacuaucauuaccgagugacagacuugggauugcaaacucaaauucucgaaugcagaauccuccuuuuuaaccaugucacaccaugucgaagcugggcauaguggcaucuuugacaaacugaaagauagaguuaauaguuuauuuuugcauuuaaaaagaacauaguuauuauuuguuuuggaagagaaaguuuauuuagaaaaaaaguacauaguuuaaagcaggagguagcagccuguuucuguaaaugaaagugucuuacaucacuguucuggugcugcguugccaaguugcacugagauuuauggcucacauacuauauggccuuuuacaagaacaguuugccaucccugcugaaaagaaaauggacaaaaaaaugaaacuucuacugcuucauaucauacuuuauuuucauguggguugggguagccuucuuccaaguaagcaaauauauuuuauaaauugauaguuaaaagggggcucaaagugccuggaauguugaacaguucugcguuguccagcuaguuguuucauugagaacguuaugagaucuguuuuuauuuucuugucuccuaaguggcugauggucugucucagugcuugcuauuuccugagaggccagguugcgaaugagggagaaaagaucgaaugacaaguucacuauuacaaaugacaaccuauuauuuuguucuagacuagaguuauggcagaauguugauguuucagaaagggggacuaacuagaggaaggaaggaaaccagcagagaaauggaggaggguggggucagggaacagaugagaacaaagcguauaaugauacuugaagaugccaugaugaaacccauugcuuuguauacugauuuaaagcaaugauacagacauggcucagugcuuguuguacaagugugaguucaauuccccaaagccauguuaaaauggcagguguggcagcauacacuuguauuagcacuauagagagguagagguaguggauccccaggagcugccuaaccuacuaggccagcuccaggccagugagagacccugucucaaaacacacacacacaccaccaccaccaccaacaacaacaacaacaauaaaaccaaacaaacaagguagauaguaccugagaaauaacacuuaagguugccuucuggucucugcacacacagggacacacaauaagauaggagugagugauggcugaugggcaugaggcuuugauuugaagugaaggaaauguucagaaaugaugaggauuucacuauuugagaucaagacuucuaggugguuuuuuuucauucuuuuguuuugcuuugaguuuuuuuuuuuuuuuuuuuuugguuuugguuuguguuuguguuucuuuuugguguaucucuggagacugagcccagcagauucuuaggcacucuaggccacaccuuaccauugccuucucucgcacacacaccgccccauguguauuuucagucugauguagcccaggcugcccuugaaucuuucugccuccaccaagugcugagaugacaggaauguacuaccaccuuuggcuuuggcuuuauucuucaugguuuuugaacaaaugcuauauaaucaggcaggucgacagugauuggacuguauaaccuuggguuuuaaauaucuuuauugaguuagcaauaggaaauuuaguuuuaaaacugaccuauuagauauucaaauaccuuauuacuaaacccuaguguuuucuguuacugaaggaccuccccugucugguuauauaguacuauguaggcagaagaagaauuucagggcaggugcaucuaaucugcccuuucuaauucaucuuccccauucugcuuucaugucuaagaacaauauuaugugcuguaugaacauaagguuagaagagucuucaaagcacaguguaagauuuugucugaauuuaauucauuuggcaguuacuuacagaucuuuuaaaaaguuaaacuuuaauuccuuuuaaauuaggccaccaccuaauucacuuuuucuuucuuccucuuuucucuuugauacuagauaauuccuaugaauuugauuucagucaaaucuauuucucaucaaaccccuuaauguagaacaaaauaauucuuaaagggaaguuguaugagugauauaauucacccuaucauaguucugcuugaaugcauauacauuaucuuucaauuaagugguauagaaauuucaugcuugucauacauugguagacauuaaagguuuuuguauauuugcuuguuuuuuuaagauggcaacuggagcacuaugaauauaauuuccuagaauaagccugauaucuucugugggguuccccuuuuaauauuuggcuccuguuucacauggcccuuaauagucaugucgccuagcuguuaucuuaauguuuagauacaacucuggaaauguauggcacacaucugaccucucccuaucaaaccuuaaaccaagaguaaaauagauagcauugaacgccuuucuucuuuggacauguacugccugugugcuggcuagcucuguguauuuuuuguucuguugagccauaggaaguaaaaagggccuacaaagucaaguacuguuuguucuauugaaauauguaacacuuugaugucauauguuugaaauagcaaugcaaggucaguuaacagagaauuuugucuuccuugguagguuccaggauggcuucugcaucagcaucuaaguauaauucacacuccuuggagaaugaauccauuaagaaaguaaguugaguuuuuacacgucucugaaucucucuacauuucuuucuucauauuuguauuagacagucauuugggucauacugaaucaugaauuucauuuuauuuaccgucccaccuuguucugggaaagauuuaaaauagaauaugugugaagugauuuuggcuuuuguaaaugcucucccaaagcuuuauucaccacuuguugucagaccugacauucagguaugaagcugcucucugaaggagcuauuggaaggccaagacgaguacaaggcuaguauaccuucuuaaauaugccauuauuuucuagccaagaugauuagacuuacaaaaccuaaacauacaaauugaguauaaaaugcuucacagucgccaggguaaauuguuccauuagaaugacauuuuuggggggggggcguggauauaaauugaaaggaaggggugaacuaaguuuuauucauggcccuuugagauucuaaagaugguccaucagaaaggcaaauuuauucucccaccccacaguguacaaaaauacucagucagaaauguggcuaacuuuuaauuuuuguuucuugauuacugacaagucugaccuuuuauuucuuuugaaagaaacauuauugcccguuccuguugauuuugugaaguaaccaugaauguccuuucccuguuugccuugggagggagauggggagauucuuuucuuaauagcuuauacauauuccucauaauguaauacaugacucuuuauaauguacaaaucauuuuauuucagcuuuuuaauuuuauagcauuuuacuuugauuuuuaaauauugagauuuaauugggggguggcuuaguugguuuguuuugagacugggucagguuguguggcugaggcugcccucaauuuccgaucauugugccacagcuugccaaaagcuggcauuaaaaguguaugccaccauagcuggcuuuccguaguguaaugauuagugcuuugccuguaugucagagcugcugcugugaugaggugagguacguaccugagaaugccucccaagugggaggccuacagaaaagucuuuggggaacuugucucugaccgacuacauggucacuuauguacaauaagguagaauaaaaaugaaaaggaagacaagaucuuaauaaaagauaauaggucaaaaauguagucucacuguaguaugacucugcaacaauugcauaggaaaaaagcuauuaccauacagcauacugauuucauuaaaguuugaccguuauacugagauauauuaccuuuaaaauacuuuuuacaaaguacaaaacuuuaguaacacuauuuaaaugcagacuaggacuuagcaugacuaauaaauguuacagcuagcacagucuuuuauuuuuauuuuucuaauuugcuauugcuagggauugaacaaauggcuucacaugagcuaggaacauaccuauauuuucauuccagauucuauuuuccaaguuugaauuuuauuucuaauuuucuucaaugcuaaauuucuauuuuuuauuuaaaaguauauuucuguuugcuaccaugugugcaaagauggcaccaccaccuccgucccaugccccuuucuuuugcaggugucucaagauggagucagucaggaugugagugagacugucccucggcucccaggggaguuacuaauuacugguaaggagcuugugggucuagggguacagaacuggaggaggagugcaggaagaccagguggcuuguguuccacuugcucuguacaagucagagaagacaaauaaucuagcuuuguuuaggagccucaauggagagagaacacugcaugccuuuuccugaucaaagaguucuuucaagagcuuggugcucacaaggcuagcaauauucuugucucuguaccaaagagaaugauuuagagagaacaacauagguuaucacuugaaagucucgagcuagagauauccacucuucauaauuuaaaguuauaagaacagaaguagauuaaggcuuucugucugugauauauguuucaaaaugauaacagcuuaaagacucuucucugugacauaauaggagauccuuugccagaaaaccgaaauuaagauggugguaacauuuugauacaguguuuuugguuugguuguuuugguuuuuugcuuuuuuuuuuuucaugaugaaccuaggcuaagaggacaguuucuacuuuggaagggccaaaucauguagaagcauggugcugacauucaauauuuguguuaggguucaucccuucugucacaugacaguauauuugggaccaauaaucagcauuguuucagagaauuuuuuauuccuugaguacgagucaaauuuuaauuuuaaaugguuaaauuauugugcuaauuaaugggacuuuuaaaaaaaaaguaccuuugugaauuauuuguacaccacaagaaccaugagaacauauuuggugucuacagacucacacucacaauuauagucuugaaacuaaaauuaguaguauauguucuucccaguuucuggauaagaacaaagaaauuuuacuauugguagucuucauauaggacauuuggguacugaguauaaacagacagaccuuaaccaauauaguaacuaauugaacuggcauaaaaugaccuuaguauugcguuuucauuuaguaccugaaggauuucauagucauuaacauauucaaggauaucuuugaaggaaaagagaaagauaauuuuuauuauaauuaaaucuuucgauuuaguuucuccuuacaucaaauuuaaaaauauguacuuuuccuugacuguacauuauuaacuuaaauauuuucugcagagagauuucuaaucuggcauuauagcagggugugguggcacagucccauaauuccagcacaugggagguugagucaggaggaucaugaauuuaaguuuagacagugaugcacagagaggagacccuuugucaaaaaaagcaacaaggaccugugauacaugugugguuggcaguugucaaccuaccacccagccuacugguuagucacgaggcuacccugugugaacguuauccucccuugaaauaacgcaaguaguuucuuuugcuaucauaagaugcuaacaauagcaagacccuaguucacuucugugcucuggcucuggucuacaugucuuugguggugauaacauuaggugcaaacucagaagugccaugagugcguaauucagccuggcacagagcuguggaaacuuugccaguguuguuuucaacuuuuuaguaaucuuuauuguaguuaaacauagccaaguaguuuauauuaaguucguaccauuuguuguguaucuugguaucuauuuccauuauuuuaggguccuuuuuuuaucuuacuagaaaaagaaguuauuuacauauguccuuucaauggccccauuaagggaagaguuuacaucacaaauuaucgucuuuauuuaagaaguuuggaaacgguaaguagauuauaagaucauaaagaugacccuaaccguuaaaaaugaugcuguuucuuuucuauccuacaacauugacuguggauugcauuaacgugggggauauauuugguucucaauucuuaauuuuuugcuucugcaaaacugauauaacacuaacaucuguuuuuguaggcaguagaaugaaauauuuaaauaggcuguaucccucagaauaaaggagaggugcuuugaguacauugguauaccacaggggguuuuaaccagcagcacagauaagaaugaacagcuuagagauuuuuaccaagcaguagggaugcuucagagucacuguaucagaaugucugggcccaugguccaaacaugcacacauuuucuaaaacaucacagaguaagauguugaugugaauccuugguuaaagccuaccacucuagaaguaucuugguguccuuuuaccaacagcuaaguagcaggguaaaacugggaugaguggcauggcuuacuguuacuuauuuuuuucaaccuauggccaaaaaagguuugucaccauauuucaaaggaugucccauugaugaagugaugccauagagcagagaaacuccagaaacacagaagaaaauguauaacuacugugccuuucccagaagaucuugugguagaucauggcucacuccuaaauguaggggcaguugugauuccaaauacuccugggaaaugaguuuaggguagauggaagaguaagcuguugcugccuuguguauuaggcaacuaggaaacugaugcggggaaucuagcuuuuguuuucuugcuuuuagccauccauuuuuuagcacaguucugauguggauuuauucauaucuuuugcucuuuuauuauguucauuauuaugucuaaauuuuaaaaugcuacuuaauauuccuguugcccuggcuucuuguaaauccuguagggugcaggcaggugcaggcuacaauggcuaccauuguaugcaucaugaccuaugugagucaauucaaguuuaaagagugaaccuaaggaaauguuucaguuuucuagaauggaaaggaagauucuggaaguuuauagcaagcugggugucagucuuuggcaaucauuuuaguguuugaugguuuaaguauuaugaaaauaaaccauugugaguagaaucaaggaaugacacagcccuugggaaaggcaagcuaaaugguggcaauauauccagauggguuacagacuguuuaauaaaagcuuaauuacaacuagaaauggugaucacugguaccuuacuauguagagugcuuccuuguaauauaauguaauguaaugugaaauaauguaauguguggcugagaugugagaagcaacagauaagccaaugucuagauggaagagucaggguuugaaauuauuguaaaugccuagaauauuggacacaacuaaugauauaacauuaaaguauacagauagcaccuacuuuguaaaagaucaguuguaugauuaaaggaugaagaucuaucuuaacaggaaucuaggcuuuugaaaucaguaaguggguauuacuuguuuaaaaauaagauagcucuaucaugaauuaacagagguauaauauaaugaaugccuagauaaaaugagacaguaguccugucuguagucaugcuauaaaauugugaugcuaccauuuaaacaagacauugagcuaggcagugguagcauucagguuccugccuugcguuucaaguaaagaaaaaaaaaaaacaauaaaagaaguagcaauagaaaguaaacucacacaggaacuauauagagcugucuuugaauauugaagugccucgcuguggaccaacucuggacuugguuuguccaguuuccaggggucuuauagggauagauugagaugcuuagugcugauauauaagaauuaucaaaaguuaaaauuaaagcuaugucacaggcccuuucaccugacuccuggcuuguuguuuagccaugcauagcugguuucauuuuaugcuguccuugauaaugaauuggggaaauuauucaaauugugguaacaugaugaggcugucuauauggugugguuuugacuaaauaaaacaagaaaauuauuucuaaagaagaguccauaaggaauauauaugaagaauuugaauucuugggauauucaggguaaaauuauacaugcuuaauauucuucucacucguugguauuucuuaaaaaugaguauguauugccuauauaacaaaaacacuuagcaaucuuuauuucuuuuuucuacauuuuaaagauagaauucauaugauuucuuuuacaucccuuccucccuuucuuccucuagccccucccaguuacucuuccucaaauuccucucaacuuuuuucuuuuauuauauuuguugcacaggcauauauauauggccauugauauugcuacuggugcaggcuaguuuaugcacuauuucuacagaaacuguuucaaagcagacuuucagguauucugguucuuaauaucuuuccaccccuucuuccaugauguucccugagcuauagguucaggagcuaugauguguauguauuuuuggggacuggauuccucgugauccauugagcucugcauccuauccagguguugcuuugugcaauggucucaauuuucuguaacaagaggccuucuuugaugaggggcaguaacuauacuuaucuauaauaacgauaaauccagaaugugguaagggguuaugcuggucuagcaaaguggcgacaauagauucuuuucuaagauccauggccucauuaccuccuagaagccaauuggguuugucauaccaggcaugauuuccuuuguuuacacaugguaccuuauacaauaggguuugacauuuaaugcauaaaugaaaugcccaucagcuagugacugcuacuuucuuucuucuucuaugauauuauauaaaaaccuuuuaagcaauuagccacacaacuuuuagugaaaguccaaaagucuguuaaaagaaaacagaagaaaugcuaccaacguaguuauauucagcagcuaaacaaccagucauuguaguguuagugcccuuaaauagucuaaacuaaaccagcaaucguagguucuguugcaaaaugggaaaacuuuuuuguauguuugaaaacgaauuguccuuucaucgugcuuuucaguuaauacuuuucacugcucugaagccuuucacaccuggcuuugcuacacuuuuaaugucccuuuuccaugguuaguuuuucucuugagugcugguaacuauauugcuuauauuucucugguuccucuuguuuauuguuuauuguucauugauguucguucugcuuccagaguagauccuagugcauugaagaugcuuaaucaguaguguugagugagugaauucugucuuauuugcauauugcuaugucuaugacuuuaacaaacuuggaauccuuuugauccucacuagugcaauaggcagaggcugcacauugaguagguaaacucauguguuguucauguuuccuauaaguuaaaggccuugguacaugucuuagugguuugauaaaaguauguagccuacuaaauuguggcauccugaauaccauugccucuggaguucagaaguuccauagccaucaucugaccuugaauguaccaaggaacuugucuuugguuaauauugugaccacagcaggagcaacuccauuuaagccuauagacuuucacaaagaagacugaucccagauuguaaccaggagcacacuggauucagaugcuauugugaaugagagaggcaacuugaccuauucuuuguucagguuuuagacccagaaccauucucuguauacuauggugaaucuaaaaucaugugggugaauuauuuuuuuuuuugccuuguuuuuuucuuuuuucuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcaaguccaaugggccucucuuuccagugauggccgacuaauacaacauuccucacaggauccagaaauggggaaacugggagaaaugugacacagcccauggcagcacauguaauguuguuacagggcagagggcgaugagucauauuuguuuauaaacuugaacaggaggaauggaaagagaaagguuuacuuggcaaagggcuuccaaauccacauauuauaccuuucuauaccacuauauagacaucugugcuggggacaauugaaugaucugugagaauugggccaccagcaacagagagaguagaggggcuaggaggauaugugguuggaauaagagguaaccucaggaucagaaguaauaguucagcaguauauguguuauuaugugacgggccacacaucagaugugcauuucugaaagagaauaccagcugcagcauggacagugggauaagggagcaugagacuggaaguaggaagacccauuagaagguuacuuguguucugcgguaagcaacaaaagccuaauggcagucaugguggacauaggauggaagaaacaggcugugggcaacuucagaggauuuggguaggccauuaugagaagggaguuggauaaucacccacuuaaaaaugacucccacgauuuucugcuuguguaaucaaagcugcuccuauucauugaaauguaucucacuggagaagggaguaucauauggguaaagcuccgugggagggauacaaguaagguuuggacuuaaaguauauagcuauaauguggaaacauguccaguacagucggaauuauauguuaauacugcacuagaaguggugaaaaccaucugugggauuccccaggaagaggguguucccugacaugaauuaugugcucaguugagaagcaccaugggugauaggaaccuaauggaaaaaaucuugaguucagccacugcuagagaucuagaagagagcagaaucuugggagggagggauggauggauggauggauggauggaugauuggagggacagacagauggauagaugcuggccaagguaggaaaugguaucugcaugagggacauagcgugagaauaagucagaaauggaugcccugugguguucauaggagccucagugagcagagauuguaugagaggggaggccuuuauaaacguuggugugcucauggggucuucacaacaguaaaacagaaauugauaccaggggcugggauauugcugugauacaccucaccgugcuuuuguuuggaggaauguggacuuuaggacugugaaucagaaaagcaguugaaagcuugaaagcuuuaaguggagcuuaaugguccauucuaguaggagcaaggaagacaguggugcugagacagauuugaacugugggagcucaagagguuucagaggaaaaaaauguaguauguucuaaaaaauuucauuagaaauuguucuuuuuaaaaauuuuuauuuuauuuuuuuccuuuuuuuauuacguauuuucuucaauuacauuuccaaugcuaucccaaaaguccccccuccccccuccacuccccuacccacccauucccauuuuuuggcccuggcauuccccuguacuggggcauauaacguuugccugaccaaugggccucucuuuccagugauggccgacuaggucaucuuuugauacauaugcagcuagagucaagagcucugggguacugguuccauauucuguucccugcccccuaucuacccucugucugcuccacaucccacacauucuccccaccccaccccgucuccacguggaugcccccaccccccaccccaccugaccucuaaacucccuggggccuccagucucuugaggguuaggugcaucaccucugaaugaacacagacccagaaguccucuacuguauguguguugggggccuccuaucagcugguauaugcucucuguuugguguuccaguauuugugauaucuuggagguccagauuaauugagacugcuggucuuccuacaggaucgcccuucuucucagcuucuuccagccuucccaauucaacaacagggguucagcugcuucuguccauugguugggugcaaauaucugcaucugacucuuucagcugccuguugggucuuuuggagggcaaucaugauagaucccuuuuugugagcucuccauagccucagaaauagugucaggucuugggaccuccccuugagcuggaucccacuuuaggccuguugcuggaccuucuuuuccucaggcuccucuccauuuccaucccuguaauucuuucagacaggaacaauuaugggucagaauugugugggaugagagccccaucccucacuuaauacccugucuuccugcuggaggugggcucuauaaguucccucuuccuacugucuggagguucaucuuugacuccugagagucucuuacugcccagguuucugaugcauucuggaggguucccccaaccuccuauuuccugagguugccuguuuccauucuuucugcuggccuucagggcuucaguccuuuucucucaccuaguaacagaucagguucuccuccccccucucuacccugcccacugucccucccaggucccucccuccccacuugugauugcuuucuucucucucccaagugggacugaggcauccucacuugggcacuucagcuuguugacuaauuugaguucuguggacuguaucuuagguauccuguacuuuuuuuuuggcuaauauccacuuauuagugaguauauaccaugcaugucuuuuuggaucugaguuaccucacucaggaugauauuuucuaguuccauccauuugccugcaaagcucagaauguccuuguucuuaauaucugaguaguacuccauuguguaaaugaaccacauuuucuguauccauucuucugucuugggacaucuggguuguuuccagcuucuaccuaucacaaacaagggugcuaugaacauaguaaaacaugugucccuguggcaugguggggcaucuuuuagguauauucccaagaaugguauagcugggucuucaagucgaucuauuuccaacuuucugaggaaccuucagauugauuuccagagugguugugccaguucgcaaucccaccugcaauggagaggagcauuacucuuucuccacauccucuccaacaugugcuguuaccugagguuuugaucuuagcccuucugauugguguaaggugacaucucaggguuguuuugauuugcauuucucugauugcuaaggacuuugagcauuucuuuaggugcuucucagccauucaagauucuucaguuguaaagucucaguuuaguucuauaccccauuuuuugauuggguuguuugguuuuuuggugauuaacuucuugaguucuuuauauauuuuguaaauuagcccucuaucagaugugggguuagugaagauuuuuuuccaaucuguagguuacugauuugucuuauugacuauguccauugccuuacagaagcuuuccaguuucaugaggucccauuuaucaauuguugaucuuagagcaugagccauuggaguucuguuuaggaaauuucccucugugccaaugaauucauggcucuuucccacuuucucuucuguuagauucaguguaucugguuuuauguugaggagagaucucccaugcucauggauuagcagaaucaacauaguaaaaauggccauccuaccaaaggcaauccccauucaaugcaauccccaucaaaaucccaauacaauccuucaaagacauggaaagagcaauugucaaauucaucuggaaaggcaaaaaacccagaauagcgaaaacaauucuuaacaauaaaagaauagcugggggaaccaccaucucuaaccucaagcuuuacuacagagcaacagugauaaaaacuacauaguauugguacagagacagacaauagaauagaauugaagacccagaaauaaaaccuuacacuuauggucacuugaucuuugacaaagacaccaaaaauauacaauggaaaaaagaaagcaucuucaauaaaugaugcugguuuaacuggcugucuguauguagaagaaugaaaauagacucauauuugucaccuuguagaaauuguucuugugauaauuugaugaagaaugugguggcuuuuugcccuugucugaacaucugccugagacuaaggagaaaggauuuagguuaauugcuuuggcaaaagaaaucucaaaacagccuaguauagacucugagcuacacucuuaugaagagcuuuuugaugaaauguagcaagcuuagaaaggaaaaauacaaaauguaugguucaaggguuaaaggagcaccaggaaguagaauggagcugaauccuauguuguguugggggggggcagggaggacuugcaugaggggguucugugaggagaggaagggcugauauuggguuguaaagugaauacauaaauugaaugaaugaaugaaugaaugagaaaggaaggaaggaaagaaggaagaaaggaugaaaucucccucuguagcuaaggaaauucauugagaccagacacauggcagguuagccauaagccccaagagguuaaagaugccagaaccaaggaaagcugcuaacaggagggaacuagcugaagagaaagaaguauguugcagucaacaaagcugaaaggaauagaaaucugaagagcauugacaucacacauggagaugcagaguuuagaguuugcccagcuggguuucagucuugcuuugguccaguauuuucucacucugcucccuuuucucccuuuuggaaugcuaauguguauccaaugcuacuguauguuggaaguaugugcucuguuuuucuuuaauuaauuauuuaauuuauuuauauuucauauguugccccucuuccuggucuccucuccuaaaguucuucacuccauucuccccucugcuuugcuucugauaggguccuccccccaucccacuuuccugggguaucaaguuucuauaugauuaggugcauccucucccacuaagaccagacaaggcaguccucugcuacauauuuagcagaggucgcaaaccagcccauauaugcucuuugguuggugacuuagucucugggagcucccagggguccaaguuaguugauacuauuguucuuccuaugggauuaccaucccugucaccuccuucaguccuucccuaacucuuccauaggggucccugggcucaguccaaugguuggauguaaguaucugcaucugucugagucagguguugguagagccucucagaggacagacgugcuaggcuccugucugcaagcacaacacugcaucaguaauagugucaggguuuggugucugugcaugagauggaucccaaggugggcuggucacuggauggccguucuucagucucugcuccauuuuugucccugcauuuccuuuagacaagaacaauucugagucagaaaauuugaaggugaccccauccuuccacuggggacccugucugucuacacugaaaguggucucuuugagguucuaucuccccacuguugggcauuucaguugagaucauccccauugaguccugggagccucucacaacccagaucuaugggacuuuguaaagguucccucaccuccaacagcugcagguuuccauucauucuccuggcccucugggcuucucucugucucccccaauucaauucucuuguauuaccauaucgcccauguuugccuuuaaccagugauucuccugccuccccucuacacugggaugauggucauuguacaucaccauucccaacaggaaaucuguguuuacagaauuacccccaaauccuugaauguuguucuguucaguuagucuuuuguugagcuuuggugacaggagacuuuuacucugaaaguaacuuuugugcaggcccaagucaguguuaucugucugcuuccucuugaguuuccuucugauacagagauggagugcagaaaagccaaauggguaaaccaucugcauggucuucauagcugugaaaugaucuucagauagaggcuggguaucaaugcgcauccuucaagaccaucacuagcugccauuggaacuggaagcucuggcaacaggaagcaacaggguggggauucaaaguuuacuuacauuguggccauuugaaagcuagacccugaagagaaaacgaaacaauuucauuauaaacaaaagcaaaaagugauucuuuuuucccuuacaaacuacuggaagcucacccuuuucacaguugugcccagugagcuuguuacccuccacaauuuacuugucuguuuguuucauuuuuauuuacuuauuuguuugauauacuguagcccaggccacugugaaacucacuacguagccccagcuggcaacuaacgcagcaacucuccagccucagccucccaaguacuaagauuauacauguaagacacugugccugccuaugucuuuucuuuuucaaggaaauuauauaaugcuauuuguguauggucuaauaauguaggaugcuaacuguagguugaguaucccaacacaaggaugugaauuuucugagauccaauaugaugcucaaacucuucacauuuugaggcuuuucauguuauagauucuuaaccaauaaauuccauauuccaaauccaaaguauuacaaaucaaaaaaaucauucaagucugaaauucaucugauauaagcauuuugauaaaagauauucaacuuguucagguguucuuuuuuucagccuuaugucaucuacuuauauugcugcuaccaaaugaauccuguuuuuagguugaaaauacucuuggauucagaauauggaucacauugucaaaauaucuguagaggauuugcauagacugcaugaagacuggggcuugauucucaaaaccacagcaaacaaaaauucuuauuaccaccaguucuuuguuccauguaccaugucaaaaccauguccaaaauaggauguauugccaaauccugguauugaaaguuauauaacagauuuaccugaugauccacuucagcccccaaaauaaaucugacuauugcuuugacaguucuuuuagucucagauugaauccuuagcacaucucuaucagucauuuaaauggcuacauauuucaugguucauacuccacuuuucuuuguuuuugguagggagguguuaagacaggauccccuaaaccucaagcuaagagugaccuugaauuuugcuuuuauaagaucaggucucauuuggaauuguggcugaccuggaacuugccauguacgccaugcuggccgugaacacacaaagacccugcugccucuguuccccuccucacugcuggaauuaaaggcacgagucaccacaccuuuuccaaucuugaacuucugauccuucugccucuaucucccaagugcuggcauuacagauguaugcuugucauguuccauacgcuagcugacuuuguuguucuguugaaaagaugucauugucucucucugagcuuccauacauuucucucuccuagccuuuccucccuuccuucacacaggagaguaacuagauguccacuuggccaaaguguauaccacuucuggaacuuuucccuacuuguuccuucuaccuccuuuggagccuuagcagcacucauuuugaggguaacaauuuugguuuuugucuuuugcuuuuucuagacaggguuucucuguguagcccuggcuguccuggaacucaacucuguagaccaggcuggccuugaacucagaaauccaccuaccucugcuucccaagugcugggauuaaaggcgugugccaccacugccuggcucgguuuuuauuuuuguaucucuauacugugcacaacugcucaagacucuucauuuaaacuuauuuauuuauuuauuuacuuacuuacuuacuuacuuaccuguggguauguguuuaugaguauuuugccuguauguagauauaagcaucaugugagaggcuggugcccauggaggggagaagagggcauuauauccccuguaacugaagucacagaugguggugagccacgauuguuuauugggagucaugccuggguccucucgaagagcauccaguccucuuaaccacuuagcuggccccaccaacuccucaucuuacuaccaucuucuuuucuccccuucuggaaaugcugcuucuacuuugugacaauucaguuuauuuuuuuauuuuaucucaucuuuuuuuauuagauauuuucuuuauuuacauuuccaaugcuaucccaaaaguaccccccacccuccccccacccacaccccuacccacccacucccacuucuuggcccugguguuccccuguaccgaggcauauaaaguuugcaagaccaaggggccucucuucccaaugauggccgacuaggccaucuucugauacauaugcagcuagagacacgagcuccgggguacugguuaguucauauuguuguuccaccuauaggguugcagaccccuuuaucaagcaucuguuuuaacaaaacuucacaugccccuuuuccaggcaacuuccagaaagacaccacaugucugcuucagcaaaacauccucucauaagacagucucaucacaugacacaacugagucuuccaaaaagccaaaaauuuccacuucacacacucauaauuuuuucuuguagcaagaacacuaaaaauuuucaagauucuacucauucccacuccgggccccauguaguacaguggcucuugaauggguccuuugccucugacuggacuuuggcaugcuuuuaucaguagcuucuugugcacaccugcauagguuugggguugcaguguuuaguguugcaaagcuucuggaaaggucagcagaagacagcuuucuuugugcuuaucuagaaguugguucugguugcugugucacugcaacucaugaagagaacagaauuggauguaaagggaccagaauaguggccauuacagugaccuagaggaguuuuuggcagaguuggaaagauguugagagaucaaaauuguuuuaagagauacacauggaagaaugaguuaaugcuaguuaaaacaaaauaagaacaugucaaagauaaauguuuuuuagcuggacaguauuggcuacuaagacaagaagcaugggaagagaacaacauuuaguguuuccuacuggauguucugaaugugaaguaucucuauauuaguuaauacuuauuauauugucaaauauaguguaucaaaagucuacuuucugccccucuuccucaucccuauguuuaguauaucuuuugacagggccaccauguuccaucugagaucuagaccuaauucagaaucaucuuggcuuccuacucaggcuggugaucuccucuguuuuuccucugucgccauccacuuucagaucccccuggcccuacaugugaacucaagcauuagcuuccaggaugcagagaguagggggcaucacucuccuugcuaguccaucaggugcaguccugcugccugaaucuucaugacauaccaguugaucaugugcucuucuucccaaaaagcauucuauaguuaucucucaggugaacuaguccuaccaguguuccuugggaaauucuaggugcuggcuuuuaaauccaagcuacguauaugaugucuggucuuuccuauauggguaccagaugcagucugaggaauuucuagacagcuaaucucuaaucauaguuauuucaucccaaggacaucaucaccaaagagcuuugacagaauccaagcaauaagauaccagcuugccuuucucugacaucucauucaauuuuggguggacucuucugaugacuuauggcacugacaaacuggcaucuugcuguuuguguacccaugucuuaccuccuagauauagcuggggcccaaaauucagaagggcaauuccacaacuuugcuucacagacccagugcccagaacaguucucuuuucucucucacaagaaagguagacuacaguaucuaugcuaguuuaucauauuucuucucaaaugcuuuagaaacuugaaggaacagaaagaagcauaugaguuuuaguuagauuggaccuuugacacuauucuaauauuuaaugauauuuagauagugaugacucagguuuccugagacuugggcuaauuuuccuauuccuggaucuuccuguuuagccugcuaaguuaucagaccugaacauaccauucaggaagagcauggccaauagccucauuagacugugugggcuuucgguaaggagcuggcugguucuccucauugccuuguuuucugcuuucuaguggaccggggcagucugagaucuagaauuuucucuagauaaugauuagagaagacccauguugugucucauagcugggcaugguggcucacaucuguaaucccagcacuugagagguggagauaagagaaucacaaugaguaguaguaggaaguaaauguauuauaauguauaguuauuuauguuacuaagucagggcuuuuuuuuuucucuuugggugcuuugcuuucaguccugcuguaaaaugcguaguauuuaauagaauugcauacagcggcuagccaugccucuuuacagguacagagacaaaacuuagucagaauauacugauuggcuauguguacagagcacagucaugucuucuaaauucuuuuucuccccaauuuuuaauagguauuuucuucauuuacauuucaaaugcuaucccaaaaguccccuauacccuccccccaucccgcuccccuacccaaccacucccacuucuugguccugguguuccccuguacuggggcauauaaaguuugcaagaccaaggggccucucuucccaaugauggccgacuaggccaucuucugcuacauaugcagcuagagucaagagcuccgggguacugguuaguucauauuguuguuccacauauaggguugcagaucccuucagcuccuuggguacuuucucuagcuccuccauuggggcccugugauccauccaauagcugacugugagcauccacuucuguauuugccaggcacuggcauagccucacaagagacagcuauaucaagguccuuucagcaaaaucuugcuggcguaugcaauaaugucugcauuugguggcugauugugggguggauccccgagugcggcagacucuggaugguccauccuuuugucucagcuccaaacuuuguaacuccuuccauggguguuuuguucccaauucuaagaaggggcaaaguguccacacuuuggucuuuguucuucuugaguuucaugugcuuuauaucuuguaucuuggguacucuacguuucugggcuaauauccaguuaucagugaguucauaucaugugaguucuuuugugauuggguuaccucacucaggaugauaucuuccagauccauucauuugccuaggaauuucauaaauucauuucuuuuaauagcugaguaguacuccauuguguaaauguaccacauuuccuguauccuuuccuguugagggacaucuggguucuuuccagcuucuggcuauuauaaauaaggcugcuaugaacauaguggagcauguguccuucuuaccgguuggaacaucuucuggauauaugcucaggagagguauugcuggauccuccgguaguacuauguccaauuuucugaggaaccgccagacugauuuccagagugauuguacaagcuugcaaucccaccaacaauggaagaguguuccucuuucuccacauccucgccagcaucugcugucaccugaauuuuuaaucuuagcuauucugacuggugugagguggaaucucaggguuguuuugauuugcauuucccugaugauuaaggauguugaacauuuuuucaggugcuucucauccauucgauauuccucaguugagaauucuuuguuuagcucuguaccccauuuuaaugggguuauuugauuuucuggaguccaccuucuugaguucuuuauauauauauuggauauuaguccccuaucugauuuaggauuggucaagauccuuucccaaucuguugguggccuuuuugucuuauugacggugucuuuugccuuacagaagcuuugcaguuuuaugaggucucauucuggaucuuacagcacaagcuauugcuguucuauucaggaauuuuuccccuguguccauaucgucaaggcuuucucccacuuucuccucuauaaauuucagagucucuguuuuuuauguguaguuccuugauccacuuagauuugaccuuaguacaaggagauaagaauggaucaauucgcauucuucuacaugauaacugccaguugugccaguaccauuuguugaaaaugcugucuuucuuccacuggaugguuuuggcucccuugucgaagaucaaguggccauagguguguggguucauuucugggucuucaauucuauuccauuggucuacuugucugucucuauaccaguaccaugcaguuuuuaucacaauugcucuguaguacagcuuuaggucaggcauggugauuccaccagagguucuuuuauccuugagaagaguuuuugcuauccuagguuuuuuguuauuccagaugaauuugcugauugcccuuucuaauucguugaagaauugaguuggaauuuugauggggauugcauugaaucuguagauugcuuucggcaagauagccauuuuuacuauauugauccugccaauccaugagcaugggaaaucuuuccaucuucugagaucuuugauuucuuucuucagagacuugaaguucuuaucauacagaucuuucaccuccuuaguuagagucacaccaagguauuuuauauuauuugugacuaugucuucuaaauucuaagacacaguuuaacaucaucagaauguuaacaaguacaacccccauuguuuucugguuaucaucagugggcacugugccaacuccuuuacauccauuaucacaaauaaucacuguuguacagauaaaugugaccuagagauaguacugacuugucuacguucucuagcuaauaaaugucaggaaucauauuugaaccacuuuuguccauguuaagagcuagugcuauuuaucuucccaugauacuugaacuuaaaguuuugaauuuuuauuuccacauaacuacaaauacaaaugauuuuuauaaacaauagagagggaucucauguaccaaucucccagcugccuccaguagcuguauuugaucaccuagaaaguugcuuaguggguaggaggaugugcugugcaccaugagggccugaaucugaaucccagccccuaccccagcacucauggaaaaagccaagugugacugugcacacaucucuaacuccagagcugcaggcauaaggugacaagugauagagcaggacaccugcuguacuccagcagccuguacaauaacauaccacuaacacacacacacacacacacgcacacacaugcaaacacacauccacacauaaaaguaaaaaaggaagagaggguggcagugggagagguacucagugaaccaguacuugaguguugauagauuugugagugucuuuuguacauucuguggcauuugauaucaaguaaccauccucaguaauaaagauauaaagcuguuagaucagcacaaaagaaucauucauaccucugcucucuuauccucaucuccuggcaaccacuuucauacccucaaucccuguuaguuaggcaugguagcacaggcccguaaccuuagcacugggaggauacggacagaagaaucagaaguucaaggccagcuuagacuacaaaccaacuucaaagaaaaagaaugguauauaaauagaaucacacagcauuguauacugagauugacuuuacuuauauggcagggugcucaaauggcccuauacuuccuagaggaacuauaagacacuuaauggcugcugguaguggaaaaguuauauuccucagugguauagucacugauaaguuguuuauggucccauaaauuaccacacauauauacucaagcaagcaaccuuaacuaaauuccuaggucacaaaaaaaaaaaaggaacauggaagugggagagggacuucaaaaagaaguauucagugcgagggaaaaagggcagaagaaaauugcugaaagugugugcaugcauguguguguguguguguguguguguguguguacguguguaauugugagagaauggauguuaguggguuugugguccuuuguaccuucauccauuugacuacauauuuucuguuacuucuguuacuucuugcauguugcucauuucccuuaccuuaguuguccagauauuuuaauuauccuaauagcuccauaccugacccauuaaguugaccucugaucucucugcuagccaaccuuuuucccauugagcaucuugaucuauauaggcuuuuuuccuccuguugaaugauugcuauaaauucuuuaugauugcagugguugggucaaaggauaggacauuuguauggcucuucuugauguuuauuucccgacuuuggcuugaucaucaacccaugaagcagugcuuggguucuagugaggaaauaaauucauggugagaagucagagaagcaggugguauaguaggaaucucucuuaagcccuuccucagaagagcuuacuaguucugcuugaucuaguugaaaaaacaaggcuuguggagccauagcuaucagaagaaauuuaguaguugggaaagauggaucauucuaagcaacaggaguacuuuucgcaacgugcauuguccuaacuauagaggaaaugugugaagaauacagaaaggaccugaguugcucuaggucagaacaguguaggaaagggccugcagaaaccgccugugagugacucccugggcucauggaguuauguguaggcaacgccaaauuuugagguuacauuuuguuggcauaugugccuauuuuaaugcuugaucugucauguuugacccauauccuacuuauauucuuacgugguuaaugcaccaaagcaggaaacaauacuuugaaagcuuaugauuauuuuuacauguuuuugauguguuuacuauauagauauaaauacugacuuuuguaauuuuguucauuacaggauucugcucuaauacuugauguuccucugggugugauaucaagaauugaaaaaaugggaggcgcgacaaguagaggagaaaauuccuauggucuagauauuacuuguaaaguaagaaauuugauacuuucuuacacaaaagauacaauaguauugaauaguagaaaguuuaugugggcuuaaaaaaucaaaauccuuuccggugguagugguacacaccuuuaaucccagcauuggaaaguagaggcaggaagaucucugugaguuuaaaaucauuaaaaucuuuuguuaaucuaaaguuguagacuuggaucuuaccccuguagucaagugagacuuucucaaagaaguggucagccuauuaucuugcugggucagaagaaaaguguauagauaacaguucuuaaaccuucauuucacucuccacuccucaggcagucagggcacuguaaucaucacaauagcaugcuguccuauggagcugacugauacuguccuccuagcucccucugaccccauugaccacccucauguacaucauuucccuccuuuugaaugagaguuauaaguuuuccugaggaaaaugagugaauuaaagaguaaaaguguuuuuauggcacuuuaugguacuacaugucaccaccuagauacccucauacugugaaaggaaggaggcguagaagagauuuugcccuuugugcacaggaugccuccuuaccuauaacaaccauuuucagugccaguggcuaguauuuuauuuggaacgcuaagugggaaaaugaguugugacaacauuuagucaguuguuauaggaaacauuuauugagcaucuguguucacccaagcauauacuagaaacuucacauucuguccuuagcacaaacuuccuagacagaauguuauaaauggaggacuugagaagaauuagggagcuuugcugguauguucuaaagcgugccaaagcugaacuccaaauaggaggaaguaacuuaucauuuuguaaacagcacaguuagguuuucuggcaaaguaacuugcuuucuacauacuggguguagcauuaugcucaauucuagaaagagcuacaaggacuuuggaggucguuugucccaauaggucuuaaauguguacaucaagauauccaaaaggcuuuugacagaaguuccagagcugacuguacgauauguucuaaaggcuaagacuaagaauguguccuaagugccugucaagccaucuugcuaguacaguguucaucaugcuuguuuuacaaaaagguccagacagcaaauauuuaggcuguagagggucacagaagauauuggaugcauauucuccuauauguuuuaaaagaguguucuugccuugagaaauguacaaagaaaccugguuguaguugcugagccuugaccaccucaaguccauuauuucauguagauaggaaaaugaagccuucauaaagugauguggcuuuccuugguguugccaaagaccaauaaaagaaccuguuuuaaaacccaagucauguccuagucucuggugcuacaauuucuaaaagccaaacuuuuauacuuacauuugcacuggaaauacaauacucaguuuuuucuccaguuaaaagaucaacaugaguaugaacaaccagaaccugaauagguacucuugcccugaauuucucuacuacucugcaucucagcugcuuuaguuucuauuggaaucuaagcuguuuuucauacucugucugcuaucccagguacuggcuaucaugugaaaccuagauguacauaaauuuacuuugaagaagggucuuugcauuuugugucaaaauauucaugaggaauguuauauuaaacacucaaggcagugugguuaaaauguuggugcuacuaaagugacugucuuaccaauaagguacuugcugccucaucaauaggaggauuuauauuuaacuauuaagucuccaaaauaaauaaaacaaaguaugcucugaaacagauuuccaggaaaaaaauucucagauaauauacaucaaaauuuugaauugacuuguacccaaaauaaagaaaacuuagagcaauguuuuaacgcaacauuuuuuaaggcagggucuuaugucacucaugcugguuuugaaccccucuguagucaaggccagcuuugaacuucucuuauuguaccucugacacccugagacuacaggcauaugucauuuaacacagccauagcauaaccuucuaauaaaauuccuucccagaaacacugauucacaaaaggcacagcccauuuucuaaguagcagauauaagagaagugugcagcagcgggauaagcacuugucauccugucucacagaucaccuugcacccauugucaguaaucagaacauaacauuucucuccccagcuaaggagcaguccccacacuuugggcuguuuuagaugugcacauauggguuucacucagcagcagcaacaaucaauagacuggcucuugguuccagaggaccuugugucaccacagggguguuguagauaugggaaucaguacccugcaggcccuauacuaccacuaauaacaauuuaaagucuuuuuguaaaaagacagggcaaacaguacugccagauaaucuucuuucucuuuucccccuuuucuaccuucuuggcuuucuuuaauaauaaugaagccauugaguaucacccuaagauccagcugguuagccuguugagugugacagggagacuguuacaacacaaggcucuuucucaucuucccuuccuugaugagucaagcuuggaggagaccauguaugacuuggaguuaguguauguuccuaguuauguuucggacuagauggucugcuuugaaucacgugccuuguucacuucagcuuucuuauugcaagacuuuuuuuuuuuacuguuauugcaucugaaucagauggcagaaagugacuagagucauucaugcuuugacaugugaaaaguuauuccucugagccacugguggaucacaauaaauauugguuuggaaacagucuaauuuggagcaaagugguuugagaaugauguuguagcauuaccagugcuuuauggcuguuagaaggaaaguuccucacagguccguguggccugacaguggcagcuauccaguguuaggccuguggcugcuuguuaacguguuagauguaucucguccuauugagaugacuuucccuuucaucugauuaccaugauauuacaacuaauauuccaagauuuuggggguggugaaauaaauuggguuuuggaauuuuuucaguaccaugcuuuuaguaugggccugaaguguagcugggugguagaguguucaccugacauucaugaagcucuacaguccauucccaguguuuuaaaaaucaaaagaggaagcacaagauccuggagcuggcaaggcucauuagaugccaucuguauucagagugauugcucucagaucauuuguuaguagucuuggaggcuucuucaaacuuuacuugucuuuuggaaugucuuguauauagcaaagccuucguuggcccuuuggacugaaaaauuaugaagcuuaaauuagguuggaaauggaccauccagagagagacugccccacccgggaguccauccgauaaucagccacuaaacgcagacauuauugcauacgccagcaagauuuugcugaaaggacccuuauauagcugucucuugugaggcuaugccagugccuggcaaauacagaaguggaugcucacagucagcuauuggauggaucacagggcucccaauggaggagcuagagaaagcacccaaggagcugaaguggucugccacucuauagguggaacaacauuaugaacuaaccaguaccccggagcucgugucucuagcugcauauguagcagaagauggccuagucggccaucauugggaagagaggccgcuuggucuugcaaacuuuauaugccccaguacaggggaacaccagggccaagaagugggagugaguggguaggggagcagggcaggggaaggguauaggggacuuuugggauagcauuugaaauauaaaugaagaaaauaucuaauaaaaacaauuuuaaaaaauaggcuggaaagaaggcucagcuguuagcagugcuugccgcucuuguagaggaugaguucaguuguuauucauacugggcugccuauaccaccaccgcuaaauccaugggcucuucuacccacuucagccuuugcagaugccugugcacaugugcauauacccaaaaauaaaagucaaagaaagcuuuugaauaauauuauugauuaaaaaaugcaccuaugcaaacuaugaauguuguaguauguaagacagcaggaucggagucuagcucacuccuuagauagucccagacaaccuauaaaacacucucuuuguuuugguuauuuugagacaggguuucucuguguagcccuggcuguccuggaacucacucuguagaccaggcuggccucaaacucagaaaucugccugccucugccucccaagugcugggauuaaagucgugcgccaccacugcccugguaaaacacucuuaaaaauaagguagaauguuguguuuacuacaaacagauauuagaggacccuaucauuuagauucaguuuaaaagccuuucuugccuauuaaagaaauauggauagagagcugccauuaaaaucugguuuugaucauuaacuuauaguuccugaggguaaaaugauaucuaauguggaauacauuaauaugguuuauauagaacucucugaaaguagaguugguaguaaaaguuuaugacuuguaugagaacauaaaaugccaaucauuuagggggauaguguuuguauuuuaaugacacauuuaacaaugucaaagcagguagucuuuugaaacauuauaugacuuaaguacuguuuaauaacuaaaacuuucuugcgccagacggugguggcgcaugccuuuaagcccagcacucaggaggcagaggcagguggauuucugaguucgaagucauccuggucuacaaagugaguuccaggacagccagggcuauacagagaaacccugacucgaaaaagcaaaaaaaaaaauuuuuuuuuucuugcaaagcagugugcauagaagugggcaguaagcagaugaaaaguaagacaagggucuuucuuccagcauguguuugcacugucuuagcuucagcacuuuaguuuagaaacugacucauucugguaaagugcuuugucuuuacuuucuuggcuacaauggaacuguguccaggucuccuuaaacuguguaugucaagauagcauauacaaauauagcuuaaaauaaauuacccuuguauggguaacugaaaagauuuuauuuauuuauuuauuuauuuauuuauuuauugcuaauuuucacaauuuuacuugaagauucaacuccacuuucucauuugccucuaggauuugagaaaccugagguuugcauugaagcaagaaggccacagcagaagagauauguuugagauccuuguaaaacaugccuuuccucuggcacacaaucugguaauguccagggcuuaccuaaacaucugcauucucugaaaugucuccucugggaaaacuaccuguugguugggcuucuuuuugcuuugcauuuccuggugugacauauuuuacauaugauugcucaauuccagaagugcaucccugcuaguguccaugagccugggaucuccuaugcucuccagccaggaguuuguccuuucugugauagaaagagaauaagguugcuuaauacaguaucacuaagucuucccacaauucauggcuccucacuuuggugcuaacaaggaaugggagucagacuucugugucaccaguucaaaaugggaacggauccauugauccuaaagaccauuuaaacaaauacccccaccucuguaucucccuccuccuucccuucuucccuuccuuucuccuucccuccuucuuuucucucccccucuaugucugucugucugucuuuuucugugucucugucucccucccuucccuucccucccucccucccucccucccucccucccucccucccucccucccaugagacagaguaucauguaucucaggcuggccacagacucuaugaaagcaaggauuaacuugaacuucugcuacuccuaccucauccucacugggauugccagcauguaccaccauggcuggguuaugugacgcuggccuggaacccagggccuuaugcaugccaagugagcacuuuacugacuugagcuacauuugccuaggcuaaccugaaacucaugauccuguuaccucgaccuccugaaugacaaaugcauguugccaggccuuguggacauccucauaccccuagcucucaacaaacauagaggugaacucucauuaauagggggagaaggaaaagauaccauuguugaaaaauguauaaaugguuuugaaacagcucaggcuggccuaaaacucacuauguagcugagagugacuuugaauuucuaaucaauccuccuaccuccaccuccccaccuccccgcuguuggucuuaguguuugguuuaugugucauugaggaucagacccagggcuuaaugcaagcuaguguuguacucuuccaaaugagcuacaucccaaaauggcuacagacggaacagacggugagaaggaucauauccggaaacuaucuugcguuuucucucucucugcuauuuuggucuuuuugucaugguaggugguugugguucuuauucuuguuuuaauaaggaagugagacauuuuggggggaguaggggguuuuuuguuuguuuuuguuugguuuuuuuuuuucuuuacugucucuggaucucaccaccagcaguuguuugccuuucaggaaacacccaccugguagaagggagaagccauuaggaggagcuaaugaguacauuauacccuuacuauacugacaccagauggaauguguuugggaaacaauucuaccaaaaguuucuauauuucugaucaaauaagauuuuaaaaauguuucuuuauaaauauuuucaacuuuauuaggauggaaguuuauaggaauacaucuuuuaaacuauuauaaaggugagacuaaaauuuguuaugauuuagucaggaauagaucuuuucaacuauuaugaaggugaggcugaaauuuauuaugaguuagucaggaaacauguuuuguaucaugguuuaugcauauuuauaucuguauuauuagaaauugaagcaaauggauauaucuggaggauaucauccuuagugagguaacccaaucacaaaagaagucacuagauaugcacucacugauaaguggauauuagcccagaaacuuagaauacccaagauacaauuugcaaaacacaagaaaaucaagaaggaggaagaccaaagugcggauacuucauuccuccuuagaauagggaacaaaauacccaugaaaggaguuacagagagaaaguuuggagcuaaaacgaaagguuggaguauccagagacuaccccuccuggggauucaucccauaaucagcccccaaacccagacacuauugcauacgccagcaagauuuugcuguagggacccugauauagcucucucuugugaggcuaugccagggccuagcaagcacagaaguggaugcucacagucagcuauuggauggaacacagggcccccaauggaggagcuagagaaagcacccaaggagcugaugggucugcaacccuauagguggaacaacaauaugaacuaaccaguaccccccagaacucuugucucuagcugcguauguagcagaagauggccuagucagccaucacugggaagagaggccccuaggucuuacaaacuuuauaugccccaguacaggagaaugccagggccaagaagugggaguggguggguaggggagcaggguggggggaggguauagggaacuuucgggauagcauuugaaauguaaaugaagaaaauaucuaauaagauaauaauaauaauaauaauaauaauaauaauaauaaagaaauugaagaagugccucacacgcauguuugagaaagcuaaggucuuauuccaugauccuucaguuuugagcugucagcuuucucuuuucucuggcauccucugggucuuuuaaagcuuauucccuuagaaaaaauagucaaguaucaggccagcuuucucuuaaacuacccaucucuggaaagaauuuuucacuaacgucacuaacuugcucccucguuuacucauucauucacucacucacucacucacucacucacucacucacucacucauucauuccucuagcucaugccagaaucaagcugauauugguuaguguugaaugucaacgugacaggaaacaaacuucuggaaacaucuaugagggacuauguagacgagugcuucugagggauuuuuuaaaauaauaauuaugcgauuuucaaguuaaaaugcaauucuaccacuucccccccuuacuuuuuuucuccaagccuuccuaugcacccacuugcuccucuccuuucucaagcucauggcuccuuuuucuuuaauacuugacacacaaccugcuaagcccauauaauauuaagugugugugugugugugugugugugugugugugugaagcucuucuaugggaagaccauuuucccacucugaacauguccuacuuacccauagcucuuccuuuaggguugaggcccugugagcuuuccuguuuucauguuaacaugaucauugauguaauccuuggugaggucuuuuuuggacagccauguugaugggacuucauagauucucuggagacacaauuuuacaguaaacuucugguuccucuggcucuuauaaucuuucugcugcuucuucccaaauaagcccugagcuacagguacaggcauuauuguauuguagauguaucaguuggaucuggguaccacauaauuucuuacugucugcauuuuaccaguuaugguuuucuguaauauaucuguugcaaagagaaguuccuuuaacaaggggugaaaacuaacccuuauagguggguauaaggauaaauauuuagaauauagauauaauuuacauugauuuugaaaguagaaguucuagguucuccucuaagaucugugacuucucuggcucuggguuguugguucggguuccaguaccaggcaugaguucuuuuuuguugagcaggucucaaguccaaccagagagguucugauuaucaccaaggugugugugcauuauugugcccuuaggguuauuaugccuugcuggugguuguucugguucauaggugucagaguuggauaggccuacugugugcuuccuuugcuuggaaguuugcauguguaaaggauuaguuugaucagaugaauuggaauugugaucuaaaaguaggcugcaccguuccuugagcuugaguucuggagggcacaaggagaaagcuaguugagcuuaugcuuuuauuguugucugcuuucuaacugugaaugugauaugaccagcugucucuagcucccacugcuguuacucccugcaaugaugcaaugaacccaaaaaaucuuuaucccuugaguugcuuuugucuggauauuuuaucacaguguuagaaaacuaaguaauacagagcucuugaccucuuaguggccaaaccuaucaccugauuuccacgugcauuugaucagugggauugagcuccuucuugugaccuucgcuccccagucgacgcugcccuugccuuuuucuucacugugaaugucuuguucagggauccacccucagcuuucaguuccccuaauguucccaguuuugccauggugacuucauuuauucccauaaauggaguugucacuacuguguaccuggcuuguaagucuagcccuuguaagucaggacguugcccuugagugacucaaaccucacuaauccugcagaacuccuuuccagaagacuugugcuuuccaaguucauugauaucccaaucucacuugucucuguaaugcuuguccuccacagucauccuccacuuagcaucuugcuccaucuaaguugccgucccaugucaugugugauucacuuaaagaauugaucuucuguuucauuguuaggucucucuugaguauauaccacagcuuccuugugugauaauuauguuguaauuuucuuuaccagcccuuccuguccauuauucuucgagcuuaucagggcagacaucacccuuuaucucucuagccccaguauagugacuucuguacagaaagguuuuuuuuuuuggggggggggggaaguucuggcugaggauagaacacagcuaauacagagagucuaccagugugcuacaucaccagcucacacauggggguguuaaagugauaggauuuuaguuaaacuguuucaugagaaagucaugagaaacauuauuauauagaaaugaguggacuagaucuuucugucaggaccuagaauccugugcaugucacugaagaaagguaucugcagagaauuggcuuauucaugguugugguacuuggauauauuuuucaugucuacacuggaaauccauguuaccuuccuuaggacaucaggaauguaacuacuaaaauuuucccuucaaaauauauaaaucuaucacccaaacaaugcaauaaacagauccccuguuggcacugcuuuccuaacuuaaguuuauuucagcguccuauggaggguagcguuggggaauaaccagguaaguuaagacaaggugcaaaaugagucuacuagaagucuaguagaagugacauggcaaaagcgugugguuccaauauaggggagaggaaugcagaagaaauucgcaaggcucucagaaaggaggcuagaagagccugugugccauugcuccugaaaagaugaaguuuguuuuuaguaggccaggaaaauggaggaagugagaauucaggcuauaggcaagaccucuuaaauacggaagaaaagcuggcaacauuucaagguguuugagauggaucugggaccagcucugaaaucuaagagaucugaggucaucuggucaaggcuaaugcuaguguagagagccuuugccccagggaguaacagaaacuugcugaagguucuaaaggaauggugauagaauaaagaugcccucaggcagaacagaaccaaaggccaggacuagagaauugcagagccuagacaaggaccuguuagaaagacuugacugacuuaagcaggagcuuggccagaaaggguagagacaaggaugcgcuuacuuugguucucaagugugagugaugggaaggauggcacuuuguugagaaacagcugaaagagaggggcagggaggggacgccucgucuuaaccuccaugcccagggacuacccuagugcugcccuaacauguugacgguugaaagagagagugguuuguaaaagaaagaaaaagggaggagagaggaaaggaggaagggaaagagggagucacuuucuaggcaaggcucaucagaagccagcagguuaaggguucaagcccccauuuguaagguggacuuuagaaaggaaagggcgcaauuguuccuaugcgaugggagaggaacaagaguuuccaaacugccacagaggggaugcggcuuccuuggagcuuaaucuacuuaugauugcauugaacaauaaaaaggcuccugccccugaacuacuuugugaguauuucuggaacuguuaaacuaguauggaugagcucgguggguuuugucacuauuugaagucugaauuugccaaugaaugcaagaaauggugucuggaggccaacagaccugggcagccauggggugaacacacugugagugggcauucagaccaccccuuuagcccuucugagccauuacuguuuucaccacucaaugugugcaagucagaacuuaaaaacucauuugaacuugagcuauuauagcagcaaagaguccaccccaagccauuaaacugauugucucagcucaguauuaugugcauggcuuuagaugagauuuuucuauuucagccaaaauacuucuuguuugaucuuugcuuuucaaacaccagaaagucucacaaauuucauguagcucagcacaaguuuuagguaagugauacaguguugugacaacugcuguaauccuucugacacugugacagaauauuugaagagagaaaccagucauguaccugugugcaaauguagcaacacuacagaaagcacaacaaugucaagauaacaacggauagccaauggcaaagcucagucauugauuuccuugacuggucauuuuguaaugaaauguggcagucagaaauaauaucauuuuagaugagaguuuagaugaaagcaucacuuccaacauauuagugaaucauaaaucagugugucucuuuaaaugaaauagaauagaaaccauggagaacaugacagaaaagggguauaguuugcuaagauguuucuucuaaggguguguacauaugguggcagggugcuagguucuugguguuaccguuaguuccuuacuuagaaucauggcccagaaagguugaagcauaagguucaggggccaagcucacagcagccacugaugccgagaucuaugaggggacuugacuucuacugcuaacauaagccaugcauucagugcccuuugucagaaugggccucagugaauuuccugcuuacagacuuuggaagucacauaauauuuaugugugucaguguucucaucuacaacggggauaauaacagcuccuaccccauagaguuuuugugaagauucaauguaaagugcuuauaacacugccugacacucaguaagggcccaauaaaugccagcuguucuguuauuagcucccuauuuucccagcagauguaagaaauaaggaugacuacuacaacuccccacagacuauuaauaaaggaauugugauagugugugggaaacauuaagcccuuuaaaagaaagaugcuauauaaagauuagugguauuauuaacaaaccauggguuguacuuugauaaaggacucacuagaagucuucagagucuuaaaucagaaagcaucccaaccugcagugcagaauaggagaagugaugcuauggaaugaaaggaauccuucagagacugcgucccauccuucucuuuccaucuuuucagcccacacagacuuaaaugcuuuuagggaaacauggcucagauuuguguuugcaccucccauuucuuggggacauucuggacuaaaguuaaggacuucaguauuucccacuuguuccucugugagcugaugaacagucaugaaggugcacccuuugucuucaucugggagcauggcacaucugaccuuaugucuauaugucaaggaagguagggauaaggggacuugcggcggcuuuuucaaguuucaggagcagagcagcugacugauuuaccuuugcgcuuuacauugaauccuuacaaaacucuaugggguaggagcuguuauccccguuguagaugagaacacugacacacauaaauauuaugugacuuccaaagucuguaagcaggaaguucacugagccucacucugacagagaucauugaacucauggccuaugcuagcaguagcacacuggaagagcucuucacuguggcugcuguaguaccuuauugcuuccaaaggaugggaacaaugccuuuaagagcaccuccuggacacugacaggcauuggucacuaccuuugguuuucauaguaucuguggccuguuucuucuuguuaggcuuuuucuaaguauguguuucuauuuugaacuaacacauaguaaugcguguucuucugggcagcagucagacauuuuacuuccuacauacaauggguagguaauaggagauuuuggucucuguuuggggcugggagguucugguuuugauaagaucaaacccuguuaugugacuuaagccuugggccauuuuacuugaguucccuccuauucaacucuaaaugugcuuaugagaauaauuacauaagaauuaaugaagugaguuaugcaugcgcucucucucucucucucucucucucucucucucucucucucucucucucucucucucucucucucuucgagacaggguuucucuguguagcucuggcuggccuggaacucacucuguagaccaggcuggccucgaacccagaaauccgccugccucugccucccaaguguugggauuaaaggcaugcgccaccaugcccagccacacacacuuucuugaucauuuaaaaacuauaaaugagccugugaauaaagaauccauggggaguuuuauucucugccuuuguuauucaucucagaaauggagaaauauucuaaauuguacuaaaauuuuaaaugagacaaagaguuaguggacucuucuuuuuuagguugauuauagaauccacagauuaaaggacauaauguuuugagauaggaauugaaaugagaagugccuguacacauagcccugcuuuugguuucaagauggcuuaaagacuauaaacuaugucuugaauuuucuauuuccuuuuggucaagaauuuuuccccuugaauaaguacaauuagcuaauuaaagaccuaaccaugcuuuucaauauucugucuugccuucucaaaaucuuaacccuucauuugauuugauuucucccuuccacugcugucucuauucaaaaccuuugacucugcuugguucuucucagcaccauccagcuccuggaaucgucucaucuagcucccccucaacaucacugccugcuuccaaagugcugcauucccuggcugccuaugccucaucaggauccacuccagcaugcuuguagcccugcuauuuauucagaacuauucuaaaaauggcacuagaccagacacauuauaaaaccugggcugggcagaugguuugcucaguaugagaaucugaguucauccucagaacuuacauguauaaaacugagcauggcuguggugugugcucacaaucccauugcugagggggucuaagguagaucccuggagccuggccuaauuggugaacuccaggucaguaagugacucugucucaaaaagcagggugagagugggauaugggauuuuucacuguagcucaauagucaagagcacuuagugacacauaugaucuuuuaucugucaaggcaggcaaggguaaggggacuugcacuggcugucucaaacuucaggagcaaagccuucacuguggcugguguaguaucauacuguacuuaaguacucuuaaggaagaccugaguuuaguccucaguacccacaucagaugucucacaacucccuguaagucucacucugggaaaucucuucuggcuucugugaguaaugugcccacauacacaccuacacacacacacaaacaauuuaaaaagaaauaauaaaaaaagguggauggcagcugaggaacaagaccuugggcuguccucugucacacaugcgugggagcacgcacccagacacuccacagcccuuccucuccaagaaaauacauauaaaauauagccuuuuucacacagguauacauccuuugauccaggauucaggcaggguaauuucuuccauuuuaucuuauacuuuaacuaccucuacauuuguuuugcugggcuuuucuuuccauuguguauggggaguggugagguuguuuuauuucauuauuauggaaugugguuuucauuuuguuucaaagcuguuuggccaauguuuauaaucucucccucucacaucuuccauaccauuuuuauuuaucaaucauauuaaguauaauuuauagugguaucugauuauuauaguucaaagucucuggauuuuuuuuacaaaagggcagucgugaaguauguuuccugcuguauuuucugaauacgacuuggaaacuuucauucuuuggaauauuaccuauggaaauacucugagccugggauugaaaggguacugaauuuuuucugccaagcaccucaaacagcuugagaagguuauaaaugaauucuccuucauuguuuugggagccauucaguuuuuuuuuauuauaauacaugcuaggcugaccugugacucuggguagacagugguagacauguguugucuucucuguucagcaucaguaauuccagcuuagaagcuguacuggcuaguuuugugucagcuugacacagcuggagaaaucacagagaaaggagcuucaguugaggaaaugccuccaagagauccaacuguuaggcauuuucucaauuagugaucaaggggaaaggccccuuguggguggugccaucucugggcugguagucuuggguucuauaagagagcaggcugagcaagccaggggaggcaagccaguaaagaacaucccuccauggccucugcaucagccccugcucccugaccugcuugaguuccaguccugacuuccuuuggugaugaacagcagcauggaaguguaagccgaauaaacccuuuccuccccaacuuguuucuuggucaugauguuugugcaggaauagaaacccugacuaagacagaagccaaaagagguuaugucccacuuacuucugcuuaugugguaguguugugaaguacagucuuucuuaaaagagguuucaaauaugacuccaucuuggauuggccuacagcuucauuuccaagcucuuaaucaaucauuaaguucuuugauccuguugguggcuacuucuggacuucuguacauuguuccacucucauagguucauugguacauuaaaaaaaccuguuucuauuauauauaguacucuuugguguguuuagcaaaagucacaugaucccauugucuaagcaugucugaccuauggccugugcagugaacauggccaaggauagcuauaaauguagcccaacacaaaaucauaaucuuauuuaaacauguuauagaaaauugguuuuugagauuuugugguuuguggcaacucaauugcacaguugucaagugugaacuuuauaaaugacaacauuguuuugcaguaucaaagagucaggcauggcagaguaucgcauuucuagauaauccuucuuggauugaaguuuaacuuuccuuagcuucugagaccuaagucucuuguccuuucuuccuccuccugacauucuuuuucggggguggggaaguggggguucuauacaugaauuuucuagaaaagucuguuuucuucuccagcuuacuaggcaagcuuucucuugugaccaccaaaaugcauucugagcaggauuuaaauuuuauagugucauauuucuccuuaguugacuuguuuaagaugacucucucauauucccucccaauauacccucugugugccuuagacauuccugaugcccucucucccuucuucccucuccugguucaaacuuaaaaucauaggcauuuucucugcugcuuagugguuacuaaaccuaaaugccucucauccccagccugacuugguugaagacguuauucccucuguaagaaguggacuuuggcugguuuuccuagcucgcagccaguacgcaugccuucugugagucugugcugacagcacacaggcaguccuggcuuucugguauccuugcucuggaaauggccuccccucucugucaguuuuuaugcaagccucugucuccuccacaggguggccccaucucaguauuuuuguuugcucuucuacacuccugcagacagacuaaguggccauguauuaucucuggccuuucagugcuucugccauuauuguuuacuguccauccaaggucauucagacaucaccaccauccccugggaaggucugucauggagucacccugcuguuaccccuaaaugaucuacaacugugagcccuucaucucucuccuguggauaauuucuaacuccuuccagugauauuguccuucuugucauuuuucuacuucauaccuuguuuacaguggguccucagaaacuacaaacucagugaauguccuaccauagacacuaaauaggagucaccaucaagcagcccaucagauuagucuguuuauguuuuuuaaaaguacauagauguguaggcccagucccuggaugaggccagagguugacacugugcuauuuccauggaucgugucuccaucuuaguacuuugagacaaugucucucacuaaaccuggagcucaccaucucagcuaggcuggcugccaaugaaccccagacuugucucuguuucucccaguucuuugguuauagacaccucuguaccugcuuuuuacauauauuuugggaauaugaauucaagucccacugaaccauuuaccuauccuccaauuuaacucuaaugguaucaguauauauugucugugucuugcuuuuuuuguucuccaauagagacuacauaaugaauggguuucuucucuguguuuagaacuacauaguauucucucaacuuuuaacuuuuauuauaauauauuagucuuuucuugauaguuauuugaagacuuccauauuuggcacaauauaaauacuguacugaguagccuugcauauacauaauuuuguauauauucacauacaucuuggacuaacugcuuugaaguagaguuacuguuuuugccaaauucugcuuuauagcagauaucaguaugcacuucugguuagagugcagguucuuagccucugcaauguguuaguuuccuauuauugauauguuaugaugggcuaaauugugugugugugugugugugugugagagagagagagagagagagagagagagagagagagagagcgagcacacagagauaccaggcuggaauugauuuccuuuugcuccaugucucauggccccuuugcuucuaucagcaccauuccuaccucuuccagcuuaaauucuaaauucuuuuaggaguauaugaugcuguuacagauaauccaggauacuuucucccuguuuuaaggucaguuauuaguuaucaucauuccaucuggaacauuaauucuuuguuguguaugguaacauaacaaagguuucaaagauuagaguacaaccauuuggggagggcacaaccuccccauauaccuacaauaucaacucaguguguuuucuaacuuuuuuuaacuuugcaacccuuuaggcaaaacuauagauucccaguucugcuuuguagcacgugaaauugaaugcccguugauauguaccacuuguguuauguucugccuucugcucuguuuuccuuuuuagagugcugaacacuuuauuuaauaguugacuuguacugugaguugcaaguguuugcugcaauaggacuuuggacugugcuuauaguguguuugcuauugauaacuuuaagacauucauuucuagaauuucuugaccauuugguagggaucccuaagacgaucuucaaguguauugauuucacuagaagaacuugcaagccucaacauuuauuuguguguacaggugggauuuauuacaaucaaaagauaacagaauagaaccaacaaauggaaaagcuacagagcccgaguugaaauaccauuuguugacuagucuaguaauagguagaugggcuguggugcaauguaucagucauuagagcucuguauuaguuauucuuugguaaucugggaucaugugcaugcuggguaagugcucuaccacugagccacaggagcagcccagcauuguuguaacaguugaaggcaugagcuuuuuucccccuaggggagagggagggcgguguuucaccuagccuugaauaugcuguauaacugcagcugucuaugaaguucugauauucuuuuuauuaauuguuuuauuuauuuaccuucccaaugguuucuccccuccccagucccccugccaagaguuuuucaccccauaccaccccuuugucuuugagaggaugcucugccccauccccuuucuuuaauuuuaauuuuuuaaaccuuauaugguucuuaaaugucuuaaccucccuucuaguccaucacccacuagggguauugggaaagaaaggggaaguggaccuguuuagaaaugguucuuuggagcaacugcccccucuguguugucuagaaaccggcagugcaguuuaguucauaaauuagcggcagcagcucaaucuacucacaaacacuuaaccguauaucagcaguucagcucaguagagucuggguagcaaacaaaaauuagcagugguggcacuaccuagcagacagccaggccucagucucagcacaagucagcaggagggaccagggccaacaggaacuccaggaaaagaucucaggcugugccucucucagggaagugaagaucagagaaggcuugagaccaacaaaccuugcacagcuagcuguacuagcaaaccaagcucagacucucacugucuaucaaguucuauuuauacucccuccaaacaccacauguccuccaugggucuugccuaagcacaugucuugccuuagcauguucgucugucucagcugacaacacucugccaaucagccuaaguucaccgaagcagcaagaaacugcaggacgccaucagaaauuuguuggugccuuuucucucuauuggauuccugacaaaugcagcucaaccauacaauguaagguggaccaauacauuuguguuguuagcaaagaauccuuuauuacauuuucuuucauguacuugcuuuagcagaacauccucucuccauuugucuacuucagccaaauguuccuuuaugggucugccuuagccuuucaccuguguccacuucagcuagauguuccuucacauguuugcccuagccaaacaccaucagacacaacugacuuuccaaagaacccuaaaguuuccacuuuacccuucccuggggcaccaaggcucuacaggauuaggugugugcuuuccaacucaggccagacaaggcaguccucugcuauaugugugcucuuuggcugguggcuuagucucugagaguucccggggauuuggauuaguugauacuauuguucuuccuaugggguugcaauccccuucaguuccuccaaucuuucgccuaacucuuccauaggggucccugggcucaguccaaugguuggagguaaguaucugcaucugucugagucaggugcugguagagccucucagaggacagacgugcuaggcuccugucugcaagcacaacacugcaucaguaauagugucaggguuuggugucugugcaugagauggaucccaaggugggccggucacuggauggccguucuucagucucugcuccauuuuugucccuacauuuccuuuugacaggaacaauuccugggucagaaaugugaagguagguugauguccccaucuuuccacuggggacccugucuacacugaaagugguuucuucagguucaaucuccccacuguugggcauuucugcugaagucaucuccauuaaguccugggagccucucacaacccagguuucugggacuuucuagugguccccccucaugucccaccccccccacagcugcauauuuccauucauacuccuggcccccugggcuuccuucuguuucuuccucucuuagaguguuacugcugugaacauacaccaugaccaaggcaacucuuauaaggacaacauuugauuggagcuggcuuacagguucagaguuucagucccauaucaucaaggugggagcauggcagugccuagguaggcauggugcaggcugagcugagaguuuauaucuucaucugaaggcugcuauaaggagacugacuuccaggcagcuagggucuuaaagcccacacccacagugacacaccuacuccaacacguccacaccaucuaauagugccacuccuugggcugaguauaaacagacuauaacacccccauaccuaauccugcccccccuuucccuuccuucuccccuuucccauccaguuccccccuucccucugccuccagugauuauuuucuuuccucuaagugggauucaagcauccucacaugggccuuccuucuuguuauacuucauagggucugugaguuguaucaugggcauucuguacguuuuggcaaauauccaccuaucagugaguacauaccaugcaccuuuugggucugaguuacuucacucagcaugguauuuucuaucuauuuucccacaaaauucaugaugcccuuauuucuaauaauugauuauucaguauuuuguuguguaaaugaaccacauuuucuauauccauucuucuguugagggacaucuguguuguuucuagcuucuggcuacucugaauaaggcuucuaugaacaugguggaacacaugccucuguggcaugguggagcaucuuuuggauauaugccuaagaguggaacugccagacugauuuccagaaugguuguaccagcuugcaaugccaccagcaauggaagaguguuccucuuucuccacauucuugccagcaucugcugucaccugagguuuuuaucuuagccauucugauuggugugagguggaaucucaggguuguuuugauuugcauuucccugaugauuaaggauguugaacauuucuuuaagugcuucucagccacuugagauuauucuauugugaauuaucuguuuaacucuguacuccauuuuaaaauuggguuauuugguuuuuggagacuaacuuguugaguucuuuauacauuuuggauauuagcccucuguugcauguaggguuagugaggaucuuuuccuaauuuguggguugccguuuuguccuauugacauuguccuucgucuuacagaagcuuggcaauuuuaugaagucccaucugucaauucuugaucuuagagucugaacaauugguguucuuucaggaaguuucccccugugccaaugaguucaaggcuuuucaguuucaugaggucccauuuguugauucuugaucuuacaguacaagccauugguguuccguucaggaaucuuuccccuaugcccaugugcuugaggcucuuccccacuuucuccucuaaguuucagugucucugguuuuauguggaguucuuugauccacuuagacuucagcuuuguacaaggagaugagaauggaucaauuugcauucuucuacaugcuaacugccaguugagcuagcaccauuuguugaaaaugcugucuuuucugccccgcccagggauccauucccauuaucagccaccaaacccagacacuauugcauauaccagcaagauuuugcugacaggacccugauauagcucucucuugugaggcuaugccagugccugguaaacacagaaguggaugcugacaguaaucaauuggauggaacaaagggccccuaaugaaggagcuaaagaaaguacccaaggagcugaaggggucugcaacccuauagguggaacaacaauaugaacuaaccaguacccccagagcugugucuuuaguugcauauguagcagaggauggcuuaguuggccaucaaugggaggagaggcccuuggucuugugaagauuauaugccccaguacaggggaaugccacggccaagaagcgggaguggguggguuggggagcagggcggggguguauaggggacuuuugggauagcauuugaaauguaaaugaagaaacuaucuaauaaaaaacauuaaaaaaaucacaaaagaaaagaaaagaaaaugcugucuuuuuuccacuagaugguuuuagcucccuuuucaaagaccauagguguguggguuuguuucugggucuucaauucuguuccauugaucuaccugucugucacuguaccaguaccaugcaguuuuuaucacaauugcucuguagugcagcuugagggcaggaauggugauuccccagaaguucuuuuauuguugagagcaguuuucacuuuccuggguuuuuuguuuuuaguccugauauccuuagcucuaacucucaagugcuaggaguagaaguauaugccagcauguccagcucuuuaccugcucaggauucauaagauguuuggcugucugggagggccagccuucuuuuguuccucuuccuuuuuaucucuuucuccuguaguuuagcuuagccacucaaugccuuuuuauuugugguagggccugcagaccuagaacugaucuccacugacugccuccagaacaccauuuccaggauggcguagacaagcagauacauauaauagagugcuucaugagaucucauggggcuauuccuaaaaggcuuuccuagaaagaucagcagggcaccagucagguuaagccuaacuaaaggaguggugugcaaugugaagaagccagauagacugccaaugcagggguguguugccucgggcuguaguauauguauaagggugcuaaccguagaugguacugggguaaaaggcaagccaaagcuugcagaaccuauccaaucauuuuucuuuuuaaaaggugugcuugcgugugcgugugcaugugugugugugugugugugugugugugugugugugugugugugucuaguuuucauaguacuggaagguggcauaaucuaccugcugcuggaggagaaaagccaucaucagcucuccccagcuaugaccccuaugagcuccaguaacgacugcccugacaagguuuguccauuggaacaaugauggcacaaauguuauagaguuaaccagccauuuucugauugaguccaaagucuacuccacaagauagaacccauaccuaccacuacuauugagccagaaaccugugauuagauaggucauagacccuaaaggagaaacuaauacuauauuuugcuaaaugcauagaguuguagcagaacaacuccuaaugaguuacugcuagagugauagauuagugcaucuuccaacccucaccguagaagcuucuuccuuuuacaguagaugacauucaacacagggacaugcaauuggucaauuuacagaaaacaaaacacugucauguacucagcccuaaaugggaugucuuuacccuuaccccuaagcucagggagaaagauuuuuagaggcagaggugguagauaaacuguaaagaagcugcuuuccaggcacagugggacagcugcacauaugcacucugugauugggaugacauguaagaggcuugagauguaggcacuuguagcugaggaugucuuggcauuuaauugcugcugggugacagagagucugucuucuuuuaggguauaaccagugguaggccgaccuauauuccagggcaggacccauacccaagaguauuugggcaacacaguugguugugaugauuuaaaaaaauaacaagaaauuugggaguagggagguggguguggaucugggaggagcuaagggaaaagaaucaauaugauuaaaacucauuguauagaauucucaaaguauuguuuuuaauuccuuagacugcuguaccuccuaugauucuuuaaauuuggggguucuuaagauuuucaagaaaacauuuucugaaaugaagaaaucuuuuuuguuaaguauaaucuaaaagguacaaaaugaggugacuauauauccuaauaugguagaucaguaguuuuuacaaaggucaucaguucagaagaauaucagaaauucaaauaagaaccaaaaggucccuuaaacuccuguuaaacuaguguguugccuaggcauagaggcguggaccugucaucuaagugcuugagaggcugaagcagggcgcauaccuggagcugaggccauucucuucuacauagagaacuucaggcaggcuuggguuucaaagugugacaauguuugucucaaaacaacaacaacaacauauaaaugucagaaaagaaccaguuaguaagugguuuccuagaaucuugacguuagauauucagagaaauaagucuguuuacuuuaucaaaagagauacccuuccuaaaacuccaugaauauguugcuaugggauggucccaccauuugaagagacuucuaaagguccauaguucuucaguuuauucccuggaauacuuguuuuucuuuguuuuucucgugcuaaggauuuguaccuaggcucuuaugcauguuugcaaucagucuuauuaccgcacaauacccaggccccuaaauacuaaagaugugauguuaaugaaacugucuucuauuugagaugauccugaguccucaucuucaucaaucuaacucucaaacauccaguucugauaggccaguacagagcaaccccacucaguuaggagacacuuacacaucucaaaaaguuuuaaacacccagucuaaaauuaagauaaauguaguaaaauaccauaaugaaacccauuacuuuauaugcuacaugcuaacuuaaaaugaguuuaaaauuuuuuaucuaauucuuuaagcaauuuuuuuuauauaugugccauuuuaaaauaacaucuaaguaaaagcuagaaucuguuguuauuuuggaaauuuucccccaagacacaacaaugcuaaauauagcuaaaugaaaaugacaagcuauauucuguauguccaagcugguuuuuuccccuggugcaaaaaucagagauuuucauuucaacuuuguccuuuaacauuuuucaaauguuacauugugcuauuuuuaauguggaaaaaugugcacgcacucuuuuuguuagucuccacggcuugucuaguagguauugaaacugacggaaugcccaaauaccaauacagaguaaaacaaagaaagucuuggacacuuuuuuaaauucugggcuagguuuggcuuuucuaauaucuugugccagucuugacauuuuucacuuacauaagaugcuauugagggaaacuggcugaaggacuuggagucccccuuauguucucuguaaauaugugaucccauacuuauaacuuuaaauaagaaucauugcccaaacaccuugacuacagauuccuaagcauuuuucucuagucuaucuguccuucuaggaccaguacagaaaggaaguuagcuccuagaaaaccuagagagguucacuagaggugaguuaggacauggcaaucuugaaauggaaccugccaaacaccccaguucuaaggcagaagauguggcuggggaaggaccagaccccaaaaguaaccuauaaacagcauaugaguagugacucaucaccaguuccuggcaaaacaugucaguguucugacuuugcuagguuagggaugaauuugagauuccagugcuuacucagucaagagaguagcuggcauccucaccugggcaugugucaagccagaguagguaccguccucacuagcuaggcgaacaguucugcuugcuugaugauguucucucaaugagacuucacuucuaagauagagaggcaaaaacaggcccacccaagguuauguuugggaaugucaauucucuaacgaaauuuaaugaccucgaaauucugaaauguauugucuagaggagaaaagaaaaugccagccgaaacccucaggauagguaagccauuaacuucagguuacaauguuuuucagccaggaccuucaguuaggcugggaauaaguuaccacuugugggcaacuuuauacuuuuuaaggauguaugguauauagauuuuguuaacuuugcuuugauuuccuguuuaauauuuguuuuguuuucuaugauuauccaccuuuauguuaucugacagugagcuucccuuguaaaauucuugcuucuuucucuuaucuaaaucuuuaaagaaaaaaaccaaaaauccaaaaacaucuagaaaaaguccugguauguucugcuuugaaagcuauaagcaucuguugcucuagaaugguuguuucacuugagcaaaaugguuucccuauaauuaaaagcuaauuuguuggaaugguaaaaauaaugguuuaagcuucaagcauuuuccauucugcgcucugauacagcauuguacauguugcuauguuauuuccugaagagaaauuuuagcaauuaugugauucaauuuuuucccaaaaauauaugaacuaugagucuggcuuuuagccucaagagugauccaggagcucuuccugucacuaauucuuugcuuccuuuucaggugaguaggggaauuuacacugagauaugaugucaccuauaaauauguuaaccaguuugagagcuauuauuguaggacacgugcacaagcugcagguuggauguaccugugaccaguucaccaugugaagugucacuaugaaagcaguuguuugagaaaggccaucugauaguuaucuaauggagacuuggucuugucuucauacuuaugacaaaaaaagucauugucuguacuugauuucucauuagucuaaaguguucagaagaugaugaugauuuagaccauauaguuuuaaucuucugauaauuuugcaguaauuuuucuauaagauauaugaaggagugcucaaggcaacaacuaaguguuacuaucaaggauugagauauaguaaugugccuagaaagugugguuggccuugagcauuccaaaucuguaaccacacauccuuagcucucaaauuaugugcuaucuacaacucugcuuaugucauagcauuuccgcagccuagauacugaccaggguagaauuagauggccagagcagugauauaucccagauagacuuuuuccugauuagagaaguuaccaaaagugugaggugaacaucaguuaacagaccuuaguucuucaccuucuugacaccaaauaagcauuaagucagugucagucuagggccuuggucaauuucuuagguccaugugguggcuaauauguuaggccucaagagugaugcuauccacuguugaauauagcauuugagucugaugucagacuugagacccacugagagugcuguaugcaugcaugcauggaaaaauucaggaaaacagugagauccagcguuuagguggucaguuuuuuaccuuaacuuucuugcuauucaaacauagaaaacaguuccugcaaaaugagacuuuuccaaaaauuccauguaaugugggggaagggacacugucauucaguguaguaacagaaggaacuagauaaggagauagaugacuauugaacaaguguccauccacagcaucuccacaguuugcagagguuucaggacuucacuguaccauucggucaaaaacaaacaaacaaacaaaaaacccucuacguucuggaccaagcuccaauuuagcuaauauguguagaguaucuagaaguguccagacggcagauggccauguggaacauuagacacacuucaacuuucgcucugagccaaaugggaagccaugggaugauuuugacaggggaaugacuugaucuaaauuaauauugcaacauuguugcucugaccuuagagauguacaguugaaaaugggaauaauccaguuacuuugauaagccaagugagagaccagaggguaagcaggugguacaaagacuagcaguacaguacuuggcuuagucaccuaggagcaugggcuucuuguuggcuaaacagaggagacuggaaagaaacuggacugcuggauagauccaaggguuugguuugugguguuauccucagagacaccccugccccugccucaugccuuugauauaccuguggggauuguggcauggacacagccauguucagagcaaggagcuagaauggucacuaggggacagaugauuuuccaauuuaggaaauucaucaauagugccuugagaggucagaguccuguuauuucagaggcuggaacauugauucagaagucacagagagcaguuaauuaaguuuucuaauguucugccucucuuuaaauagauaaacauuucaugauacucucuugagacaggugcacuguuuaauaaucauuccugaauuucuucuuuuucuuagugacuuuuaacuaaucaguugauaauauuuaauauucauagguacuuugagucuauaaaucucguguguguguguguguguguguagcauuauuuuuuaaaaagcacaaagaugacauuuguagccauagaaaaucaagguuuuaaaagcaauuauuccuaaagauagaaguuaauguaaggcuugucuuaauuucccacaguuguuuucuguuguuguuguaggucucaauguggguugcaguuucauaguaaaugaaucuauaaaaucuauuggugaaaaauuaaaauaugaacuauuuauagacuaucacuccacauugacauuugaacuccuguuucuggccuuuccuagccauuauuugcauuuguaaaugaagagaaguuuaacguggauggguggacuguuuauaauccaguugaagaauauagaaggcagguaagucaguaaugcaauugucugguguguguugaauugcaaacauguauuggaaaauuauauuguuggucaucuucucaaaauaaguaacagccuugcuuaguuuguguucauggcuguggcaucauccacauuuuguauaauaaaauaauaccucauuguuuuccucuuguaacuaccaagcucauucuguagccauauucagacuuaucugaaaacuaaaugacuaaguucugcuuccuuuccuagaugaggaacuuccauuuugugguguuuaugaaaugagucaaauauugaaggucuagaaaagucaaaccuuuauauauuacuuuguguguauguaagcuuaaauauuacuaaucuuguuauuuaaguuauguauguucugaauuacagauuugaaugaguuagaaccuuuuuuacaguugauauauaauauccacaaagagcuuuauuauucuuucacaugaacguuaucugccuguauguucauuugugauuuggaguauggaaaugucucagaagguaaagugcuugcaacaugaacaccugaguuuggacccccagaagccaugcuaaaggccaagugugguggcuuauaucuguaaucccaucacucacucggaagaaauacuaggagaucccaggggcucucuggcaagccagucuggucagacauuaaauuccaaguucagugagaccccuguuucaaaagaugagguagagaagaauacagaaggaaaccugacauuaguauuuggcuuucacaugugcgcauacaaguauaaauacuugcauauauacauccauguacacauacacacacacacacacacacacacacacacacacacacacgccauacuuacccucuacauagcaagaaaaaagucuagaacuuguacaaggaauaucacaagcaagcauauuauguaacaaaaaccacaacuugaccucuaauauaacagcuaggaguuuugcaauggaauguuucauauuucuucuacaaggcuucuaaaauuauuuggaaauguuaugaaaugagcuuucgagaaucaaguuaaggccaauugcuucauaugaaaaucaagugaacauagaguacaauuccagaaccucaagcuuguaaaacaacuucauagccaccccuuccaccaucaugaccccgguugacuucaauuuucaguguugaucagugguuugcacauucauaagcagauuuuacccugggguuagaugaaacacacuuacgauggauccugugaaucugcuuuaggcuacugaguuuucaaaggguguguaccuuuaauuuuaauggccucuguuguagacugacuacugagaugaaagaaaggccauuagaacauuguucaugcuuuagaaaccucucugacauuauguaugaaagcauuuuaucuugucuuugguugacguugacaauacuaagacuuuccuucaguuugagcuucuagcuugaaacaaaaacauuuauuguuuuuuuuuuuuuuuguuuguuuuguuuuuuuaagaauugcaugcauagacgaacuuuuuagguauuuucuucuagacugccauuauauucaaucuuuuuuucuuguaacuuucugaugggacuuaaaaacucucuaauuggacucagcaucagacucagcaucugguuggccgugguacauagggccaguccuaaagaaaagguacaaugucuauccccaaagcaaacagccaccaugcucacguucauguguguguuugugcauuugugaguauggggagagaauauuccaccaccucugguuauuguccaaaguggauauaauuuugugggugaaugaucgguaagggguggccucugugucucccuaucauacuagcagucugcuuaaaauacugacuucacuccucacacaauuugcaggaugauccugaguccccaggcucuugauuuaaauaacuugucggagguggcgaaaugagccuccccaaaaggguucccucccccaacccccagugccucuuuccaugugggagcagacuacaccauucucugugucugaagcacggagaggaaguugcuagcucucugggaacccucaaguggacacagguuaacacugcccauggcacuuugcuuuggaauggaggguaggggugcauggguaggagauggacuugggcucaucuguagugcacaaggaauaaagaauacagcuacaagaaacaaaaugucaaauuccagagagccuauaguuaggagaaauaguuuaguuauggaaaccacugguguuuuguccaugugcucauauugucuggauuguuaauuugacauccuuauuguaaauagguaggcugccaaucacucuggucaaagaggcauguauacauaaugguagaaggaagacagaacccagauauugcagauaagaagucauuucaugcaaacuuaaugcuuucuuuuauccugcagggccugcccaaucaccauuggaggauaaguuuuauuaacaagugcuaugagcucugugagacauacccugcucuuuuggugguucccuaucggaccucagaugaugaucuuaggaggaucgcaacguuuagaucccgaaaucggcuuccugugaguaucgugucacauuucccuuuucuuucauaagaguaguagucacgcaguugagaggagcacuuguuuucugaugaguaauucccaaggaccuacugcaaauguagcaucaggugaaaugggagaaaaaggaacagcuagcugccuucuaugagcugccaguccagggugcagaaggaagacaagaaagcucuaaugagaacaucagugagaggucacagcccaccucagugaugcacaaaagaaagggcaggcccuugcuugcugucagcauucuggugcaauaccugauguugcaggcucaagcuaacuguugguuaaacugggcagcaaagaaaagacuagaaugugagaacauguguuuguggaggcuuuucugcagaugcuagggugugcucauugccagccuguuugcaagcugcuuaauccccuuaaugaacuggagucaaguacagacucuuccagucauuaugcuaccaugucacuaaaccuagcucacaaggcucacagaguucucucuuaguccuuaaauauuuaugcacaugucauacuuucuacuugcuacauaaauuuuauugacuaaaaacguaagagauuguuuuuucuuccucuguuaauuuucaagagcugucguaauaaguacauuggguuuuguuucaaauucauagacuuaaaaaaaaaaacaaugguagaagaaauuaagauuuaaugucacuuugccuuugauuucuaaguguagacauucuuguccuuaaaaggauuuuuuggagaggaaaaauuuguauauuguuauccaaugauucuaauuuuuaaaaucucuagguucucugauuacugucuauucauaucuuccugauaaaauuguauuugaagguauauucuuuagcucaguuugcuaaaauggaaaguagacuuagaauuucagucuuauguuuuacuuggacauguuuuucuguacuagagccacagauuauaguacuaugacacuagacacuguuguguagugugugccuugcuuuuagcuacugugguauauaucauguguuuggauuccuaucuguucagucuucauugaacaucugcuguaucaaagauugugugugcauguaugggggaggagggcugguguguagcauaugggacaaaagcgaaaaugacacaguugugccuaaaccauugacuucaguuccuguugcucuucaugagugacaguccaauguagaaaaaaaauuuaacauguuauuuaacauguuucucauacuuuaucaggguaccaacuuauuuuuuucugaaaaaaaaauuaaggcuaaacugucuuuuuauuuuuauaaugauauauauuagguauuauaagcaugguaguaugcuaauuccaacauaccuucugaucaugugacucuuaacaauaggucacagaacauuuguccagaaaguagauaugccaguuaugugaaacaugacuaauacauagugcuuuaaguuuuuaaauguaaaaauauaaaaaauaguugcuaagaaauagcucauuuaaacaaaaaacucaggcccacauuguaauaacauagcacugcuucgugagcucaagcacaugcggcgugcuucugucccugaguacgcauuccuuuccucaagcaagcaggcgcgucugcgcuucauaggagguacuaaugaagaagggauaugggcucauuugagacaucuagaaaacccagaugagcaaacacuauugagaagcccuauugcgaagcagcaccaccaugcugcacacauccuucuggacuuccuucugugcacugaacuaaccuuuaauauggaucccaauaagcaguucuuccccagcaguauaucuuaaccguaacuguucgagaugggcaaugauuuaauaaguguucuauuguguaagacuucuauauccuuuuugaauuuuugcuuuuauaaacaaugcuuugagcagggagauuauucagugaauaaagacucuugcugcuaaacccgacagccugcauuuaucucugauaccaacuugguagaaggcuagaaccgauucccauaauguauucucugaccucugcauacccucuguaaaaugugcaugcccagucacacacacacacacacacacacaauaaguaaaugaaaauuuuaaaaguagaagauaaaaaauguuauaauaaacaguucuuaauuuuaauuauuuuuuauuuuaugugcauuggucuuuuuuuuuuuuuugccuguaugcgugucuguguaaaagugucagaucccauggaaguggaguuccacuuguaaagugcuaugugggugcuagaaauugaaaggggacuuuugggagagcauuuaaaauguaaaugaagaaaauaucuaauaaaaagauuuuuuuaaaaacaguuuaacauacucuuacagcagaacaggguucgauucuuuuuuuuccccacauuuuuuauuagauauuuucuucauuuucauuucaaaugcucucacaaaagucuccuauacccucccccugcccugcuccccuaccaacucacucccacuucuuggcccugguguuccccuguacuggggaauauaaaguuugcuagaccaaggggccucucuucccagugauggccaacuaggccaucuucugcuacauaugcagcuagggacacgagcucuggggguacugauuaguggggaaaacccucgaagauaugggcacaccuaaacagaacagcaauggccugugcuguaagaucaagaaucgacaaaugggaccucauaaaauugcaaggcuucuauagggcaaaagaugcugucaauaagacaaaaaggccaccaacagauuggguaagaauuuuuaccaguccuaaaucugauaggggacuaauauccaauauauacaaagagcucaagaagcugaacuccagaaauucaaauaaccccauuaaaaaugggguucagagcuaaacaaagaauucucaacugaggaauaccgaagggcugagaagcacuugaaaaaauguucaacauccuuaaucaucagagaaaugcaaaucaaaacaacccugagauuccaccucacaccagucagaauggcuaagaucaaaaauucaggugacagcagaugcuggagaggauauggagaaagaggaacacuccuccauuguuggugggauugcaaguugguacaaccacucuggaaaucagucuggcggaucuucagaaaauuggacguaguacuaccgguagauccagcaauaccucuccugggcauauauccagaagguguuccaacugguaauaaggacauaugcuccacuguguucauagcagccuuauuuauaauagccagaagcuggaaagaacccagaugucccucaacagaggaauggauacagaaaaugugguacauuuacacaauggaguacuacucaacuauuaaaaacaaugaauuuaugaauuuccugggcaacuggauauaucuggaggauaucauccuuagugagauaaccuaaucacaaaagaacucacuugauaugugugcacucguugauaaguagauauuagcccagaaaacuagaauauccaagauauaauuuccaaaacgcaagaaaaucaagaaggaagaccaacucauggauacuucauuccucccuaaaauagggaaugaaauauccaugcaaggaguugcagagacaaaguuuggagcuaagacucaauucuauuagccauuugaaguaucaauuacauaguucuguccacuauaguuauccaacuaugcuaggaaagcaccugcugcauacagcucagucauuuucaggauauaacuuaucagcaaaccuuuaucugcagaauuuaucauaugcuuugagaagcugagaagcucagcgucaacaggcuugccaggcaguugaagacuggcucugagaacaggccacaugugcccuucuaggcauuagggaugcagaguuuacaguagagaguggagcucucuuagccacugaaauccuucuuugcuuccuuugugucuucuuccuccuacggugcauuuagaaaggggacuguuggggaaagauccuguagacauagguuaccuccauggguagggcacugauugcuuagcccuucauuuacuguucacguuuucauauaaaguccaguaaaagcuaccaaauuccaguaacaguauaaacuuucuauaggcuuucaauaauucaucuuuguucugguaagcauuaauuuauaguguuaauuuuaaaagaaaggcugauaaacugguuguuguucuuguuucugagcaauugaaaguguuaaauguguauucugaugcaaauugcgugcagugaaaauuacaaaugagcaaguaucuuguuucagcacagaucugcuucaucaugauugucaguuuuaaugauuucuagagacuugcuagauuuaacuuucugaacuaccauagguacugucguggauucacccagaaaacaaaauggucauuaugcgcugcagucagccucuugucgguaugagugguaaaagaaauaaagaugacgagaaauaccuggaugugaucagggaaacuaacaaacaaacuucuaagcucaugauuuaugaugcacgacccaguguaaaugcagucgccaacaaggugaguguaaucaauggagacagaccuaccuuacaugugaacuacaguguucgccaugaauuauuuuccagaauauaucaaccaauauguggauuuauuuugaauuuucaugucccauuuuuuaagucccauuggauucuaaucccagcaaugggaagauggagacaggagauaaaaaauucaagaucauccucagauauauaaugaguucuaggccaacuugauuuacuuuagaccuugucgaaagagagagagagagggggagggagggagggagggagggagggagggaggaaggaaggaaggaaggaaggaaggaaggaagaaagaaagaagaaaugaacaauaacaaaagccuaauguggucauauauaucuguaauaccaguaaugccagcaccaaggagauaaggagacagacacaggaggaucccagguauuuaagccuauaaucucaguauuugaauggcuaaggccaaagaaagacuuccuuaaaaggcaugucuagaacuguaaugaaaguggguuuuaucuauaaccuuaugcaaaacauagucuuuggcacccuugccacuaugugugaucacccuuauuuugugaagugguggggcaucuucagagacuuguaggaaacugcugcuauuuaaucugaaauuuaucauuuuauuugaagacucccucaugcauaccauaagauaguuaaagauauaaguaggucaacauauggguuuuaaaaucauagacauagaaguugauuuuugaaaagcaaauuucaauugucuuuuugaguuucuaagcccaccuuccugugggggcuuuguggggaagaauugcuuggucuguuugcuuuguguuuuuguuggucaguugguuguuuuaggcaggggcucauguuuagucuaggcaguguuggaauucguugcaguccuccagccucagccucucgugaacugagauuguagguuuaagcuaccguguauuuuuugauucucucaucaaaaccugugugguuuccaaaugcucacaagcaagccugccccaaguugcucacucccagauucugucuuucgacuuuauucucuucagcuccaggcuuaaauuucaucaucuuuaaugcuuugcucuucccaaggucauuuaucugacaucuuuaauuauucagaacccaucacaagaaccugaaagcaaagcaagucguugagcaguccagauagauauagcaauuuccgaaauggaauguaugugaagucugucucccuuacaguguauuagaauauggauguauguggggcuuagcucuucaccacguguguguggcucagcuguccuacacaauuauuccuaggcuucccgcccuggccucaugcaugcuguagaugagcuauuuguuaacacaguuggugguuauauagaaauaauuucaaacuucuauguaaaacagucaugaaguugaauugguaauucaauuaagaauuguaaguaaagcauuuaggaaacuaaaucuaaauaucuucuuggguuauccuuaauuuuguauauuuuaaauuccauuauccuucauauauaauucaagaugaacacauguauaaaauacaauauuuccauguacuuacuuagccugaaauagguaggauauaccauuaaaauaaaguauuuagaaagaauacuuuaaaauauuaaagugugugaaaugaauaccuuaguuauauuaaauucuaaagcucauuauaacaacacaauucuugaaugccuuuuuaauguuagggaaauaagccucuguuucuaguccgcuuaggaaugaaaagaaggaaaauauuaagggaaaagccaaccaaaccaccuaagccuucaagcacacuaggucugggcucugucucuccacuaguuuucuuauauccauagcaaccggccucuggcccuuuauagcauucuagguaauuugaguuguucaguuuuguugaaaaaagaaaaaccaaagggaagacuucaaaaguaaccagagauagagaauuugaacuuuagggaucucagccugugcuugacuaauugauuuuuacccuugcugacuucuguucccuuugccccucauaauuguuccucccuuguguguauuuagauguaaucggcaacguugagcacauuguuuucaauuaaacaaaacucaggguugguaacaucuagcaccacacggcuuuuauuuuggggcagagcacuuuguuggguuaaaguugggcuauguuaaugucuuguuuugccagaaaguuuggcaaugacuaaaacauguauuuuuccuuuugcuuuuuuuuuuacacuucaugcucaguuauuuaugaaaggaacuccagugucaagcaucucugaaaacccuaaaauuauguaucagccacacaugcagaggagcaggccuucugucugugggagagcgagcaugucacugcauuauauauaggcuugccgagguagcuaaaaguaaaccagcucuucccaggucucugccugcaaugugcagagauacugccaggcagaugccaguaacucuggccaucaacagagcaucaacagccaggaaaagaggaacaugauacauuugucugcugacuuacuggcaaaaaagcucuuuuuaaauggcaaauaggcacuggagagaugguuuugugauuaagagcacuuacaacucuuucagagcacccacagcuacccguagcuccagcuccaggagaucugagagcaucuagcuccagaauccaugccuaaguauguuuucuccucgagaguguuuggagacugaggucucugcccuuacacggagauuuccagguuugaaguucaaaugauagucuuauucuacuacaagaaaccucuauaaguaacccuggggcacagagacacucaguugguuuugccuuuccaacucugacuccaagcuuaucucccuaacuuugauauuguggggauggcacauuugccuaccauuuuccucuucaguccccagugcaaguguuucccugugcuccuccuggaggcacucuaaaguugcuaccucuucaaaaucuaagaaguguuucacuuuuucuuuaaggucccaacuucauguaucccaugacauuuuaaaaaucuuuaaucaaaguacaacuguguuuuuaaacaaagccauaaugucuuuuucaucacuguggaaauggauaccuuucacaguguugugguggugaacuaaaguccacccugguaagugaguacgauuaaguacuauuaggugcacuauuaaguguuucgguaauaggccacuuaccuaccauguacaaugucuugagcuccauauguagcacuacaaggcaacagcagcaaaguuuugugcuugauacaguaggugguugccaucuugucucucuuagaaccuuguggguccaguaugugcaggccccuucuugcuguuuauauaauggaaagaugguggggauacuguggaaaggguuucuauguugaaaucaaagcagacauaaauucuguguauuaauuccauaauuuuguaauggaugaaccucuuaguuucugcuucccaaugugccaaauguggauaguaacaucuguuuuguagcauuccuguaggagguaaaauuacaaaguaugucacagagccucaucagaagaguuuucuuuuuccucuguuagaacuagguagugaacccucuuuuacagaacaggacacuagugccuuaaguuuagugucuggcacuagaucaugaggugaggagaggcugaagcuaagcuguugaccugugucuaacuccaaaagcuguuuucccacuaacagauuauagccuaugugaauguucacaauguuagagugcccacugccacaccaauauggcuacaucuuccccaaacaguacaauaauaaccauaaaauuuaugaaggaggacuuuucaaagccuauucuugcuuuuccagaucuagaaaagccaauaauuacagaacauuuugaagggaauauuacagcugacgaauucaguugucugccacucccccccacacacacacacaccaggaaauugccagccuucccuauuuuucuccagcucaaaggacucagguucuugaggguuuguacauuaacuacuuaaugagagagguuugggauaaaauuuuggaaguacaugagauacuuuggcuaagaaguuacugauaaacuacaaaaccuaugugauuguaaucuuguuguuucuuaggcaacaggaggaggauaugaaagugaugacgcauaucaaaacucagaacuuuccuucuuagacauucauaauauucauguuaugcgagaaucuuuaaaaaaagugaaagauauuguuuaucccaacauagaagaaucucauugguuguccaguuuggagucuacucauugguuagaacauaucaaggcaaguauacuuuaaaaauauuugcaaguauagaagaauuaauauuuugaaggugauauuuuuccuuaaacauuuaaaaauuauaugcucugagacuguaguagaagauucuauauuugauagcuuuauguuucuuauaauuuguuuagcuaaauugaagauuuuacagcaucauuauaucuuauuuuuagagucuguagagcugucucuuccagucuugucagucuuaaauaguuucauguggguuuauuuaggaacagccaauuuauuauucaaccauuauuagguguaucccucagagaccuagacagaaguacaguuucuuugucauuuuccuuuuaacaauuuauuacugauuaguuuuauagacuagguuuugcauuuugauugcauucagucauuugucccaauaaaagcauaaaacuccucuuuucaaaguacaaguguuagaaacuauguucgcagccuggcacuuuugaaacccauauaguuuucuaaauaaccaacugaaagcauauuuuaagcagauaaauuauuaagauacaguguucucuaaugagauuauaauuuuuaucuuguauuuuuaauuuuuuccuaacuuuuuuaaauugaucauccucaaaaauuugauuacaaaauaauuaauuguggcaacuaaauauaauguaguauccugaaugggacucuagaaaagaaaaggggcaguagguuaagaacuaaggaauuacuaaaaaggaauugaagacucccagagucaacacugggccuacacauacaccuauacccacauauaccugcacacacaggcugacacuaccccccaaacucccaaaaagggguagauaaaagaggaagcaguaaagagucauaugauuuuaauagaagcuuuuaagucuugggauacuuccaccuguuuucagacaaagaacuuagauguuuuauucaggaacaaaucacaauuuugaaaguguaguagauuggaauuuuuauauucauagaaaaucaucauaaauaaccugacuguaaaggaaaaguuacgucuauauaaugaagugcugugcagucacaaaguaaaucaaguauugugguugcuaauagcaugaggaaaugcucagaagcccaauuaaagaauccaggggaauuuauaaaugucuuccaacuuuuucuuuguucauucuuuccacaggguaggguauuuucaugucuuuuuuuucuuuuagagaaauaggggaaauagaaagggagaagaaagagggagugaagagcaagaaagcagagagaaugaauacaugcauauagacauguaucagaaacuuuaggaggguggggaaagcuccuaacuggcagcagaaagaauacugguuggaaguccaacuggucccuugucuccggugaaggcgauucagaaccaacaaaagaaauuguggcuguucuuucacauggccauauaaaacucagauaacugugagaagcccaaggagccugugugggcgugugcaagggcacgcaccucaggguuucucacagcaguugaggggaguagagcaggugcagcacuugggcuauauuccucuggaagcucugagacaugucauuuuuaucucuucucagcuucucaaggccuuucaggagauuucuggucuauuccuugucuucauuaguaagaacuacuggcuagagccugcugcuuucuuuuucauaaaagugccagauuacuuguuuucaugacggaguuuuaaaaaguagacaauuacaauugcuccaagucagaguguuugugggaauacauaaucgaaaagcauauuauauuuucuaaaauaauugucuuuuuauuauaagugagagauucauccuggggaaagccaccucuagaguguucuggaaccccaauuuuauuaaauuaggcuccaguaaucuagaauguugguaaugcuucucagagguaguagcacuuucuacagaaaugccucggguuaaaacugcaaacagaggagcuaaagagaucugcagcccuaucgguggaacaacauuaugaacuaaccaguaccccagagcucuugacucuagcugcauauguaucaaaagauggccuagucagccaucacuggaaagagaggcccauuggacuugcaaacuguauaugccccaguacaggggaacgacagggccaaaaagugggaauggguggguagggaaguggggggggggggauaggggacuuuugggauagcauuggaaauguaauugaggaauauacguaauaaaaaaaaggaaaaaaaaaagaauuacuacuaaggguugcauuagagaaccuucuuaaaauauacaaggcccuguuuauaauuccacacacugccaagccaacaagcacaaacauccuauuuaauucauauugauugacaauaaugcugucacgugcaacauuugugggcaaccaaagaaagauugugcacauagaaauauacaaaaaugaacauaauuuguaauaauaaaaucaccuguccucaauuccaaaaaaaaaaaaaagaaaaaaagaaaaaaagaacccugcaaacagaauugcaaggagucguuucaggggcacugccacacgugcuuuucauggccugccauccauuggcccccuaacuuucuuguucacuugucucuugggaauuuauauaaaauaacuaccuuucauauuuucuauuugucagaugguucucauucuccaauguuccuuugaauaaguuucaguauuuuuuuucaguuucuuugaauuaguuaaaauaaccacaaugcauaucugagcaugcuguuagaaucccgggcgcuccauggaauaaaucuuaaagaagcagcucaagggccaacacgauggcucagcagcuaaagugauugcuguacaagccugguaaccagaguccaguccccgcagcacauagacagguggaaggaguuaacagacuccauggaguuguccuuugaccuccacaaaugcacuaugggaucauaccuacacgcacaagaaguuauguacaaauaugcacacaacaauauguuuuuaaaaucaacucaaaaugacaaaaaacaugcaaguaacuguuaagcacuugagaagauagagccuucauacaauacaagacggaaugggaggugguguaacuauuuuccuuacaaauuugagugugauccuacacauuggaguauccaugccaccugcuguuucucucugccagcuuguucugaccggugccauucaaguggcagaccaagugucuucaggaaagagcucgguacuugugcacugcagugacggaugggacaggaccgcucagcugacauccuuggccaugcugauguuggacagcuucuacagaacuauugaaggcuuugagauauugguacagaaagaguggauaaguuuuggccauaaauuugcaucuguaaguaaacacauuaaaagcugcccuuuuaaaucaguugggauuuuuaaaaauugguuucuauacuguauaagaaauuaccgaucaagguggugcuugccuuuaaucccagcacuaaggaggcagaggaacuccaagccagccuggucuaaauagcaaguuccaaguuggccaggguuacacaggccuugucucaaaaacaaaaauucugaagaguauaaauaaaaccgccuucaugauuucaaaaacuuguaaggccuuaggcuaagacauguguucguccaucuguacucuucuaguuagacucaagagcaguguaaugaagccugcagaggaguauauaaauugagacuuggauggcugaggcaggaagauugcaguuaguuccaaccaaggcuacucaguaauuccagaccuaggcugcaaagcaaacuuggucucaauaaaagcaagaagaaauguuuaaauuaaaauuucccaaaagaaagaagauagaacaacaguuuuuuucugagcuaauauuacaacucucaggagcaaaugcacuucacagaauggcaggguuuuuacaugaggguuuuuauucuuggacacauauuuuaaaaaaaucaagagaaacuguuccaauucaaacucuuaggucuuaucaacagauacccuuugaaugagcaucguuuuagaagacuuguuuauuggugguggggcugucuacauguuuguguaccacaugcaugcaguguucuucgaagccagaagagggcaucagcuuuccuaggaucacaguuauagcuaguuguuaggcacccuguggaugcugggaauugaaccuagguggccugcaagaguagcaagcacucuuaacugcugaaucaucucuuuguuacccagcuccauggugauucucagaggauauauauaucauacuaauaaaaauaccauuuggucaccuguuagccuucauccaaauuucccaaaugauauaaguaacaucuucagguagaagcagucacuguuuaguggagacauugugaggguuuuguuugggcucuagcagaggaagacauuuuaaucauaggaacugugcuuugggcaugauuucaaacuuccauguugcuucuuaccugaaagaucuagugaagcuagaacauaccaugcaggguaauccagucacuucugucuguaguuuucauuguuuuguguuacagugugguaugugguauguguguguguuaguauauauguaaaugcacauagcuguauguacauaaauguacacauaaauguggaggccagagcucagccucaagugucacuccucaggauuuuuuuuauuaaauagggucucucaaagggaccugggaccuuuugcuuggguuuggaugacuggccagugagccccagggauccuccuguuugcaucgccccagcuccaguguuacacaccaggguugugguugguugguugguugguugguugguugguuuugcuaugacuucuggaaauugaacucagguccucaugcuugccuagcuagcacuuucuuaacuaacuaccccacagccccucccucccacugaauugucacuauucagauggugaaaugacuccauuguuaaagguacuucucaccucaccaggccugacugcauguguucaguccuggccgcucacuuuaggagagaaucaacccuugaaaguugucuucugacuuccagacacauguuguaggaaucaggcacaugugcaaacaaauacacacauacguguaauuuuuuaaauugccauuauuaugaaaucaucuguuguuucucuguauuuccauggcaauauucauaauuuacugucugagcuugguauuuagaaggcagguugcugaguuacauuuuaacauuuuguaaguuauauccuuucucuauuuuauauccaugaauuaaaucaucuucaucaauuuauuucagagaauaggucauggugauaaaaaccaugcugaugcugaucgaucuccuauuuuucuucaguuuauugacuguguguggcagaugucgaaacagguaaaaauguauggauggauguacauucaguguuugcauaguguuauaacauccgaaguuugucuacagaauagugcagcacauaaauaaagaugacacaggccaggccaugaguaaauccucaucgaaucccagcaguggggacauaagaaguuauuucuuuaguuacgacugcuauggauguuuagaacccuacucacuacgguuuacaaaauuggauuuugaccugaauucuuuguuccagugggcggucagcagcacggccaguuacuuggcaucucuguggaagcgugucugcuaacuuguaauacuuuacacaguaaacuuggccacuuuuuccuuuuuauuccuugacuuuacacuuguguauauagucuuauauuaaguaaaaacaaacaaacaaaaaaauaaacccucuagggucugugcggacggcagcucugcuggcauucccagacuuggacuguggcagcgcuuagucacucuugccauugaugcaggagucuuuucuugccauggugugcauauguauuugcauguuucuuuuaauguaaugacuuccuccuuugacacucaccaaccaacauggucugguagaaaccaugcauuuugucuuccuugagagaauagacucgacuuuucaugaucuucuugcuuguuuguuuugaaucuaguuccccacagcuuuugaguucaaugaaggcuuuuugauuaccguuuuggaucaucuguauagcugucgauuugguacuuucuuauucaacugugacucggcucgagaaagacaggugagcaaaacacuacugcugaucuaagaagaggaugaggguuugaggcacugguuucgcucucaacaaauaggagugauucuuaaaguauacaaguucucccuugugaaaaacuaaguaaagggacuuuuaaaauguauugagaauuauauagaguauauuuugauaacauucuuuccaauccccaguccccccugguucuuaucucacuugagacuaccccacccugaauccaucccauagacaaccaccaaacccagacacuauugcauaugccagcaagagcuugcugacaggauccugauauagcugucuccugugaggcuaugccagugccuggcaaauauagaaguggaugcucacagucaucuauaggaugggacacagggcucccaauagaggagcuagagaaaguacccaaggagcugaaggggucugcagcccuauagguggaacaacaauaugaacuaaccaguaccccccccccccccgccagcucgugucucuagcugcauauguaucagaagauggccuaguugaccaucauugggaugagaggcccuuggucuuacaaagauuauaugccccaguacaggggaaugccagggccaagaagcagguguggguggguaggggagcagggcggggggaggguauaggggauuuucggagaggaaacuaggaaaggggauagcauuugaaauguaaauaaagaaaauaucuaauaaagaaaaagaaaagggccacuaaaaacauggaguauggucacacucuguugaagaaauugauuuucccucucccaacagcuaucacuuuaaaauagcuucuuggugagggcugggucuuuguguccacuucuccuccuuucugggauuuugucuggaguuuacuguuucccagaagucagccaccaacucuggcucuuacagacuaucucucuaggagauguagaaguauuaugcaguuauacacuguuaagggaauggaaaacaauacaguuuuaaaagggaaauguagaauuagcaucuaaguuagaaauuucauuucuuaguuauguauauauauauuuuuuaaacaaugaagggagucggggagagccagacaugguagcuaaagucuauaaucccagcaguuggggggcuaaggcacgaguaucacaaguuucaggccagauaaguuacagccagaguuccagaguaggcuggccugaauauuaagaccuguuuccaaacaaaauaaauacaaaauacaagcauuuuaguguauagccuaaaauucaauucaguauauauauauauauauauauauauauauauauauauauauauauauauggcauauauaaaacauaauuuaauccuaugcuuugaugagauuccaucucuacaauaucucauuaucuauaugcaaauauuccaaaaucagaagaaaaauucaaaagacaaaucccuucuggucccaagaauuuuggguaugagauacucaucaagacaacuugggaaucuucgccgacaauauuguacagaugacuuuuaaggggagaguuucaagcuagccuuuacagcuaucaaacuaacaacucuaugaaaggagaacagagcuccucucagacacacauaguauaaauaaugaccugacucaugugcugaggagauagcucaguugguaaaauguuuaccaugugaacaugaggaccugaguucaauucccagaacccauagaaaaacccuaagcaaaggggaacacacauguaaucccaguacuaugcauguggagucagcaggaccccuagaucuaacuagccauucuagcacaguugguaaagucuaggcuauugagagagcccaagccaaugagaaacccugucuuuaaagagauggacagcauuucuuagaauaacaccucugauuggugacuauccuguacacacauacacaugugucugugcaccuguauacacaaacacacaucugaaaaaaaaugaccuacuucccucauuguaccuuccuugggaaguggccaaaauaugcacuccacgaaaacaaaaaguaaggcuucacagaaucuucagagugagggcuccagcacagcauuccucaacgagaacugaccacaaagcacagaacaacuuguguagguugaagccccuaugccagagagaaguuggggucaucugacgugcuuaagauucuuuaggggcaugugauacucuaaggagaacuuggcguugaguuagucagugccaaggaaaguaaacagacacuugugaaaucaagagacaaucacugagugcaggagaaggaaagcaaucccaggcuggagacuggagagcuagagagcgcagcugcaaacagcgggugcuucgucaucagaaccaaccugcuaaaugcugagcuaaucagagcucuucuguggauugggaauguguggcagaaaaaaaaaaucaagucuguccauggggcaggaaugagggaaagucguuaugucugugucaguaguuaacaccugcaacugaauagcuacgugguaguaaugaaggcuugcacuugggggauaaaaagacaaguaccagauaaaucaauuagaaauccaaguuggcucaggcuuuauggaagacaguaugaagauuccugaggaaauuaaaaacagaacuacucuaugauccaacaagcaugcuacuacugguuggguauccaaaggaaaucaaaggcaggccugguaugucaggccugugaucccagccgcuauggagacugauguaggagcaucauaaguuaaaagacuauagagcaagaucaaggcuggccuggugacuugguaaagacuugaccuauguuuuuuuuaaguaguaggggacagugagaugccuuagugaauggauaaaagugcuuaccucaaaagcuugggaaccugaguucaauccugucuuagguuauuacuacagcaaugagaccaugaccaaagcaaggugggaggaaagaauuuauuuggcuaacacuuccacaucacuguucaccacuaaaggaaaucaggacaggaacucacacagggcaggaaccuggaggcaggagcugaugcagaggccauggaggggugcuguuuacuaguuugaucagccugcuuucuuauagaacugaggacuaccacucacaaagggcucauuccuccccagucaaucacuauaauuaagaaaaugcacccugagcuuauggagguauuuucucaaaugaguuucccuccucucagauggcucuagcuuuugucagguugacaugaaaacuagccagcacagugguagaaccgggugauuuuaagugggcugaugcccuggaugaucaaaacuaucuagauggccacacaaaaagaaugacccacagcccaaucuuaugagacuuuuucuuaauugaggcacccuccucucugaugacccuacacuucagcuauggcauaccugugccugcacucaaacauuucacuaaguccuuuaaaaaaaauaaaaguaaaguaaaacacucuuaaagugggcugguccuaucuuuaaacuccuguagcacaaaagggaacaaggaaaaucccguuggaguguaggagagacaauugcacucauacuuacagaaacaguacucucagaagccaagagagagaaucuggagucaccuuaaauacacauggguggaugaauaacgaagaaaacuggaugugcuccgugauauaauagaauauuauuuacccuuaaaaacgaaauucugccacuugcaguaacauagguggaauuggagggcuguaugagguaagccagcugcaaaaacuuugcaauaagaguuuguauaaguugaacauacaguggacagucagcugugucaggaugaugguaaaaagaugcaaaacuuugcuuagaguaugaagagcuccuggaaauaugcuaauguuugcuugugaaauguucccuuauugguucauaugcuggaaccuuuuggaaaguggagccuugcuggaggaaguggccuuguuuuuuuacugcauguauuuuccacauuuucacuauaaacuauggaaaagccaaagcuaagaaauaaaaaaauucaagaaauaaauauaccaaagucagaaucugauucuucgaugauaaaucaugauuguaccauuugagcccaccuuuuaaaguucauuuguacuuuucuggacaaagucugcacuggguugugcuucuucugcacauuucugguuuauauacaucguuuuaaaagucaaacagcuuuacaguuaguuaggagaaaaagcagccccucguaccccucagaaacuaugcuuugacuuuuuaaagcuaguuuaagaugugacaacaaaugcaaaccuaugcaucgaaagcuaucaugauuuaucauuucuauaaaugaaugaaacaugcuacaggaauuccauuucccuguuaauguuggauccuuugucuucuuuuugaagucauuacuaggaagugucaaaguugaacuuugguaauuucauuuucuuuguguuuucuauuucucagcuuuggcuuuucauaguuuaugaugaaauuuugguaaaauguaugcauuauaaaaacguauaaaugucuuaugagaacauaccaguuaaaacggaaaacuugaugcaguuauuuauccagaguuuuucagauaucuggauaugguuaugcugcagauuaaaaauauggaugguugguuaaaauaacuguugaaauaccuguugucaaguagauauagguuaaaauauuucuaacagauagaaaaagaauuggaaacuagguauggucuccuaauuuuucuuugaguggaaugaaaaagaugguguggcccaucugcucauaaggaauugucuguagaucaaugguacagcauccugcuuccuuguaucccagcagaaacaguggcucucaaacuaggcaguuaucaguaagugaauguaaguccucagugaugcuuuuucuuaguuauggaggcuaauauaaguaagugugucagugaagcuaaucuuaaauggauugccacaggcuucaggauacuuuguugaguguauucacauuucugcuuucccucuguguagaaacuuacagaaagaacaguuucucuauggucgcuaauuaacagcaauaaagacaaauucaaaaaccccuucuauacaaaagaaaucaaucggguuuuguauccaguugccagcaugcgucacuuggaacugugggugaauuauuacauccgauggaaucccagggucaagcagcaaguaagugaagcggcucucacgcuugcagggcugaauaagcggcuccaggccgccuucuacggugcucuucucucacaguuugaggacaaacacaggaaagacaauacuugcuuuuaaacuaacccuaauuuaaaauuguugggaacuacuaaaccaggaauuuugaaguuaaaaaugucccugucgaugaaugucguaauaauguaaguaauuuuaaagcucuagaaaguuuuaaaguuuuccuagcuagggauuuccuguaaucacuucaaaugcucaggccucauuagaaagcucuguauggauuucccuggcauggugggucacuguuguguuucuaacacuuaggaagugaaaggcaggagaaucagaaguucaaagccagccuuugcuacauagagaauuugaggccuacaugagacccugucucaaaagacaaaguucuuuguacugacuaggcagucuuaagugaucuuuucuaugcucugcuugacguguauauauaaagugagcuggcguacuccuuacugaauaucucuauaucuaaaauaaagguaccaguauaccagugguuaguaaauuuagcuagccauuuaucagucaauaugaaggcagauuuuugaagugauaauaugcauauuuuaauaaagacauuuccaugugaguuucaagcagccaggacuagacagugagacucuaucugaaaaaauaaacaacaacacacacauacacagugaaccauguuugucuucuaaaauaagcccuuucuaucuuugucuuugagccauuggcugggaggaacuauuggcagugucuguguagauucuacaauuacaucuccauuuauucuuguaggaauuugcgaaguauaaggaauuuugaauuauucauuucugacuauuaaaaguaacaaugauuauucgacaaaucauuuggaaccuuguugauugguuuuguuucauuuugcugauaaggaaaguuugaagggacaucaccaucaucagaaauuuaaaguauaccucuccgccccuguauucucuaaggguuuagcaaaaugguaccuguacaaauagaaauguuuguccuuuaggggagccuuuuacuuucaaauauuaauuguucuauaucaugauccauuggcaucuauucaaaacagaaaauuaccuucccuuugcaaauuuuucugacuuacaauauuccuauauaauuugaugucacugagcauuucacauuuucuucuacaaaauguugaguauuccuauguguccugcaauggaagaacacagguauuagaaagacauggucucuacccacaagacuccccaggcugguggaggcagccaggaacauaagcugaugauugcagugcacagggaugaagcugauaaugaaggugugaauuaaguaugugagaugucuuuaaagaucugcuuauguagaacauuauuucauaaagagauuaaagccaaaucgcauaggacuuucuaaauuauauaauguauauaauguaaaauugaaagaaaguacuuaacugcuuaaaaguuaagcgauuauucauuugugugaucuagaaagcauucaguugcuggccaccuacaguauucacaacacaaugaucugcuaccugugcugaaagauaaaagagcauacagccccucccuauaaugagcucuuagccuuaaugaaggcaggguggccuguucuuaaacgcagacuuugccaguccuugcugugauaucaaacuuccuaacugaaagauaacagcagggccaaugacauauaaaccagcugacaugugugguauuuaagucauuucuacuagaaggguuaaaagccauaugaaugcaagaaaucauuugaggcuuaaaaugcugccaugaugagcucuccugggguguguauggcaugcugaguuggcacacacuuuagcucacagcuugucgccagucuuuccauccuaucagaaauggacuccucugcuauauucuuuaagguuuuuuguguaucuauagguuaaugacgucuauguauuuuagacucauuacuccacugaucuuuuccauguguaaguuuuuaaucucuuuuauugcuaauaguuuagaaaacucauucuaaucauauauucaugccacugcaaaaagauuguuauuaugucugauuccuuuuucuuaaguauaugugcugauucuaguauucaaacugacucaaauuuaauauucauauggaagaugauuuuuuaaauaaccuaaacaguuuuggagaauaucaaggaagaaccugcccuccuguguauaucaaguuauauaugcuccagacuuagccauugauaagguagccacguuccuauaaacagcccuaauuaaauuuaucaggucaccaggaaaagggggcaugaaagugggaagcaaucucaaagcuaaaaaaaaaaaaagaaagugggaagcaaagagaaaacaaauuagugggaguggggagcagacagcuucaaaguacauugucauguguauaaaaagguuaugaugaaacuauuuuguauaauuagugcaugauaacauauaaaacaaaacuugauaugacauaggaacagaccacuguggcuguggagacuugguauaguaagaagguggcauuauuuauucuguuaauaaugucaggauccuaaauuaaacaucacacauccaaccagaacacguaaggcugcccuccagcuccuccuacugucaucuucauuucagcuccgggcaucaccucuagucacccuaucagaaagucuagaaucaucuuugauuccuucccgucucuucaccccacgaucagugugccaagagaacccauuugacugucacaauacauaggacauggggaaggagggcuggagagaugcuucaguguuuuagaauacuugccgaucucucccagaggaccuggguucaauucccaggacccacauagcagcuugcaacugucuguaauucuaguccuagggaauguaaagccuucugccucucugugcauaccaggcuuauacauugugcauaugcauacaugcaaaaaaauacccauacccauaaaauuaauagaacacacacacacuuggugugcuucugccaccacuucaggguguuugauagcaguacacuucuaaauggacucauggggauacccuugccuccucugaaucuguccucagaagagcagccgaagcaguccuuguaacguagacaucugacuauaacacuuuuucauacugccuaggaaguugcucaccucaugccagacucaaggacuaagucuuaacagugacuuucugaggccuuaugugaccuugucccuuuucuguuuucccugucucaacccuuugugaacaguuuuuagccauggugaccucuguucuuccucuauuccucucaaacuuuuccucuaaacucacuuucuucuuuaguguucuucauuccacaaauccaaauuagagucccagugacagcgcaccuguccauacucuccuagcuuguucggcucucuccaaccagucuucuucguggaauugguguuucucguuggucugucgcccccugcuggaagauauacagcauacaggaaaucaggcuguuuugaucacugagcaccuagaccagcaccuggcccuauuugaauacagagaaaacuaggcagaggauauuugugagcggcacugcaugaguguugguugcugcaccggguguucugccuucuugacgagggcacuuugguaaaucuguggacccugaacaagcaauccauauuuugucaaaaguagcaguccuccuagaaauguggagguggaaacauucacagcucuauucagcugauucacucuuuggaagccugcaaugguugaauggcaccugcucucuccucaaaggaaguauauauucaaacacuacaaaugugacuauuaguuauuuuucuuguugcugugacaaaacuaccugacacaaacaucguaaggagaaggguguuuauuuugguccacgugugugaacacagugcagcauggugggagcuuaaggcccacagucaggagggaggaggaugaacgcugaggcccgccucucucucuccuuuuaauucauuuuauucagucugguucauaccccccgcccccucacacacacacacacacacacacacacacacggccugcugccucucuuauucacaguguguccucccucuucaguaaaaccucucgaaucucccagagacauacuguguguauccuaggugaguccaaauccagucaaguugacaugaagaucaaccauugcaguuacuucacauuugcaguuguaacugagauugcuccucaaucugcugagaagcacucuccugggacaggggagauuugcaacauggcuacagcggaggggaaagagccauacaaaagcagauagagagaccagugugaaauuuucgugggccaaggggguuagcuggagccaccagaaacacagagcaaggaaggauucucuccuagugccuccaaaguguguguggcccuggugauacaugaccagugagcuuuuaccuugcagaaacaaggugaguuacuuucaguuuuaagccaccaaaguuucuguucacuugagauauggccccaagaaacuaagucacaguguuacuucucaaggcucaggcuugcugaucuugaacccuggucauaucaagugccuggugcuggcagggaccauucuccucagccuuuaccggcaguaucugcugccgcagcuuuguuggcacacggagcuuggcuugacaguuuaacauggacuguucugggagccacuauaugugcuaaaggaaaacacuuuuauagacuuuagcuuuuauuucuuccuguuucauagucacucaagcuuucucuaaaggcaucucugauggcuuuggaacaugagucuccugcagagcucuugucuuguacaucuugacuugggugaugauugccuaaguguauccuuacauagagauucauugagcugggcauuuuaggaugugugcacucugauuugugucucagaauaaagauuuacagaaaugaacaugcuggcaaggaucccauugugccuuuaucaauccccuguugacugcuaaaagaaauuacggugacacagacucauggcacccucagaacacaccuggaagggcugugcugggcuuugggcaguuuguacggagagcuugauagagacaugcugaaccuguuacacaucugggaaagggcagaguaagaagugauucccugaccagaguuaggagcucugcugcucucugcucuaccuucauucaggcaguaaacucgugugaagaaggucuugcagagcaguaugggcacagaaaaguaagauacaccacauuauagcccucgagucgguacaaacucuuauaugggugagaauauggagcaggaggaaaugacagguaucacugccauggccccauguuaagggcaauuugauagcauguguugaagucaaagagauuguacucuauucuucagagaccccaugccuaggaauggugcaugaauacauguguaggaagacacucauagaccauuacauauagcauagaggagcccuggauaugagcucuguauuuuaggacuguguccacagugcaguguguaaggaaaguaugugugguugucaguucuugggagcuuaaucugaagacaguagacagauagcauggcuaacagaaaagaugacuugugccugugauuccuuauagcagcccaacccaguggagcagcguuacauggagcuuuuggccuugcgugacgauuauauaaagaggcucgaggaauugcagcuggccaacuccgccaagcuugcugaugcccccgcuucgacuuccaguucgucacagauggugccccaugugcagacgcacuucugaggggacucacuucuggcacugcacuugaacucuagauaagugaaauagcugacucucauucugggcauguggacaaaguagauuuaaagugucugccuccauuuagaaguucaacuaacaucuuagacuuuugaguaugugccuucuguaauacauaucacaagaaaucgaugguguccguguggcaaucauaaggaaggagucaagaggggguucuggaaaauccucauacuuuuuuuuacaaagcacuuuugcaaagauaaaacuuaaauuuaauuuaccucuauauaaauucuacauauacaguauguauuuugugggcuuaauugaaauauuauuuuaaauccaggggggagauuuguuugcaaaauguauuuuccuccagcugcuuauaacaguugcuuuggauuaucuaaaauuaauccaaaugugaaagauggguauuacugccaaagccaaauugcacucugcuucuucagcaaauuccaagagcaaggcguuuaaauaauugccaauuuuuauuuuaccauaagugguaagguaaaaagaaagaugaacauuucaucauuuugaauuuuugaaaauaaaagguucucccaucauuuuucaagagaagcacauuuuuauauuaagaaaaagugauaagguuugauuuuuuuuucccucaacauucucagcuuugcuuucuaaauuaucccaugauuuuugucuaacacugagucauacucagguugaaggaaacccauaaauagcacugugcgaggagcuggcuggcuucugcugcuuagaggaauauguucgcaaacaugccucuagucaauucgccuuaucugcugaaguguaggggcaccgccuugaauggaugagcuauggcuagagcaucuuucuuuacaguaaugccccagguguauucuguuuaugucucucuguuuaaauggugugcgugcauaaaaacuugcucugcacauuauuacuugaaguacugggcaauuugcuuuuucagguuuuuuuucauuuuguuuuguaguaugaaauggaauuuuaaaugcacaguucuauuugauauccgaacuaauucauuuaguaaauauauuuguaaaagcuaaaguuaaaucaauuaauguuuuacagugauuuguaaaggauuauuuauagcuaauaugguuuuguuuucagugaauuaagagagauuacauuuaucuuuguaaauuauuuuaugucauagcuuaauggccuaccaaaugagacaucucaaauauaauaguauaauguauggauuuuguaaguauaaaaauuauuagauauucguuugcuuuuuguaaacacuguaaauauuucauaaauuaaaaugugucacuccauaagaagaaaaaacuaauacuaauaguugacaggaauuggugaaauuucaugaaaauauuuucauugcaauaaauauuaaaagaccugcuguaauaaauauauuaacuaaaaccuaacaguauuuccagggcuaugacuguguguuuaagaugugcaugguguccaucuuacuugcuuacuugcuuuuucugaaucgacuuuacuuucuuugucacaguaacaauaucuguuuucuuuugcuguuguuguaauuauugucugaccugaagucucauauagcccaauugucauccagugcacugugucaccaaagcuggccuggaaccccugauccucccgcgucuaucuccuagucauguacuacccagccagcuuauuuccacucugacuaauaacuggucaaaggaauguacucuucuugauggacagaccuagaaacguuuaggaaugugcaccccaagcaugcacacgccaggaaaaggaggagagaaaacaccucaccuugacaaaucgggca

SEQ ID NO: 9532 - RNA, 2222 nt, Mus musculus
caaaacacugugugcucagcauacuuagaagguguuugauaugugguuauugcauuuagagggaaaacuuguggcuuguagacagccuucucagauuucccuuuuguguagcacuguauagggacaacacggaaugcugccuucccuaucugccauuugccuagaacgacaccauggugcuugcuggguacuacuugguacagaucaugcuuacaugccccugugaaggcucagcgaggcucaggaccuuguucuagaucuggcaguaaaucacugauaaaaauggaauuuggcccuggacagggacauucuaugacaucuaccaggcagcaaggugcugggugacuuaugguuuaguucugacauucucuuuuacucucauguguaauagcuaugauaggucugcugaucgcccucaccauacugaagccugcuuugcuuaccuguagaggaaacugucugcauuuagagacaaacucucuugcaggcuauagguuuuaugaaugacuuuguuuccuacucccaccccccuauucccaggaguacgcaauaaagacgugucacuaagcacuagcagaaggaauccauauauccaugaggauacuuuuuaccuagcuucaccacacuucaaguuugcaacaugcugagcacagaacaugggcagagggcaauuccugcagucucugagaagccacucaguccccggcgugccagcuggggcccacagcugagucuaagagugagugcacugucuagcugagggaggguuaguaaagccaugcuaccacuuggacuuccauccuggcaaguaaaaaggagaaggaacaauuugaacuuuacccuagccagugcagcuuaggaagcaaguggagguugugaaaacaccagguaaaagggauagaggaggaggaggaggaggagguguuuauguucuaggcugauggaaucagugcuauuaaagaaugaccuagcaacaugcuccuguuggccacccuuuaaagcuucagaauauuaaacucugccugucacuucucuagcccuauguggaggagcuuggcggauugggucaaggcgugcuagcuagcaguacuugauaugcagaaugaggucagucacugaacccagcaggcaggaggcaggagaccugcuugacuggucucuguugugcacugugccuccccccgccccccaaucuuacuuuacugugaaauaaugcagcaguuuggggagaauuuuacuccuucaagcuguaucugcuuuacaacuuaucacauacccucucuuucuauuacauuauaagugaacuugggugcacuuuucacaggccuuuacuaccucauauauauacuagcagagagagguacugugcaagccaaauaucucccaacaacuuagaagauugauaaccaaacacagcaagagguaauacuuccuaccauuucaccaguagaaggcagacauauaagaguuuaaacucuaacucaguaaaugguauggaguugguauauggaaggaacuuucugaaaaaggaacacaaaacauggagccuugacuucuagcagcaauauaacuucaguaagucaauaucuacuaugaauacauuuuauaacaccaucuucacuuggaaagaaaggcauacccuuaugaaaacaagaaaauaaaaaauuaccuguggucucauccguggauuccaccguacauaauaauuuacccacaauuccaagugacucauacuagcaacaggauauaacacaugguucucauaauucacaaagaagggauuugagaauucaucuaguuggcuauugauauaagaccauaaagauauaguauuuguauauacauccugaaaaaauaaaaacauuacauugaauuaaguucuccacagccucaaggauuaauuuuuuucauacgaauauagauuuuuagauaaugaacugaauucaaacacugaaaaaucuaggcacauuuacuaagccccaccccucuggcuauauacagucucauccuggagaugauaugugugauguaucaggaaauaguacuaaaguuaggcaacaucuggaaacuguauuuaucuauacaguauaagcaggcucaucaauaacaaauauauauuuuauugaggauuugaguucauugauauugagggauauugaugacuaauaacuguuaauuccuguuaguuuuauguugguggugagaaagagagcgagaaaaag

SEQ ID NO: 9533 - RNA, 10107 nt, Mus musculus
cgacaauugcggccuggcuaucggggcaaggcgguuuuggcgcucgagaguggcacgccaggcgcggggcgcgaggccagagcuggcucggcagagugcggggggagggucuggcggagcccccagaggagagcaggggcaggcagggggugccgagguaaugggcaaggccugugcgcuuggcugcgaggggcgggggcuccaggcgcucuuuggcucgggccuggcgggcgauggggcgccaggggcggugggagggaagcgggacagggagggacuaagggaggagaccgcugggaugggccgggggcuuggccgacccggagcaggugggcggggacacgggcccugcuugaagaggagcagcagagggguggcgggcugcgugcgcaaacagggcggccgccuccugggcccggagaacggugaggccauuugguuggaugcccccagccccgagggcacgguuugguguucaggaccacugagcugggagccgggcacuguuggggagggaagauuuggaggucaagcaggccaagguguuuggauucuugaguagaucccaggagaacaguguugcugggccagaagcaggaguucuucacaagggcgcugguguccagcgaaggugggcgaagccaggcccuuucagggccgguaugaguggaaggggacaagagaccccagaguuugaguugaagcacaauuugggaguugccuguggugaauugaugaaucacgagauuuggaaauagcagaacccuuuccuggcgagcaguucugagugauggaaaucacaggggcuaggauuuggagaaguggcuuuggaggccaggucuugguacgccaggugcucacgggggccaccagucucuaagggagguacuuugggaguuuugacccagagacugggguccagaggccucagccugggguggaguuaaggaaggucuuugugguggcuaguucucugccuuccuuccuuucuagaauaucaggauucagcuguguuccuguggagaguggguuaaaaauucuuuuagccuacagucagcuguacaguauccaccaggggcuggagggacauauauaugcgugacugcagcugcguuuucugucguggagcccucaugcuuccucacuguugccauaguaacugccuauugauggaguauuuauaggggaaaaagcaggcacuacauuuuggggagcgagggggagaagcccuuauagcagcaacagcagcaauaguggugguggcuacagaauugcuaauagggugguccaugguuugugaacucucugggggagauccuggcuucuuugaggcucagaaaugaacuaaugacuuuuccaggacaggauaacacacacuuggggcuauggcguaugugcauaugaaugcccggaaguccaguguuagguugggaccaaagauagcuguauguaaaguucuuauauaauuuuuccauguaaauuuuuuuuaaaacuccgcaguucacuucaguaagcaaugggauauauuugcuuucuaauuagugaaagcuuugcucauucuuuucaaacucugaugugacagcuuuguuuuucuuuaaccaaaacauccugucccuaauccaauucucccugcacccucaucauauggacaccauaggcuuuuugauaguucucuuuuugucauugugaaacuugagguauauaguggucugcugguauuuuuccauuuguucuaaagagaaagccccaugauacaaugauaguacagaugacugugagaucgguuacuuuucccaucauuuaaaauuuauucaugauuuuuauccuccuuauuuuccauagaagaagacauauauuaaacacacaauaggauuauacucuggaagaguaaauagaauauuguaccaaguuauggacagaaaagcaugugugcauaacagcugggcuuuuagagcacuuguauugggccaucaauguuaacacugaacuuccuggcagccuaggcaaaaaggguaguguaaugggcuccaaagcucaugugucucacaacccuauuagucuuaaaacaugagcuucugcuuggggaggggaacugagggaugauugcuccuaggugauggcuuagacagugcuuccaaauaugugugaauauguguauggguaggagauuaggauuguguugguagaaaaaggcuuuaugaugguacuuuuugauagaggccucuccucuaaguuaccauugcagauuuauuauauuguguuguacuuacuuauuugugaguugugauccugaaaaacaaacccacauucuuagauaugccuggaacaugcuguaugaacaaguuauagcccaaggccugugucuucguguugaucuuuuaaauauuuuuaccaagguugucugcugcaguagucuuuaaugcuaagauaaaagaugggcaugccuccagagaaguucaaacaucucucucuuucuggggaaacugagcugagcagauugccugaguuugagcccagugaguuggaucagggaguguaagacuauaucuauguuguacacagugggucugacccugcacaacagauaugcauagauuacuguaugucagucucagcuagacuggguuauuugagaugguuguuguuguugcauugaguuugguauuaaaggaauacuuucaucucuagagguaucugggacucaucuucaccaucaagugcaauuccagaucuugucucugucugggucaauuugcuuaacuuuuccuuuacuugaccccauauuugggcuugauuucucaucuguaucugggguccuuuccauucugaaggggaaaagauucauugaagggauagggaguguuaggucagagacucacagaacuaacucucucucucucucucucucucucucucucucacucucucucucucugugugugugugugugcgcgcgugcgcgcacaugcgcgcauguuuugugucuuguguuugagaacaaggcucuccugggcuuuggagagcucuggagaaggucuuuugggacaaagcagaagcagcaggaguuaggaguggcuguaugagggugcuguuccucaugggaugcugcuuugaucuuuucgcuagguuggugggaggucacauuccagaccccagaagguuucaccaugauuuucuuuucucccuugacaggcaagugagacacuggagcugaagaagcaucauggcugguaagugaauaguucuggacccaucugaguugggcaggcucaugcagaaguaacgcauccaucuuuucagcuuuucucuccuugagugguucugggguauaugaaugcaacagcucauggaucauuggaacgaggacuugcaggccagaccugucagccugggcauauaggggcaucacuuacugugaggaguaagcagucccaccauuggugauugcuuucauccuccaaagucacagcucaugccuuauuucagucccuccaguagcagccuggaagaggaagagcgcucgugguaagaucucuggcuuuccuguuucaagaaagauacagaagcuacuggauguuuucuaagacugcaauacguagaguucuuacugauccuucuucauguuucgccuuaaguuccuucuuaguuggggucucauuuuccuuuguaugggaaaggaccuuggccauguugggacccugagcuccugcuggugagcacagcaucauagaaaggcagcccucccaucaccacugcaauaggccaggucuuugcuuggaguccaggcuuuaggccuauaggauuugcccuauuucccuucauuauugggccagucuaguuuguagggacugaauugcuucacugugguucucuccucaguauuucuagaagcaaaaaaugcccaugcaguccugaaacgguuuccucgugccaaugaguuccuggaggagcuacgucagggcaccauugagcgggagugcauggaagagaucugcaguuaugaagaggucaaggaaguauuugagaacaaagagaaaacggcauguacugcccuggggcuggguucugggaggauguacaaucuugggaauaaugagaacaggucugaaacgagggaagacuaccaccccagcuuaccuccugccuuuuggagcccaaaaagaaugcuggggugucccucuaggucaguuggguugcaaugauuuuauguggacuucuuucacugagagcuuuguuucucaaccuugauggauucgcuagacucucugagagcucucucuggccaguaagauggcucaggguggagaaggaaucacaagccuguccuugguacaggacuugcuggaggccucagaugucuaacacauggauguuaggugagcacuuccuggugucugucuuccucagaauugaguggcccuucuucuuuugcagauggaguucuggaagggauacccaaacgcagucuacucaguucgagaccccucacagagcucagaugcuauguaugugguggugccccuucuggggguagucuugcugauugucauugccuuguuuaucaucuggaggugccaacugcagaaagcaacucgucaccaccccuccuaugcucagaaccgauaccuagccagucgugcugggcacaaccucccccgugucaugguguacagagguacugugcacagccagggagaguccucugggcaccgugaggcaggaaauaacccacagauaguuaugggacccagccggggaggcagaaccacugucaggcuggagaguacccucuaccucccugagcucucucucuccagacuauccagugcuaccccucccccuuccuaugaggaggugacugcaccccaggagggcagcagugaggaggccagugucucuuacagugacccucccccaaaguaugaagagauuguggcagccagccccagugcagacaaguagcugagcacaggccauggccuguaugaaagccucugccagagguagccugcuuccuuuuggacuucugaaagacugugccaccacaaaacagccuuagccuccuuguugccaaauaauucccuaauuguggauuuguaggaagucaguugguagagaagguguguguguguguguguguguguguguguguguguguguguguguguaugugugguggucgggggaggcauaggacaagugcaugagcccccugggaagaacuacagaccuccucccugacaccaaguccccacuauccugcccucucauuagggacuggcuuaucuuaugccaaaggaaccaucccauaguguugauugugauucgaaugagcacaaaaucauccccuggggcugugggucugucuggggaccuaggccacggcgauaaggaggucaaggcaguccuacaguuucucuuuucucaacaguuuucacuucuuccuguucucacuuauauuaugaggacagaaauaacgauuuacuaggaacaaaacacaaguuauaacaaauaaugaaccauagaugaaaacaauagcuccuggaccaucuguacccuccaaaagacaucaagugaacagaccuuggcacagccuuccuccaacacccaacccuaugcaccuggccagggugaaaucuauguggagagcaaccuggcaggagaauagggcaugggaaggaggagggaaguggacuguguggcagagcuccuuuuuuccagaccacucacggggcccacuugaacucugccaucuuguuucugauguguaccaucuguguuuaaccacuccccacuggcauuaguccagguauagccuuggaguacucuguuguggggcaacugauaaccccuuccuucaugaaguccagggccucuccuuggcuguuacagacuggcacagagagcucaagauuccuccuuugugggguugauuaauccacaggauaguuuaaaccaugagauccaccuccuuggcacugugcuaucuggcuuugaaguauuagaauauauauauauugguaaauaggugcauugaacuugaacuuuagauugugauuucuccugaugauggugcccuuacagggagaaguucccaaagugugucuuaaaauuuuucuuagugggggagccucugagcuggggucuaaagccuaccugggguucgcucugccauggccaggggcugaucuguuuucagugaggcuuuggaacacauugggcagaggugacuugcucuuuaacugucaaugauaaaguaaaagacagcgcugacaccaucucuaccugcccccgcuguauucuccuggccucuaugccaaaucauucuuccucugcggugcuuugaaauauguagcacaguuuuguggggcccaaaaagagugcagagcgugggucugcuggcaacugcagugguucccagcccacagagucgacaagcuuccuucuguccaaacagccuuccaaggcacacacugagacacauuccuugaaugcaguucugccuugaggccccagaugacuucuacaggcugauccagcgcuaaggacaugccuagggguguguuucuaccccagugaggcugccagcuuggagaacugaacccuguggcuccccuaccucacuggcccauuagaaauggcugauggagcuaauauuugugaagugcuugaagcacuguggaaccagugaaguuugcccauaguaagauucuuuuugaaauaaguaguagcugaaagggacugguuuuagcagaggguuuccagugccacugauguugagugucaaccugaagagucaaucucuuuccauuugacccuuuuugggccuuccucucuccccaaagucucuucccccuuucccuccauuuugaccuccuuccucuguuccuuccugcuuucauuccuugugucuucccucuucccuuuucuuucuucccauuuuuuccuuuuauucuuucacuuccuuggucuucuaguauugccuuucugcauggagagauuugggguucagaagucccaugcuuuucucaugguagagauugguaucaaucucauccagacauguuggagauucuggggaaggugaaagcucuggggccagcccagcaucucccagcauuuuguuacgcuggugccugauugugaucugagauacaugaaaacagacuuaccccaaugugaguccucccccagcuagcagagacucagacauaggcuccacugacuagggccacagagaguaugucaaggaaugcccacugccuuuggcuuguguugagguuuuucuguugagcucccugacagcuagaggcuagggauguauaaguaagagcaggaaacugacucccaaggccuauagagagugacagguagcccccaggggcugagaacuggaugcagggugagcgagaagcagcuccuuggauguggucuguggguucuaggucaggugcuucacagagcucucccaggugacuugugccaaggccucugcaaugguuuucacagcauaguauuuaguacauauauaaugggcauaauuccucaaggugcacacuuggcuuuuaugaaugcccuguacauaacuuuucaaacucugucuuuguauagacauugauuugauaugaugcuaacacuucaguagccacauuuuguuuguuuaagacuugugugcacaugugugugugugcauguguguguguauacaugugggcacguugucuuuucucauuuugcuucuaugaaaugauagcuggugugugauucuauuuguccuaagagagaucugcucugaagagaagucugucuucaucuuguggggccugaacucugugggacccuucucccauucacaugucuuuugggcccggugcccucugcuucagcuccuaucuccuaucuuuguagaugucaccaacuaaaggaaaucugagcacaccuguguguguaugugugugggagagagacagagacagagacagagagacagagagagacagacacagagacacacacacagagacagagacagacagaggcauagaaugugugugugugugugugugagagagagagagagagagagaaagacagguagaaaaugaaugugugugucugugugugcuuguguacaugugugugugugugugagagagagagagagacagguggaaaaugaaugugugugucucugugugcuugugugcauguguguguguguguguguguguguguagaugugugacuauugacuuagauacuuuucacuaaaaaugaaaaggcuuuaaaauaugacugucacuuguuuucaaacaaauccuuuuuaagacuuuuuaaacaagaauggcaacccuguauguccccucccagacugcccaucacuuuggguuuucaaaaugaaagcacaagagaaagaguggggcgcacaggugccuggcaugugcauacccuugcacagcucuguguugcgcccuggcugagcaguuccacccaggaaacugaggccuccucugcuacuugccaauuccacugccauuagugugaauuccuuagggugcuccagcaaacaagcaucugcccaauuguuucgauauugucuuuuugguaguucaaacacuagggauuaggggcagcaguguuuuuuguuuaagcaguuagagccagaugcuuccucucucccacuggaugguaacucuccagaucccagacagaguugacagaucuuuugacaagcaaauggcaucccaugagaaaaccaagaaaaaaaauccaauauugccacuagauugucuuuuaauucaagugggaggaagauggcagagagaggcugaguugccaggacagugucuuuggaacagagugugugcucugacugugugucugcucagucaauccugagcugcugggucgggcugcuuuucagccugucaagugcugaagcuccauucacgggcgucaccgaucuuccccacugaaaucuccuaauacuaaucaguauaauuagcuaauuuuagacugcugcaaugaaauugcuuccaaguacaguaaaagcccauuaauuugagcacacuaauucagaacuuagaggaaauccaaaucgagauaauucacaguaacuguuauucuugcuauauaaaaauauuugaaagcgucuucccuucauucagucuucaucuguauaaaaggaauucuguuuaaaauggguaccuuuuucaaaggaaaugcucaagguaccaaggaucccuucauugugccuucagcuuggaguuuagcaguucuugugucuaaggcucuuucugugcagggugaucccuuguucucucuccauuguggggauguuagauauuaaagccuuucacuccaugucuguauuuauccugugauuaaauuaguuugugaucuugacugcaguuuaaauacaaguaugugucuuuguaaguguucuguaaagcagacguugcacuaacagaccgccugcucucauuuacccucaagucuucaaacuuuagagugucuccuuucccaggcuguggaaggagaaucucucucuaggaagaauuucugugacaaagaucuccaaauagcacacgcccucagcuccaugccucaaccguuguuucacuguacugcuaucugacugcugaacgugccugcccuucuccagcccccagcgagcauaaagacugauagcuaggauugggaccaacccuccagcugcuuuuugccacccaaccugucuugccucucugaugccauuuucccagaccugaauucaccugcuguuuuacucugucauugugaauuugugacaauggcaaccccgagcuucuagaaaugauuacugugaaauggauuaauuuugguaccauuugaaacugugcucauacucaugucuugacugaugucagcuggagcgucuguacauuuagucauauguugggauuucaaauggggccuaggggcaacaaaccaacuugcuucugaucuuucucacgcacgcuuucuggcucccuuuuuacaauuguugaguuuagcuguuaacuuuugucucuuucuguauaagaaaauaaugauuaaaaauaaagaucacauggcauccacuuguac

SEQ ID NO: 9534 - RNA, 10107 nt, Mus musculus
guacaaguggaugccaugugaucuuuauuuuuaaucauuauuuucuuauacagaaagagacaaaaguuaacagcuaaacucaacaauuguaaaaagggagccagaaagcgugcgugagaaagaucagaagcaaguugguuuguugccccuaggccccauuugaaaucccaacauaugacuaaauguacagacgcuccagcugacaucagucaagacaugaguaugagcacaguuucaaaugguaccaaaauuaauccauuucacaguaaucauuucuagaagcucgggguugccauugucacaaauucacaaugacagaguaaaacagcaggugaauucaggucugggaaaauggcaucagagaggcaagacagguuggguggcaaaaagcagcuggaggguuggucccaauccuagcuaucagucuuuaugcucgcugggggcuggagaagggcaggcacguucagcagucagauagcaguacagugaaacaacgguugaggcauggagcugagggcgugugcuauuuggagaucuuugucacagaaauucuuccuagagagagauucuccuuccacagccugggaaaggagacacucuaaaguuugaagacuugaggguaaaugagagcaggcggucuguuagugcaacgucugcuuuacagaacacuuacaaagacacauacuuguauuuaaacugcagucaagaucacaaacuaauuuaaucacaggauaaauacagacauggagugaaaggcuuuaauaucuaacauccccacaauggagagagaacaagggaucacccugcacagaaagagccuuagacacaagaacugcuaaacuccaagcugaaggcacaaugaagggauccuugguaccuugagcauuuccuuugaaaaagguacccauuuuaaacagaauuccuuuuauacagaugaagacugaaugaagggaagacgcuuucaaauauuuuuauauagcaagaauaacaguuacugugaauuaucucgauuuggauuuccucuaaguucugaauuagugugcucaaauuaaugggcuuuuacuguacuuggaagcaauuucauugcagcagucuaaaauuagcuaauuauacugauuaguauuaggagauuucaguggggaagaucggugacgcccgugaauggagcuucagcacuugacaggcugaaaagcagcccgacccagcagcucaggauugacugagcagacacacagucagagcacacacucuguuccaaagacacuguccuggcaacucagccucucucugccaucuuccucccacuugaauuaaaagacaaucuaguggcaauauuggauuuuuuuucuugguuuucucaugggaugccauuugcuugucaaaagaucugucaacucugucugggaucuggagaguuaccauccagugggagagaggaagcaucuggcucuaacugcuuaaacaaaaaacacugcugccccuaaucccuaguguuugaacuaccaaaaagacaauaucgaaacaauugggcagaugcuuguuugcuggagcacccuaaggaauucacacuaauggcaguggaauuggcaaguagcagaggaggccucaguuuccuggguggaacugcucagccagggcgcaacacagagcugugcaaggguaugcacaugccaggcaccugugcgccccacucuuucucuugugcuuucauuuugaaaacccaaagugaugggcagucugggaggggacauacaggguugccauucuuguuuaaaaagucuuaaaaaggauuuguuugaaaacaagugacagucauauuuuaaagccuuuucauuuuuagugaaaaguaucuaagucaauagucacacaucuacacacacacacacacacacacacacaugcacacaagcacacagagacacacacauucauuuuccaccugucucucucucucucucacacacacacacacauguacacaagcacacacagacacacacauucauuuucuaccugucuuucucucucucucucucucucucacacacacacacacacacauucuaugccucugucugucucugucucugugugugugucucugugucugucucucucugucucucugucucugucucugucucucucccacacacauacacacacaggugugcucagauuuccuuuaguuggugacaucuacaaagauaggagauaggagcugaagcagagggcaccgggcccaaaagacaugugaaugggagaagggucccacagaguucaggccccacaagaugaagacagacuucucuucagagcagaucucucuuaggacaaauagaaucacacaccagcuaucauuucauagaagcaaaaugagaaaagacaacgugcccacauguauacacacacacaugcacacacacacaugugcacacaagucuuaaacaaacaaaauguggcuacugaaguguuagcaucauaucaaaucaaugucuauacaaagacagaguuugaaaaguuauguacagggcauucauaaaagccaagugugcaccuugaggaauuaugcccauuauauauguacuaaauacuaugcugugaaaaccauugcagaggccuuggcacaagucaccugggagagcucugugaagcaccugaccuagaacccacagaccacauccaaggagcugcuucucgcucacccugcauccaguucucagccccugggggcuaccugucacucucuauaggccuugggagucaguuuccugcucuuacuuauacaucccuagccucuagcugucagggagcucaacagaaaaaccucaacacaagccaaaggcagugggcauuccuugacauacucucuguggcccuagucaguggagccuaugucugagucucugcuagcugggggaggacucacauugggguaagucuguuuucauguaucucagaucacaaucaggcaccagcguaacaaaaugcugggagaugcugggcuggccccagagcuuucaccuuccccagaaucuccaacaugucuggaugagauugauaccaaucucuaccaugagaaaagcaugggacuucugaaccccaaaucucuccaugcagaaaggcaauacuagaagaccaaggaagugaaagaauaaaaggaaaaaaugggaagaaagaaaagggaagagggaagacacaaggaaugaaagcaggaaggaacagaggaaggaggucaaaauggagggaaagggggaagagacuuuggggagagaggaaggcccaaaaagggucaaauggaaagagauugacucuucagguugacacucaacaucaguggcacuggaaacccucugcuaaaaccagucccuuucagcuacuacuuauuucaaaaagaaucuuacuaugggcaaacuucacugguuccacagugcuucaagcacuucacaaauauuagcuccaucagccauuucuaaugggccagugagguaggggagccacaggguucaguucuccaagcuggcagccucacugggguagaaacacaccccuaggcauguccuuagcgcuggaucagccuguagaagucaucuggggccucaaggcagaacugcauucaaggaaugugucucagugugugccuuggaaggcuguuuggacagaaggaagcuugucgacucugugggcugggaaccacugcaguugccagcagacccacgcucugcacucuuuuugggccccacaaaacugugcuacauauuucaaagcaccgcagaggaagaaugauuuggcauagaggccaggagaauacagcgggggcagguagagauggugucagcgcugucuuuuacuuuaucauugacaguuaaagagcaagucaccucugcccaauguguuccaaagccucacugaaaacagaucagccccuggccauggcagagcgaaccccagguaggcuuuagaccccagcucagaggcucccccacuaagaaaaauuuuaagacacacuuugggaacuucucccuguaagggcaccaucaucaggagaaaucacaaucuaaaguucaaguucaaugcaccuauuuaccaauauauauauauucuaauacuucaaagccagauagcacagugccaaggagguggaucucaugguuuaaacuauccuguggauuaaucaaccccacaaaggaggaaucuugagcucucugugccagucuguaacagccaaggagaggcccuggacuucaugaaggaagggguuaucaguugccccacaacagaguacuccaaggcuauaccuggacuaaugccaguggggagugguuaaacacagaugguacacaucagaaacaagauggcagaguucaagugggccccgugaguggucuggaaaaaaggagcucugccacacaguccacuucccuccuccuucccaugcccuauucuccugccagguugcucuccacauagauuucacccuggccaggugcauaggguuggguguuggaggaaggcugugccaaggucuguucacuugaugucuuuuggaggguacagaugguccaggagcuauuguuuucaucuaugguucauuauuuguuauaacuuguguuuuguuccuaguaaaucguuauuucuguccucauaauauaagugagaacaggaagaagugaaaacuguugagaaaagagaaacuguaggacugccuugaccuccuuaucgccguggccuagguccccagacagacccacagccccaggggaugauuuugugcucauucgaaucacaaucaacacuaugggaugguuccuuuggcauaagauaagccagucccuaaugagagggcaggauaguggggacuuggugucagggaggaggucuguaguucuucccagggggcucaugcacuuguccuaugccucccccgaccaccacacauacacacacacacacacacacacacacacacacacacacacacacacaccuucucuaccaacugacuuccuacaaauccacaauuagggaauuauuuggcaacaaggaggcuaaggcuguuuugugguggcacagucuuucagaaguccaaaaggaagcaggcuaccucuggcagaggcuuucauacaggccauggccugugcucagcuacuugucugcacuggggcuggcugccacaaucucuucauacuuugggggagggucacuguaagagacacuggccuccucacugcugcccuccuggggugcagucaccuccucauaggaagggggagggguagcacuggauagucuggagagagagagcucagggagguagaggguacucuccagccugacagugguucugccuccccggcugggucccauaacuaucuguggguuauuuccugccucacggugcccagaggacucucccuggcugugcacaguaccucuguacaccaugacacgggggagguugugcccagcacgacuggcuagguaucgguucugagcauaggagggguggugacgaguugcuuucugcaguuggcaccuccagaugauaaacaaggcaaugacaaucagcaagacuacccccagaaggggcaccaccacauacauagcaucugagcucugugaggggucucgaacugaguagacugcguuuggguaucccuuccagaacuccaucugcaaaagaagaagggccacucaauucugaggaagacagacaccaggaagugcucaccuaacauccauguguuagacaucugaggccuccagcaaguccuguaccaaggacaggcuugugauuccuucuccacccugagccaucuuacuggccagagagagcucucagagagucuagcgaauccaucaagguugagaaacaaagcucucagugaaagaaguccacauaaaaucauugcaacccaacugaccuagagggacaccccagcauucuuuuugggcuccaaaaggcaggagguaagcuggggugguagucuucccucguuucagaccuguucucauuauucccaagauuguacauccucccagaacccagccccagggcaguacaugccguuuucucuuuguucucaaauacuuccuugaccucuucauaacugcagaucucuuccaugcacucccgcucaauggugcccugacguagcuccuccaggaacucauuggcacgaggaaaccguuucaggacugcaugggcauuuuuugcuucuagaaauacugaggagagaaccacagugaagcaauucagucccuacaaacuagacuggcccaauaaugaagggaaauagggcaaauccuauaggccuaaagccuggacuccaagcaaagaccuggccuauugcaguggugaugggagggcugccuuucuaugaugcugugcucaccagcaggagcucagggucccaacauggccaagguccuuucccauacaaaggaaaaugagaccccaacuaagaaggaacuuaaggcgaaacaugaagaaggaucaguaagaacucuacguauugcagucuuagaaaacauccaguagcuucuguaucuuucuugaaacaggaaagccagagaucuuaccacgagcgcucuuccucuuccaggcugcuacuggagggacugaaauaaggcaugagcugugacuuuggaggaugaaagcaaucaccaauggugggacugcuuacuccucacaguaagugaugccccuauaugcccaggcugacaggucuggccugcaaguccucguuccaaugauccaugagcuguugcauucauauaccccagaaccacucaaggagagaaaagcugaaaagauggaugcguuacuucugcaugagccugcccaacucagauggguccagaacuauucacuuaccagccaugaugcuucuucagcuccagugucucacuugccugucaagggagaaaagaaaaucauggugaaaccuucuggggucuggaaugugaccucccaccaaccuagcgaaaagaucaaagcagcaucccaugaggaacagcacccucauacagccacuccuaacuccugcugcuucugcuuugucccaaaagaccuucuccagagcucuccaaagcccaggagagccuuguucucaaacacaagacacaaaacaugcgcgcaugugcgcgcacgcgcgcacacacacacacacagagagagagagagugagagagagagagagagagagagagagagagaguuaguucugugagucucugaccuaacacucccuaucccuucaaugaaucuuuuccccuucagaauggaaaggaccccagauacagaugagaaaucaagcccaaauauggggucaaguaaaggaaaaguuaagcaaauugacccagacagagacaagaucuggaauugcacuugauggugaagaugagucccagauaccucuagagaugaaaguauuccuuuaauaccaaacucaaugcaacaacaacaaccaucucaaauaacccagucuagcugagacugacauacaguaaucuaugcauaucuguugugcagggucagacccacuguguacaacauagauauagucuuacacucccugauccaacucacugggcucaaacucaggcaaucugcucagcucaguuuccccagaaagagagagauguuugaacuucucuggaggcaugcccaucuuuuaucuuagcauuaaagacuacugcagcagacaaccuugguaaaaauauuuaaaagaucaacacgaagacacaggccuugggcuauaacuuguucauacagcauguuccaggcauaucuaagaauguggguuuguuuuucaggaucacaacucacaaauaaguaaguacaacacaauauaauaaaucugcaaugguaacuuagaggagaggccucuaucaaaaaguaccaucauaaagccuuuuucuaccaacacaauccuaaucuccuacccauacacauauucacacauauuuggaagcacugucuaagccaucaccuaggagcaaucaucccucaguuccccuccccaagcagaagcucauguuuuaagacuaauaggguugugagacacaugagcuuuggagcccauuacacuacccuuuuugccuaggcugccaggaaguucaguguuaacauugauggcccaauacaagugcucuaaaagcccagcuguuaugcacacaugcuuuucuguccauaacuugguacaauauucuauuuacucuuccagaguauaauccuauuguguguuuaauauaugucuucuucuauggaaaauaaggaggauaaaaaucaugaauaaauuuuaaaugaugggaaaaguaaccgaucucacagucaucuguacuaucauuguaucauggggcuuucucuuuagaacaaauggaaaaauaccagcagaccacuauauaccucaaguuucacaaugacaaaaagagaacuaucaaaaagccuaugguguccauaugaugagggugcagggagaauuggauuagggacaggauguuuugguuaaagaaaaacaaagcugucacaucagaguuugaaaagaaugagcaaagcuuucacuaauuagaaagcaaauauaucccauugcuuacugaagugaacugcggaguuuuaaaaaaaauuuacauggaaaaauuauauaagaacuuuacauacagcuaucuuuggucccaaccuaacacuggacuuccgggcauucauaugcacauacgccauagccccaaguguguguuauccuguccuggaaaagucauuaguucauuucugagccucaaagaagccaggaucucccccagagaguucacaaaccauggaccacccuauuagcaauucuguagccaccaccacuauugcugcuguugcugcuauaagggcuucucccccucgcuccccaaaauguagugccugcuuuuuccccuauaaauacuccaucaauaggcaguuacuauggcaacagugaggaagcaugagggcuccacgacagaaaacgcagcugcagucacgcauauauaugucccuccagccccugguggauacuguacagcugacuguaggcuaaaagaauuuuuaacccacucuccacaggaacacagcugaauccugauauucuagaaaggaaggaaggcagagaacuagccaccacaaagaccuuccuuaacuccaccccaggcugaggccucuggaccccagucucugggucaaaacucccaaaguaccucccuuagagacugguggcccccgugagcaccuggcguaccaagaccuggccuccaaagccacuucuccaaauccuagccccugugauuuccaucacucagaacugcucgccaggaaaggguucugcuauuuccaaaucucgugauucaucaauucaccacaggcaacucccaaauugugcuucaacucaaacucuggggucucuuguccccuuccacucauaccggcccugaaagggccuggcuucgcccaccuucgcuggacaccagcgcccuugugaagaacuccugcuucuggcccagcaacacuguucuccugggaucuacucaagaauccaaacaccuuggccugcuugaccuccaaaucuucccuccccaacagugcccggcucccagcucagugguccugaacaccaaaccgugcccucggggcugggggcauccaaccaaauggccucaccguucuccgggcccaggaggcggccgcccuguuugcgcacgcagcccgccaccccucugcugcuccucuucaagcagggcccguguccccgcccaccugcuccgggucggccaagcccccggcccaucccagcggucuccucccuuagucccucccugucccgcuucccucccaccgccccuggcgccccaucgcccgccaggcccgagccaaagagcgccuggagcccccgccccucgcagccaagcgcacaggccuugcccauuaccucggcacccccugccugccccugcucuccucugggggcuccgccagacccuccccccgcacucugccgagccagcucuggccucgcgccccgcgccuggcgugccacucucgagcgccaaaaccgccuugccccgauagccaggccgcaauugucg

SEQ ID NO: 9535 - RNA, 4998 nt, Mus musculus
cucuucguucccaaaccaaugggaagcgggcugugcgcgcguggagcagugggaacgccgcugaggcugcgaguacgccguugccuuaacaaccgguggcagaguccguugggugaugguaagugcuagggauucgguggaccccacgcggcguccccgguccuuuccuaggccucggugcagccuugcuaccuuucuugcacgguucuuggcguugacgcacuaguucuuccuuggagcugugugccggaaggguagaagagaaaguacagccgccagcagcuugccuugccugcucuuucccacuacccccuccucgcccaagucaccuucagccacccccgcacaaacugccucuggaccuccgcuggcuuucaggaaacagcagggugaccauucuauugcuucccuuagacuuccgccucagucaaacucaggccuccuggccgcggccacccaguuaaaguuuaugcauuggugcuaagagguuuacuguguucugauggucgcaaacgcuuucaggagaggcugugagaaagcacgcaggugcaaaugguuugauuuuuaucacuuuguaccggcauaauuuuuaucuuaguaaguuuacauuuagccaaauuuaggcauaaguaauuggaggagcagaguucuugggaacuggcaccacaaguagauguuuuaaguacauuucuaaaaccgagaguacggaaaucauauacaguugaucauccauaacuguaauugguuucucaaagagcuuuugaugaugcuuuuuuagauuuaaaaaugacugaaauugaaucuccuaaagugacacauggauuaaugguacaauugcaugaacuuucuguaguauaaacuuuaagacaguggaggucagaguuaugucuucucaugaaggcuauguuaacacuagaaauucauauucauauauucacuugcucuauguugaucuauacaagaacaaggaggaaaaugguaauauacuauuuuaaaacaaaaacucucuucuauuugguggcuccccaaugaaauauaguugaauuuagucauaugagacaucacauuaagacaaauuuacaguuauauuagaaaauaaccucauuauugccaauuucuuuuuuuauaacuuaguaaaaacugacauauauaaauugaaauaguuuuaaguugagagaaaguuuuuucuucacagagguuugugcuauuugucauuuagaguugggguuaauuuuauuuuaguuuuuacacuuauuauuccuugguggagaagcacauuuuagccugaguguggcggucagagaauaauuuggaagaguuaguucucuccuuuuaccauguaagcaucguuucccuuuucaucuuugacaacgacaacugaagccuggguccugguucccacuuagguuaucaagcuuggcagcaagaauucucacuggcccauggaaguuuacguaaugacauaaguacauuacaaacgauggcacaccucauugaaaaagauauguauguuuagagcugucauaaauaaaacaaggacuauggcuuguaauaaugugcuucuguguuuauauauugugugaaggccucuaauuuuaagaagacaaccauggcauccagugcccagagaaaaaggaugaguccuaagccugaacuuacugaagaccagaaacaggaaauccgggaagcuuuugaucucuuugaugcugauggaacuggaacuauagacaucaaagaacugaagguaagcugcacacauccuuuucuuuguuaccuuguguuuccuuauugcuugucuuuuagcuguuaccguucuucuccuuucugccugcaaaaaguaacagacaaggguacccuguguauauuuuaccugaaacaauggucuaauugauaaaguugauugcaaauaucaauuaaaucagccuuaaguguucccugaucauuuccaucauuuuaucagguguuugguuaauaucuucaauagucauuuuuguuuuuacguuauguaucuauuuagaugauucuguuuucauuguagguggcaaugagggcccugggcuuugagcccaagaaagaagaaauuaagaaaaugauaagugaaauugauaaagaaggaacaggaaaaaugaacuucagugacuuuuugacagugaugacucagaaaaugguaaguuaguuaagauaauuagcaugcuuucuacccauaaugguagaaacaugagaaucuagacauacaaagagcuuuauccaacaaaaucuaucccuuccacaugggagaagauaguauuuuuaauugagaggaucucuacguuucauuuggcuuucuuuaagguauuagcauuaucuuguuucauguggccacaugauaaucacaagcaguaaaaacuuuuaacaccgagauuuucaaugcuagucauuuuugguuuuaauuuauuauuauuaaaaauuaaauuaucauacaauaaaucaggugucaaucugacauuuucagacaaaugguucacacuuaagauugguuccuagauuauucuuccaccugaaccuccuggcaagaaccuuccugaaauagcugagguuugaacgcuuucagaaauucugcucuucugcauuacaaggacucagggcccugguaauucuuugaaggccauugugaaaaauaccucucuccuccucugccuuuaucagucuaucuguuuuagcaauguauuuucccugacuacaacccuacucacugcuucuauauuuuaaaaaugaaucuagugucugcuuguuuuguacaguacuuuauauacaauuauauuuccuauguaaccccugaguuuauauucacuuuacuaaguauguuuucuuuuuuuuuuuuuuuuuuacaauguaccauacuuguuugccugugaccaaggacauauaucaugacagcuaucaccaggaccuuaugauaaugugggccauggccggggaauuaaucuaagaagauaguuuuccuacaacucccuucuugggauuagaacugggcagcguucuauacaagacaaagcacaggagggacaguauagauaccuggccagauccagugucagguguuagaaagaugagccccagcucacuccagaggcucuugucuucuaccugugaaaacaguauaugacuguucggcuauaauaggaaccuguccuugccacaugauacuuugccccacccccccaacaaguccucaugucuauuuuuuaggacuucuugacuuuuucaaaagcaggcaucuuuuuucuacuaaguucugauuugauuauggaauagaugauggcagaggaaguagaaagggaauauaugccaccaugaaucagaggaccuggcuuccuaacauuguucaagucagguuuuuggagacaaaaagaugaccggggaguagcaagaguggcuggauauaaguaacuaucacuuuuguguucuacuccagucugagaaagacacuaaagaagaaauccugaaagcuuucaaguuguucgaugaugaugagacugggaaaauaucauucaagaaucuuaagcgcguggccaaggagcugggugagaaccugacagaugaggaacugcaggugagaaaaaggcuauggcuuucguggguucuauuuucucuauuuuccuucuuugaaggaaagcuaguaucccucauaccuguggugauaauuucauaccuguggacccuguuucgauaauacacauguacaauugaaguucccucauuuggguuucaggucagggugacuuuccagcuucuuuucaauggaugcauaugacagucauugagauuuggcuuuuaaguaacuuucauagaaaggggcauacucacauuaaauggaccauagucaucuuuucucauagcauuauuugaaguuucuucuuuuuuuucuuuuguuuuguuuuucguuuuuuucaagacaggguuucucuguguagcccuggcuguccuggaacacacucuguagaccaggccggccuugaacucagaaaucugcuuuugucugccucccaagugcuggaacuaaaggugugcgccaccacagccugucugaaguuucuuaucuaauuacuuucaguuuaguuugugacuuaaucuaagaugaacccuuaucucugugcaggaaaugauugaugaagcugaucgagauggagauggugaggucaaugagcaagaguuccugcgcaucaugaaaaagaccagccucuauuaagaucaguguuucuuuuucuacugcaagcacaugugacuagauuuagugccuggcauuuugugaaauauggcuuuugaaagccucccucccccaaccugggguaacuuuagccaugaccuugaaucuauuuuugacuuuuggaaguguucuuugauauuaaguucuuuguacauuuaccugcugacuaaaucaacagggcagaacaagagcacauagaguggggaaaagggucugaaagugugacuguggccaccccaccuuccauuacuucaccuugcucaugcauauccacucgacugaaaacaugcaguggcuucuuaguuguccauguauccaugucaccauaagcagugguuguucuuaaagugguuuugguuuucauuugacaccacaguacaguuuucucuuuuacaaaacccaaugagugcuugcuguggcauuuggauguguguuaauguauuuguuuggucuuuaaaaaaauaaaaccuuucuuaauuuaagcucucauucuuuaaaggaugaguauuuuuuagcuuuaacugugaguucaccuuguaaacaacuguguugaggacagccugguacauauauacaauuugucaucggccuauggauuaaaaaaggguaauaauucuuuguaacuuuucugccauaaauaguuuuuuugcuuucagaacuuguggauuuuuacagcuaguagaauuucuuaugcucuaagccuauagagucuuauguguaauuucugcuuggacaaaauggagagggauggg

SEQ ID NO: 9536 - RNA, 44207 nt, Mus musculus
uguucucgggcgggcggagcccaguccgugccucuucguugccccgcgcgcuucccacugcguaccgcuucccgcgcccgcugacgcggcccggcuggguucagugcugcccacccgagggagcccgcgcaccacgccuguccgacccucugcccgucacacaagccgggcaccuguaccagguaggguuguugagucgccguccuaaagaaguggcucgaccaccgggaggcuacaaggagcacccaguucguguccuccuggacacaagccagggccucaguuucccuaccaauaauucauacucgcuccaagcaucccucuucggaaucccgucagggaggcagugcccucgguuucugcuuuucaccgcgagugaagagacaggcaacguuccucagaguguccaacaaaagcagguggcucucuggcuggucuagucccucugaccuacucauuuguggaugagaccgauuguuaguagacugccagcggggauggggcagggugagccuagaauugguguguugcaagcaucacagaauuccacauccuuaguaaaaugugcccauuuuauagaugaggaaacugagguacagaggcaagcuuacucaauaauccccucacuggccuggagcccagagcaaagggacuuaauggugguuugugauagacauguacuggucacugggcgaccucagggcugggaagggagcugcucauacucagacagaaggcgccgaaucaagugucacugugguguuaucagcgggaucugcugugcacagucucuguaacuggauuguuugugugggagcaggggagagccaauagccucauccucuuugcaacugcuuagugauagcuuggccucugagaaagguuggaaacgcagauccuccugucggccaugccacuuccuucuguacuguggcaccuggcagcuccacugaguaaaaggagaagccuaucaggcccaccuuccccuccaaggcuguggagucuauaaaguauguugggaguuguguucuccacaagccauugguacugacucuugacauuaagguagguggugacaccugcucuuggucuugucuugcucucaugguucuuuggauuucuagucaugggcaggaagcagguuuccacaggcugauaaaccugaauaauggugaggggcucugaacuggagagcugcaguaggaagcuuaugaaguucuuauuuucccauggccucaacuggcucuucugcacaaacagugccaguuugggugggugccaacagaucuccaggguacagguacaacuuacuggaggccuuucgagaaugugcuguccaucgccuucagcccacucacuacaagauuggaaggaacagaaccaucccaucaauuaucagugcugaccgaggcugugcacucaguggagcagaacugauagaaggugccuaggucaaagcuaaguacacagcagaugcucaaaaucuguuccuuuuccuccucugggcacucaugagucagugacaaacauggcucaugaccacagagggugcugcagcuuugaaggugaaaaguguuagccuggaucauggaugcaacccaagauggaaagauuaggaaggcucccuggaggagggaaccuuugaaaguugagcaggucaagagggauaggagagaaaucagcccuucauuuuaccaagaagucucuagagauagguuacuccagaaagagcugccaucuggaugguaauaggacaaaacccucccaacuuaguggugagaguaguggucccaggaacaacuagaauguagcaacguccuuccucaaagugcuuuaggccuucuaagaccugguagggcaggaacucugguuuccuagcgcucgggaccugguugaggugggcacugguaccuguucccugaacuguguucaguugugugccaagaaaacacccccaauuuuggcuuugaugcagaauccuguuugaugaaagccagaagccugcucuucuccuuucucauugaagccuccauaugugauuuaucccuuuaguuuagauguugccucaagccauacccuauauugugcugggucacacauaacacacauuuucuuucugcuugcuaaacacugaggcccccuucauugccagcccuauagugacauggaacaggaucauugaugggggucugggguguggugcugggagaaacuucucguauuacacuacagacuuuggacacccaugguggguacuuggccugggugcagacaacuugucuggcuucuuucucccaaacuaggccccacuucaccucuugcucccacggccaaugaggaggcaaauaccauccuagguuaaacacuguccuuguaucaaggugcuugaauacaaggugggaaaucaaaaccauaagagguugcgugguaugcucaggccuguccaaguggaugguuacuuaggcugggcucugaacucaguguggccucugggccuuucucuuacccauggugcuggaaagauacuaucuucacugaccacacacccugcuacgggcgaucuguuggauaguuccuccuccugaucugccgucaguucccuuagcacacggcccugguccugguaucagcugguucuccauuggcauagcuggugucaguucauuuuucccaaagagaaacugaggcacagaauggaggcccuuuaccuucucuuguggauccacgugaaaacauuuggcaggucuuuucagcucacugucccugcuaggaugaccaaaguaaaagggugugggcagggaagagggagggggucuggguagaaaagaagcuggaaaacgaaagacccagaggcccugggcauguuguucuccagggcuuaugugcaaacuuaaacucagaggugaggaggguggacauagagcaguuuuuuuuaaccuacuuguuaaugccuacauuguagccccucuucuugcacagcugcccuugaaguuacugcugguggccuggggaggcuguggagcucuggagacacacccaagauucagagaagacuuggccccuagggucaguagugagcaaacccaagcuacuggugguggcuguugguggucccugucuuugguuccaucugugggcacacaucaggcaugagguucagcccccuugggcugugaucccuguggugguuggcucagaacaccacuuucugaugacuaagucacuuucccagagagcuugauguggcagaagguugcuauggagagaggaggccccaggauuccagucacacgaauggggaucccuguugaaaaugcugacaucaggcauugccugguuuaaccuauaaagagaaaaaacccacaaaacccuaaaagcagaccuuguuucaccauuucugagcaugcgcacacucagcuccuacucauucuuucauaguuuaggaccugguccaagggcacauccuugggaaaugcagcacucuggcaggggccucggggccugucuguuuuccucugauucuugucuaucuccccagcacccagcccugacuguuagcuuucuauggaagcuuguugcagaaaaggaaaugugaccuugggcaaaugcauacuucucuccuggcuuccauauuuuuaucccaaaauggggguaauuguagaagcaaggguggagugaaggggacuuugggcuugagauggacagggaaauacaagagaguauagagggauugauggggagaaggcuguaaagagaaacauuuuuuuuuggugcuagaaaagcugguggguaguucuuuuuuucauucucaguagaggaucacuuucaagaugggcaaaagcaauuugaccaaaauuagaagcaaguggggcugagcuccugggaucaugugugcuccggaaaaggucaaacagguggcaguugugaggacuugggauacacaugaaggauggaggaagguugguuccaggauucccagccccuuugaccucaugacauguccaucuguagauggauacagcaucucugagcgaguagggcuggcuugagacuuuagauuucaguuugcagaaauaaccguugugauguagagauaugagagaggugccuaggacuguggaggaaggcauaggaguuccuccgugcccuuucuugugggauagcugcagagguaacaacaauaguaacaauguaaauagcucauauggggaauuggagccaaggucuuguugggagcaagaugcuuuccacuacccucagcaggcugcccucauccacauaucucagggcauaucucuaagagcucuucccagcugcccuuagugguccuguaggccaagguaccccugaagucucucggcaucuucaaucauuuuuaaauacaucucucugagaaccagaaaaugaauacaugagagucaggggauucuaggaucuuagaaauggaagauagcuaagagaaccccuucccccuugguguugcagcucccuaccccauugaaaaggaccuggccugccucagacaucuuccucccaggauuccacuagcacagacgccaagaagucuagaaucugggguuuggggaugggauggugggaggugaaauuccagacuuucaugcagaagucauuuaccuguaaagcacauuuacaaauaccacucccucccaccaugcuugcuuuuuuuccauauuacauuuucccucugcaacccaagucucuuccaacucuuuuuuuccacguaguauaccuccuuccugcugccuuguuggcuugccggcgggagccccagggaguagagcauugcagacaggccacacacuccugccagagaggcccagcccucaauuccugggaccuguacacugagcagcagacuuaggagcucagaccagagccagcugcugcucagccuuugcucuggcagagccagcgcugucuaaggucucuaaaucacuugcauagaucuuagucccuccuggaccagugauaguagugucucugcuagcuccuuacgguuggaaagcaauccaucugcugacugcugcugacacuccagugcaggacagugagaauccgaaugcccaggguuacaaaaccuggccacagggaaccuguuucacaaauggaacauuucaucauuccagucuuuugggccuggaaagagaaucaaguuggcagcaugagugguaguuuaggucagccuggguccaguuugugggccaagugcauuccuugagaagggauuggacuaguagagcuaaguaugcggaauaugaguggggguguugagguugugguuccuaaauuuuagcauuucuuggccccucauccuccgggucaaguauaccugcucauccuugcacuuccuuaugaagccucuagagggagacugccacagccgagauuuucacuacugugcuggccuuccaucacauacaaagcagcaagcucuucuugggcuccauugaugagcagagaagcugcucuaaagccucugcuuuccccacaggggggaaaaacagauauaagggcuugggugcauuuugauaaaagggcuuccuuaaggccauccuugcaucuguuggcauagguuggauugggcaagaagggaggaguggaaguacucuggccaaggagcuaccuaaucugacuggacucuggagcucagaaaguuuggauucucagaguuuuggagcucaaacuaagcucuugcaggacagcuauagaaucaggggccuguuucccuugcagauuuugauuuuuuuuuucaaguuugguccugcacccauacauggugguaagggaccaaggugcuguguggggaggaggguuugcucagggugagagcaaguaugaggaugcucuucccacagaccaauggacucucugaggcugccccugaucucaagcagugcccauccaagagauuagcguuaacugcagccuucauccaucuuugaugagugaaguuucugggagauugaggcugcucucagggccccugccuggcaaagccagagauugaugaucccugcaaaaggucugcaugcuuggagagguggaguugggcuuccucuccucuccucugcauaaaauaucacaguuuaucuuugacagugaagcucuucucccuccuaccucuaccucuuacuuguuuuguuuuguuuuguuuuguuuuguuuuguuuugagacaggguuucucuguguaucccuggaacucacucuguagaccaggcuggccucgaacucagaaauccgccugccucugccucucgggugcugggauuaaaggugugagccaccacugccaagcuuccucuuccacucuuacuuguacucagacccgugccuagcacaccaacauggaaacaaaccccaucaccuauaccuuaggcacccucucauugucacaccacacuaaaauaaaaacugauuuuucucaguugguggaguguuuaccuaccacgaagcucuggauuuaguccacagcacugcauaaagcaaauguagugguguacauacauauucccagcacuugggcaauguagacaaauggacaaaaaccaucacacuuggcuacauagugaguuaaggccagccugggaaaaugaauagauggauggauagauggauggauggauggauggauggaugccagccugggaaaaugaauggauggauggauagauggaugccagcuugggagaaugaaugaaugaaugaacgaacgaaaacaaaauaauguuaaaggcuuugcuucuuucucacucccaguuaauuucuauugacaucuagcaccaauuucaguuucuaagacugggagcaaauuugggguaucuugaucuggcucuuccagugagcugcccuagucugcauucuauuucagcagugaucuuuuucuuuauuguuucucaauagagaaucugaaauaacccagacuggcuugaacuugcuguguagccaaggaugaccuuguacuucugauccuacugccuccaccuccucugugcuaagaaugcaggaguuuaccaucgaccuaguugugugguggugagaguggaacccagggccuuguggaugcucaacaaguacugauccaacugcacuauaugccuaggcccuuucauguuuacuguuacuggaaagagaauuguauuucugaaauguagucagaucugaggggaagcuggugauauggaagcaccagccccaguucuuucuggcacauauccuugauccuuugccuguauuaggaaacuucuagacaacauggcuauuggaucuaucaaggggaaaacucacaaguucuggguuuaauacaaggccuagcaugaaugcagcugcuauaauggggaugaacgucaccugcuugcccaguuccucuguggaaaccaguggccacagucccuggggucuuggaaaggaguauguccuugagguaccuuacagaaaauaaguuaagauagcaaaaauaaaaaauggccuaguacaauuugagggaccaaugggcggcgcauuugcuuucaugcaagaggagagggacuguccaagguuuucauauuuaauagcaugaaaagaccuagggcugaaggcucaggcuuuaguggucugcauacaaacacugacugaaucaugcacucaggcucauguagucacuacacauuucugcuaggaugcagacaauugaguuuaugcaaccauaagagcaacugaacacugauguggcagcuucagugccauaaugagguuccauuccuggcauguagaagguucagccugccuggacugcucacuugguaguuuaugggagagcaggcucuugcugauguggcuaauuuaguuuggucuuggccuccuucccuuacucuuuuaguguauccccgauuuccacaaaaacauauccagguccugccaguuggcaccauuacugaacuggucaaaguguagcccuggagggacccaaggggguggcagaccccagggagaaaggucuuucugccuuaucacugccagggccuugcuuuuuguccuguucacaccucugaaccucccagacucucuuuauguccaaaggagccaguuugguuauuaauauauccaaaauauccaaacccacagucuaguccuuuccucuuccucagcuuugggucucucagccuggcgaacagauuauaaagaaccuggaaccuguugacucugaccagucuccucagcugaugccgaggccacuccuuagccuuuggucccugugaggaaacaggaugaggagccaaccucaaauagggcugcaaauauccacuuuguccugcacugguuggagaacacuagcugagagcguuuccuccagcuuucccccagcaaacagauuuaaagucacuaugacuuggcuuauggccagcugccaaugauaugccugacuuuacagcaguccagaaauguagaucguuucacuuucaucuuacaggugauaaaacugaggcaacccagagagauuaacugauuugcccaaagcaugacagcuaguguaagaaagaugauugaguccuaaagcugcugguucccugaacccuugcccuaccuccaaaucugccugcccucaaagguggugugucugaaaugugcuuccuucaauccuacugucuggcucagugccauacuacucuccaugacacuguuggaacuuccguauuacuaccugcucccuuccccagacucuuuccauuagcacucucugugauccacccuuaauaacugacuagaacagucaguucuugacuacccacauguuuucauauucuccaggugagcagccauggcuauacagguagguguagcacccacgguggaaugugugcuuaguccuugaucucucucauacauuuggaauuccaccaauucuugucaccccugauaccugaaaggaaaccugcaugaucuuggugugcuccagguucauuucucuuuuaugaugccauaugugagacugggugcuaggcuagagaaaauauauuuauuuacuucuagagacucaaggccauaggggguagcaucgccuugauucaaguaaggaucucauggcugguggcauuacaguuuugggcaggagaaccugaguuugugagauggaaagccagggagaaaccagagcugggccagacuugccuuuugacaacaaacacugaugagaacuaaccaguuucucucaagacauuaauuccaucauacagaagcucucccaauuaucuauccaaccuuauuuugugugagggaguggggaugggaauggguauggauguguggguaaaggggcuaaguauggaugcacauguguauacauguucauaugcacacgucaaagucagaggucaguaucagguaucucuaucacuguuugccuuauuuuaugagauagggucuucuagacuggcuggccaccaagccucagggauccucuugucuuugccuucccagugcuagagcauaaggguguguuaugauggccagcucugacugaguaauuuucccauucccccaaauuucauuucuuaaguguccccucuuaauacugccauauugggaccaagcuuccaacacaagagcuuuuaggggacaaaccacauccaaacucuaauggugacccacaagccauuacaauucauguauugacagauuugucuuugucuuuguucccaggagcucacugaauccacuaauuaaagagcugaaagauaaacaucaugaguauuucuuccuuaggaaguauugggaaaggugagccugggugccaugucugccugaauuaucccaggcaaaccccuagagggcuuaugcauacugcccaugcagcuaguggaugaccucauaaugggugggcuggcaagagcccugggucuaggggcugugguucccuguauaaagcucuuagccuugccucugccagggagaacuguaccaucuggugaagaggagcgcaauaauauccuaagacagaugaaaguacggacuacacuaaagggugaccagagcuggaucaccaagcaugaugacucugaggaucauaccauguaaguccaggacagaaagccagaggggaaggcugcaauagugagggcaugugacccagcccuuccuagggaugcugaggacauuccaccauuuacagcucggucagguuguguguccacuggccagccaggcgacauuaaaacuugaaaagcuguacacagccacaaauaucgcaauccuaugugcugagaggcauguguaaagugggucaggaaaggggaaggugaggugcaauggcgguacacguaaggcuaacuuugugauagagccacaggaguggugguggugaggagcaugggagccacuaucuucagggccugucuuucugcagagagccacucucacgucacaaccgagccacauccuucucaucagucagagacgaaucaaaugccagguaagaggugguaccuagcugacucuuaaguggaccccaggaacucuucugcaaagaaguguagaucucacagaagagaucuacaugagaagggcauggaggaccuuuaaugagucauuuguaauguucuuugaacuuuccuuuuaguguuucuggaacuuggccaucuccaagaaucugcuaagaacaagguuuauaggagugaaugguagaguucugugguacuaguagaccugcccagagcacucauaugcugaauagaacaacucuuggcugaguccuugucaucuugcuuucugcuuucauacuuccauugccacuugggagugagugcuucaaggaccagaggaggaaacauucuagaggaguaggaagggaaggccauagagauuuaccuuccaucagaacaucccagguuugggucagccugggcucugaccaaaggacuuucagucugauccaggagagaacagauucugcaguaaauguccagccauaaagcaagccuggccugguaccugcuguagguuaggcuaugcugagcauggcuguggaggagucagacaucgcaguguuccuggaagagacugaaggagagauagguggagcagagugggcaccuggucacaguauuaggagaucagcuguuguaguuggaaauaggauggaauaaguggucugaaauccauaguaaggccacgauucccuugaugucuccuuuuuucuugucaggucuccaaacgcaagggcuccagcugguuacauaauccgguaagugacuucuagacccuaccugcauccucaugccacuagagccacuagagccacacccagacuucucaauaccuucuggugucucuuguaggggaguguucacccgaacaauagauagcucuucucacucccagcaucgccccucuaagaccaacggagcuccaagaagguacauccugguuagauagucaauaggaagguugggagagccuuguccagaaccaagucugagaaagggcuagcaaaguaauaagagaauguccugucuggcuuauucucagggacagaggcugggagagggagauccucacccagggagagggacucuggacagagauguggauugugcccacacaucuucauuuuacuuaccccuuguccccuuggucucacagcaagcaccuugcacuugcugaaggcacugagccaugcgcuuaguucaccuuuccaguaugacaaggcaucauguuacccaaacaccuugauaccagucaaaacuggggcacuauuggagaagauauggaagagagcccaguggguucuuuucuacccaguugggucugcccuauucagaaugccuggccccuauccugucucucuugggcuguguugguaaaccuagaggcaagaggggaccugugguugggcagauggaaaugacuugcucuucuagugcuucugggcagcugggagcagcuaauucuggucauccucuucagucgucuggcuauaagaugacuacggaagauuauaagaaacugugaguauacaguggugcccgauacuggaccuacugaaggcagguagacacuuaccucugagcacaaccuggggagagcuauucuaguggcuuaacaaccccugccacuuauagauguggccuggagcaaaggaugacaaaacucuagaaaaaugaaugcucaugcccaauacccuccuuuuaggaggcaaagacuguuggaagcuucuggaaggagcauaugcgucuagucaguggaccaugagccauagcuaugggggguucacucucuggguuuccuagaugaacucccuuccccauucaggucucagguucuugggcugggcugggcugggcugagcuaugcuuugaggcaugaauuuucuuagguugccacuguccccguuggcuauugguguggguauuuuguaucuaaagcugagcuucccuugagguuccuuccaaggaacccuagacuggaagggggguucuagacagaugucuggauugugccaguacuucccaguaguccacaucuucauacagcuuauucauugcccccaucauccuguuuuauggcacagcuggcaguauuucuagggaaguagugaaacugcaauuggcugagggugguagccuguagcagggaacaggaaggacauggaggaaaaagagucauaccugcaucucucccccacagagcaccguacaacaucaggcgcagcuccauaucagggacugaggaagaggaggugccauucaccccagaugagcagaaacggaggugaugguguuuguuaugggcauacccaugggcagggcaggggccagagucuucacagauugcugaaaggaaucauacaagccagaguacaaaaugcaugacacauaaaucaugaggacaccccaugucuuuccaggagucuaggaacuaucucucagugcuaggccagcucaggaggcacuucugagaaccuuccagggauagaaucuaggaaacacagguccacaaaaaaaggcuuaugugcagauucaaaaggucccagggaacuugaaaaauaugcagggcaaagugcccuaggaggggcgucugcaguguucuuugaguucaagaauggauccagaauuucaaaugcccugugcuuacaaagaaggaauccagacuaaaggccaacaucugccaacccauaugcuuuaggaagcauagugacaaccccuugcuaaaggcccuguaaggguguccauucugugcaaaaagaccacaguugcacaaggccugaaaucuggauagugcaagggacaggcaaaugaauaagcucugaugguggcuccuacugaaugcuguucugucaccugcuuaagugugugaauuuagucaaaucaccagagcaguggccaggcucagucaguaauggaguaugucggcaccuacuugccuggguugggagagucaaugaaccauugugaagaugucugcauugcugagcagggcacaugcuacaugcucccuaaggaaguguccuucccuccauguccauugucccucugaauaguucuuagagcagugcuuccccauggugugcuccugagucagacagugaacaucccaagcuagacugacagagaggcuagacugacacccaucaaaugucccccuuuauacuaccccaggucccaggcugcacuugguguucugaggaagacagccccccgggagcacucuuacguccucucagcagcuaagaagaccacuaggugaguuguccaggaaugagucccugugagcuugagccugccuuggccacugcugacuccauguucugggcuccuucuuuuuuucuuggggcuucagcuuuccuuugacuggugaaagaaugaguugaauaccuccaugagaauucuagcuugagcuccaggguucucagaugcacuucuuagaaagauaaacagacuaaaauuagguaagguccugagaguuggaaagguucaggcaacuggaaauguucaggacccuauagggaugggggcuaagaugacaccugcccuugaacuuuuuccaacauguuccccauucugcuuccuuucuagcaguccgacccaggagcugcagucgccauuccuugcaaaaagguaaguaucagucaggaaagccagauagcaagccugcugucaguagggaugcugggaaaaagaaggaagcucucucugagcaaagagagucaugugaugccaacuccggcgucuuuuuggaggccaggcaaagaccuagguaacuggugacacaugugucccuuuuagccaguucugugcaguuaggagccuggcugagaaaaugcuuuugcuuaggggccuuagcaaauguccucacuccuuccacaagcugguaggcaccaagaaaccaacauagcaagacuccuugcucuugcccugcccugugcucuucuaucacccagaccuaggaccagaaucaccaagagaaacuccaugggagcugacugugauguuacugauugguccuauggggcaaacagggugaaagagggaaugaguccuaugucgguagucuaguugagugagguaagggucucauuauuugacacaggucaacaucucuagagaugcaaacaggggaagaugaggucauacuaaauuaggguaggcccugaauccaaugguagugucccuucgagaccaaggaaauucggacaccgacacaaagaaaaguccacaugaaugaagacaguggccuaaacuggaaugaggcaaauacaauuuguuccaacccugccaacaccucaauuucagauuucugaccuccacuucugggguuuuaagccauucaguuggugguaccuuguucuaguagccacagcuaagaacacacuauucucuguuacuuugucuauggaggagcaaggugcugccaacccccguaccuuucacugcuuauuguauuuuagucagcuacugucaugucacacagcaguauaucuacuucugggccuuugcaguggcuaggccuggggcuuggaccauuuggagugccuguuccuuguugacuuuacaccuacagcuuacccucuuugcaucucucaagaacguauuucuaacgaagucagacucauggguuccagggacuauuccaaugguuuuauagucaccugacucaucuggacacuggugaaagcacacccuucaaaggccaaaaagcaccaagguaacugagaagaccacaggugccacuuuuuccgcccacaggguugaugugguagaugaggacguccuuccugagaaaaaccaggaaccaccugcucuggcaagaccugauccuggccgaagcagguaaucagucacuccccuugggcugugagagacuggccacugcagcaguagcaccccaguguuaagcuugcacccggacuucuauaacuuggccaaguucagccuaccugggagacacacuugucuccaacacuucucacaucugccuucuuugccaguguggauggagguaggacccaaauaucucaggacauucuaauugagugcaugcuaaacaugccuagccccucuggaagccaggaacaugucaagaaucaucucuaguauaugagcugguaauauggcuucucacuggccuggcuggcuggcucuggcagccagggaaggucuagcagugggguuacagugcagggcuguuauuuucaggcugcuaccccaaugaccuuucuaaaaugucagauugacugugucaaaccccuuaccuccacuucaagcccauuugcagcuuccccuuaccaggcacaucugcuagaaugcccaccuagaagccccuucauugccugagaguagccuaggguuagcucugggugggagacuggaaccaagaaggcuuaaggacgaagaaaagaugaggaccaggagggagagguaugggucugguuaucacacugcagggaggccccagaaggaggacgcccaaagaugcugacacagagugggaggggaagccucuccuccccccacacauugcccaggcucuccuuuggccuacagcucgacaaccgagaagauugcccaucggcagauuacaccccccacagcagaacuccaccugguggccccagaccuggaagcccugagguacugaggccccauugcuguccugucucucuuuagccuuucucaacaugagagagaagcaggagacugguuuguaacagguguggcaaaccuggcuucuccaucacuaucuuauauacauuuaaaauaauuauauaaugaauaauuaugcaauguaauuuugugaggucaaagaccuggccuugggaucuaaucaugauugggacuuccugggcaagaacuauugacuucaucugaugaaggagacagauagaugcuaauaugaacgagaucagccuauaaugcuggccaugccauguaccuccaugcccucagaaagugacaagacuggucagcagagcuggguggggucaaugugucuguguaacccuuuauuaaaaccagaguguuaauuauguugcuuauaggacaaggcauuuggaacuggguggaguucuugggucugccuccauaguucacaaugccacagugcccugugcuugguauaagaauggaugaaggggcugcauccaucaaggagcacaaagauccaagcuccuuuuccuuggggugggcacgcaggagacaggccagcucuaucuucaaacucugugucaucuuucuuacuguccccccucccccaugcugccuuccacacaucuaccuaaauugauagcaugaaagaacagugaguagccuagcagguuaugcagacugggaauaacacagaagcaugaauguuucaaggacagauugggggggggggauaaaaggagaccagaaacauguggccaaggaagcagaagguuucacaggauugagggaagagagaugguaagucugggggaagagacccacuggugacccaaaauaaugcugaaacugacuucuggacuugguaacaaagggcuccugaugaccucaggacugacugagggguuaggacaggaacucagaagaaagccuugucacuuguggaacuuggaacacaccacucaggccuucugagcaucagguggcucaucuggaaaaagggcauguaacgauacugaagucgauguggagaauuaauguguggaaaguuggaagaacagagccuggccccuagucaacaacggugacgaauaaugaggauuugugaguuggucaguucaucauuagcauauuuucagcucuuucaaggcagcugucauuuaaggaugagguaacugccuccaucagaguguggguggaggaguaaagucauuucuuaccuccgcagcucuucccaaaaagccuugugcacucagccuaaagguuucugguagccuggguccaauguuagcagcugacauacagaccagcacuauacuacuguugcauaucugaaaaggaagaaguagagcuagagagcgugggucuagggggagcagaacuauauuucaccagaggcgcaccgacuccagaccaggcuaucccucucaaaguccuugggccggcacuauguugucauuugggagcccuagaacccccucccuagagugaagugaucccugggaaugagggaaggggagcuuggaugaaugggaaagguuuugacuucucucucuggcuuacuagcagcccagaauuccucgugucuugcucuagugaccauugaccaucaauguggcuaccucccucugaguuuucaccuuuuguuuccauucuuguuugaaagcuguuaaaucugaauagcaauguuugccuagaguccacuggaacuuggauuggcucugaucacaauaauuuagagaggcaaagauuucugcucccaagucaucuaaauuacacgaggucacagccuaaugaacgugcugaaacaggcauuggugcaggaaaaaaaaaaaaaggugagaugccagugcuucccaccgccauuaccaguaccacauccuuugcccaugcauguuuuacuucuuguuggauuuucuucuucuccagacuuagccacuacugaacccccaucauugacucuccaauuccugcagaacaaauccaagucccuaacucauagcuauaggcccaucccucagcaaggaauggccucggguacaaugaauguguggggaaggcagaaaaacaaaaaacaauaacagacuaaugaaugaccuaauaauagaggaaucucugccuucuuacaaagucugccuuccccacauacucaucugcauaaguagccuuugucuccagggaugccucuguuuuaguuuggaaccauguuggaauugguagaacugucacuuuuuuuauuauuauuauuguuggucugaagagagcugaaacugcugaagggccagcccauccucaugaccuccugaaguccaccccacguggauccaucccuugaggacacuuuucuaggugcuuucccagcugguucucccagcagcagguucauuuucucacuaaucuaccuaguugcagcgggugccuggagacagauaaaguaggccccaccucgguaaucucuguuuugaagaggucugggaaaggccauuaggccagggacucgguucuuugaguugcuacuaauguaacuuuuugcuaucuuugcaggcaucagaaagaucuuucccaaauaaaccacaauguguuuaucccccucuuucaacuucucaauggcucucuacuuccuugaaauuaagccgaaaccccugucucuagcuccuauaguucugcauggcaguggggacucccuauccagccuuuucuuucuccuguaccacagugcugcaaacuguuucagagugcuauuggcuauuguagaagacaucugaucuagucuggcucugguggcuuucuuuuggacuguucauuggcaucauccuuccauuuguuuuacaugaagcuaaaccuuaaacucauuugcaaaauaacaugaaguaucuuucuagauuuguaggauuuagugcagucuguuacaguuaucucacuuauacuaguuugaaguuugauuuuguauguauauguggguguacauguguaugcaugucuguguguauguucacauggguaugcuccuguguguguguguguguguguuuaugugugucuguguguuuguguaugcgcaugugugucaagaccagagaucaacuucuagugucauuccuuaggcaccauacaucguguuuugugagacaggaucucuuaucaggaccuaggauuuaacauguuccaaagcauagaguaguugaagacuaaugagugaggagacuggaucagggccguguuccauauaaugaaauuuuaucagguuuuaauccaaagaagaacggcugugguuuauagacuuaaagaugaauagguauuugaauuuuaacaccacacuacagucaccuuuuacauuaaaucauaugcugggaggugguguggaaaauggaucuguaagcuacaggccuuguuaugcaccuuuuuuuuucuuuuaaauuuuacuaacgauuagaacugaggaaaauaauagcugaugauagcuacaguauguuguuuuuauguacuuuacaguugccucaauaacccugugagauggguaaauggggaaacaaacagguuaagugauuuauccaaaaccauacccgugguagcugagagcuaaugaacagccucaaggagaaaccuucugagaaacuugagcaagcuaguugaugaaauguguuugaaggcuaaugucuccuuccagcugguguacuuaaucugguguuauuccccaagccaagaaagauuucugauugugcaauuugauagaggagaaaacuuggguccacacaugugaugagcaaauaggaauaaacucuaaaucugcccuacugcagagcucaggcccagauaguaacauugcucuaauauuuacccguuugaaaaaucaaagcaaacauuucugaugacacuguuuaauaacuggcuauguuuggauuguuuuuuuucccauuuaaauuaaaaaaauuauauguauaaguguuuugccugcacauguauguuuuugcacaccacccauuugccacgucagugguggccaguagagagaggacaguggauccucggagacuagaguuagagauuguuucuagcuguaugugggugcuuguaauaaaacuuaagauuucuaaagaguacacacugcucuuaacugcugaaccaucuuucuagcccuucaucuggggaaauauuaauaacaagaguucuugagauuuuuguuuaauuuccugaagguaugucuccagcguuuuucuuaagcauuucaauuuccucucuucuccaguauacacuggagauggcagcucucaaucagagguuuguccugcccaccccuacccucuugcgucauacaguaguaaccgaagauuuuuuggguugccacaaccgaggguggcuucuaaaggcuaaaaaucauggaugcugcuaaacgaccuauagugacaggugauauuagugccucauucucaacacacacaguauuauuauccagacaaaaacguuaauauuaauauugacaagccuugcucuagcaacuuauguucacuugggggaacacacacacacugaggagugugucagcauagaucuagucagacugccgcagacaggcaccacgaauacggacgcaugcacccgugacugcagcagauuucuguugcgcaggcagauuuggaucgcuccugcggggggggggcggggagggaaggggggagggggcgcaugcgcaugaguaagcuagccagcuccaggguaagaauacaccuacucgcgcggccauuuccugcagccgcuagcucaggcugaggugcccgcuaugaaaggagaguacaaaauggcugcuccagagaccagcuucuaaggggcuccuccugaggcagugcuagcuccagccacgagauggcgcuggaggaucacaaauggucccuguugcgccagugcacucccguuacccaucccccuacuaguaaugucagagggcgguugacuacaguagccuacuuaggagugaccaaacccaaggauaguccccuuuccuuugauaaacagugguugaugggcuugaggacagacccaggugacaaaguuaauguaaaugucagaagccuuaggagcuuuacccaguguucauuugauugugcaaaguggacuaaaugcagggauucuugagcuugaauuuaagcccaagguaacuuuaugggacccuuggaucacucagcucuuacaugaacaauaauggaaauaguuuccaccauagacaguucaaagaguuaaauggguuuacauauguaaagcaugcaggacacugaggaguguguacaaaauauuaucaaaugcuacauuuauucuuuauuuuauuuuauuuuauuuuacuuuuaauuuauuuuuuacacuccauguuccauucccugcuccccccauccacccuccaacugcuccauaucccauaccuccuccccaccccacucugucuccacguggaugucucuaccccaccccaccugagcucuaaacucccuggggccuccagucucuugaggguuaggugcaucaucucugaaugaacacagaccuggaaguucucugcuguauguguguugggggccucauaucagcugguguauguugccuguuuggugguccagugucugagagaucuuggagguccagauuaauugagacuugcugguccuccuacaggaucgcucuucuccucagcuucuuucagccuucccuaauucaacaacaggggacagcugcuucuguccauugguugggugcaaauaucugcaucugacucagcugcuuguuggguccuucggagggcagucaugauaggucccuuuuugugagugcuccauagccucaguaaucaaaugcuaccuuuauaaaaccuucaagauagauaaaguucugccaauuuuuuuuuuuguuguuuauucagucauuugauagcacaccgucuuaccuuuuuccuucaaaguuuugguaucacauguuaaaucuaagacuuagauuguuuucuucuuuguuguguugcaaguguggauuuuuucuaguuuguauuugacacacgaaggugaguguuagacauguacucagugcuggcaacuguggucaggcagcagauuacauugcguagaaaguggcauugucuucuugugcaguauguaguuaggucaaaaauuggcagugguugccuuaagcuaccagagucugugaaggcuucagagaauucaacagauaucacauccuaugggccuccuucucucuccccacuccaguuuagcaguagcugaggccgaguggcaagaaauuaagauacucccuucaggauguuauagugcacagaaaggcauccugugaggguuugaccaauaucuuuuucaugaccuauaaagguuacagcugaaacugcaguugcccugcuucaaggcccaggguuuccccauauugcccugccuccgagcggcucuuucugaagaaccuugccucuguuuacucagcacuacuuccuggcagagcuggaaccagcagaggaguuuaguauccucuuaccugaggcugaaaacuucaauuaguuuuacaaccuagucccugaaaagcauggccaucgcacauucuuuuuguucugccagcuuagagccucccagggaugguagucacugauaauggguuuuuauucuguccuuaccucaggaguucccagagcacugcagggagguucuaagaugauaaaauaaagagacaggaguagugaugagagaugagugcaacaccuucuacugucuuuccuguggcccccaccuuugagaggacauugcagacaaacugaggaagacauacccuccucgauggccucagauguagcucgagcuguuuaugucagugcgguagcuuguuuuucuuacuccaggccacugccuggguucucugaaugugcucagaauguugauacccugguccuggggcgguguugacugcuuucucggguuugagauguuggaaugggacugugaucaacauaagaagucugcauguuucuuggugcaugaggcaagaggcaagucuguuucccagagcguacaugguaagcugcuagguuugcugaggacuacuuuucuuuauccagugguggugucaaaguaugacagggagcaugagugacacggacuguggggaagagagaaauggaaugaaaaagacaaggaaggaccacgcuuaagaaagcaaaagagagagugaagacaguuugugugugugugugugugugugugugugugugugugugucugcacgggaaugauggauacugugacuguaacgaaagguaacugugaaguaugggcagauuuucaaaccuccgcucucauuugugguucggagauuuuaaaggguacauaaaaucaaugacauaaaauuagaaauggaaauaucuaggggaacaaagggaauuaguuggagguguguguaaaaugagagucaagguauaugggggaaauauguucaguguacaaaaugcuuguuuuaaauuguccuuauguaacauaacacaguguaccagguacaauaagagacacaacaaaaacauuuuaaaauaaauuuuuacaagaacagccuacggaugcaggagaaaguucugugguguuugggggagugagguugaacuuagguuugaaggcuaaggaagauuucccccaaacgacaugcuaaugaaggcauugcagauugaggaaaccagagacccgucaaagagagguauauggugagugucuuaggguuuuacugcugugaacaggcaccaugaccaaggcaacucuuauaaggacagcauuuaauuggggcuggcuuacagguucagaaguucagcccauuaucaucaaggugggagcauggcagcauccaggcaggcacagugcaagaggaacugagaauucuacaucuucauuugaagguugauaguggaagacugacuuccaggcagcuaggaugagggucuuaaagcgcacacccacagugacacaccuacuccaacaaggccacagcuccuacuagugccacucccugggcugagcauauacaaaccaucacagugaguguaaauuuagagugacuauaggaaagaaaagcuaauuggugcccuugccaggaagcccugaaaggaaacuaagcagucacuuacucaugagcuggugacugcaaacuauauucugaagagcugaaggaccagcgaugcuuuucaauuaggagaggaguucaagaggaguugcaggacugucaggccagggaggugcacagcagcacgaggcagguggcuuguaccgaaccugcggcucagacugagagugaccugauaaggcugcaaggguugcugacuuuaacuaaagacaauagugauggaaaaguaguacccagggaugcuuccauauuucuguuuggggugacaggcuggauguugaaaggaacuagcugaggaugaggaaguuagaggagaugcugugcagaugugacaauauuaaggucauugggccauguugacucugaagcgccuguaggagaccuaggugacaagaagcccacuagguuagaguugaguuaagaucugaccacugacuagagaccugaggguugucaguuuauagaugacaagugagaggaggguauaagagcagucuggaagccagugcauagauacaucccugagggacuggugcaugaagaaggaacauaacucuuucucuaaaccaggaacaugcuuggcauaagccaugagcuugugcaagaccuccugaccccaacucuccaauuuucuuuaucuucucaauuguuggugguuuaacuuaggacacuuucaaaacugcuugcuuucugggaauuggggggcugcuugccucuugagaugggucucccagugcccuugggaaguaacauucagauuccagaggucagcaagggucaagccucugcucuucucuguauaugauauacaauauucauucuuucucagcacuccagauucuugugaggagaacaaugcagcccccaagaucaucaaggaaauaccuggcacccuacaagauggacaaagugacccaacuguggcuucucagcaacuugcagaucucagcauccuagagccacaggguagccccaguggagccgagcagcaaaucaaagccgaggacuguacuaacauguaagagcccacacuaccuucuuacugccccgucgcagcugucaggggccacgaucuaggaaaaacacuuacggcacuuacagcacaagccuauuucucuucgcagcuaugagaggcuaaaaagcagaaggauuugagugcagguggucucuuggagucauuugaaugagagcaccauguuauccaccaaccaguugaagugggaaaacugauguggguuggaguuacggauaugggguguuuuacaacccuauucaugggguuguaaggucugagaaaaguagagccugcuaugaaugagguuauuauaguauugccaucacuaaagcugccaguuggaugaguucuuucacuguuacuacuaccaggauggccagagaaggcaccagugagucaauaauugaccucuguggugcugaccuaggcguguguggcaacugaaauaggcuaacagcaggaguuugaggaaacaagggucauacguuuucugugagaguccaaaagaccaggggguaaagcaguaggaaauaguguuuccccuuccacucuucugagagcaacucaggccucccaccgugugagccuucugacuccuagccucagaagugcagggccuguucacaccaaggaugcuuauauaauauuuucucaaauuauaguaugauuguucuccguucuauucugucaauuuuuauuuauaaauaaaauccauuagaggcuaggauuaaaucagcaauccuccguacucuguaacuuucauuuuuuacggcuuacucuaaugaugguuuuuaaauacuuuagccucucuuuuagcccaccauccaccagagguagugggaaagaaaggauauugaaaauaauagauuuauuuuuaaaaguucuuuaaaacaacucuugucuauauugucuaaaaaucaacaauuuaauucauagguuaauaaugauaguucaguccauucacaaacacuuuauagauagaccaacaguuuaauuugauagaguugaaauaagaaacacaaaugaacagagacagcgaggccucagccucugcucaagucaagagauacccaaagagaugccaggaaaacuucucaacuaugucucuaucaacaaaacgaaaaugaaccaagacacaagaccaacaaauguuauccaacuaguuguauaaacaagccaaguuuacuuacucugucacugucuguuaaguuguuuuuauaugcccucuaaacaucacguguccugcaccagucuugcacaugugucugucucaguugacaucauuuugucaagcaacccaauacacaaaagugacaaaaaacuaacacaccaccaaaagcuucuuacuauguuucucucucccaacaaauagagcuccaguacacaauguaagacagaccaauacgugcauaugguuaccaaagcagccuuucucuuaugucugcuucagcuaaacauucccuuacgagucugucuuagucuuuauuuauuuauuuauuuauuuauuacguauuuuccucaauuacauuuccaaugcuaucccaaaagucccccauacccucugucuuagucuuuaaccugugucuauuaaaaaaaaaauacuccuucccuuguuugccccaacuaaacaccuuccaacauaacugacuuuuuaaagaagccuuaaguuuucacuccaguacuccuuucuuucuugggcuuccuggcuucuucugccacugucuuguucucaccucugccuuuccauaucucaguuccaagagucuuagcaggaaugaggauacaguuggagcccagagagcguacuguucaccagcagacuccgcacacuguuuuucuguuuguaauaagccaagaaaaauuaucuuguaauaugacauagagggacgcaggcaaaguguuauugacgaggaagaucugcagcagcuggaaagaaagaccacacaaaaacaaggaaccaggaagggcccauaagauggacccugagguugacaggaauggaguaaggggaaccggggaacagaaagugggcuuuuguagcucagggagaggagaucauugggaagaacuugggauguuuccuucccgcuggguaugaagaacucuggaggccucuugcuaccuacauugcaggucugggggucuucuuuuucuuuuuuaauuuuaucucuucagugcugcuguucucucucucucucucucucucucucucugucugucugucuguguguguguaucugugugucugugauguguaugagacaugcuuacccauguauguguaugaguauguggagaccagaggauagggucagguauuuuuaucagucuccaccuuaauaauguuuuggguggguauaugugcgcuauguguacauuuaugcguguauaggugcaugguggguauuggugcguguauguaggucaaaauuggcaucagguaucugauaauuuuauuuuuauugagaccaggucucuuguugaaccuggagcuugcuaauuucugcuacuaagcuagccagcuugccccggggauccuuucacggggccuaccucugcagugcugggguuauaaguggcugcugcauugccuagauuuuuauguauauucuggggauccaaacuccagucuuuguacuugugagcuaccuagggaggggggucagcauccuggaucagggccaugugucgcagccagggugacugccuccucaauaaucuacucuccgcccauggccugcaguucuccagacuuugauauugggugaggaaguuaguccuacaaaaagauuguuuugucugauuucuuaacuagcaaacuagacuguuuuucccugcuccuccacccuggcugccacagucccaguaaccugacgggcaaguuaccaacaccaauacccuagccugcaguccagaauucagaguaaaaauuggaaaauggcagucucacgcaugagucauucaagagcaaugauaagggauuugcaccgacuguucccaaaacacuggcaugcuuuuaaaggucuugaaguugcaaacuuugggguuagggcagaaaguucuauuugaaucaagaaguagagacaugcuuacucuuuuuucguuucuuucaggcugaugagcccuucaagcugcauggucacuguuaccaucucugacaccucugaacaaucucaauuguguguuccuggugucucaagcaagguggacuccagcucaacuauguaagaagggccauuuagcaagucuugguguccuuuagcaugggguuuccuuauaaucuccuugcaaguaaaggauaccacuuuccuucucugcuguuuucucuuuuaugucuuuuccagcuccuagcaucccaguagcaaaugcacagauagaauauaguccuuagucccucaaguauaaauuuuacauucuccaagccuauuggcaggacuguaacaugcuuuccuucucagcucaacaagacguggaacauacaaagcuagcagauacaaccaaugggagguuuugcccucuguaugaaagccauggaggccaggcugaucucuccaccccucuuucacugcuuucccuguacuguugaauacccuuagccuacaagaagggaugcaauucaaggacuccgcugagugagcaguauguguaagaucucugcugauuaggccagggggcugggacauggaaaugagggucaaggguggggcuacacugagccagccugaagcaaaccuuguuucuaacgcuugcagaggcuuuccaaaacauagauuaagguuaauguaggccccuggaacccgauugauaauggaguuggaaguguagcaggugaccgcuucagggaaggcaugaguguccauguacaauggcaucagcagccugccaucugucugcagcuuccccugcagccuggcuuguggagcccacuugccccucuacccuacgccuucauugagcuucugcauuuccuucacgccgggcuaggggcacugacucuccucugugggccaggcccaguccucuagaaucuucuaguacacauugcuauuuugcugugcuccuucuacagcaaagggauucucuucgugaaggaguacaugaauaccagugaagugucuucugggaagccagugucuucacacugugacagguaagaacagguuucagcugaucuguugucauagccuguacuaggcccaguacugccuucguuccuacauccugcuaccucaagcaggacuuaguggacaguaccuacuggguaaucuuccaguaagugacagcauacugcaaugcugccuacuaaugcaugauuuauggauuuucagauugucuuucuaguuagguggauagaaaaucuagcccccauguucuuucaugcuagauggacccacugaaccccuguuugcuuucugaugcuaugcaagaaguuacuuccgagacuuuucaguacuauuccacccacucacacucuaguuugugucaaguugauauaaaacuagccagcacaauggaccagggggugacacacagacauauugcuguuaagccaacuggggucucuugcugcaacuggacuguacuuuaaccaauaauagccucucccagccucucuucagggucuccaguccugucacaugcuaccaagcccccaaagcccuccagacuuaccaguccaugccaugaaaucuagugccaccuggcugacuaccaaguucagcugccaggacaggguggagccuugggcaccucuggagcagaguuucugagugcuaaugcugagggcauacuucacaaaggguuucaccuccgugaugcuggugauccccacuaaauuaucaguuccagccaaccagcauugauuaucccaguauaggaaacguuucauuugagugcugcuugcuccuuguuauucacagccaaucagucugucccagcucaucaauaccacagauucuuaaaauauaccaggccuccauagagucuuuaagugauccugugacugcucucuggcaccucacaagccaggccuccauccucugcauuguucucagcuuucugaaacugaaggcaggagcugaugcagcagcccaggcggcacuggagcugaugcagaggcugugggggggaugcugcucucuggcuugcucuuuauggcuuguucagccugcuuucuuaaagaagcuaagacaaccagcccaggaguggccccauucaaaaucggcuaggccuucccaugucaaucacuaguuaagaaacuucccuacagccuuuucuauaggcugaucuuauggagacauuucccccaagugcucucaucucucaaaugauucuugcuuauaucaaguugucauaaaaguaggcaguauaucuagauucugauuucuucaguguauaggcuccuaaaaguucccauaguaguccauacacaaauauauguaguaagacucuacuuuuuuucugcuggucaaaggaacugagggucccacugguacauaagucucaagaaucuuaccagagugucuucuucauucuccaugaaagaacuccucaccaagaaaaaugugccuccuuagcacaagcuuuuguaccaaaagugauuucugaucacaauggugaugacugucaguguagucauaucucuaauuguguguggccacaaggcuaaugagaaaagugucuucuauguaugacuaugauaaugauguggcccauguugugcccucuucuccauuacacuucuugcagucccagcagcauugaagacucauuggaucuggcaaagaaagccccacaugaagguacuccuucugagagguaugucugcuuucuugaacagaggucuuccaguuauguaggugagagaguccuaaggcagaccuccacaugggucuuucucugcugcuuugaggcuuuugaucuguuugcaauucugucauauaguggaacacugcauaagguguuacuaccccaaucgggaugucacauauacggcaacugaagccugcaaaccaagaugaaaaauagggccugaaagagagccuaaggaggcucuugucaguaagauagacucuucagagucgaaucuaaugauucauuugacuaacuugcacuucugaauagauguugaaagaaacaacuacacaagagauugguauguagagaaaaauguuuuuguuuguuuguuuguuuuauuaucaagaagacggaacuaagaaugcacaauguccuagagccauggaacugaucgcuagaugucagcaauaaaaggaugguuuuaaggacaaaaaaagguuauuuuuaaauucuuggaauaggaaagaaaagaaucugcaucagagagugaaucuacccagguuacagugaggaaaaaaggggagaaggaauaaguuacaggaaauuaguuacuggcagagccagaaaugaauccuggggcuugaguacuaacagguuauagagaucucgccccugccauaugucuucucacuuauuaugagaucuaacuuacugugcuuuacacucagaagccacagguagacuggggagaaaguuaagaugaagcaaaucuuaacagugugcuccauuuaccccaacacaaacgaguacaggagcuucuauauaggcaaggugacagaugucccuuccauuaugccagauuacugaauucuggacagucacagaucacuugguaagucauguuaucagauaauuucauagucuguauaugcuacuuuaccaaaaugcccaaggcuggguaugguggcacaugccuuuauuccugggacucaggaggcaaaggcagguggaucucuguaaauuugaggccagcuuggacuacauagcaaguuucaggccaccuagggcuacacagugagaccuugucucaaaaacaaaacauacaaagaaggaagcaccuacaaugacuuauuuaccucuugcuaggcccugcgucuuaaaagucuuaccacaugucauauugccauaguaaggacaaagccucuaacacaugacucucuggaggauacacucaagcuuuguaaaaaaccauggacugcucaggugccugagaauucuacaauuauauaggagcaaaugacauauaucauauuccaguagcaugacagaucaaauaccaugguucucugucucuccauuguuccaauauuagaaucuacauuacugauucgucacugggcuugguuacaggacugggauucucuccaaggacaagcccagucacuugugcacaaguguacacaaagaacauaggagaaacagggaugcacugagaagaggauucucagacaauucuuacauccagagagucagcuauaagccagcagcaggauggcaaggugucuuaggguuuccauagcucugaagagacacuaugaacauggcaacucuuauaaagggaaacauuuaauuggggauagcuuaugauucagaagguuagcccauuaucaucauggcaggaaucacagcaucaugcaggcagacaugguacuggagagguagcugagaguuacaucuggauccacaggcagcaggaaaagagugagauacugggcauggcuuaaguaucugagaccucaaagcccaccccgagugacauaguuccuccaacaaagccuccuaauagugucacgcccuuaugggccuuugaggaggcauuuucauucaaaccaccacaaagggauaaaacaucagugcccauggcagugcuagguccugguuacuagugacaccauggcuucuguugaaucacgucuacaucucuggaagauagaacuccuaauuuaagccuguaggaucagagaauagaaucugcuucggcaguucuuguugggggaagaaaagaaaagggaggaaaagcagagaugauucucaaaaguaaaaggaaucuuggaacggaggauacaacugaucaagaaguaucuucuaggacuuuagcaugaguucugaguaggcuauacaauccaacuaaucauggguggccuugauaguaacuagaagaaagggugagcuccauggucccaggcauguagaagaggcugucaagacugguuuaggagaauagugacaaguugaaaaaccacuuuggcauagguuaugcucccaguuauagaacacagaacacauuggaaaucugggaauacuggcaaaccuagaaagaucugcugcaucauaucagaagugugggaaccagccugacugcuugguccuuguuuccaucuccuagaccaaccgaaggggucuguacuuacuguagccaugagauccaagauuguccgaagauuacccuugaacaucuuggcaucugcugccaugaguauuguuuuaagguaagaaagaggugugaguauucugaugaugacgucaaagagugugaaaguguagaagaaacuggauuucuguucacagcugcaaacaaucucagaggcucaucagcacugcgaguugcagaggaguggugacaguuccacauggcuaauaacaaaauggaggcaaaaagggguggggauggggucuaacgggaaugaauaggauggcaagaaugagaggauacuggauuaaauuuuccuagggcacaugugaacaugugaacagaugucauuguaccccauauacagcaccaaaaacagauaaaagaaauuauuucgcucaagucaaguugggugaaacaaugaguuuaauugggguuaauuacaggauauguaacuuaugacauagcuauaccaccaaagaaaaguaguacccuccccuuagcaaccaugagcugcuuauauauucuuagaguuggguguggugaggccuccugcauuuaguaauaugccucauggaagcuacaaucuucuuugugaguacuacaaucgaacauuauugugccuaaucuuauaaagaucucacacaguuaaucacaaaugccaugauuuuuaagaugugacauccaugucuuaccaggacaacagaguuccacagcaauuuauccaucccucugaauccuaccuuuuugucuacuccaucuuuuuugauguuuccuggcucuuggaagguugugguacaaaugcaugauuauuuucucccacguagaccuaagcacugugcuaccaugccucagcaacaguucuaugagucggcaguguaacucguuagaagucuacaguaacuaccucucacugcaaaagaagcuuccagaugaaaauuaacagcagcacaaucuguagccaugaacaaaugucuauuuaauaaaucaguaacaguauguuccauaguagggccuaugcacuccccagccacugccuuugauagggcauguaugggauaugaauucccuuccaugaagcuggccuuaaauccaauuguaauguucuugguugcaccagugcacauaccugcaguauucauuguauagcgugcaggauccuuauccaaguaaaucuguuggugacaauucuccaucagcagcauuuucuuagccaguagccacuucagucuucuguauccccagcuguuaguaguauugcuaggggucacccucauagacucccaggagccuccuccaucccaggucucuggcucaucccugagaugagccucccugauuuccauucuuuuuugcagcccuccucugccccaccucuccccaccugcugccucauuuaccucccuaccccuccucccauccaguucucucccucugauucacuuccagugucuguuuuauuuccccuucugagugagauucacgcauucucccuuggacccuccuuguuauuuggcaucucugggucugugaauuguagaaugguuauccugugcuuuauggcuaauguccacuuauauguggauguagaucuauuuuuuuaaacaaguguaaguuguagcaaacuaagauaccaauguauagguuuuucauuauaagccuuuuauuauaacuuuaaagcuaaauuuuguuacagauauuuuaaccauaccuaaugaacuuacaaauccugagauuuuuugcagaaacgucuuacgagguuuuuguuugagauuagaaagcaaagaacuuagagagauagaagaauuuuaagaguagaaaauaaagucaaccuuagagaugagaaaccuuugagaguauagagcagaacaaguuuagccagaagauuuuggggucauuuguacaguggcaaaacucguuggaaaauauaaugugccaaucuuuggccauugauugaucuguacugaggccagacuguuucuugaaagacagcgagguuuuaauaaaaucucugaguccaagauaaaagagaggaugggccaaacaagcccaggaggucguaaggagagagagagaccucugggggagaggaggcaaggaaaggguaaguguaguggugaaagaauuucaauccaggguguccccaagcagaaugagagaacugucagagagaaauguaucaaaucacaaaggagaggcauccuuuucuacaagacaggagcccagugggacaagaggagcaucuuagcacaccagagugauuuuuguaguaauaguagacaaagcaggcaacuuuggggugacauuuauccaguagaaaaagacagaagguaguggagaaaacugcugaagaggugaacugggagaggcuuugggggaaaaaaggagcaucuuuaguaaggaggugcccacaugggcuuaacaggucagagagagagagagagagguacccaggugauaggcaucccaggaggauuuaggaggcuccaggagccagagagaccaagagaugcaugaugagugcacaggagguauagcaaacuacaggagccagagagacacuuaccaaguagacaaggagagacaaaugguuagagcagguggagggaaggugugucugaaguggagucuggaauuuggaguacaauaugguagauggcagaauccagcagaaacaaaugaucuauacauaucuuaggaaagucaaaucagcaggcuaguucagagcggccaggucccuugggaaggaauuaguauaugcuacucccaugguuucagcaccagaugaauguaaaaugaggacaugacuucuccuagggauaguugcugagaaggguuuauugcagauaugagggagagaaccgccagaggcaccugaaagggucuagacugaacuaaaccaugacaggggaaggacaggggaggcucaagagagggagaaaaggacaggguggggggaacuaagagaggagcuguagaccaagaggccaagacaggaagcuggagccaagagaaucaagacagcauggacccagccaggugugguggcacacgccuuuaaucccagcacuugggaggcagaggcaggcggauuucugaguuugaggccagccuggucuacagagugaguuccaggacagccagggcuacacagagaaacccugucucgaacccccccacaaaaaaaaagacaggaagggcagguccuggagagguuuuacacaggggauggagcuaagaauuucuaagaagaaccagaacucucuaacauguacuaggagagccuggcugccauguuugcuuuaauuuguuauagguaucucagcaauguauucuggauuucuuugauaccuaacacuuagcagucuaagguggucccuuaagcuuuauggaauucaacucaaaccaaacugagauuuuuggcuuuaauauggaauuugaaaggaauuuuagaacuggcuuguauaauaaagauauuuuaguaaucaugaguguuaaaagaaaaauaugacaaguaaucgugggucuagcauuccaagugaaagugacuuuuacacaugggaauuuguaauaucuuaauauaggccacuguccuccccuuugauauggaaucucauuguuaggagauaaaaaugaaguggcaagucagaggaagagaugaacauagacacuuaucucagaaagcauguguaacuuugauauaaccucuaauuuuuuauuaauuuaaauucauuuuagugucacuguugacauuauaaguuuuuauauauaaguuuuacaucuuauugucaugaaugaacaauuuuaucauuuuguuacggaucauuuuacacuuuaauuuuaaugcccauuucugauuauuuuacauauaaccuauggcuuuuaauuaagugcuuaaaauaaaccaguuuaagaugauaaauuucuuuaguugagaggaaaucuuaccuauaguuaggguuuuguuuugguuuugguuuuacuuuuguaaguugaauagcuacauuaauaaacauaaaaccagcugggauugaagaacucauuuguuuuucucacaacaaagaauucuauaaaucaagauacuuuaaaaacauugguggagaaguuaaguacacacuuagcauuucauugauugguuaacuugcuagauuccagaaggguuuuuguuuguuacgaugugaggucuuuuucuuuuagugagaggaugagaagaagcaagaacuugcuguuuaguaggucaaagguaacccaagaugauugauuaggcuuuugaacuucacuauuccagccucuccacggcauuaauguucuaagcagccaaucagauguuuuucuaggagaucucauucacaaaucaaucuagagagaguggucucuugucaagcauuugacagugaagauguuaagauggugacuggauugcucacagcuggcaaguugugaugauucaaaagauaucccaggauuuuaugccuaagccucaugguaaagaaaugugauauuauuugcuaccaugggaaagacugaaaaggaacaaguuaggacauaaaugacacuaaaugcauuuaaugagggcugguuuacagguucagagauucaguccgucaugacagagagcauggcagacacagugcuggaggagccaagaguuccacagcuuuauccaaagguagccaggagaaagacacccuccucauugggcagagcuugaccaaagaagccucaaagcccaccuccacagugauggaauuccuccaacagggccacacuuccuccaaggccacaccuccuaguagugucacucacucccugggccaagcauauucaaaccaccacaguauguguguugcguagggaaaauauggaacuuguagcaccaguggaaaugcaccugcaccuggcugguaucugcaggugcugaggcccugacagauagucuggggaagugccugauuucuaacauucuuuuuuauuauaaaaggucagggaaaaggaaggggugauggugaagcaggaauggaggugcugugcucuuuagacugcuuccugcugucugaaggcauugacaucuuugaggacccaagaaaguugauaugcuggccaaguccagaaauaacagacuguuucccucaauauccaggcucucugcaggacugucugggacuaggaaaguguaggcuuaauugaagcagucugaggcuggacuaccuggggcuagcugcuuuggaacugucuuggaugucuuggaacaccuaaagcugggaggauguuggaguauauauauacauauauauauauauacauacauggcagaagauaaagcuaaggaguguagggagaauuuuuuuguuagguguacauuugaaacuuccaggccuaagguccugguaguugagggagggaagccccaugaccagggaaauggggugugaucucacccucaggaauaagugaaauaggcagaugcagaaacaggcuguugauugacaguauuuaucuggagucuauuugaugcaagagagguagauuuaagcugauuacccaaaacuuacaagauuuuuuuuaagguuacaaaagagauaagucuuauauauauuagcauuaauguugcuuguaaucuauccugaaauccaugcuggagaaaaagcaguagauucacaucuuugugucauaguagaagccuggggauaucauuuuggguucaaagcaugaacacuuuuuaaggcaaguucagggaggacagaaaccucccguggagcagaagggcaaaagcucgcuugaucuugauuuucaguacaaguccagaucaugaaaucagggccuuuuuccucuguccagaaacuggggguauagagauuagacagacauuuuuagcacaguaccaaguauagacuuagaagacaacuaaaggaaauuuaaaauauugagcuuguuacuaugauaucauuuugaagugcuuuaccaaaacuagauuaauagcuuaccagaacuucauugauuaauguauuucaaaagccgcugagcuuuugaagucuuaauauaacaauagcauagagggaaagaaaucugaaaccguuuucauuuuuauaccuuaaucacuuucuuaucacaauugaagcuuucacauccucagaccuuuuuaacuugcauauauacacaacuucuuagaccaaaaacuauuuucuuagauccuuacaaccuaaccuuuuguauccuuagaccuuagaugaacuuuacauuuuuuuuucuaucuaucuaucuaaucauucaccguaagacacaggugaaugauuacugagagaaguuauuguaaagcagguuccuuuaaauaaaggaauagugaaaguuacuuugauaucuguuuugugaguuuaucucuuuuccgagucugguaaugagguaaauugugucuaguccuaguugaagcuccaggaaagugaggccugaggccugauuguugcaccugaagagaacugagaaggcagcuggggacuucuugguugcugccguuacacugacaaaggugucacuagccuacucaucaaucccaucagacauaugagaaggauacauuuuacuugagcaagcaggaacuacaggccaagcagcuuuugaaucuauuaaaaauggcagacuuacuggcuaaccuggacagucaucaacguagguuccuccaugguuacuaggugcagagucccaggacagaguuagucuucaaccaccaggaccagaaaaucggacaaacuuugcuguggaguaggaccuugggggugggggaaccagccuggcuugucuaggcaaagcagugcagucaacuccccaguguccugcgugcccacaguuuaaacaggguuggcacuaaauuucauccucggcucuacccagcuccuuuuugcugccccaagaaaagugaugauuacauugguuagggccagucauauacauuguccauuuucugcaugcccagaagagacccucucaaugugucagcaccauucuaaguccauguucuagucugguguacaguaacuaaaaggauagaaacauucuguaggaaauagaagcauaauugauuuacauugagggauacucugccaggagaaguaaguugggaaguagaaguaugcagauugccaucagaagggugcauggagaggaugagcaaugagcuugggguugucgaaaggcuauucucuccuucccgugcaccuuuggcugccuguagcuagaagccucaggcuggagacauugagaguucuggcaaaccuggcacuucauagucucuuuuuacucaacgcccaggguuaggaaguccugccacugccauuccuggggacacagguuuaugggagggauuggguuaacaaaaccucccuucuucuguggggaucucuaucacguucuucuggaccuuaaacauucacagcuuccagccucuccuaaucguauaggugaggaaaacggagacugggaaaguuuuaguaauucagcuuauaaauaaauaaaagucaagauuuuaaccugggcugaucaugaaacugcagccccuagccaggaugcuaaucauccugccagugugugugugugugugugugugugugugugugugugugccauauagcaacacuggaugucuuccucgguugcuugcuguguuauuuaagaacaggaauauuaguccgagcccuagaaaucccaugccugccauccuagcccugagauuacaguuuugugccucuacacccagcuuuuauaugagcucuggagaucaaaucugcagcaagcgccaucuccccagccacuaccagcuuacuuuuggugcuuuauuguguguuuaucuugcuuuauaaaucacguuuaauaucuguguuugcaaugucuuaucuccuuggaaguccaggaugugccaucaacucacagcuuugagugcucaccuccauuuugcuuuuuuagugcgggauuugcaauaaaccgaugggugaucuccuagaucagaucuucauucaccgugacaccauccacugugggaaaugcuaugagaagcucuucuaggugaguuccggaagcucauaggagaagcaucccagagccgaauuaaacuaaaggagcaagacaaaaauuugcuuugguuuggacauggguuuuacuucaggacccugcuaugcuucucagccaucuaauuagagaaucucaaguccuuguccuuugcccuaugcuucuuugagaucuuaaguaauguaggaaccccuccccacccucaccuccacccccacgacccuuuccaaguuguuaaaagucauaguaucuuccuuuacagaaauaccucacccauguagaaccgcagcugaaucuguuaacccuggcacaccugggccuauuuugugacaaggaaauaaauauguagaaagggaguguuucuaaacaaacauguaggugguauauggaaaaaucucuaccucauuucagcucucaaauucuaguaccagucucugccaucuucaagcauuauuugcauagcuuuagguuuaggcuuaauaaccaagauguugacuaaaagcucucucugggccaguagccagugggauuaucccaagugucggaacacaacauauuuucccucucugguuaccugaagguugacuuaucuccaggaaaugcuuuuugugcugggcuugggcucacaaucacugcaacaguuacccaucccaaaggacccuggcuguaagggauuagauacuucaaucucaccaguaccucuauuuccuuuuuugguuccuccaggcugaacagaagcugaugauccccagcuguauuuggcuguccaguugacccaaauuguuggcuccucgucacuuacauccuccaugguuccacuguacuucugccuaccuugugcggaaggagcauacaucuaagauuguguagccaugauguuaugauuuuguguagccuuuuauaccuuaggaauaucucaguuccuugcuuccaggaugaaugaguccacuuugaccucccugagacauguuuucuaaugagugcagaugaccuaguauguuagacauggguacaagucuagguaucagcguaugcagacuuucugaggcuucugagagcccaagccaaaaaacuguugacgaucccugguagggaaauuacaggcauuaaauacuaaggguuggcaauaggcuacuguuuagcuugucuauucacuuuguguguauguguguguguguuuaaauuucucacauuuuaaaaauaguuaauuuuuugauugaauuacauagcagauuuaaauuaccuccuuccauucuccuuugguuuuuccaguaagguaugucagcacauguuggaaaguuuacccagguuuaaauuugauaagauacaauauuaggaggcuucuaccaaagggauaucugugucuguuugaauuuuguuaguuaguuaaaaucuuuacccucaguauugcugaacuuuuauccucugaacagcuuuuaauguguguaaaucaggguaaagaaaacagauacgguuucuugagacuucuguuccuacugugaaauauuucccugaagcguaguguuagaaauggcuuugaaaagugugaaauucaccccaucucugggcuucuugggucccuccuugaaacacuacgguaauuuaauugcucccuuucccucuccuccagagucuuucacccagagacgaauuuggcuuauguaacuucucaaagaaaagcuugcuauccagugaaacgucaaguaggcucucugcccugaucgugcagcauuuugugaccuguuuucuaguccugaaucugucucaaacuaacaucaacuucuagguucccagguacucaaaacacuaccaguugaugucuggcacagcagaggcagguucgucccugcaguuugcuaauaugcugcucuaagucaaccucacucugcugccuuugggcucagcauuaaauuggaagcuccuugaaaggaaaaaaauaguccucaagacuugggaaugcaaaauugaggcuucuuuguuggauugacuuagaagauagcucuucacucucugcagacuuugaaugggcuuguucuuccuaccagguaaccagagaagaacauucuauuuauuugacuauuuaucuguuaccugaacucugaagggaagaaggaguacauugugccacaccccaauacuaauuaugaacuaguucuuucucaaguucagcucuaggaugggacuuagcagagaguggccaauaacauaugugugccaaaugaauuaguaagagaaaacuaagucagucccuuaauuaucuaggcauuucagugcaggccucauagacaagaguaaaaggcucuaaaucggauggcuuccccacuuaaagguguacucugccauuuaaggaguuuuagaaauauaaaauauacucaaagacagcuuguaaggcuaguauugauuugaauccaaaacagcccuuuugugucuuagacacaaaauucugcagcuaacaaagagagaugguuuugcauugauuugcuucuuuuuaauugcuuuccguuuuuaauuauccuugcuuaauccacauuaauguacacaaauuauaauaaauguuaagauguuacacagcaguauuauaacuucuuuuuuaaacca

SEQ ID NO: 9537 - RNA, 3125 nt, Mus musculus
auagccagaacauucaugagauuuauucaacaaaaauuguauuaaaaccauuaaaaacauaacagaaacuuugaguggucacuagaagccauaggcucugcucacacagggccuucugcuaucucaagagaucacucacuacaguguaguucucccuuauagcauacacaguccaggcacagggaauugguggaaccauagcaugcaacaccccaccaacccuagaaaguaaaauuauaaguaauaacaggagaggaauaucacacauagucccaaguugaagucaucagccuugucaacauccaugguuccagaaccaggcucaggaacucagguuagcacacacaucugcaagagaacaagcagcaggcagcuggccuagauguacacuaggaaagcugacaaggaguucacaacaccagguggguaagagagcagcuagcguagccuaggcuggcacagaagcucacaacacgugccaggguguagaaguggcugaccagguagguagucagggccuccaguugcccucacucacagcuuuauacaggagcagcugaugguggguaagcacgugauaggggaagggacucacuggacagcugggucacuaugagguuaacagauaagggggcgggguuccagagcagggggcagccugccucuggacagcaguggcaggggaagggggagaggggaaagggaagaggaaggggcauuuguguugggagagccaggcaguuggcagaacccuugagauggccuuuucugugauguccaccuguuugguuauggguggcagauggaggauggcaccucggcaaagcugccaggccacccuccaggucggcaggguuuggggccagccuuggcagcugccuggcagaguuguauucaccugccugucccugcuugcucucuggaauucuccagcagcccuggacaaaagagagcagaacaaacucuccccccccccgcccccugccugcccccgccccacacacagaguccucuuucugcugcuccuguuugcucacacaaaaccuguccugcacacucccaggcucucaggccagcugagggcauuaacccuguggugccaugugccccagccuggggcuuuucucaggcacuaguguccugucagggugucaagaaggaaacugccuuguguuggcacuugccucccggguccuuuggguccugaggcuugcagguuucacaggagcggggggaguucacucacgaaaggacucaagggugcugcccucauggggcuccccuagagcuguguagaugauccugaagacaggcuggauccugcggccuccucuccuggguacugucucccugccuagccgugcuuguucccaggcacugguguccucugcccaagacaacccuguggcaggcuccuccacacccugugcugcuucagugccagugggcauucuuagcucagaacacccauccucaccaucuugugacccacuaguaucccaacugcggucuggauuacccuguggucuaguuaucauacuagcuccccauuucagucucugacacuccccacgguccugccauuugguagucacugagcuguguggaauuuguucuugcuuguugggaucauuucuagcuaguaagaaguugggugccuuacccuggcccuguugcccuucugcaacacucauguccccuguuccuuugucugggcugccccaugauuuugucaaaguaucucuguugccugccacaggaaggaauuccuggcuguccugagccucuauuuccuugggguuaggguggcucacugcccaagccccucucucguuccccgacuccugugcucuaacauaagguuucugcucaucggguucacuuucagcccagaaaccugauuccuuccucugucccucuuccccagcacugugucuccagagcagucgccuccguuucacugaugucaucuccucuccuguggucugggugcugaccucccuagaauccucugccugggugacaacuucauuugccgccucacaugcgcugcugucccuucguaccugcuccugcuccuccacuaccacagugcuuucccacucuuccucgucucgaguaaguuucauuaauuccagaaaaguaggugggcacccuugcugaucuaagagggagagcuuuccccgaaggccaguggucauggagaccugagauaagacgugcuugagacgaauugaaucugcacugugugcugacagugggcucugcugcacugcuuuuugcagcaggggcucuaaacguagcaaguagucagauaccuucucugcagguuucugagaagacugaaggaaccugaacuguaagaccuuagaguccucuuuauuuccaaagaugugcuuuagggcuuucaagcacugcuccacgguuagggagucauugcuaguccacagugccugcaugauugacagggcagagccacgcaagcucucuagaaggcacugcuucuuuucccucucggacaccugccauaacugcaucagcucagugaccuccucuaaccagguuucaaagcuuucuucuccugggccuggaaagggacugccagaaaauacuuucaguuuuuuguaacaugugcuauuauuacacagagacuucaagccuuuugguuugucuuggucuaaauucuuuaacucuauuuucccuguaggaacagugcuaaaccccagggcuuuggccacaucuacuauucuccguccuucaucucuuagaaaguagaucaacuuauucauaaacucaucaucugggcuacgggguuugacaaccacuucccaggccccacccucugcugguauaugaguaggcaucauaguauaaucaacaacuucaggcaguucaauuaagacugccuuagcuucaucuucccuccugaacauccugccuaucaccuuguaugcacacaagggagguaagccuucuuucagagcaucauuuaucgcagccucaguguacugcacggggaugcccacaaugagcacagccuucuugggauccagauccauccccuuacaccagucaucuaauagagccacggccauuguucccucccucuaucagcagaccuaaca

SEQ ID NO: 9538 - RNA, 3125 nt, Mus musculus
uguuaggucugcugauagagggagggaacaauggccguggcucuauuagaugacugguguaaggggauggaucuggaucccaagaaggcugugcucauugugggcauccccgugcaguacacugaggcugcgauaaaugaugcucugaaagaaggcuuaccucccuugugugcauacaaggugauaggcaggauguucaggagggaagaugaagcuaaggcagucuuaauugaacugccugaaguuguugauuauacuaugaugccuacucauauaccagcagaggguggggccugggaagugguugucaaaccccguagcccagaugaugaguuuaugaauaaguugaucuacuuucuaagagaugaaggacggagaauaguagauguggccaaagcccugggguuuagcacuguuccuacagggaaaauagaguuaaagaauuuagaccaagacaaaccaaaaggcuugaagucucuguguaauaauagcacauguuacaaaaaacugaaaguauuuucuggcagucccuuuccaggcccaggagaagaaagcuuugaaaccugguuagaggaggucacugagcugaugcaguuauggcagguguccgagagggaaaagaagcagugccuucuagagagcuugcguggcucugcccugucaaucaugcaggcacuguggacuagcaaugacucccuaaccguggagcagugcuugaaagcccuaaagcacaucuuuggaaauaaagaggacucuaaggucuuacaguucagguuccuucagucuucucagaaaccugcagagaagguaucugacuacuugcuacguuuagagccccugcugcaaaaagcagugcagcagagcccacugucagcacacagugcagauucaauucgucucaagcacgucuuaucucaggucuccaugaccacuggccuucggggaaagcucucccucuuagaucagcaagggugcccaccuacuuuucuggaauuaaugaaacuuacucgagacgaggaagagugggaaagcacugugguaguggaggagcaggagcagguacgaagggacagcagcgcaugugaggcggcaaaugaaguugucacccaggcagaggauucuagggaggucagcacccagaccacaggagaggagaugacaucagugaaacggaggcgacugcucuggagacacagugcuggggaagagggacagaggaaggaaucagguuucugggcugaaagugaacccgaugagcagaaaccuuauguuagagcacaggagucggggaacgagagaggggcuugggcagugagccacccuaaccccaaggaaauagaggcucaggacagccaggaauuccuuccuguggcaggcaacagagauacuuugacaaaaucauggggcagcccagacaaaggaacaggggacaugaguguugcagaagggcaacagggccaggguaaggcacccaacuucuuacuagcuagaaaugaucccaacaagcaagaacaaauuccacacagcucagugacuaccaaauggcaggaccguggggagugucagagacugaaauggggagcuaguaugauaacuagaccacaggguaauccagaccgcaguugggauacuagugggucacaagauggugaggauggguguucugagcuaagaaugcccacuggcacugaagcagcacaggguguggaggagccugccacaggguugucuugggcagaggacaccagugccugggaacaagcacggcuaggcagggagacaguacccaggagaggaggccgcaggauccagccugucuucaggaucaucuacacagcucuaggggagccccaugagggcagcacccuugaguccuuucgugagugaacuccccccgcuccugugaaaccugcaagccucaggacccaaaggacccgggaggcaagugccaacacaaggcaguuuccuucuugacacccugacaggacacuagugccugagaaaagccccaggcuggggcacauggcaccacaggguuaaugcccucagcuggccugagagccugggagugugcaggacagguuuugugugagcaaacaggagcagcagaaagaggacucuguguguggggcgggggcaggcagggggcggggggggggagaguuuguucugcucucuuuuguccagggcugcuggagaauuccagagagcaagcagggacaggcaggugaauacaacucugccaggcagcugccaaggcuggccccaaacccugccgaccuggaggguggccuggcagcuuugccgaggugccauccuccaucugccacccauaaccaaacagguggacaucacagaaaaggccaucucaaggguucugccaacugccuggcucucccaacacaaaugccccuuccucuucccuuuccccucucccccuuccccugccacugcuguccagaggcaggcugcccccugcucuggaaccccgcccccuuaucuguuaaccucauagugacccagcuguccagugagucccuuccccuaucacgugcuuacccaccaucagcugcuccuguauaaagcugugagugagggcaacuggaggcccugacuaccuaccuggucagccacuucuacacccuggcacguguugugagcuucugugccagccuaggcuacgcuagcugcucucuuacccaccugguguugugaacuccuugucagcuuuccuaguguacaucuaggccagcugccugcugcuuguucucuugcagaugugugugcuaaccugaguuccugagccugguucuggaaccauggauguugacaaggcugaugacuucaacuugggacuaugugugauauuccucuccuguuauuacuuauaauuuuacuuucuaggguuggugggguguugcaugcuaugguuccaccaauucccugugccuggacuguguaugcuauaagggagaacuacacuguagugagugaucucuugagauagcagaaggcccugugugagcagagccuauggcuucuagugaccacucaaaguuucuguuauguuuuuaaugguuuuaauacaauuuuuguugaauaaaucucaugaauguucuggcuau

SEQ ID NO: 9539 - RNA, 3407 nt, Mus musculus
ccuccccccacauuagagucucuugaaguuggggccaugccauugaaccuguugcaagacugguguaggggggagcaucugaacacccagaggucuaugcugauccuggggauuccagaggacuguagugaggaugaguuugaggagacucugcacgaagcucucaagcaucugggaagauacaggaucaucggcaggauguuuaggagggaggaaaaugcccaggccuuuuugguggaacuugcacgugauuuugacuaugcuuuggugcccagggaaauagaaggaaagggugggcccugggaagugguuguaaaacccccucauucagaugaugaauuucuuaauagacugaaucacuucuuagaagaggagaggagaacagugucagacaugaacaggguccuugggacacacucuaaucauucaccuaccaaaacgacuauaucagcagauuucugggucugggcucagacucuaggugcagugaugcagccucugcuagaacaaauguuguaccgagaacuaagagucuuuucugggaacaccauaucaaucccaggguuauuggccuucgauuccuggcuugaacacaccacugagauguuacagauguggcagguaccugagguagaaaagaggcggaggcugauggaaugcuuaagaggcccugcucuacagguugucaaugugcuccgugccaauaacgcugccauuacagugaaggagugccuggaggcccugcggcagguauuuggcucuguggacaaccgaaaaaucgcccagcugaaguuuugcaaggcuuaucaggagccaggagagaaaguuucuagcuuuguggugcguuuggagacccugcuccaaaaagcccuagagaaaaaugcaauaucucgaaagaaugugaaccagacccgccugaaacgaauuuuagguggggcuauccuuucugcaaaacuucgagagaaacuuaagaugcugaaacagcguagaaggccaccugguuuccuggcccuagugaagcuuuuccgugaggaggaggaagagugggaggccacuagggguucagagaggagcugcuaugaggggcuggaguuaggcccaagucccucuaacauaggcagugaggagagagaacuauuuguuccggccuuugguaguguucuugaggaaaggccuuaccaggguucccgccgccgccgccacaggaggagaggccagcacagaaagggaggugugcccagggaugauucucaaggcacaagaaagcagaauuaugacacauucugcuauaguuguggggaagauggccauaucagaguacacuguuuuaacccuuccaaccggaccuuggugaaacagaagagacaggcugcaauggagaagggaaacaggagcugggcuugggagaagagccaucccaagcccaagaccaaguaggcuccagggaacaggguaaccuuuguuccuguaagccaaggagaaaaaagagauauuugaaggagggggaagaacagcucaaaaaaaucgcagagaaccuuagaaaggcacaggggcaauguaaucagucagaagucaaggccccuaagccaauaccagcuggagaaaauucuaacaaacaaaaauccauugcauucaacucaauaaugaccacacgcaagaccucuaagauucaccagagaaggaagccucaaggaacugcuacagauguguggggccacaagaacucagaugggggugucagcaaagugaaggcaacuucaaguccauaugggguguggaggagccugccacaggguugucuugggcagaggacaccagugccugggaacaagcacggcuaggcagggagacaguacccaggagaggaggccgcaggauccagccugucuucaggaucaucuacacagcucuaggggagccccaugagggcagcacccuugaguccuuucgugagugaacuccccccgccccugugaaaccugcaagccucaggacccaaaggacccgggaggcaagugccaacacaaggcaguuuccuucuugacacccugacaggacacuagugccugagaaaagccccaggcuggggcacauggcaccacaggguuaaugcccucagcuggccugagagccugggagugugcaggacagguuuugugugagcaaacaggagcagcagaaagaggacucuguguguggggcgggggcaggcagggggcgggggggggggggagaguuuguucugcucucuuuuguccagggcugcuggagaauuccagagagcaagcagggacagccaggugaauacaacucugccaggcagcugccaaggcuggccccaaacccugccgaccuggaggguggccuggcagcuuugccgaggugccauccuccaucugccacccauaaccaaacagguggacaucacagaaaaggccaucucaaggguucugccaacugccuggcucucccaacacaaaugccccuuccucuucccuuuccccucucccccuuccccugccacugcuguccagaggcaggcugcccccugcucuggaaccccgcccccuuaucuguuaaccucauagugacccagcuguccagugagucccuucccccaucacgugcuuacccaccaucagcugcuccuguauaaagcugugagugagggcaacuggaggcccugacuaccuaccuggucagccacuucuacacccuggcacguguugugagcuucugugccagccuaggcuaugcuagcugcucucuuacccaccugguguugugaacuccuugucagcuuuccuaguguacaucuaggccagcugccugcugcuuguucucuugcagaugugugugugugcgcguguguucuaaccugaucagaugcuccccggaguuccugagcuccgucuggaagccagcaggaaccauggauguugacaagagacuggcugaugcucaucuuacgauugauuucagucugggacaggaagaccugaacugggcauggguagggccuggggacugggcugugcugauccccuccuguuguuccuugugacuaucauuccuuggguuggugggguauuccuugcuuugcuuuguaguuucuuguuacuauccugugccagaauagggcaaggccacccuacagugguaaucccuugugagaguuccuaaaagagugaggaaauuuuaagagguagcucuugggccuuugggaagggaaaaauagcagagggauuccaugguggugggcagacaaggcccaucugcgaagcuccaggaggguggcccagaaccuggugcuuccaguggcuguggagagguccugugcugcuaaccccuucucuucaauaguuucagcaaguguuucuguucaauaaacuucauaaauguuccag

SEQ ID NO: 9540 - RNA, 11144 nt, Mus musculus
cagccaaggcccgaccaagugggaugaaccucugaguggaaggaggcugccuuguggagaggaggggacuaggugggugacgaguuuugccggggggugggguggggggggguggggacguuccacagugggacuccgcgggugguuaggaggcacccuuguuguccucgucgucauuguagugggacaguggggucacagaauaugagggucccgggaagccugugaggugacuuccggagcuuucuuuuacuguaagaggcgccagagcugagaaugagaagccaggaaugagaaaaacucccaguuugggguuguuuuucguuguucuuugguuuuguuugguuuuugugguggugguggugguuuuuuuuuuuuuuuuuuuuuuuguuguugcugggucuuguuguuguuuguuuguuuguuuugguuguuuuuuuuuguuuguuuguuugguuccugacugcacaccuggauccuccugugacacuuccauaagcaguaucugagcaggauaguuagucugaagcggaagggggaaacccugggcacuuugcacaaacacaugggcaacgacagggcccaagcugggaauggguaccugauuggcaggccucacaccuuugggaguaccuguaggcagccucaggcaugccugcacaguaguguuucugauaaucagagaccuacuccagaauguggggccucuaucugaggggcgggggaaauagccucucagaggaauguauugaaguguggucaccugggugagugacagggaauuagcagagucagucuugagccucugauggugagaaagcucugucagccugguguaucuggccuuuuggggagcaaaguggggucuugaggcagaagggaccagguuuagcugugaugagauguuuggaagacuuugcaccugguaguaaaauagaccagugagaccaguugaugaaaaugguuccaggagcguugcagguuugaagagaguuggcugggacagugacuuggagaaaaggaaguagugacucuccccuguccuccagggguccucaguggccacaucuggguccugcuucuuugcagccaugggccuugccucccucaacacaaaugccuguguuuuuguauguuuuucucaaagugucaagauuuggucaagaucuagaauauuggugggccauaggagguauuccuaaaaucuguguugaauguugaaggggaugggccaggacugguccccuucaccaaaggacagcaucuccauccaaaucccacaaguacuauacuagcugaaaccacuuaacccuggguauacacaccuucccagccagucagagagaugugcacugggaggugguuccuacauagguaugaccaaccacccucugaaaaggaggaggcuccagggguagaagagaacccuggguggaugauuggcuauuggggaacucuguuuaggggcucuccaguugauacaggguucagaaaagagccuuagcucgugugguagggcagugggaucacaaagaggcagguccaaaccaaaccggugggaccauccuaggaccuucacuuuccaaaggaggccuggcaaggccacagagggcaaggcaagggagcagucauggggcugcauggauugggagggcuaaaugggacagcaagugggcugugagacauggccucccugacugaugaguaggaccuuagugaguuggaauucccaaccagacaucauuagguccuuguauuaucagggugaggguauagggguaggagagcagcagaggguacugaucuagagagguagugugucugggagcuccaagucccgauacagaaaaggggcaugucaggacauugguggcaugcucuuguccucauuuugcuccagcacaagugccaggauacucagccacacccaugguguccuguucccuguuccuauuuccuucuuccaauucuucccgguaucucuacuuccaggacuccuaucuaacacaagaagauucuagcuaugucaagcagaaaaaggaaggccacugacacugcuggcaggcacucaaggauggauccaaaucucuccucagaugacagccagaacccaggugcagucgcagcagguaaaaaaacagaagacaacaacaaaaccaaaacaacaucaugaaaaaacccacaaacaaacaaaccagaggggcuggcagagggcuguguccacccccagcagacauccuaaaaucccuuggcagguggcacacugaguggauguggugguguguggacauuuccuucuuggacuaguggggggagguucagaugcaauuaacugguacucaagcuuguuuguggcuuuagcuuuccccaccugaaauucccaccacacaagaauccugcaaggcucauaagacaguucucugcaggcaauaugcagugugccucucugggaacacaugggucacauguggaaggacagugcauaugccuccaacaucugguccaagaaucacucaagccuaaugaauuuugugugugucuguacuucugugugauauuaauauucucucucucucucucugucucuccccaugcuuuuugugcccacugucacucacucucugccugcacgugcuugugugugcuugcaugcaugcaugcguaagaaugggagugugugugcaugacuucuuuuaaaagugaaaguuacuguagguggcuauuggcucuagaaaccccaccgugagucaguuuucaaugggagaugaugggagaagcucacuuugucucaaaacauuuuucaucuuugucuuuaaauacagcuaacagagaaguccuugaugcugguagggaggacauuauuuccucaggaacagagaggcaacaggccaggugaucaccuuuuuuguuuguuuguuucuuucucucucuauuucucucuauuucucuuucucucuuuuucuuuuucucucuauuucucuuucuuuucuuccuuccuucucucucccucccuccaucccucccucccucuuucucucucucucucucucucucucucucucucucucuuucuuucuuucuuucuuucuuucuuucuuucuuuccuuuugcccacucauaaacaauguuuagaaaagucaggcuggaaagguggcucagugaaagggugcucuauguauaaacaugagaaucugaggucauauucagccccaacagaaaaggccacacguggccacuuaacaccuuugaagcccagaacugagggcugagguguggcagagagcuucuuucugcaugccaaccuaccaaaaauaaacugagagauaaacaaacaaacaaacaaacaaaugcagugguggguaaggugugugaaucacaggaauguccuggaugcauugaguuuaaaggccacaacacauuuguccugcaguccaucagacguucaguguguuacaaaaugaaaaucucaugcuaccagcaaacuacaaguucugucacagaacuugucugacaggaauaagguggaaauugguagaggaggacccccuccacacauacacacauauacauuacuaccucugauggcugcacacuuauacacaugcauuucuguugcauacagagaaaucgagaagaaucagugucugcucuugaacugugaacuguauugaggcuguguggggcacacucuacuucccugcucaugcaacaaaguuggccuuugguauacauugaauuaaagaguuuaugugauuucuuugcaggaaggaaaaacaggauuugguccaagaauucgaagguauguucuaggagacaauucgaauuugagaaaauuguuugagccaaagaagugcaaggcaagggaguugucacuuggcagagaagagaagugggcuuacugccuaguucucaaacacacaguguggaaauaguguuuauuacucaccaagucucuuacuucaccuuaauuguccaugugaagauccuggcaccugcagugggacgauccgugccuacucucugugagauauuuacaaauuggaugaacguaucggucucccaguuuuugauucacacaagugaugcaucuguuuuugauaccacauuuuacuucucucauuuguauucuaguccuguucuucuauauuugguugggggcggcaaugcuugaagagggccaauccugguuaaauagcugcccacaauuuacaaugcaaagagauagcacaggaaguggaaagcugaagucagugcuguuagccuguggcucuaguaugaucaguugaguccugcauuaaauugcugucagagguuagucacaugaacuguuaaacaaacuuaucaacccgagaaacagcugggaggucugcaggcuuuucugauguugaguugcaucuagaaacuauccugaaccucaggauagggcuguagucauguggaggccauugccucauauuguucagggcucuggguuccauccccaauaccacagaguuuuccaugagucaaguuuucccuuucaauuauucaggauguagccgggcgugguggcccaagccuuuaaucauagcacucaggagggagagacagauggauuucugaguucaacaccagcacggucuacagagugaguuccaggacagccagggcuacacagagaaacccugucucaacccccccccccaaaauuuuaggaugucuaccuuaucaaauuugucaaauagccucaagugcuacaaugguuacuguauuuuucaucucacuguccagugaucucugagccguuggagauuguuguaaauggacauuuguacuuugcaucaagcagcccaacaguuccuccuagcauguucuaggacuggaacacucuuaguacauugauuacauucauacuuuauaaaugacaucuaguaaagaaauuacacagugacuugauacccuuuuuguaagucuuguuaaggccccucuguuauguuuuguauguaauaucuagacacugaaguccaacuguccaauuucauggucaggucagagccacugaaauucuuaacggaaagaaaggaggcaaauaaccauugcauugucagaucaucuccaccuauugauagcaagugucuuuccaguacccuugagggaccuucacaguaaugccuacaagauuauguccccuuacagagccaccuaacaaaguucuucaggaaaacagagaaagauucucaaggaucaugaccucaucuuucagugccauggaggucaaaauuaaggauguucugaaaacccacugugaagagagguaggguuguugcuucuugucacuuugaucccagagcuguugacaguugguuugugagcacaaugaagggggaauagccaguggccccacuggcuagaagcuuuguuggcaagugaacuugccuugauuuuucuguaggacagacuuuguuuugucuuauacccucccguuguacugaagucagucaacugcguuuccuaaggaugaacuaagauguuuugacacagggcaguugaaucaguguaacaguaaguaaggugugcgcauugugugaaaguucuggguacauugagcuugaaauccucaaaucauccauccuggaguccuucaucucuucagugugaaaugaaaugaaaaucucuagccuccaauguuguacagguuuccggaggagcccaguucaccauacagguaugcugaaauccucacagguacagugaugaagaguggguaggcguccacagaauucucugaugguugugggugugcauccucauuggaccuaucuuuauaaugggaaaauuaagcagggguugugcucgucagagagacuaauacuuguggaaugcuacuaagacaauccugaguuuucuagcacuaagagcugugaagugacuccugucucggccaaggaggaacacaugcuauuagccugguaggaacuaauccaccucauuuuccauuucccugucagaauauuuuagaucuccuuucccagucuugcauuuagugaaggaaagucagucgugcuguguuugaaugggcuuucuucaugucgagaaggaauaucacaguguucacguugucuuuuacaggcagaaacuuugucaggacuauucucuucaguuuacaaauuugaauaggaaguuaacuucggaugcauacaaacucaagaaacaugccgaaacacucucugugaguaucaggcuuagauuuaaaggaauccauuuccucagcaucagagguagcaacacaggcuuccugcagcaggucuggagggaagggacaggacaugagcucugggagacaaggagggugguugauguggaggggagagacuggucauccucccugacuugguuuuuuaucccccuucugugggaagaugacaaggguaaugauggguuaggagucugcaugguacaggccuggggggaugagcagguacugucugcagagugcaggaggagguaugggauuguauccugaggggggacccuucaggaucgacacagugcagaugccaaagaguaggagggccccacguagccuucugacacagugaucagggaugcggagugagagcaguucauggggcuguggagaagcagguggagacuuagcugccagugugguuggaguucagaccggcccugucccagaggagaagagggaaagguucccaugcagugauggguggaccugagauggugacugagucaacuuuagccuggagaugagaaugggcuuugggggacugguaacuggacucagugcugucucugggggcucuuucuuccugguggaggauggagcugcucccuggggauucugacuuccaaagguggggaagcagaaggggaacuacugagggguauggagauacuguccagcccagcucaggucaggagcguggacucuggaaucccaccaaguggaucacagucaccgucuuucuuuugcuaguuaugcuaacucagaaaaauaauuuacaucugugccuuaguuucuugggaguggaaggagagaagaaguccauacguaucugaaagaauauugucaaagauuuguuuuagauguguauccuuauauugguacagggcaguaucugaagucagucuuaaagaauauaacccuguuaguguggcacugugugcucuacucuuacuggaaaggccaaaguggagugggucccuauguggaggagugacaaaugauggggauaacucaagguagguucuaaaaauacagagaguccagcagauuugaaggccucuaguagguagguuuucaagacuacaggaacuacuagcaguguuuugaguacuguuaaauaggaacccuccccauucaaugagugagcuucacauaaugaagguuauuuuucuacuauuagguuacuccuguaaauguggucacuguuuuaauugaaaacaauuguaaauguuuuucacuccaucucuuuugcauaaauaaaauaaaaaauugccuuuuaugaguuuccuguccccccccccucacuuguucuuacaucuuacacugccuuuguuuguagaauauguuuauggagcaacagaaguuuauucaugaaagucucacucuucagaagaacagaaugaaggaauuuaaaucacugugugaaaaauacuuggagguguguugaacaaccucuacaggggacacugaauauccugguauucuuucugugcuuuggauaacagcuuaugaaaguuaccugcaaacaccucccaccauuuccucaugcuccauguaauccuaaguacaaagucaguuuaauuuuagcauucacucaugguuaggagaaucauucaaagcaggacuugcugccuuggucauuucaucuggagcuguucauauuguacagggcacuaaugcucuucagcucaucccaucuugacucacaguacauuuuuucauuggguaaguauguguacacaugcacacaugcguacuugucugugcauggguguguagaugucggaagacaacucuuacagacacacuucaucauauccuuuuuuucuuaccucuagcuuuuuguuuguuugguuuuaauuuugacacagagucucacuguguagcucuggcuguccugaacucacuaugucgaccauucuggacucaaacucacagagaucuaccugccugccucugcuuccugagugcugggauuacaggugugcaccacugugcgggacucccaugauacccuuuugaaacaggaugacucccuggaccuggaacuauggcuaggcuggcuggcugcucagcaguuccuuugcugccacaggucgaugugucaccaugccugacuuuuaguauuuaugcugaagggcuuacguuggccuuuuaugcuuauggagcaagcuccuccacuacugcugcauucuuaccccccaagaauuacuuuuacacacugcagcugucguccuagacccucucguuccaucuuuaagcagacuaguuacaagaauauuugcacuuacuucccuugcucaguccauuuacauuuccuaucauuguaggacugaaacauggcuucauauggccaauuagaaccauaagacagcugccagguauagcccucaguaagaaaguaaguggaagacagagagauugugaauugagaguuguccuccauaauagugucuguaaguucuugcuaggcauguugauuguccuaugcugucuucagguuuguagcucucuacaagacaauuaaauacuggacgcucuacuuuuguuucagacucaaugugaauuggcuuguucaaguugcaguuaaaauuuuguucauccagaguaauucagaugacccaaaacaaccaaguugacagaauucauccuugcuuucuuaaugccugucuccuacaaaaaaacccuacccccgcacacacacacacacacacacacacacacacacacacacacacacacacacggggcagggguuaggggccaguguguguuccugaugaaagaucauucuuuaaguacucaguagccuagaaacuugcucagccauuccaauguuaagaucucuguguuguuccaguuucuguggucacugaacaagauuauggaagagguccugccaaguuuuauaaugacuccacaguguuuagcaagacuguagauguagugugugcuguuucacucagugccaaagggaauguggagguggaaaccuugaguuuuaaguuccuggugcacaguggucauaguacgggacaagcuauuccaucuugcuaagaagugggcgaguggcaaugaaugggcucaugcuucaugcucuguuugcauuuggcuucaugggcuuucauuugugcugugcauggagaguuaucccagacucucagacaugguaggcaagcacccuuccccugggccaccccuauagcugaucccucacaauuugaccauucagcaguggguugagaaguggcaaagucggugucacuuugguggauguuuugaucuucuucuuguacagggugcgugcucgcugcuuuuggaguaauuuuuggaguaauuaaaccauguuuuuuuuaccacacuugcucccuuugaaauguugauguucccauuugaaagacaagaugaccagggcugauuuccucacauguuuuuugcuucagaaacuggagguacugagggauucucggggaaauuccaucgcugaagagcugagacgucucauagccaccuuggaaaucaaacuucugaugcugcauguaaguaccuagccuuucccauagaaaauggggauaaggccaaccuugagugcuauuuauuuuaugcccauuuaauauuuucauuacuuaacagaaccagcaaaagacugcugcuccuccacagucucuccuggauguguuauucucauaaaacuuuggagcacaaaagccgauaugaggggagcaguauaaucaucugggugaagcugcuagugcugaugauugcagcuucggugccuggaucuucuccugucuuccuccuguuccugaagaugccccguucuguuaaauccaaauaaacccugggauuugugugacagcagugcaaauaugucuguagggaacuccagcccucggguagagauggcaggcuuuccuugguagcaucgcaauuacugguuagcacacauugguguugauacaguagauuaucauaccugaacaucaucuccccaaauuggaaggcacacaagugggcuauuguugucguguccagauaaauaauuagagaagauacaggcuuucuuugacauucugcucugaaauguguucagugauggagccuaugaaacugaccuucagccuccaaaggcagugugcucuuaauaguuaaaguaguagaauucaucaaaccucccgaguaagaaagaugugaguaacguggcuugaaucaguggaaaugccauuugcagacaacauuuacaaggucuuucaauuaaaugaaucugucacacuaagaggugauucugaacaugaauacagcuuaauucaccaugguuuauuaaucccucacuuguauggauaggaguaacuuagaauguuuuguuuguggaauuuaucgcacauguaguaugggaucaucagggauauuauauaugaggucucguguacaguuaaagcucgcguccugugauuuccuguauggauacccugggaaauccuuacuugggaacguuugauuuaauaaacaugaaauaguuucagacuuguuggcaugagucauuuaauugcauucucuuucugacaucccugacguuucaccccuucucagacagacauggccccaugccauguggaggugugcugucaccuguguuccugcauggggccaguguaguccaggccacuugucucauugugucccguuguguagaagcauugaaaacaggcuguguucagccucccccauuuucuccaaguugaauugcauuccuccagacugaaugagggcuucccugcugggaucauuuuacugucuaaaguuugcauuaucuagaagaacuucccccuuugugcaaacuaccuguaacccugugggccuuuaguauuauuucuuuaauaaucauuaaucauaauaaaauguuguauuauuagca

SEQ ID NO: 9541 - RNA, 8126 nt, Mus musculus
uaaccaagaaggggcuuuuuuccugggagguaaaggguucugaggagauuguggugaggcagugucagaggaaggugacgcggaagggaaguacuaacccgaacgaaggaacgaagggacgcugugguaaaggacccuguguucaucaaagugaggaggcuaaggguugauucaaggccguuguaaagguucuaaaggaacccccggguaauccaagugaggcuagaguugauucaaggcuguugagggaggaggugagaaccaggcuaaccugugaagugaugaucuggacucucacuuccaccuaggacuggacaagcccccgagggugguugggaaagguacccgagggccaacggucccgggaggacugagcaggacaguguggagggugguaggugaaguguguaccuacaauucguaacccuuugccugucacuagcuuucauggaucgcugggugcccugaggugcaccuggaaucuacuuggugaguacagcucucaaacggaagugccgccuacagguaagaacaggucauuuucauacagugacccuguuucugaccagaaauaucuggaaagagagggugggacccuggccugugucaccugagcagugaggagcagaggcgacuaggguuugggggugggggaauagaguaagccccaauuuuaagcuuggcacgggaaggauggaacauaaggggugggacuggaggcacuuggggagggguguuguuuguuuguuuuucuuuuuugaucccuuccaguucguuccuccaggacaaguagaaagggacacucaggcccaacccuguggaaaccugaugccuguuccuguggcuuucauuagcuucuuguaucuuuaauaugucuuugcacauacaauguucaggauuccugucuagugcagggagacuauagucauggcuuccaaaaucaagggcagaccucccaagcaaccaaaggugacuccugcucugccaucuaaugauucacagcagcuucaugaaaauaacccagguaaaacaccacagggugagguugggggugagggaguaggccccaagaguggagaucaguucccuaauaugcaagaagcucccagcauuguauaagaccacaugugguagucuaagccucuaauccucaggagguggaaucaagaagaucagaaucccagggucauuuucaccuacauggcaauuucaagaccaaccuagacuaugugagaccuugucacaaaacacaaaacgucaagaugcuugcaagaucauuucugcccuguccccaaaguauagucugaugcauuuagguggagcacagguaauuucuugagaaucacaugacauuucaaacaugaaaacuauuuucagaauguguuugugggacuuaugguucccaagugguguucuuaccauuaguggagcugcaaggaucauagagccucuccuggccugugccaacaugucucauaguaagggcaugguuuauaaugauuagaaacuggaggucuuuuccauaguuauccccagugucucauuguuucucacauacacaaacaugauucaguuuauauguguucuaaaaacuuugauguauauauacauuuagcacaaaucccuuagugcacauaauuucuucauguacgaugaucaaauuggcagacauaacgugaaaguuauuuguuuuuuucuauucaaugcaggaaacaaucuggcccuugaaacuuguggggaaagcaguucuucccauggaacagguggaccaaagccaggugaugugaagggaauuuucauuguugguaacguacuucagaaaagcacacuucugcuccuguaacacauauuccguguaaauucugagacagaggacacuccuuuccacaagaaacaugguguuuuaucuacauugaauucaaagccaguaggaaugcuuucaggcuaaaaauaaagaaaaugauggcaaaaaaaaauauccugguguaucuuuaagggccauuaguaguuuuagaaaguuguuuaaaacuaaagugcuucgauaccaggaagcauuauucaucaguagguaauaggagugaguuucauaacuuguucuuauauacgcccuguuucagugcucuuuacuaauucauuugagagauuuugauugagcaugcaaggugaggaguauugugcuuacaaaugguggcaguugcuuuguuuugcuuugcuuugcuuugcuuugcuuuggagacagggucucaccauguagcccuggcuaacucaguaucagaccaggcuggccuauugauucacagggauccaucugccucugcccuguaagugcuggguuaaagucauguaucaucauggccaaaaguggugcgguuuguuuuguuuuguuuauuuauauacuguaaaaucuuagaaaacugggugaaauuaucuauauuccagauuuugucaaaaguaagugacaaaaucuguuuguuuguuuguuuguuuguuuguuuuuuuacuuuuaaaaugucaguuauuguaagugcuaaucucauuucuuuguuguguggugggguagugaggaccaaggacucugaaacagcucacuacuguuugcuuacauuguauaaauagcacacacagugcaugcagaguuaaagucaaauguuaauaugugagcacuguauaaucagaaugaguuuggcucugaccugcuaugucagaugaucugugguaaaggucaaacucagaacuaaucuagaguuuuugauaugauagaccucaauuuagaaauuguccaggauuuauacaggguuuuagcuaaguaggaaagcacuugccuacuauacucaagguucugguuucugucuucagguuggcaauagaguuauccaugagucaguucauuuuguuccuuaaacaguucaaaugucuagauuucuguuauguuuuucuaaaaaccucaaugacuacguuaaauacaucauuucuuuucacccugcaauaaucugugaacauuugaagacuauguaaauggaaugcucucacauuuuucauaaaucagcccaacaguucuguuuaauguguccuugaacuggaggauacuuugugcauugauuaaauugaggcuuuaaaugauuucuuguagagaaauuaagcaauacuuuugaaaauauuuuuguacauuuuggaaaaucucucuaacuguguuauacauuuaaaguacaaguaucagguuuucaaauuacagugguagcugcuauaaauuuccacuaacaagaaggaguggaauacccuugguuuuuuaaaggguggcuauauguugguaccaaagauuuuucuaacaggagugcaguaguauuuaccuuauuaacugaacaauaaauauuuauaaggauuuucaauacagggcccaguaagaaaacucuaaaugaaaggaagagaaaguauggggugaguguaaauaaaacuguccaaaacauugaguggaauguugaccacuucuugaaaguccagcaugagcgaagguaagacucugggcuuuccuauuuuauacauuucuuaguacuugggaauaaaccaguugcuaaggacuagcugauauuuucuguuuguuggagccucuggucaaaacuucguacggcuuggguacuccuuuuagcuuauacugccacauuauagccagaguaagcuguauugcuuagcugucaguaaagaugaccuuuuuuuuuuuuuuggucuagucaauguaauauauuugaauuuauucaccauaaagaauuugugugccacucuugaaugugauacccggguuaacacugaguaucucaaaacacauuccauauagcagauacucaaucauauggaaaaaagagaugaaucuuguagaagaauaaucuauacauuuauggaacagaguugacccuuuuguaaauuacaaauaugcaaaaguaugcucugccuuaaagugaggaagaguggguaaaccucugcagaauucucugauggucauggguaugcauccucacagaaccaauucuucagcaggagaaaauaaaggagaagcugugcuucucaggaagaugaauacuuguggaauguuacucagauacuaauuaauuacacuucucccuaagauuuauaaaccuaagguauuugaagugacuuccuucuaauccaacaggaaacagaaacuguuaguguaaaaccacaaaauccaccuauuuuccauuucccugucagaauauuuuaggugcccuuuccuagucuucccucugaagcuuuagugagggcaagucaguuaugcuugguuuggaugggcuuucuucaugucgagaaggaauaucacaguguucaccguugucuucuacaggcaggaacuuuauaaggacuauucucaucaguuuuugacuuugguuaugauguggaauauagauguagaccaaaucaagaaacaggcuggaaaacucucugugaguaucaggcuuagcuuuaaaggaguccauuuugucagcaucagagguagcaacacaggcuuccugcagcaggucuggagggaagggacaggacaugagcucugggacauaaggagggugguugauguggaggggagagacuggccauccucccugacuugguuuuuuaucccccuucugugggaagaugacaaggguaaugauggguuaggagucugcaugguacaggccuggggggaugagcagguacugucugcagagugaaggaggagguaugggauuguauccugagaggggacccuucaggaucgacacagugcagaugccaaagaguaggagggcuccacguagccuucugacacagugaucagggaugcggagugagagcaguucauggggcuguggagaagcagguggagacuuagcugccagugugguuggaguucagacaggcccugucccagaggagaagagggaaagguucccaugcagugauggauggaccugcgauggugacugagucaccuuuagccuggagaugagaaugggcuuugggggacugguaacuggacucaaugcugucucugggggcacuuucuuccugguggaagaugaggcugcucccuggggauucugacuuccaaagguagggaaggagaaggggaacuacugagggguauggagaugcuguccagcccagcucaggucaggagcguggacucuggaaucccaccaaguggaucgcagucaccguccagucuuuugcuaguuaugcucacucagaaaaauaauuuacaucugugccuuaguuucuuggaaguagaaggagagaagaaguccauauguaucggaaagaauuuugucaaagauuuguuuuagauguguauccuuauauugguacagggcaguaucugaugucagucuuaaagaauauaacccuguuaguguggcacugugugcucuagucuuucuggaaaggccaaaaugcccccccugcuucuaugauagugcucacccacucacccacuccugccucacugcccuagcauucccucauaugaagcgaaucaaaugucaaaaugucaaaaauacuuguuucaaacuaucgugucuagaugaaauauggaauuauuuuugcuaagcugccauuuucaugaaauguccuguauugcuuuauguuuguaggauauacuugaugagcaacagaagcuuuuucaacaauuucaaaguauucauaugcagaaaauagaagaauuuaaggaguuaugugaucgacacuugaagguguguuggucaucuucuugugagagcaaauaaaaacacuggcucucuuuccuuccauacugggguucauugauaguguucauaccuuuaaacgucuucuuucuuuucuuaguguuaccaugucagguaaaccuaacuacuaaaugagcgucuccuuuaaggauucauucaugguuguggguuccuuucaaagcaggaguugguacauugguaacauugcccaaaguuauacuuacuguuuugggggaaguucugauuuuuauagcauggcuuucucccauaaucagauuucuuuuggacagugacaaaucaauguaggaagucuauacgcccuuuguuucuugacuccuugugcuuucugcauuauugaacuguaauuauucuuuuccccuguggacaauuacaaugguaagacaaggcccaucagcaugaugaggcaaaacuguaagugaagauaacaguauauugagaauuagcuacuguuuucaaugcauccuauccaauucuucucagccucuuugaacuuggccaaguacauuuauauaguuauucuggaauuaauuaacuguuguacgcucagauucauuuucuggguuguuguuuaaugccuuguguuccuguugaauuuccuucauccaggcuaauugauauagguccaaacagccgcguggaaagaauuuauuccauguucuguaauacuugguguacacugggauacauguaugcagagcagccaauuugaagugcuucugagucguggguaucaggcuguaguccuuguggggggaagcuuuucaaaaucacacugcagguuugagguagcuguuagucuaauccucagucagggcugcacuuccugaguacucuccauucucuguguaugguaauacugcagacugcucagacaucucccccgccccugucuuccuccaacuuucuguuccucccuccucuuccuuucucuuccuucuccucugucaucaucuuuaacuucuucauauuuucuuccuuuuccccuuccuccccacacccacuccaauguguacgcauuuccuauucugccuauaagauuuuguuauuauauccagauugcacaguauagcaucaccauacagucaugcuucuccagucucuucuuuuguuuuccuaccaaaauauuagucuuucuacugagccauaggcauuaagauucauuucacuugcauagcucagcaaguuggucaucaguucuaaugcuaaaguuuugggcuguuucugguucugcauucacuuaaaguuauugaaauaugaaagaaauaauuaaauaguuuuaucauuuuucuauaccacaugucacaagaguuuguuuauagcaaguaucucucucucuguggcccuggcuagccuggagcucacuaugcaguggcuuuacuugaacuugcacugauccuccugccacuauuuuggagugauggaauuacagguacauuucaccaagguacucugcuuagugcaacagguuugauguaguguguccuaauccauucauuguugaaccuuccgucauggucauaaacauuucucaucaugaucacacaaauuucuguaucuccauuuguagcaauauuguacucagcaaugcaguuccauauuucugugguggaugcucugauuuucauauaguauacaguguacuuuuacuuuagauuaauuacugaccauuccauuuauuguaauacauacugauuuugaacuguaacuguucacaauugugaaccaagauggcuucuaauuaaacauggcuuuugguuuuagaaucuacaggcuauuaaguguugucgccgaaaagcuauuauugaggaagccagaaagcuaauggacuacuuggaaaagagaguuacugaagaaacuguaaguagaauauuuuuaaauggaguauuaggauuaauuugagcauuaaauuucuuuccuaaaauauaugucguauauauacacacaaauauuaauuagauguuuaauaccaccaagguucacguaaacaagcaggaagcaaaggaugguguucaaucaucacuucuaucccugcuaaucucguaacaccuggaagaaagaagcucaaccaccaugaaaugacuucaugauauuucuaaaucuauggugacaugacacugcuauuguagugauuaucaauuccuuguucacaucucugaggggucagaaaaacuuuacugagaauguuuuguuuguggaauuuaucgcacauguaguaugggaucaucagggauauuauauaugaggucucguguacaguuaaagcuugcguccugugauuuccuguauggauacccugggaaauccuuacuugggaacguuugauuuaauaaacaugaaauaguuucagacuug

SEQ ID NO: 9542 - RNA, 10864 nt, Mus musculus
cgaccaagugggaguggaaggaggcugccuuguggagacgaggggacuaggugggugaagaguuuugcgggggggacgucccacggugggacuccgggggugguuaggaggcacccuuguuguccucgucgucguuguagugggacaguggggucacagaacaugagggucccgggaagccugugaggugacuuccggagcuuucuuuuacuguaagaggcgccagagcccaaaaugagaaaccgagaaugagaaaaacucccaguuugggguuguuuuuccuuguucuuugguuuuguuaguuuuuguggugguggugguuuuuuuuuuuuguuuuuuuguuuuuguuuuuguuuuuuuuuuguuguucauuuguuuuguuuguuuguuuugguuguuuuuuugguugguugguugguuccugacugcacaccuggauccuccugugacacuuccauaagcaguaucugagcaggauagucugaagcggaagggggaaacccugggcacuuugcacaaacacaugggcaacgacagggaccaagcugggaauggguaccugauuggcaggccucacaccuuugggaguacuuguaggcagccucaggcaugccugcacaguuguguuucugauaaucagagaccuacuccagaauguggggccucuaucugaggggcgggggaaauagccucucagaggaauguauugaaguguggucaccugggugagugacagggaauuagcagagucagucuugagccucugauggugagaaagcucagucagucugguguaucuggccuuuuggggagcaaaguggggucuugaggcagaagggaccagguuuagcugugaugagauguuuggaagacuuugcaccugguaguaaaauagaccagugagaccaguggaugaaaaggguuccaggaggguugcagguuugaagagaguuggcugggacagugacguggagaaaaggaaguagugacucuccccuguccuccggggguccucaguggacacaucgggguccugauucuuugcagccaugggccuugccucccucaacacaaaugccuguguuuuuguauguuuuucucagugucaagauuuggucaagaucuagaauauuggugggccauaggagguauuccuaaaaucuguguugaauguugaaggggaugggccaggacugguccccuucaccaaagggcagcaucuccauccaaaucccacaaguacuauacuagcugaaaucacuuaacccuggguauacacaccuucccagccagucagagagaugugcacugggaggugguuccuacauagguaugaccaaccacccucugaaaaggaggaggcuccagggguagaagaguacccuggguggaugauuggcuauuggggaacucuguuuaggggcucuccaguugauacaggguucagaaaggagccuuagcucgugugguagggcagugggaucacaaagaggcagguccaaaccaaaccggugggaccauccuaggaccuucacuuuccaaaggaggccuggcaaggccacagagggcaaggcaagagagcagucauggggcugcauggauugggagggcuaaaugggacagcaagugggcugugagacauggccucccugacugaugaguaggaccuuagugaguuggaauucccaaacagacaucauuagguccuuguauuaucagggugaggguauagggguaggagagcagcagaggguacugaucuugagagguagugugucugggagcuccaagucccgauacagaaauggggcaggucaggacauugguggcaugcucuuguccucauuuugcuccagcacaagugccaggaaacccagccacacccaugguguccuguucccuguuccuauuuccuucuuccaauucuucccgguaucucuacuuccaggacuccuaucuaacacaagaagauucuagcuaugucaagcagaaaaaggaaggccacugacacugcuggcaggcacucaaggauggauccaaaucucuccucagaugacagccagaacccaggugcagucgcagcagguaaaaaacagaagacaacaacaaaaccaaaacaacaucaugaaaaaacccacaaacaaacaaaccagaggggcuuucagagggcuguguccacccccagcagacauccuaaaaucccuuggcaugugacacacugaguggaugugguggugcguggacauuuucuucuuggucuaguggggguggggagguucagaugcaauuaacugcuacucaagcuuguuuguggcuuuugcuuuccccaccugaaauuccuaccacacaagaauccugcaaggcucauaaaacaguucuuuacaggcaauaugcagugugccucucugggaacacaugggucacauguggaagggcagugcagaugccuccaacaucugguccaagaaucacucaagccuaaugaauuuugugugugucugugcuugugucuguaauucugugugguauucucaaucucucucucuuucucucucccucucccucucucucucucucccucucccccucccucccucccccucccucccucccucucccucucccucucugucucccucuuccucucccucucccucucccuuucccucucugucucccucucccucucgcucccucccucucugucugugcaugcuuuuagugacucucugucucaugcauggauaagaaugggagugcaugugcaugacuucuuuuaaaaguguaaguuacuguagguggcuauuggcucuagaaaccccaccgugacucaguuuucagugggagaugaugggagcagcucacuuugucucaaaacauuuuuuuuccucuuuuucuuuaaauacagcuaacagagaaguccuugaugcugguagggaggacauuauuuccucaggaacagagaggcaacaggccaggugaucacguuuguuugguucuuucuuucuuucuuucuuucuuucuuucuuucuuucuuucuuucuuucuuucuuucuuucguucuuucuuucucucuuucucucuacuucuuucucucuuuucuuccuucucucucucucuuucucucucucucucucucuuucuuucucucucucucucucucucucucucucucucucucucucuuucuuucuuucuuucuuugugcccagucauaaacuauguuuagaaaacucaggcuggaaagauggcucagugaaagggugcucuauguauaaacacgagaaucugaggucauauucagacccaacagaaaaggccacacguggccacuuaacaccuuugaagcccagaacugagggcugagguguggcagagaacuucuuucugcaugccaaccuacuaaaaauaaacugagauacaaacaaacaaacaaacaaacaaaugcagugguggguaaggugugugaaucacaggaauguccuggaugcauugaguauaaaggccacaacacauuuguccugcaguccaucagauguucaguguguuacaaaaugaaaaucucaugcuaccagcaaacuacaaguucugucacagaacuugucugacaggaauaagguggaaauugguagaggaggacccccuccacacauacagacauauacauuacuaccucugauggcugcacacuuauacacaugcauuucuguugcauacagagaaaucgagaagaaucagugucugcucuugaacugugaacuguauugaggcuauguggggcacacucuacuucccugcucaugcaacaaaguuggccuuuuguauacauugaauuaaagaguuuaugugauuucuuugcaggaaggaaaaacaggacuugguccaagaauucgaagguauguucuaggagacaauucaaauuugagaaaauuguuugagccaaagaagugcaaggcaagggaguugucacuuggcagagaagagaagugggcuuacugccuaguucucaaacacacaguguggaaauaguguuuauuacucaccaagucucuacuucaccuuaauuguccaugugaagauccuggcaccugcagugggacgauccaugccuacucucugugagauauuuacaaauuggaugaaaguauccgucucccaguuuuugauucacacaagugaugcaucuguuuuugauaccacauuuuacuucucucauuuguauucuaguccuguucuucuauauuugguugggggcggcaaugcuugaagagggccaauccugguuaaauagcugcccacaauuuacaaugcaaagagauagcacaggaaguggaaagcugaagucagugcuguuagccuguggcucuaguaugaucaguugaguccugcauuaaauugcugucagagguuagucacaugaacuguuaaacaaacuuaucaacccgagaaacagcugggaggucugcaggcuuuucugauguugaguuacaucuagaaacuauccugaaccucaggauagggcuguagucauguggaggccauugccucauauuguucagggcucuggguuccauccccaauaccacagaguuuuccaugagucaaguuuucccuuucaauuauucaggauguagccgggcaugguggcccaagccuuuaaucauagcauucaggagggagagacagguggauuucugaguucaaggccagccuggucuacagagugaguuccaggacagccagggcuacacagagaaacccuggcccaaaaaccccaaaaaaaaaaaauuucaugaugucuaccuuaucaaauuugucaaauagccucaagcgcuacaaugguuacuguauuuuucaucucacuguccagugaucucugagccguuggagauaguuguaaauggacauuuguacuuugcaucaagcagcccaacaguuccuccuagcauguucuaggacuggaacacucuuaguacauugauuacauucauacuuuauaaaugacaucuaauaaagaaauuacacagugacuugauaaccuuuuuguaagucuuguuaaggccccucuguuauguuuuguauguaauaucuagacacugaaguccaacuguccaauuucauggucaggucagagccacugaaauucuuaacggaaagaaaggaggcaaauaaccauugcaucgucagaucaucuccaccuauugauagcaagugucuuuccaguaaccuugagggacuuucacaguaaugccuacaagauuauguccccuuacagagccacguaacaaaguucuucaggaaaacagagaaaaauucucaaggaucaugaccucaucuuucagugccauggaggucaaaauuaaggauguucugaaaacccacugugaagagagguaggguuguugcuucuugucacuuugaucccagagcuguugacaguugguuugugagcacaaugaagggggaauagccaguggccccacuggcuagaagcuuuguuggcaagugaacuugccuugauuuuucuguaggacagacuuuguuuuguuuuauacccucccguuguacugaagucagucaacugcguuuccuaaggaugaacuaagauguuuugacacagggcaguugaaucaguguaacaguaaguaaggugugagcguugugugaaaguucuggguacauugagcuugaaauccucaaaucauccauccuggaguccuucaucucuucagugugaaaugaaaugaaaaucucuagccuccaauguuguacagguuuccggaggagcccgguucaccaugcagguaugcugaaauccucacggguacagugaugaagaguggguaggcguccacagaauucucugauggucgagggugugcauccucauuggaccuaucuuuauaaugggaaaauuaagcagggguugugcucgucagagagacuaauacuuguggaaugcuacuaagacaauccugaguuuucuagcacuaagagcugugaagugacuccugucucggccaaggaggaacacaugcuauuagggugguaggaacuaauccaccucauuuuccauuucccugucagaauauuuuagaucuccuuucccagucuugcauuuagugaaggaaagucagucgugcuguguuugaaugggcuuucuucaugucgagaaggaauaucacaguguucacguugucuuuuacaggcagaaacuuugucaggacuauucucuucaguuuacaaauuugaauaggaaguuaacuucggaugcauacaaacucaagaaacaugccgaaacacucucugugaguaucaggcuuagauuuaaaggaguccauuuccucagcaucagagguagcaacacaggcuuccugcagcaggucuggagggaagggacaggacaugagcucugggagacaaggagggugguugauguggaggggagagacuggccauccucccugacuugguuuuuuaucccccuucugugggaagaugacaaggguaaugauggguuaggagcccgcaugguacagguguggggggaugagcagguucugucugcagagugcaggagaagguacuggauuguauccugagaggggacccuucaggaucgacaagugcagaugccaaagaguaggagggccccaccuagccuucugacacagugaucagggaugcggagugagagcaguucauggggcuguggagaagcagguggagacuuagcugccagugugguuggaguucagaccgucccugucccagaggagaagagggaaagguucccaugcagugauggauggaccugggauggugacagggucaccuuuagccuggagaugagaaugggcuuugggggacugguaacuggacucagugcugucucugguggcucuaucuucuugguggaggauggagcugcucccuggggauucugacuuccaaagguggggaagcagaaggggaacuacugagggguauggagaugcuguccagcccagcucaggucaggagcguggacucuggaaucccaccaaguggaucacagucaccguccagucucuugcuaguuaugcucacucagaaaaauaauuuacaucugugccuuaguuucuugggaguggaaggagagaagaaguccauacguaucugaaagaauuuugucaaagauuuguuuuagauguguauccuuauauugguacagggcaguaucugaagucagucuuaaagaauauaacccuguuaguguggcacugugugcucuacucuuacuggaaaggccaaaguggagugggucccuauguggaggagugacaaaugauggggauaacucaagguagguucuaaaauuacagagaguccagcagauuugaaggccucuaguagguagguuuucaagacuacaggaacuacuagcaauguuuugaguacuguuaaauaggaacccuccccauucaaugagugagcuucacauaaugaagguuauuuuucuacuauuagguuacuccuguaaauguggucacuguuuuaauugaaaacaauuguaaauguuuuucacuccaucucuuuugcauaaauaaaauaaaaaauugccuuuuaugaguuuccuguccccccccucacuuguucuuacaucuuacacugccuuuguuuguagaauauguuuauggagcaacagaaguuuauucaugaaagucucacucuucagaagaacagaaugaaggaauuuaaaucacugugugaaaaauacuuggagguauguugaacaaccucuacaggggacacugaauauccugguauucuuucugugcuuuggauaacagcuuaugaaaguuaccugcaaacaccucccaccauuuccucaugcuccauguaauccuaaguacaaagucaguuuaauuuuagcauucacucaugguuaggagaaucauucaaagcaggacuugcugccuuggucauuucaucuggagcuguucauauuguacagggcacuaaugcucuucagcucaucccaucuugacucacaguacauuuuuucauuggguauguaugugcacacaugcguacuugucugugcauggguguguagaugucggaagacaacucuuacagacacacuucaucauauccuuuuuuucuuaccucuagcuuuuuguuuguuugguuuuaauuuugacacagagucucacuguguagcucuggcuguccugaacucacuaugucgaccauucuggacucaaacucacagagaucuaccugccugccucugcuuccugagugcugggauuacaggugugcaccacugugcgggacucccaugauacccuuuugaaacaggaugacucccuggaccuggaacuauggcuaggcuggcuggcugcucagcaguuccuuugcugccacaggucgaugugucaccaugccugacuuuuaguauuuaugcugaagggcuuacguuggccuuuuaugcuuauggagcaagcuccuccacuacuacugcauucuuaccccccaagaauuacuuuuacacacagcagcugucguccuagacccucucguuccaucuuuaagcagacuaguuacaagaauauuugcacuuacuucccuugcucaauccauuuucauuuccuaucauuguaggacugaaacauggcuucauauggccaauuagaaccauaagacagcugccagguauagcccucaguaagaaaguaaguggaagacagagagauugugaauugagaguuguccuccauaauagucucucuaaguucuugcuaggcacguugaauguccuaugccgucuucagguuuguagcucucuacaagacaauuaaauacuggacgcucuacuuuuguuucagacucaaugugaauuggcuuguucaaguugcaguuaaaauuuuguucauccagaguaauucagaugacccaaaacaaccaaguugacagaauucauccuugcuuucuuaaugccuaucuccuacaaaaaaacccuaccccagcacacacacacacacacacacacacacacacacacacacacacacauacacacacacacacacgcacacacggggcagggguuaggggccaguguguguuccugaugaaagaucauucuuuaaguacucaguagccuagaaacuugcucagccauuccaauguuaagaucucuguguuguuccaguuucuguggucacugaacaagauuauggaagagguccugccaaguuuuauaaugccuccacaguauuuagcaagacuguaguuguagugugugcuguuucacucagugccaaagggaauguggagguggaaaccuugaguuuuaaguuccuggugcacaguggucauaguacgggacaagcuauuccaucuugcuaagaagugggcgaguggcaaugaaugggcucaugcuucaugcucuguuugcauuuggcuucauuggcuuucauuugugcugugcauggagaguuaucccagacucucagacaugguaggcaagcacccuuccccugggccaccccuauagcuaaucccucacaauuugaccauucagcaguggguugagacguggcaaagucggugucacuuugguggauguuuugaucuucuucuuguacagggugcgugcucgcugcuuuuggaguaauuuuuggaguaauuaaaccauguuuuuuuuaccacacuugcucccuuugaaauguugauguucccauuugaaagacaagaugaccagggcugauuuccucacauguuuuuugcuucagaaacuggagguacugagggauucucggggaaauuccaucgcugaagagcugagacgucuuauagccaccuuggaaaucaaacuucugaugcugcauguaaguaccuagccuuucccauagaaaauggggauaaggccaaccuugagugcuauuuauuuuacauccauuuaauauuuucauuacuuaacagaaccagcaaaagacugcugcuccuccacagucucuccuggauguguuauucucauaaaacuuuggagcacaaaagccgauaugaggggagcaguauaaucaucugggugaagcugcuagugcugaugauugcagcuuuggugccuggaucuucuccugucuuccuccuguuccugaagaugccccguucuguuaaauccaaauaaacccugggauuugugugacagcagugcaaauaugucuguagggaacuccagcccucagguagagauggcaggcuuuccuugguagcaucgcaauuacugguuagcacacauugguguugauacaguagauuaucauaccugaacaucaucuccccaaauuggaaggcacacaagugggcuauuguugucguguccagauaaauaauuagagaagauacaggcuuucuuugacauucugcucugaaauguguucagugauggagccuaugaaacugaccuucagccuccaaaggcagugugcucuuaaaaguuaaaguaguagaauucaucaaaccucccgaguaagaaagaugugaguaauguggcuugaaucaguggaaaugccauuugcagacaacauuuacaaggucuuucaauuaaaugaaucugucacacuaagaggugauucugaacaugaauacagcuuaauucgccaucauuuauuaaucccucacuuguauggauaagaguaacuuagaauguuuuguuuguggaauuuaucgcacauguaguaugggaucaucagggauauuauauaugaggucucguguacaguuaaagcucguguccugugauuuccuguauggauacccugggaaauccuuacuugggaacguuugauuuaauaaacaugaaauaguuucagac

SEQ ID NO: 9543 - RNA, 1260 nt, Mus musculus
ucucugugauaacuccagucugugucaaguugacacacaaaaccagccaguacaggugccauaaguuauuuaaauaaauaacacuugaagccaaugcauuaguuacuguuuuuguugcuguguguugguuugaauaaaaauggccccauuggcuuguauauuugaaugcuuagucaucagggaaggauuuuucugaguagauauggcccuuuuggaagaagugugucacugggugugggucuugagguuucaaaagcucaaacaagguccaauaucacuuucuuccuauugccuguagaucuggauguagaacugucagcuaacucucuagcaccgugucugccuguaugccaccuuuuccccaccgugaucauaauggacuaagccucuagaaguauaaagaaacuccaaucaaaugcuuuauuuuauaggaguuuccauggauauaguguuucuucacagcaauauagcacuaagacacugugauaaaaacacuaugaccaaaaacaacugauggaagaaaagaauuuauuauagcuuaugguuccugagggaugagaguccaucauauugggaaaacauagugauaggagcagaaagcugagagcucaaauccucaacagcaaaugggaagcagaaagaaugaacuggaagcagcauaacacuuuuaguuucaaaucucacaacauauguccuuuagcgauacuguaccaccuaaaccuccacaaacagcaccaccaauugggaaccaauuuauuacuauaaaccaugggaaacauuuuuuucacucaaaucaucacaaccaguuuguggucucuuucaauuauacagucccaaguguucuuauuaaacuuaaaucacaccugagcaugguggcacaggcugguaaucuuaauacuugagagguagaggaagggcacaauagcugcaagugaagacuuaggucaucaugggcuauauagugaguuacaggccagucagggcuuuaaagcaagacuguugaaaacaguaaugacaaccaaccaacuauauaauaaaugaaacuuauuaaguuagcuuauguugguuuucuucuucaggagaauuguuuccacagccuuaugugauugaaugcuuagucucuaguugguggaacuguuugggaaggauuaugagauguggucuuguugaaggaggugugucacuggggguggacuuugaaguuucaaaagcccacacuuuuccauuuguuuucugcuuccuacuuguggaucaguaugu

SEQ ID NO: 9544 - RNA, 21746 nt, Mus musculus
cggguuggugggcggagagaccuaagaaacuggugagcuuuuagcaguguggcggcggccuguaagcuuggggggcgugaaccaguuguaguucagagcgcgaaacauggcggaggagggugccggugccgggucugaugacagcuacuacaaagaugugggugaugacugcguggucaaggcagcuguagagguguucgagaagcugaagguacugugagccaggggaaccgcuccuugauaggggaccagguggggccccgucccagugccauuuggagcuuccuguggacauugaccgcaccacagggguccacaguggcaggcccuggcaaagcuuugggggggggggcgacuugcggaccaucugucuuaggucuuuggaguccucggaccucugcucgugcuguuccaacagaccauugcaagauugaggcuggggacuuggagcccaugaaaaauggagaacgcgggccccaaucucaaagagcuggaaguggguggaguuggguuugaggggacagaugggcugaacaccuugccguuuuguugggucagagacagugaccuccagguggguuuaagguacaugcagcagugaggagcaugaccguguaaaguuagggagcuaucccaggcccauugaaccccuugcuaaccucccucccaucuccccuugcuacugacucagugaucacuuucagucucccuccacugccccucagauuuaaucguagucuucuuaacccauucucaggcauguuccuaguuuuauggccgugaaacccagagggaacacacuuaaaagugguggggcagcaagucacaggagcaaauguagggugaagaugagggacuugaacuuuugacaaggccaggaaggggcacaaacugauagaaaugcuuagccaccccacaguaaccggcuuccucugacuugccuuuuccuuguuuaggguguaaacugccccuuccucgacggccuguauauuacagaaccaaagacaauuauggagcugcuguguaggcccucaaaguaccgguuggacauacuggaauggauguguauacgguaaugcucuuuguucuuuccuuuccaugaagugucuucugggggagaugggaaugugucauuuuagagggucccauaaccaagccagcuccaggaaagcuaacugagccaugaccaagaugguggggagguggcccuggcaguacaagauggacuuuaaugaaagcccuuucugcaccaggccuccugggcuuuugauuguguugaggcuauaugaugugguucuugucacugagcucugauuacugucagcuuggacagcaccugaugaucagagagggacguugcccagaaacccagugacagaaacgggccuucuagauuguuucccuucuuuucuaccccaacuugcaaagaacagagguuuuucuuaguccauccugagggcagugcuucuaggacagccuaggccuuuucaguggaauggaaguuguuggaguuuuuccuugcaguuuucuguggaaccaguucuguccagcuaggagcucucaaggccagaugcuuacucgagagccucauuguugagcuuaucugugugcuuaacccugaaggccagggcugcacagccaagucaucagagcuucuuuuacuauaggggccuucuagugucuuaaaauagagcucagcaaggcauuuuauaugaagggacagcuacuguuccaacucagucuugccaggguagcacaacagcagcauaggcaggcagcauguacaggaaugaaugggugguguagcaauaaaccuucuuuaaaaauaagacugggagccuauauauggguucaucucucuguaaaaguaacuauuauuuaccugauguaauugucaucucaugggcuuacuuccuccgucugcuaaccuaggccuaguacuggaagcuucuagccuccauacaaucuuuuuuucuuauuauuccacccauugaguuuuauuaguaugaagaucagaccauaacaaugggggucuugagauuuaccucccucagauuccuuuaagggaagagugggucuaagacucaaggcuuucagagaccagcauuagaaaacacaggacccucuguaugcuuaggauucaaggcuucuguguuaaggucaucccuacagaaaguucacagccuccgugcaaucuuaucuaggccuagccugguuucagccucugagacugacugcugaaugagcucacccuuucuuguucuuacugagcuguagcuggcuggauccacucagcuguucuggaucaaacuccucucuaaucugaccgauucagccuggcuucuuccucacagccucuccugaauuguucugcuuggccucaaacuaacaaucuguuggcaaucuguucuaauugucuggcuccuuuuuauucucuggcucauucugucuucaccugugccuagcuugcucucugcaaccugucucuguacaacuguccaggaaaacugccuccucucucugaacaugcugucuugucucgucucgucuuuucuucuucuucuucuacuacuacuacuacuacuacuacuacuacuacuacuacuacuacuacuacuacuacuucuucuucuucuucuucuucuucuucuucuucuucuucuucuuccgcuuccuccuccuccuccuccuccuccucuuccuccuccuccuccuccuccuccuccuccuccuccuccuccuccuccuccuccucuucuucuucuucuucuucuucuucuucuuuuucuucuuuuucuuuuuugguuuuucaagacaggguuucucaauccgccugccucugccucccaagugcugggauuaaaggcgugcaccaccacugccugucaaggagcccuuucuuaaguagcuucccuuuccuuuccuugugagagucgggcagauccuauucugucagucuuucugauucaucacuuugucugccacucaauuagcccucacuuucaaacauggcugcuuccuucuacaaacuaauuuugucuucauuguuugggauuaaaggugugugcuaagugcaugucuguauucuagucagagggauuaaaagugugugcuaagucugagcuacaccacaacuagaaacaguuuuuuuuccaauaaauaacauaaucuuaggauucaaagugugaucaaauguccugcaacaucuuuccuuuaaacuguguauugaauuguacuuuuugaaaaguguauaauuaaaaguguccacggcucacaccuuuaauccaagcaugaaagaggcagaggcagguggauuucugugauuuccagucuagcuuggucuacauagggaguuccaggacagccagggcuacauagugagacccuauccaaagccaaacaaagaaaaaaguguaaaaugaccuuuucugaaaagaguguagcaaugguagaggcaaccauugcuccuucauuauauacuuacugaccucuguuuuuguguguugaucacugccuagaaaugugcuaggcucaggaaguacccaagggaaagccaguuucuggccccagccaguuuucauuccaggaggauagagucuucuaaaagguuagggaaccuuggccaaagaggcugcagaguuccuuggaaauccuuauaaucagggcuguccaggcugaggagugaguugaagugaugauuuagguaugccagggcuaacugggaagccagcguuccagcaggugcauacucaggccaauuaguuaggugucaaacuccccugcaaaugcccagacuuuuccuuucuugugcacuugugugugugugugugugugugugugugugugugugugugugugugugagagagagagagagagagagagagagagagagagagagaacuuggaguauuuccauuucugagggaaauuuuuucuuaaguauuuucucauaguaauugaugguaagagucacaugauaucaaauaaauuauuuuaaaguggccuuucacuggcauuuagcaauuguacaaguaauucucuguuuagagaguagguauggagggugguaaggaauuaggcacaugacugacuuugcuauuuucccacagggucugccccuccuugcaagacaaguucaucucacugaaagggaaugcauuggauuugaagauacaggguaggucucuuuauaggaauguggcauuugcugguaaauucugggcaguucugagcuuggucacagugucucagugaguugugacauuuccauuaacuaauguuuucuuuuguaugguguauacucuguggcuauuauuagagucuucuagaaucacagccuucugggauauagucccaaauaguacauuugggaccaaauagugcauuguucuaccauaacacugagagguagaaagcauuguuuuuuuguggugucaucagagaucucucaguguacauauuagguuuauauggcauuccuaggagccccaugauugcucuuuaauguggcuuaccuugucacuauguuauuuugaugcuuaguuuuuuuuguuuuguuuugguagaaccuuaaccuggugugaauguuacauaaagaugagcaaaaaaugauaucuguauaaguggcuuccuuauaguauggccaaacauugauaaaauuuaaaaaugcuaaguuucucaaaauccuguguauauucugaccacugcagugugagugagcuagacuuaggcccugaacuguccucguucauccacaguuuggagacuucacuggacccagccucacuuuucucuuugaagaugaaggccuuucccuuguucaccuccucagaauguguugaguauuuauuugaguggaaguaggagacacgaggacaggaaaucauuaguuucauugacaugugaggcaguguuugaugugcuaggguacagcagugaaccgugccacccucauggaacuuauauguuagaugaugggaagcagagaugaugaagaaggaaggcugcaagcuaccaguuaagggaaaggugauacagaggguuggaauaaaggugauuuuauugacagaagauggcaagaaggguagaacugagcucugcaagggaacagccaauguacaaggacucaagugggcuaugcuuggcagcuuugaggaagaguaaggaacaaagauggcuggguagagaggauaaugagguaucggaaaucagugggggggauagggauagguccuuauaggucauagaggguuauuggcuuuucuuccaaagaaggcuuugcccuccauuagguucaucaggcucccuggggauggauacuguagugaaaauaugaacacccaggcagcagcucuuacaguaacugaggcaagauauuggggaaugaauagguuaaaaggugugcucuacuugauuuguugagaggagaucagaaggaucagaggguuuaagugcugugauugaagcaggcuggcuuggaggcguauuggcaucugaagaguauucccagggccccagaauuguuacacagauggucugacacuacuuccagugggucuuuuccagcauguccuauauagguuuguacugcucugcuccugcugaggcauagccuggccugagauggggugaagguacugcucuaacacugaugcugguccaaagcucucuaaccuuuguuuauauacuagauggccauguaaaaaugugcuagauacugcagaagauauggcgagguauucccuauuccucgagggggcuucagacuccauaucuguaaaauauagccuagacucacucaccuucaagauggcaugacaggagaaugggcaugagagacauuuggcucaucuggucuuuugugcccccaccccugcuauggggaaaaaagccucaguauccuauauguucuaagugcugggaugucuuguauccuccucuguuugggugggucuacagugauaagguuuuuguguucuaacagagauguugaagcuaggccaugagcugauguuuugugcaccagaugaccaggaucuucuaaugguaagaaaggaaccucuucugucucugcagaggaugcacauguuggguuuuuuguuuuuguuuuuguuuuuucuguccuggacuggugagagaaugggagcuccagagcccauguggcuggcaagacugcuucucuaggcauccccagguuaagcauugcaagaaaucuuucagggagacaaacaauugggacagcuaaugaaugaaccauuuuuggugggguuguauuucauuaugcuguuuagucucucucuagauaggguuugcuuuuaagcagagcugguucacagagcuugucagcagcaagaacaaagaauucccaucuccuuccugccacuggccccaugucagccucccucacuguaggaauguuuguuaccuuaguaagccaacauagauuaggauaacuuuaucucccaaguguguauccaaugggcuaugcuucucuuguuuucugguuggaaguuguuacaugguucuuugcugauacuuugugcuuucuguuucuuguucagaauugcucuuucaagcgcuuuucuaaugauuacuugaagcugucaguucauuugccuuucuauaaucccuguauuggcaucuaaugagcaucuuuucuugugcaaguugaggucuuugugguuuuucauauguuggaugauugugguuuuguccugcucauguugacuguuacuuggauuuuguuaaauuucauggaaaguuaagauccauauauuccagcaagcucuagguuugcuuuaguuuaugcagccaggaccaccccuccucucucuccugagcuuccacugucagcucaucuucuucccaucuauccugcaugcgccacccagugguugagccuggcuucacaccuggcuuaguaaucagucauaugcacgcacagucagggcugguccagacuuccaaaacugauuuuuggaguuauuuucuucaucucuuuccucucugccauucucccucuccucuccucuccucuccucuccucuccucuccucuccucuccucuccucuccucuccucuccucuccucuccucuccucuccuccucucucucucuuuuucucucucucucucucuuucucuccuccccccuccucugguuugguuuuucgagacaggguuucucuguguagcccuggcuguccuggaacucacuuuguagaccaggcuggccucaaacucagaaaucugccugccucugccucccaagugcugggaucaaaggcgugcgccaccacugcccagccucucugccauucucuaagcuuuucacuuucccagagcuguccuuuucuauccuccagcuacagcccacuugcacgacggauuaaguaacuauaaggcagaaaggaaaaacuaucaagagguuccuggaaagacacuuuuuaucacugaucaaaagaccaaugaaaauuuaaacugcauaggcguguuccacucaugccaugauaucuagaguuagaaggaaaaauagcacaggaugacaaggauggggagacguaggaacccucauauauuccaguagggacacaaauaauacggcuacuguggaagacaguuaauacagauguacagaauucauugugaauguucauagauacccauuaacugaugagguaauuuucaagaaagaagacguugcugccacaugugacaacauagaugauguuugaggauguuaugcuaagugaaaagcagauauuaaaauguaguauaaggucauaauaaauugucacauauuguaagauuccuuguguguggacuguucugaagaggugaguccauaaagaaagauaggaguauagugauugcuaggggcucaggcagagguaaauaagaaaugacuguaugacugucaguggguuuagaguuuguuuuggggguguuagagauguuucuaaaauguggcuaggagacuugaaagaugauucagugguuaagagaacuugcuacucuuccagaggagugggucagauuccuagcaccuauaugguggcucacaaccacuuauaacuccaguuccaagggauagaguggcuuuuuuuuggccuccuuggguacuucacucaugugguacacugauauccauauaggaaaacagacacauaacauaaauaaauuuuuaaaaauugacuaugauaaugaccuccuggcucccugacuauucuaacaaucacugcacuauacauuuaaaauuuuuaacauuuaauuuaaguuaacagaauuuaacacagugaauuaaaguuaaacaaacaaaaaacacuauagccaagugaaaaaaaaaaccaacaacaaagaacaucuaggagaacagcaaguacaagagaccuuguacugugcuugaugcguucagaaaccugucagcagacugguuagggcagaguagacuggaaacaaggaaaaugaauagagcagaguggguagaugugauugauggccuuuguaggcuagaggaggcuuuagcacauacagggggguauauugggagcuuggagcugagggacauggauuucuauuuagucugacagugauggcuguggcuaauguguggaguggacugugagagaccuguuggcagguuacagcagugucgaggcauguaaggagauaucucgaauggcagugguaguggggaaauuggaguaguggcuagauucagccggacccacuggauuuguugauguaguaagguauaggcagggacgacacucaacagucacucucuagaaauaucuggagaaugaguucacaaagacuuauaccuuaucauaucucuagaccuuuccagagugugauuauuagucuugcccuuugcuggagaguagagaggagacagauaggguaugguauagugaugggcuucaguaagguggccacagagcagccugcuggaggccagcauguacacuuguacauguacauggucuuguacagccuggauccugguaauccagaagggucauaagugacuuuguggaaccauucuuguguuuugaucugggcugguuccaguuuaaacaguguauugaccuucuaccacagacugcucugcagguguguuucuuaggcaaauggggaaauugagucaacaagaaagagcaaaagcaucccagaagucagagucagguuaaggacaugaggugagggcuuuggagugggucuugcuaacucagucauguaaguagcauuugggucucuuuggaacugucuacuccucaccaggggcaacuuggcccuuuuucuucagcaucugcauccagcaccagcuuucagcgcuuguuuuucuugaaggugcugggaguggugauugagugacucuuugauuucucuuccucagaagagugugugccaggccugggugguaagggcuaggucuugcuuggugccuuauucacacaggaauuuguggugcgguuauggccucuaagauaguaucugcuccuggggaucaacuuucuagaagaaggcaagccuuggacucuucacugggcaacucccugcaucaccugggcagaugggcaggcaggagacagggucagcccugcaugaguugcugcacagaauccuguggccuucgugguggaaagccuaggccccugcuggagaacaggccaccgcaggccucaugcugugccuguuggccucugcauucuuggccaggagggauugacugaggauaccggaucuuuacuugggggugucccugaggauuaggccaccaucagauuacugugaguucuauucugcuuuaguaggcccugcugcaugccacccacccacugaauaagccuuccccucgggcucugugacaaaaucacacuguaauauguuucgacaacaguuugcauuuugcauuggcaguggucuuccagguaucauugcagccuggaauguggcagaagucugaggaugcuauugcugaguucaagaggcuaccagcaggggucagggacagggaagaggaacugucuggccagcccccuugccacuggccacagcaagggcagcauaggaucgggcaccuggaacaggcuaggccuugcugggucuaguggcaaauguguguggcuuuuccugccagggccgugaguguccccagaagcaacuacaguucauggacaagauacuggauaugaugcagagccuggccacuggaugcuccaguaguucuagguaaaggugucagugucacaggcagguacccuaacagcuggucuuagucuuagcuauggagaugguaggguggugagggaaugugucccccucuggugacaguagccauguguggauccaggcauuacaggacugauaaauugagacagcucacccuagucaccaucuuggggguuaggcuagcugcucagaggccaggaagcggcucagcaaaggguaguuauauuucuaggaugcugggucauggccugagauuccugcacuauaggcuuugggggccuaggugccuauaaccuaggcagauaggaggggaauuaggaugucugcaagcaagggggcaucaagccaaagcaagcagcgacugggagggauguaggcaguagaguuccucguccuugggacugcugggccagugcuccuguugguaacacuguguucagggccuguucugauuuugcagccugaaggaacaccuugaagacaccacagagaagaaugaggcguugcuuggggaacucuucuccagccccaaccugagggcaauuuugaaaccugagagugacccauggccucuggacaugcaguccucucuaaacaagcaaucugaugaccugccaaaguaggugucugggggacucuaguccuagucccaccccaucuugcuucucuucuguaagauggagcucauaguggccuacugccuauagcagcaguagcagagagcugacagugucccucccuguuccuccugcagggcugaccccucugcccagucagagggagaaaagguggcagaucuggccaggcagcugcaggagagugcuacuaagcuucagacacuccgagaccaggugaaggguaccaacucuggggcuugugggacuuggggaauaggcucugcugaguucuagggaaggugguguucccucagcuuggcaugcugugaggcuucagugagaugaaaugggaguguggagguagguguuaagggucugagcauaaaaggaaagaauauacuucagauggcagccaugcacuaggccugaaaucuucucaaauucagcccuacuggcaucuguuggcagggcuagauauuuagcuauggugacuguggucugugcaaacauuagccucauggcugaggccccauucacacccuccccaucucucucucucucucucucucucucugucuuucuuucuuccuuccuuucuuccuuucuuucaguuuuucaagacaggguuucucuguauagcccuggcuguccuggaacucacuuuguagaccaggcuggccucaaacucagaaauccgccugccucugccuccugagugcuggaggcccggcuucccaucucucuuuuuuuuuuuuuaagauuuauuuauuuauuauauguauauagauaccccagaaaaggguaucagaucucaucacggaugguugugaacuaccaugugguugcugggauuugaacucaggaccuuuggaagagcagacagugcucuuaaccgcugagccaucucuccaggccccccccccaucucuuucuuuauggagacuuucuuccuguuaauuugugcaguguuaugucaacuugugcuauguuauguggguuggugacauccuaggcuggcugggcagccucaagugacugucacccuucauuuugcagugcuuugcacagcauaaagcagggacugacaccagcaccauagaccagaaacuucgucuggucaucucugacuucuaccagcucaucuuggccuuccugcaagucuaugaugaugagcuacgcgagugcugucagcgcccaguacccagccugcacccaaguggccccaucauccaagcugucuaucagacucuggcuuccuguggccaaguaagacacuccucccccaacucugugcugccuagcaccucaagagcacguguccaccaggccugggcucaguaccuuagcaaccccugauaucaaauguacaggcuggagaagagcuugagagggcuuagccuggguuccucaaccagucacaugguagaacucuggcuauaggaccuuugucagaugaggacaaacauuucuggugccuugggaggugaugaaagcugauaugaacauuuucuccaagagauucccccccgccccgccccaggcaguuuccguucuuacuucucuuauuccuagggaaccuuauauauugcuugcauuggauucugcuugacuuaguaugguguccugguccuagcaucuaugcuguguuaguucacuguuuucauaugcccaaacaugccaagcuauauuuuaucugacugagcacuaggccagauagacaaauaagaugguagacaguuggguuuguggcuaagccauugaguaaauguagcucacuuggcucuucuguauuucagguucuuagaggccaggcuuagcagcugaacuaauucucaucacuguagcuacaauguguguaacucuggcuuugguucauagugccaugauguugaucuuagguuauaacaagaaaacccaagccuucccagucucucaugagacucagccaguagagggaagcucuuaucacaaaggcacuuuuugguaggauaucucuuuucccacuugucaucugcuuugcucagguggcacaaugcaugucaugcuagcaggucacuaagaacugagggcugccagaauaacaugauaguguagaguccccacugaaugagggaaaaggagacauaggauuaaagggcaacucucuagaugagaguucugccucuuucuguuggcugucugucauuaggggcuucgauguaagcaacagaugccaucuauaugucagacuagccucacuaaggccugugugcccucucggucuugacaguuguugagagcagucauggagauugcagacaccucugccgaagcuaugaaagcagcaaggaagcaggaaggagagccaaacuguuggagcagcaacaacucugggauaagccuagguaagugccuguggcugaggggcagguauccuuuccuacuuaaugcaggccuauuccaucacagagccucuucuuuuuugugcugggccagcucucaggaaacaugcuacuuaguuuuuucuuuuaauguuuguuuucuuucccuugggaaaaaaaugcuuccagcauucuuggcaaaaaagugguauaacucagaaauguguagauguaaaacuaaaagaaaugaacuacacucuggcaaccauagguccugggugugagaauuuucaucaguuucuugcuacucuuuucccuauuaucauuuccuuucuuuuuauauuauuguuacuagauagaagcaaaauuguaucaauuugauuuucauucuaccuuccccucucuaaguuuguuuuuguacuguuuguuuuuuaggugaggucucucucuauauagcccagguuugccuggaauucaugguuauucucuuguuucagccuucugaguacugggaugaaaggccugcaauaccuccauuaauggguguggcuauguuucaguaaaauuucaacuaugaaaauaggcaguugacccugguuuguugauccugauguauagugcuacaucuuaguuucaauuccugugauaaaacaccaugaguuaggguggaaaggguuuauuuuuuucuuauaguuucauaccacaguucaucucugaggaaagucagggcaguaacucaagacaguaagauggaagcaggaacugaugcagaggccauggaggugugauacuuacugauuuagucagugugcuuucuuaacagcaucuaggauuaccagcccaggaguggcaccacccacagugagcuggauccucccauaucaauuaucaaucagucuggugggauguuuucucaguuuagguuccaacuuuuuccucagugacuaguuugugucaaguugacauaaaacuagccagcacacccugugucacacuaugcuauuaaugcuauaaauauucuucauaccacucauucuggaauuuagggauuguuuguuacaauugaggguucuuuuguuuguuugauuuugagauaaggccugauaagacacuguaguuuacacuuaccuagaacccacugucuagccuagacuagccacagacucauagaaauucuccugucucaacuuccucaguguugagaugacagugucagcuuccacacucagucaauuugagagucuuauagauaccacugcucugagcauauuagaacauaucucccuguguagacuugugccaguuucuccaggaugucuuccugggaggaaaacuacuccauccugacacacugccuggcaccagugugauguaucauagcugcauguccucaucagcucuagccaugaccuggcauguugcagcauguuuauucuguaucucagugaguacuuacagaguugcauauuugcauacauuuauugaucauuuaagcguuccuuucuaugaaguaccugucaaaaucuugcuuguaaaggcuuguuuucucauugauuuuuagcuuguuuuauaauacaguacacagaagcccugggaugcuaauuguagcaugugcaucuuuucccaaaaugugcauuaucuuuucauagcuuguguguguggucguugguuguauaauuuacguguagucaaguguaaccauaauuucuuuauggauagaaucuuuuguauuuguuauagcauuccuacucugacacguuaucucccaaggcuuucuagcauuuccuucugugguuagguuaguaaucuuuccagaguugauuuuuguguaguaggagaugggaguucaguuucauucuauucuauauggauacacaucugucccaguagcacuuaauggaaacccauucuuucccccauuggucuguaaacccaucaccucuguuagucaucaggucucugaguucucuauucuagucuguuucucucucucucucucucucucucucucucucucucucucucccucccucccucccucucucuuuuuaugucuuagaggucagaaaaaaauggcaaaauaaacacauaagauaaaaguuguuuuuccuccucuaucccuucacuggagauuaaaucugggcuucauauaugcuguacaagugagauacaccuaagcccuauuuuaauaacagcuuuacugagauacaauucacauaacauagaacuuacccuuucuaacagugaacaauccaguuuuuuuggaaggguuuucauauaauugccagucaucauagcuaaguccagaauauuuuuaaauauguauuuauuuuuauuuuauauauacgaguguuguuuuuguuuuuuguuuuuuuuuuuugccugcauguaugucuaugcacaauuuggauccaguacccacugaggccauuggauccucuggaacuggaguuacagacagcugugagcugccaugugggugcugggacucaaucucagguccucuggaagagcaacaagugcucuuaaccucugagccaucucuccagauccuagaacauuuuauuauucccccaaagaaguucuauaccagaaggcagguguggugguacaugccuuuaauuccagcaugugggagacagaagcagguggaucucugggagugaguuccaggacagccagugauacauagugagaccuugucucagaaagaaaaagaaagaaagaaaggaaaaaagaaagaaaggaggaugaaaaagaaaaaaaaaggucuguaccauuagcaaucucuuuuucauuuucccuacaccccagcucuugacaaacacuggucuacugucuuucuccuauagcuuugccuauucuagauauuuuucuuguaauggaauugaauaguauaugaccuuuugcuuauccuuuuucauggagcacauaguuucgagguucauccaucuuuuguauggcugauaugacugaugaauaaauauuuuuguuuuauucaucuauuaggagacauacaggcuauuccuucauuuuagcugauaugaauaaugcugcuggaauuuuugugugaacauguuuuuugaaucucucuguucuaaaguagaauugcugggucauaaacuuuuucuuaaaaauuuauuuucuuaccacuugccuuuagaauuauagcuaacaaccuaaaguacuuuggugcuaaguuuauuucaauaguacacagaaguuguacuuucauagaacuucuuugccuuuucacuuugguauuuuuuaaaacuuacauugcaauuucauguauuauaugaucaucaacauaaauuuauaauaacugcuucaugcaguugcacucaaaauuagauagaagaaaauuacaaacacuaugucaaauggguuggccacaaauguugagcgaucugccugccucugccucccaaaugcuagaauuagagaugugaaucagcagaucuggcuuucaaguucuuuauugauguaggcugauaaucacuagcguucauucaugcuuuguagggaaggucuaccagugacaaauuuccucaguuuuuguugaucuuaaaauaccuuccuuacuuuuuccuucauuaaaaaauucaauguaagauuuuaauuaauucuuugagaauaugauacauguauuuugaucauauucagucuucacucuucccccuaaugucuuccaaauucaucuccuaacuugauguucucaaaaaacaaaacgaaacaaaaacaaauccuaaaaccaaaaccucucaccaaagcugauuugugcuguccuuauaugugcuuuuggaguguggggccauucauuggagggaacauaauugacuuaucagggggcacauucuuguuuuucuuuuuuuaauucuucuuucauacaauauauucugauuauaggcuucccugucccacuccuucuaguccucccuaucuccucuuucccucggauccacuccaccuccauuuaccuucagaaaagagcgggccucccaggaauaucaacauggcauaacaagaugcaaaaagacugggcacaaacccucaugaagggggcacguucuuaaagaaaacugacucuccuuaccccagcauccaucagcugucaagagcuccacuagggugugggcuugugagcugagccagcuucaugcuagaauguugggaaacuugaucuuguauaagcaaucacagccacugugagucaugagugcagcaucucugucauguccagaagacacuguuuugcuuaaguccucucuaaccucuggcucuuacagucuuucuaccucuuccuucuugauguuucccgagccuaggggguuggaggugugauacacauuucccauuugugaauuagcacuccacaacacuuugccuaguuguauuucuauuuuaaccaccacccacugcccagaaaucuuuucagggccaucuguuauucuccuuccauacuuugaauauaucauccuacugucauuugaccuucagagcuucugguaugaaacaaauuuguguucuuauugaaggcucuuauauguaacaggucucuucacuucccuuuuuucugauagcuucugacuuuugcuagaucaguuaugugucuuucucugaacuccuauaaguuuaacaccuguaaguuuucccauuuuggaggucucuggacuuuguagauuuuuguuguucaucaacugcuaagcaguuggcagcuuuucuucuacuucuuguuggcucagagugucagguuuagccaggaggaggacuuagagccuucuuuugggaauuuacaaagugcugcaaccuuacuccucagccuuuauuccccagucuuuccuucuaaguuuuuugaaucaguguacuauuuuccuugacuguuucaguaaacaccaaguaaagcacuugacuauaauuguuuucacuggguuuuccucugaguagugaucuuagaucacagccuuuaugcugucuccuuuggggacuuuucccccuguguauuuugcuauugaacauauucccaacccucuuucuccccuuucccuuccuuccuuucucuuccucuuuucuuuuuucuuuucuuuucuuuugucuucuuucccuuucucucuuucucucuuucucucucucucucucucucucucucucucucucucucucucucuuucucucucucucucucucucucucucucucucucuuucuuucuucucucucucuuucucccuuuuucucucuuucuuuauuuccucccucucucuuucuuucuuuuguuuaauuucuauuuugagacagggucucacuaaguugcccaggcuggccuugaacuugcgauaguccucccucaucuucuccaguagcuaagauuacauaccugggacuauaggccuguacaaccaggucuugauugggauucucucuggcugauggcuuucuuucuguguucugcccugguauauaccugccacauauauaccagauacuugggaaucucuuuuugcuuaaugagccacaagaggauccuucaucuuaaaauuuauagcauuuaccuuaaucaccacugucacuggcucucguugccguccauauaauuauauuaauaaauuauucauaaucuaugcuauaauuucuacaauaauaaucauuaauagcccuaacagugugcucacucucuggugacuagggcauauuagcacugguaguaagcuuggcaguaugagcugggcacuccuaucccacccuuugguucccaauauccucaguguuguugaaauggugaguagagcagggcugggcuccugacccagcucuugucaguguggauuucugauuugcuuugagacaaauucuugaacacuagacaugcccagagaaaaggaccaguguccaaauccacuccaaagcuacuugagccuuucacugcccauuuuuuaucugacccauuaugggcuuuggccucuaugagaaacaaacuuccccuuaucugggggaagucuguuucuauaucauuuucugucuuacugauccagaugcugugacugagcucuguuggugauaugucccagaguaucaaguaagaggcucuuguaaaggucgugugucuccuggcuuauggcauugugcgaauggauacuacuguaacaacaccuauauauuuaggagacaaaguggcccugccagagcugagaauagagggcacaaaugacaagggagagauuaauagguguggaagggagauagcaaacaggaagaaauucucagaccuacagaauagcuaagugacagaauacccccagaaagaauugggggcagaugcucugauaguagaucaaaccaacuaauaaccacuguggucucaaggccuagcagcugccccagaaaagaacagaauucaucaauggccuguggagaaaacaauggcaaugaauaaacaaacaaguuugugauguaaagccuugaggggccauaugauaagggcugaccuuucagcuucuuucugaagccaaaucaaccugucaaucauuacugcuuuccauguaccucuucuuuaagaccccuucacaggaaagggugcaaaccucugaacagcauggggggaguaucuuuugcccaggcuccacaccccaauuccaggguagggcaggguacagagaaccaguauggugaagagaagaccuggauacacaggaaauuguuuuuggaaaacuuccaagcaacaugacaggcaaaugugcuuggguaacugugaaagcccagcugagaggaaagaucagaagacagugacauaggagguagugagccucuaggagcagaugugagaugagagaguaagcacaaaguacagaacacagaagcuggauccacagaaacagaaaugcaacaggggagcuccuuauuucaaguccagagcaggugcaaccuaaaggaauuagucuacaacucacccugcuguagcaggaccaggguacgagaccaaacuucaagauaaaaagccaguauguggucucaggaacagcccuggggacugagaacuacuaaaguccacauguuagggcaaagcaggccuucuuccaggugggaaagugugaaccauugggcugauagcucaggauagggugaggcccagggucuagauucuagcaacacucagggauugauaaaggcagaugccacagaagaaggacagagcagagcccagcaaacugucaucuucagagggacacaguuugccacaguugaagccuuuaacuaggauaccacuggaaacauuaacagcaaggggggaaggauccuuagggugcuauucaggaugggauuucauuauucugcaggcaggauuuauuugagcaguuaagaacacuggcugcucuuccagaacaccuggguuugauucucagcguccuuuucuggucuccucaggcacugagcaugcacauaauguacauacauguauguggucaaaauguucauauacauaaaauaaaaauaaauaaauccuuaaaacagagauacauguuaaaagcaaacaaaggaagaacuuaaauuggguagaaauuuaguuaacuggguaccucguaauugucuggucagagccccggaggugggugcguguacagguuaugacccccaaagcagugauucucaaacucuggguugugaccccuuugggggucauauuuacauuacaaaucauagcaguagcaaaauuacaguugugaaguagcgaugaaaauaauguuaugguuggugaucaccacaacaugaggaacuguaguaaaggguuucaguguuaggaagguugagaaccacugcucuaaaagccauagaauaguucuggguugcuggcuuuguuacugugugcacauacugguaucagauuaaaacaacgcacaauugaaacaacucuuggacuuugagguggcagggaccuagccuggccugaaccuugacaugcauuauggucagugugacccagucagagacuccaagcugcuggccuaguacgaccagccaagaggccuugcuugcaacucccuaaucaauguuucuggauuauggaagaaguugcccccccccacagcuuccaaaccccuugaggaccaggugugaguuguccuuacuaccaccuggucaugccuagugagagccugagcaggauauggaggauaggggcucugguaggaaggcaggaaggaaugggucuuguauggacugccaacuucuaccucuuuacucacuuggccguucguuucuuucucuauacagcugccagaauugaugaaguaacacagaaguacaagauccuuacugacagauuucacagaggcacaagaugaugcagggcuauaaagcccucccuggagcuuucaggagggccaguuccaauccugaucacagccugcauggauuuccacuugccuggugcuugcaguuugaagggaaggaggaagagggaggcagaaaaggaaggcagagauggguaggagagggaagaaauaaaagaaacucaagcuuaagacguugccuucgga

SEQ ID NO: 9545 - RNA, 12655 nt, Mus musculus
cagccuuuagcuucccucccaccgccucugucucccucucuccacgaacugcccaggagcgagcagcugcucccgguuggcccugacggacagacaaaccgacagccugacaaccuaguccaccaacuaagcagccugcaccuggcugcuugucccuccccagguagggccugcucacgccgggaacugacuccacucucucgacaaagacuuccaucuguccucccugucuucauuucuggcuaugcuguacccucaucagccaaagauguuggcaauccugcugucuccacaccagcccugccgcaucuagucuugccgccccagugucuauacuuccacugucuccuugcugcucucuauauucccccagggcacccaccaaaggcuuuguguccuuuucaucaacaccacauuucugccucuucuccccacgcucuucccugaacuuucuuccuacccuuccuuucccuuuccucucugacagugcccaguugcuaagcucaccuaugcguugcuucucugcuucuggggauggacagggagcucccccagggugcugcccagagcacugaggcagggcuggguggauggcuaagcucuacccauaguccuaucccuucauggcaaggcccaggcacacccuucacuccugcuagccuugcucucccagcucagccuuucuuggggucuuggcaccuggccaggucagggaggauggagccaaugcaaaacucagcauuggcacagucuccccuuggaguagucagagacacuugugcucccaggcacaccucaggcaccuugcccuaauauuccauacucaccauagacuaauguucugcuuccucuugagcugagaugcacaaugggcagaugaugggauggggguagaaaauggggaaauugugccauguuuccaggaagaaaacguggcuuagagcccugaggagccugucaagagacucagaagaagaagcaagacagacagagucaacugggcauuaaccaagucuggugaagguuagcggacuggaguaccuagaauaagagguccagagcuguagguagggcaggcagaggaaaucuuuauuaggccaagggcaccugggugacuccaauuucauguuuaggagcuguugccucucuagucugccaguuuucugccuugaaaugacugaaauugagacacacuuaagauguucccuaugcuagcaagaguccuaagggcuggcaucuggacaugcaaucaguugccuguaccaccuacacccuaggagagcuugugggugggcaugguugcuuuguguaaaacaugacuguguauugcugcugaaggcuaaagccgggguugagggggggcuuugaggacagguaaugcggauauacugauagaaggaugugggucugccucuaagccacaaggguaaggcagcaugaggaggcucugauccaggcaguagagagggcgucauagccagcuggcugccuggguguggcagcugggccucucuggcccacuccuacacugacuuucucuccaccccaaaggacuugagucuaccacugcuucucuucccuacccagaacaaggaccaagguccuacuacaugcaaagugaaucggaaccauggaguuuagaauuuagaagcccagauggguaugccagccagugaccaucaugucaaguaaucugcuauaacugaccaaaaauuuuuuucaaucccucuaaaauccuaugcuguugggggauuggcaacaugguggaauagaagggaaagggaugcuguggagguaagaaagagcuuuuuucagcaauauucuauaguccuccagucauagcaucaaauccucugaagagagauuuguaaugaggcuauauuugacaauuugcacugggauacucuccagaagacuuguuuuuugucacauuguuuugggaugggauggggacuagacuccauuccaaucucccuuuugccugggcucauccaccauggucuuucacuuuuucucccuguagaaacagaguaccauaagucugucccaggagucacuuguccuugguccacagauucucagcaugccucccuaaugaggccaaaauaccaaggaagcuuccuugucaaccccccccccauuaccuccacacccaccaugacucccuccugcucuuccuccuuugucccugcucucaaaugccccacccauuuucuagugggggccucacauuccaacaguccuggcagcaggucuucuccauuguagggaggucaguugguuguagagagacaccccagcacaggaccucacucacaccaaggaauaggggcagugugaaugaaugauccuggaagacugaagaugaucuuggcccuuccuggcugaaugcauaaggcugaaucccauucuagccagaguuccuagcaagcaguagagaaccugguguuggggaaagaguuugagaaccccaagacaugagcagaaagggggaucuuugggaucuggaaccuguugccuugcuacucuuucuccaggaguggggcuugggaugaacagguagacagacagccacagugacaucacaaccugauuuuaccuaacugugaggccaugggcaagaguuugggacaaauucucugagccuacuagauaccuaucauuguuaacauugucaugguaaccaggaaugguauagguaaaaaaaaaaaaaucacucaagacuccuuucccaccauugagaaguaacgacauccuccuguucuuugaaaauuccagcauauggugaguaggagcucacacuuuguugguaagugggaggagauggacaggcauaugggucaguugcaaggggacuaggaaaccuaguaccuccaacugaucaggauuaucugcugucuggcuccuuuccagaaguuugucaguagggcaaggaaugaggaagagaaggcucucucuugaugacccaguaccucucuauagauccuaggcaccucauucagguaaauuccaccccccaauucugguggagagcuguaccugacugcccagcuacucugucagugacacagucacaaguaguaagauuuggcccuggccaacaagauucugcucaccuugaggcacacaucccaucccucucuuugacacucaaguguuaggcuggagcuaaaugaccauagaagaaagcaggaagcaggccagguacaaguuuaccuuuggugaucagagaaaggaaaaacagugccuaaugucuccugucucucacacauuuccucaccuacacagucccaagagccuugcacaacuugguagaaggcagcgcuuuccauuuaucagaguugaaguaggguugcucagcaaggcccaaugccccaggaggaggcugcugagacugcccuccgugucugcuccuuggcagcuuccagcuccacaucugcaggcaagcuccuaaaagcugccagaccucaagccuugccccugccgcccuuggccuggccugaaugccuggcacaacccuuccauguucucagagacugccagcacgucuugcuuggcuguugcccagagcuauccugcauggagaacuacacauggcuuucagaggggcagacaaggagggcccuauuuggggugguggcacaagcuccaggaagcccaguccuuucccuuguucaaccuguggucaccaagcucagcucaccacgaugaccacuucuuuccuuuccucugaggagcuggugcccagcaagcucagagcucacuuugauagagcauaaggacauagccaaagaguccauaaaagguaaacuaaggacuggaagcgccaguaacaggaggaaguggaaugggagaaacuuuuuauaagucuucaagggucuguccacagagugccucuucccgacugcgacuuugccuucauucucgguguauggggaggagggaucaucaguuugagagaauugaaaaagggaggcaugugagacuauccacagcacccccugucgcuaacacaccacaugaugauucuucccaccuccugacucacugcauuacuuaccuacagacucagacuuuccuucauccauggcccagcagcaagacugaauguugagacccuagagugaccaaagcuggacucuguaaacagaagacuugggagaaaucaacuaguucguuuuuuuguaggcuucaguucucucauccauaaaguggugcugcuggugguacagacaccaagaaagucuucccuuaauuugauggaauccccuucugugggcucuguauuuggcaugcccucuucccugcagaauauggguacugagucuagugccaguuuucugaguguaaaugaaggcugcacugggaaaccugccugaccccucacccuucaagccuugaacccugaaaaagcagccaaacucuacccugccucuacgugggcuuugagccuccuaccccagguugagccuggacuggaacugacaacgggcugggaucuccccuguaucacucuccuaguccuuugugcaucccuacaguauuuccccucaaaucuagucuuauaagcccaccugggguccuguagcuccuuucuuuggguggaggaggcuuuuaaucugaaaaggcugcagugcccacaaaauauauauauauauauauauauauauauauauauauauauauauauauauauauauauauauauauauaucauguccugagugucugagggcuacacaaggcuuccggggagauucgugucuaggaaaagaaugcccuguggugauuuccaggccauucuguguuccaaagcaucuggguugguuccacgcagaugguccucuguccaacugcauccccaauccauaucaucucuccugaucuugccucugccgguggacugugggucgcuguagcucagcugagcagaauucuaguucugacucuucuuccugcaggauagcagcuuuggcagaggagacaggcagaagaguggucagugcagagggcugggagcagcaccucacucuuucccugcccuuccaucuugcucucuggccucccuucaaccuuuuuuaucuggucuuggaugcuucugcucuucuucucaggcuuucugguccaucugcccugggcaagauccccacccuguccuggaugcuccaggcugagggagaacuaaccuuucuagguacccuugggccaagaacuucugggggaaucccaugucuugcuaggccaggcuugggugggcaucuggagacuacuuggaaagaaugagggaggcuggacacuccuccagcugaggacuuccugaccucaggagucaccaaagagauugagcaaagccuuugucuguguccccuacuuugcugugugaccucugaggaucaggaaggcugcucuauucucuccaggaagcagcuuugcucuaaccuccgugcaggcuuuucuggccacugguauuagaugggagccagggaaggccaugaaaaucacuggguuucagucucugugugugugaauacccgccccccccacacacacacacaacacaaaccuagggcauuuuaagcaauaacacagggugagauuucuucuggggcugacagccauuagaugggcagugcuugugccuagguuuaaccaaaccaggaugucccagccuccccuuucugccaaugcacgcacaugcacacacacacacacacacacacacaccucugcuggugcuaagaauuucaaagcagcaagcagucagcauaacccccuugucagcuggguuccuuccacuuuugccucuagcaguugaguucggaaggcuuauuuaucccagauggagcaccaaauaccccaauuucaccaccaccaugugcucuauaagaggacucuuugagcugggggugcuuuaagccuuuuggaggcuagacuuccuauuuaccccuacaccagggcaaccccagacauccaucccugggaggccaucaagaccaccauggauucccuauuuagcaaaugaggugaagugacuaaaauacccugagccuuugccauggaguuggacaaagaggagugguaaaagaagcaagggcucuggccuuguccugcagacuacacacugcuugggugguggaaugcaggagaaagaaacaggagaugugggugcuggggcaggcucgggcaaugaagagucuccacccccaucacacugucuccgccuggggggccuacagacaagccugacccugcccuguuucucuggcagcaaucuacucuccuugagaucuucuccaggaugccugguccaugggcacaaagagggaguagagguagauauggaagccuggaacuuuugcacccugaguccugggaaaugagaggaaggaagauaugaaguguugauccccuaauucccaggacccuugcuugaugcugcuacagcauugaagaaucuauuuccccuccucccauccccccauccccaucuuccucucucucuucucccacuucaugccuuggccucugggccuucucagaccaacaugggcacuguggagggacucaggcagugaagggggugacucacucauugcccaguuaaacuaauagcauccaaaucuuccaggcucacucucagaagggguaaccuguggggccaauagcugugcuucaucucagccuccaauuggccucacugacccccaaccucaggcagugaagcgggcucuggcugacucguggggaggcagccuugagcuaauuucaaagacauuucauugcccaaaugaaaccaaguccuuccaggaaagggaggggaguggaaagagacacccuccuggccagccagcacuccuacccugacuggcgccucuuacccacaccuccucccucucucugcucccaucuagccaucccugguuaaggucgaaauauuguguucucucucucucucucucucucucucucucucucucucucucucucucucugugugugugugugugugugugugugugugugugugugugugugugugugugugugagagagagggggggggagagggagggagagggagagagagagagagagagagagagagagagagagagaacccuagcuacuacugcugggaggauaaacuaaccuacagcucuucucacuuuuugcucccaggaacauugaccauguguccccuguggcuacucaccuugcugcuggcccugagccaggccuugcccuuugagcagaaggguuucugggacuucaccuuggaugaugggcugcucaugaugaaugaugaggaggcuucagguucagacaccacuucagguguccccgaccuggacucugucacaccuaccuucagugccauguguccuuucgguugccacugccaccugcggguuguucagugcucugacuugggugagucacuaagcacuuaggcuaagaguguacagagaagcacaggcccugccugggagcccuuacuaaaaagaauacauuugcuacccugugagauggguuuaaaacuguaggaguggggagguugagucaccacaggcugagguguaugagggugcucagagucccugcauuucucccagugucuguguguguccauaugcauguauguacccacccccuuuacaccagcugugacaacagacuggaugagccaggcuuaugcuggugaugaugcuggcccccaggucugaagacugugcccaaggagaucucaccugacaccacacugcuagaccugcagaacaaugacauuucugagcuucgcaaggaugacuucaaaggccuccagcaccucuacguaagccuccuccugccuccugccuuuucugaggagccaggaggaguuugauguuccuaugacuuggaagaaggguacucacaaaugagguugggaagaggggugggaaccgauggaguccugagauaagucuagagcuggcuguaaugagaacgcccaaaaccaugcauuauauguauggguacaagacgaaaucugucaggucccauuuuuuuuugacagaaaucuuuacguuuuguugacucaucugaacaacacagaaaguguauuccaucauagcucuuagagaaacugucuagcaaaguaugcuaggcagugauggcauuaccagggcagcuuggagcuaaccucagcuccuugcccuacacucuacucaccaacacauacugaucuccaugagaccauuaaagguucagauguuucccaagugccaucaguagcaaguucaggaggcagaggagaggggagguggaguggggggcuggggugcucacccugguugccugccccguuuuaggcccuggucuugguaaacaauaagaucuccaagauccaugagaaggccuuuagcccucugcggaagcugcaaaaacucuacaucuccaagaaccaccugguggagauuccucccaaccugcccagcucccugguagaacuacgaauccaugacaaccguauccgcaaagugcccaagggcguguucagcgggcuccggaacaugaacugcauuggugagacuagucuguaccuuagcaucaggcauaaaggagacagguagaggauaucucuuucagccagggcagcuggguccauguagucauggaaaagcccugugugccucagaauguuccagauguuuguuuugggacaugaagaaaaagacugugguggcuauaaaggcucgguugaagaaagagucucaaauauagucuaaaaaagaccaguauguuucuggaaaaaaaaaaaaacaauauggguaaaaggaagguauaggacaccgacuggacugagagagaaagggagaagggcaguggaccaccacagcagcaaacguuggauggcuuucuggguccccacaguuuccucuugcuucccaacucccaaagaccaagaauaguggcagaggccuugagcuagucaugcagaacagcuggaauuuguaguuagcggugcaaauucacaaccugcuuucuauggaagugggaagagcaagcaaucagcagagcugcaguccagaaaagaacaggcuuugguggagauuggcuucagggcucacaggacuucucuccuagagaugggcgggaauccccuggagaacaguggcuuugaaccaggagccuuugauggccugaagcucaauuaccugcgcaucucagaggccaagcucacuggcauccccaaagguaggagagugucaauacccaaccuccaaaagcauugaugggccuugcacaguguacuugagcagagaaugggccuuuuaucugccccagacccugcacuuaccucccagcauguucucuucuggguagaucucccugagacccugaacgaacuucaccuggaccacaacaaaauccaggcuauugaguuggaggaccuacuucgauacuccaagcuguacaggugggguugaggcagcccuugggggaugcagggauccauuagcaaauggggcagguuauaggguggcacccaggucccugugcucuaucccagaguccuccucucccccagccucugacgaccucuaauucauuuaccuucagguugggcuuaggucacaaucagauucggaugauugagaaugggagccugaguuuucugccuacccugagggaacuucacuuggacaacaacaagcugucccgggugccugcuggccucccagaucucaagcuccuccaggugagagcugguucuccaagacuagauggggaguuguagaagguccauucucugcaccagccucuuaacugccuggaucuccugucucccuuuauaaaggggcacaggguagagagcagaauaagaccuagauucacuuuugggucucauguacucauccaggccucaguggaacagugucugcuucguguuugugguuggaaaaggggagucuccuucccugacuuagcuuccaaacacaugagcaaacuaggucuuucccaaccuuacucuggaccucaauuuuauuuauguuuuguuuuguuuuuuauuuauuuauuuauuuguuuguuuguuuguuuguuuguuuguuuguuuguuuguuuaagcucagauccauucauaaugguagaaagcacguucauccucuucuagggcagcacuucccauaccaggcuaagagcacccucuaguggccaguaaccuuucuaucaccagugagcuccuaaccuaaggcacagucuuucuuuuuuuuuuuuuuuuuuuuuuuuuuuuuaauuuauuacguauuuuccucaaugacauuuccaaugcuaucccaaaagucccccauacccuccccccccccacuucccuacccacccauucucauuuuuuugacccuggcguuccccuguacuggggcauauaaaguuugugugugugugaugggccucucuuuccagugauggccgacuagggcaucuuuugauacauaugcagcuaaagucaagagcuccgggguacugguuaguucauaauguuguugcaccuacaggguugcagaucucuuuagcuccuuagauacuuucucuagcucggcacugucuuuccuacacagauaucaugucagaaucaaaguuugcuuuguuuuacagcaucauucuaccaaacacagccuccaccccacccaucccaacucaccacucguuuauacacugcacuugagcccuucauccugaccugaguccagccaaauaccugugcccuaaucagagcuuacacccacuaacauacuccgguaugcccuccucucaacccugagaagaaucaccuucaaagggugacuaugaaaugacacuaagaagugauugaugggguccgaugugaaggcaggccugaccuuucuacucuccaucuugccuacaacuuacagcaacuacccaggcuaggacagauugggauggcucugggucacugauccuuggacaaaagccucagauacauucccucugcccccagguugucuaucugcacuccaacaacaucaccaaggugggcaucaaugacuucuguccuaugggcuucggagucaagagggccuacuauaauggcaucagccucuucaacaacccugugcccuacugggaagugcagccugccaccuuccgcugcguuacugaccgccuggccauccaauuuggaaauuauaagaaguagaggcagugguugccaccaugguggccuuggugagagucucugaggaacauagccagaugaagaagcaacaccuuuguuccccaauauuaacucacugccccaccacagcuucccccugacuccuaagcaugcauauaugcacauggccuggcccucucacccauuccccucaaccuuugaaauuuaacauucaucaaccauguccacucagagacucccuauaaaucuuucuucuugcucauccugaaacucagauguuuuuggcaagaggggcuaggaaagauggauagagcacacugccaccgccauuguuccauccaggcauguguuccuccucuuccuugcucaugucugacuuccagcucuccugggcucugcuugcugcccuuauccucugguguucucucuucaacaaguucacuaccugucaaucccagcuacaaccuggcuguacuaacuccuggaucuuucccucucuccaacccuguuaugcuuccugacacuuuucuuccuucuggaguuauugaccuguccccuuccaucucuggaccuaggucauauuucuccaucuuugucucuuucuguaucuccuugccuauaucucugucugucucuauuucugucucucugucucuguguaucucucuaucuuuguaucugucucucucugacaacacacacacacacacacacacacacacacacacacacacacacacacacggaucaucugccccaggcugcuuucugcuucacaggucucuagccagucccuccacaaacaaauauggggcaacuaucuuccugauugcccuacccagaacuugaccccccaacccuggaggaagcuggaagguggaggcccagaauccuguccauuuuguccaggaaaggguucauacucugcuaucaagacgaggaucaaggagcuuccuagccccuggagaggcucagcaggccaucagagccgccagaaccaguuugcauuggccccugcucucuccccaagauggcuagguccccucccucaccccugggucccugaugugguaggaggugauggucaguugcacccagcaagagggagugcugcuuaugaggucaguugucucucaauuaaagaaacacugugcaauacgagucugugugccaguucuuugaaacaucacugggcaucaagagaaaagcagaggugaaacaagggccuccucaggccaccucaaaggcucugccuuuccauccccaguuuacaucauugugcuuccucuucacuguugcccuugcccguagaagaaggccccucucacccucagguccagaacuauaaaagcacaucccaaaugaccagacauaaggccuaggcccuaucugcuuuccucuccuuucuugguccuuccauugccucaauugcucuuaagcuggacucaaaaaagcaagccacaccugaggugucaucug

SEQ ID NO: 9546 - RNA, 12655 nt, Mus musculus
cagaugacaccucagguguggcuugcuuuuuugaguccagcuuaagagcaauugaggcaauggaaggaccaagaaaggagaggaaagcagauagggccuaggccuuaugucuggucauuugggaugugcuuuuauaguucuggaccugagggugagaggggccuucuucuacgggcaagggcaacagugaagaggaagcacaaugauguaaacuggggauggaaaggcagagccuuugagguggccugaggaggcccuuguuucaccucugcuuuucucuugaugcccagugauguuucaaagaacuggcacacagacucguauugcacaguguuucuuuaauugagagacaacugaccucauaagcagcacucccucuugcugggugcaacugaccaucaccuccuaccacaucagggacccaggggugagggaggggaccuagccaucuuggggagagagcaggggccaaugcaaacugguucuggcggcucugauggccugcugagccucuccaggggcuaggaagcuccuugauccucgucuugauagcagaguaugaacccuuuccuggacaaaauggacaggauucugggccuccaccuuccagcuuccuccaggguuggggggucaaguucuggguagggcaaucaggaagauaguugccccauauuuguuuguggagggacuggcuagagaccugugaagcagaaagcagccuggggcagaugauccguguguguguguguguguguguguguguguguguguguguguguguguguugucagagagagacagauacaaagauagagagauacacagagacagagagacagaaauagagacagacagagauauaggcaaggagauacagaaagagacaaagauggagaaauaugaccuagguccagagauggaaggggacaggucaauaacuccagaaggaagaaaagugucaggaagcauaacaggguuggagagagggaaagauccaggaguuaguacagccagguuguagcugggauugacagguagugaacuuguugaagagagaacaccagaggauaagggcagcaagcagagcccaggagagcuggaagucagacaugagcaaggaagaggaggaacacaugccuggauggaacaauggcgguggcagugugcucuauccaucuuuccuagccccucuugccaaaaacaucugaguuucaggaugagcaagaagaaagauuuauagggagucucugaguggacaugguugaugaauguuaaauuucaaagguugaggggaaugggugagagggccaggccaugugcauauaugcaugcuuaggagucagggggaagcugugguggggcagugaguuaauauuggggaacaaagguguugcuucuucaucuggcuauguuccucagagacucucaccaaggccaccaugguggcaaccacugccucuacuucuuauaauuuccaaauuggauggccaggcggucaguaacgcagcggaagguggcaggcugcacuucccaguagggcacaggguuguugaagaggcugaugccauuauaguaggcccucuugacuccgaagcccauaggacagaagucauugaugcccaccuuggugauguuguuggagugcagauagacaaccugggggcagagggaauguaucugaggcuuuuguccaaggaucagugacccagagccaucccaaucuguccuagccuggguaguugcuguaaguuguaggcaagauggagaguagaaaggucaggccugccuucacaucggaccccaucaaucacuucuuagugucauuucauagucacccuuugaaggugauucuucucaggguugagaggagggcauaccggaguauguuaguggguguaagcucugauuagggcacagguauuuggcuggacucaggucaggaugaagggcucaagugcaguguauaaacgaguggugaguugggaugggugggguggaggcuguguuugguagaaugaugcuguaaaacaaagcaaacuuugauucugacaugauaucuguguaggaaagacagugccgagcuagagaaaguaucuaaggagcuaaagagaucugcaacccuguaggugcaacaacauuaugaacuaaccaguaccccggagcucuugacuuuagcugcauauguaucaaaagaugcccuagucggccaucacuggaaagagaggcccaucacacacacacaaacuuuauaugccccaguacaggggaacgccagggucaaaaaaaugagaauggguggguagggaaguggggggggggaggguaugggggacuuuugggauagcauuggaaaugucauugaggaaaauacguaauaaauuaaaaaaaaaaaaaaaaaaaaaaaaaaaaagaaagacugugccuuagguuaggagcucacuggugauagaaagguuacuggccacuagagggugcucuuagccugguaugggaagugcugcccuagaagaggaugaacgugcuuucuaccauuaugaauggaucugagcuuaaacaaacaaacaaacaaacaaacaaacaaacaaacaaacaaauaaauaaauaaauaaaaaacaaaacaaaacauaaauaaaauugagguccagaguaagguugggaaagaccuaguuugcucauguguuuggaagcuaagucagggaaggagacuccccuuuuccaaccacaaacacgaagcagacacuguuccacugaggccuggaugaguacaugagacccaaaagugaaucuaggucuuauucugcucucuacccugugccccuuuauaaagggagacaggagauccaggcaguuaagaggcuggugcagagaauggaccuucuacaacuccccaucuagucuuggagaaccagcucucaccuggaggagcuugagaucugggaggccagcaggcacccgggacagcuuguuguuguccaagugaaguucccucaggguaggcagaaaacucaggcucccauucucaaucauccgaaucugauugugaccuaagcccaaccugaagguaaaugaauuagaggucgucagaggcugggggagaggaggacucugggauagagcacagggaccugggugccacccuauaaccugccccauuugcuaauggaucccugcaucccccaagggcugccucaaccccaccuguacagcuuggaguaucgaaguagguccuccaacucaauagccuggauuuuguugugguccaggugaaguucguucagggucucagggagaucuacccagaagagaacaugcugggagguaagugcagggucuggggcagauaaaaggcccauucucugcucaaguacacugugcaaggcccaucaaugcuuuuggagguuggguauugacacucuccuaccuuuggggaugccagugagcuuggccucugagaugcgcagguaauugagcuucaggccaucaaaggcuccugguucaaagccacuguucuccaggggauucccgcccaucucuaggagagaaguccugugagcccugaagccaaucuccaccaaagccuguucuuuucuggacugcagcucugcugauugcuugcucuucccacuuccauagaaagcagguugugaauuugcaccgcuaacuacaaauuccagcuguucugcaugacuagcucaaggccucugccacuauucuuggucuuugggaguugggaagcaagaggaaacuguggggacccagaaagccauccaacguuugcugcuguggugguccacugcccuucucccuuucucucucaguccagucgguguccuauaccuuccuuuuacccauauuguuuuuuuuuuuuuccagaaacauacuggucuuuuuuagacuauauuugagacucuuucuucaaccgagccuuuauagccaccacagucuuuuucuucaugucccaaaacaaacaucuggaacauucugaggcacacagggcuuuuccaugacuacauggacccagcugcccuggcugaaagagauauccucuaccugucuccuuuaugccugaugcuaagguacagacuagucucaccaaugcaguucauguuccggagcccgcugaacacgcccuugggcacuuugcggauacgguugucauggauucguaguucuaccagggagcugggcagguugggaggaaucuccaccaggugguucuuggagauguagaguuuuugcagcuuccgcagagggcuaaaggccuucucauggaucuuggagaucuuauuguuuaccaagaccagggccuaaaacggggcaggcaaccagggugagcaccccagccccccacuccaccuccccucuccucugccuccugaacuugcuacugauggcacuugggaaacaucugaaccuuuaauggucucauggagaucaguauguguuggugaguagaguguagggcaaggagcugagguuagcuccaagcugcccugguaaugccaucacugccuagcauacuuugcuagacaguuucucuaagagcuaugauggaauacacuuucuguguuguucagaugagucaacaaaacguaaagauuucugucaaaaaaaaaugggaccugacagauuucgucuuguacccauacauauaaugcaugguuuugggcguucucauuacagccagcucuagacuuaucucaggacuccaucgguucccaccccucuucccaaccucauuugugaguacccuucuuccaagucauaggaacaucaaacuccuccuggcuccucagaaaaggcaggaggcaggaggaggcuuacguagaggugcuggaggccuuugaagucauccuugcgaagcucagaaaugucauuguucugcaggucuagcaguguggugucaggugagaucuccuugggcacagucuucagaccugggggccagcaucaucaccagcauaagccuggcucauccagucuguugucacagcugguguaaaggggguggguacauacaugcauauggacacacacagacacugggagaaaugcagggacucugagcacccucauacaccucagccuguggugacucaaccuccccacuccuacaguuuuaaacccaucucacaggguagcaaauguauucuuuuuaguaagggcucccaggcagggccugugcuucucuguacacucuuagccuaagugcuuagugacucacccaagucagagcacugaacaacccgcagguggcaguggcaaccgaaaggacacauggcacugaagguaggugugacagaguccaggucggggacaccugaaguggugucugaaccugaagccuccucaucauucaucaugagcagcccaucauccaaggugaagucccagaaacccuucugcucaaagggcaaggccuggcucagggccagcagcaaggugaguagccacaggggacacauggucaauguuccugggagcaaaaagugagaagagcuguagguuaguuuauccucccagcaguaguagcuaggguucucucucucucucucucucucucucucucucucucucccucucccucccucucccccccccucucucucacacacacacacacacacacacacacacacacacacacacacacacacacacacagagagagagagagagagagagagagagagagagagagagagagagagagaacacaauauuucgaccuuaaccagggauggcuagaugggagcagagagagggaggagguguggguaagaggcgccagucaggguaggagugcuggcuggccaggagggugucucuuuccacuccccucccuuuccuggaaggacuugguuucauuugggcaaugaaaugucuuugaaauuagcucaaggcugccuccccacgagucagccagagcccgcuucacugccugagguugggggucagugaggccaauuggaggcugagaugaagcacagcuauuggccccacagguuaccccuucugagagugagccuggaagauuuggaugcuauuaguuuaacugggcaaugagugagucacccccuucacugccugagucccuccacagugcccauguuggucugagaaggcccagaggccaaggcaugaagugggagaagagagagaggaagauggggauggggggaugggaggaggggaaauagauucuucaaugcuguagcagcaucaagcaaggguccugggaauuaggggaucaacacuucauaucuuccuuccucucauuucccaggacucagggugcaaaaguuccaggcuuccauaucuaccucuacucccucuuugugcccauggaccaggcauccuggagaagaucucaaggagaguagauugcugccagagaaacagggcagggucaggcuugucuguaggccccccaggcggagacagugugauggggguggagacucuucauugcccgagccugccccagcacccacaucuccuguuucuuucuccugcauuccaccacccaagcaguguguagucugcaggacaaggccagagcccuugcuucuuuuaccacuccucuuuguccaacuccauggcaaaggcucaggguauuuuagucacuucaccucauuugcuaaauagggaauccaugguggucuugauggccucccagggauggaugucugggguugcccugguguagggguaaauaggaagucuagccuccaaaaggcuuaaagcacccccagcucaaagaguccucuuauagagcacauggugguggugaaauugggguauuuggugcuccaucugggauaaauaagccuuccgaacucaacugcuagaggcaaaaguggaaggaacccagcugacaaggggguuaugcugacugcuugcugcuuugaaauucuuagcaccagcagaggugugugugugugugugugugugugugcaugugcgugcauuggcagaaaggggaggcugggacauccugguuugguuaaaccuaggcacaagcacugcccaucuaauggcugucagccccagaagaaaucucacccuguguuauugcuuaaaaugcccuagguuuguguuguguguguguguggggggggcggguauucacacacacagagacugaaacccagugauuuucauggccuucccuggcucccaucuaauaccaguggccagaaaagccugcacggagguuagagcaaagcugcuuccuggagagaauagagcagccuuccugauccucagaggucacacagcaaaguaggggacacagacaaaggcuuugcucaaucucuuuggugacuccugaggucaggaaguccucagcuggaggaguguccagccucccucauucuuuccaaguagucuccagaugcccacccaagccuggccuagcaagacaugggauucccccagaaguucuuggcccaaggguaccuagaaagguuaguucucccucagccuggagcauccaggacaggguggggaucuugcccagggcagauggaccagaaagccugagaagaagagcagaagcauccaagaccagauaaaaaagguugaagggaggccagagagcaagauggaagggcagggaaagagugaggugcugcucccagcccucugcacugaccacucuucugccugucuccucugccaaagcugcuauccugcaggaagaagagucagaacuagaauucugcucagcugagcuacagcgacccacaguccaccggcagaggcaagaucaggagagaugauauggauuggggaugcaguuggacagaggaccaucugcguggaaccaacccagaugcuuuggaacacagaauggccuggaaaucaccacagggcauucuuuuccuagacacgaaucuccccggaagccuuguguagcccucagacacucaggacaugauauauauauauauauauauauauauauauauauauauauauauauauauauauauauauauauauauauuuugugggcacugcagccuuuucagauuaaaagccuccuccacccaaagaaaggagcuacaggaccccaggugggcuuauaagacuagauuugaggggaaauacuguagggaugcacaaaggacuaggagagugauacaggggagaucccagcccguugucaguuccaguccaggcucaaccugggguaggaggcucaaagcccacguagaggcaggguagaguuuggcugcuuuuucaggguucaaggcuugaagggugaggggucaggcagguuucccagugcagccuucauuuacacucagaaaacuggcacuagacucaguacccauauucugcagggaagagggcaugccaaauacagagcccacagaaggggauuccaucaaauuaagggaagacuuucuuggugucuguaccaccagcagcaccacuuuauggaugagagaacugaagccuacaaaaaaacgaacuaguugauuucucccaagucuucuguuuacagaguccagcuuuggucacucuagggucucaacauucagucuugcugcugggccauggaugaaggaaagucugagucuguagguaaguaaugcagugagucaggaggugggaagaaucaucaugugguguguuagcgacagggggugcuguggauagucucacaugccucccuuuuucaauucucucaaacugaugaucccuccuccccauacaccgagaaugaaggcaaagucgcagucgggaagaggcacucuguggacagacccuugaagacuuauaaaaaguuucucccauuccacuuccuccuguuacuggcgcuuccaguccuuaguuuaccuuuuauggacucuuuggcuauguccuuaugcucuaucaaagugagcucugagcuugcugggcaccagcuccucagaggaaaggaaagaaguggucaucguggugagcugagcuuggugaccacagguugaacaagggaaaggacugggcuuccuggagcuugugccaccaccccaaauagggcccuccuugucugccccucugaaagccauguguaguucuccaugcaggauagcucugggcaacagccaagcaagacgugcuggcagucucugagaacauggaaggguugugccaggcauucaggccaggccaagggcggcaggggcaaggcuugaggucuggcagcuuuuaggagcuugccugcagauguggagcuggaagcugccaaggagcagacacggagggcagucucagcagccuccuccuggggcauugggccuugcugagcaacccuacuucaacucugauaaauggaaagcgcugccuucuaccaaguugugcaaggcucuugggacuguguaggugaggaaaugugugagagacaggagacauuaggcacuguuuuuccuuucucugaucaccaaagguaaacuuguaccuggccugcuuccugcuuucuucuauggucauuuagcuccagccuaacacuugagugucaaagagagggaugggaugugugccucaaggugagcagaaucuuguuggccagggccaaaucuuacuacuugugacugugucacugacagaguagcugggcagucagguacagcucuccaccagaauugggggguggaauuuaccugaaugaggugccuaggaucuauagagagguacugggucaucaagagagagccuucucuuccucauuccuugcccuacugacaaacuucuggaaaggagccagacagcagauaauccugaucaguuggagguacuagguuuccuaguccccuugcaacugacccauaugccuguccaucuccucccacuuaccaacaaagugugagcuccuacucaccauaugcuggaauuuucaaagaacaggaggaugucguuacuucucaauggugggaaaggagucuugagugauuuuuuuuuuuuuaccuauaccauuccugguuaccaugacaauguuaacaaugauagguaucuaguaggcucagagaauuugucccaaacucuugcccauggccucacaguuagguaaaaucagguugugaugucacuguggcugucugucuaccuguucaucccaagccccacuccuggagaaagaguagcaaggcaacagguuccagaucccaaagaucccccuuucugcucaugucuugggguucucaaacucuuuccccaacaccagguucucuacugcuugcuaggaacucuggcuagaaugggauucagccuuaugcauucagccaggaagggccaagaucaucuucagucuuccaggaucauucauucacacugccccuauuccuuggugugagugagguccugugcuggggugucucucuacaaccaacugaccucccuacaauggagaagaccugcugccaggacuguuggaaugugaggcccccacuagaaaauggguggggcauuugagagcagggacaaaggaggaagagcaggagggagucaugguggguguggagguaaugggggggggguugacaaggaagcuuccuugguauuuuggccucauuagggaggcaugcugagaaucuguggaccaaggacaagugacuccugggacagacuuaugguacucuguuucuacagggagaaaaagugaaagaccaugguggaugagcccaggcaaaagggagauuggaauggagucuaguccccaucccaucccaaaacaaugugacaaaaaacaagucuucuggagaguaucccagugcaaauugucaaauauagccucauuacaaaucucucuucagaggauuugaugcuaugacuggaggacuauagaauauugcugaaaaaagcucuuucuuaccuccacagcaucccuuucccuucuauuccaccauguugccaaucccccaacagcauaggauuuuagagggauugaaaaaaauuuuuggucaguuauagcagauuacuugacaugauggucacuggcuggcauacccaucugggcuucuaaauucuaaacuccaugguuccgauucacuuugcauguaguaggaccuugguccuuguucuggguagggaagagaagcagugguagacucaaguccuuugggguggagagaaagucaguguaggagugggccagagaggcccagcugccacacccaggcagccagcuggcuaugacgcccucucuacugccuggaucagagccuccucaugcugccuuacccuuguggcuuagaggcagacccacauccuucuaucaguauauccgcauuaccuguccucaaagcccccccucaaccccggcuuuagccuucagcagcaauacacagucauguuuuacacaaagcaaccaugcccacccacaagcucuccuaggguguaggugguacaggcaacugauugcauguccagaugccagcccuuaggacucuugcuagcauagggaacaucuuaagugugucucaauuucagucauuucaaggcagaaaacuggcagacuagagaggcaacagcuccuaaacaugaaauuggagucacccaggugcccuuggccuaauaaagauuuccucugccugcccuaccuacagcucuggaccucuuauucuagguacuccaguccgcuaaccuucaccagacuugguuaaugcccaguugacucugucugucuugcuucuucuucugagucucuugacaggcuccucagggcucuaagccacguuuucuuccuggaaacauggcacaauuuccccauuuucuacccccaucccaucaucugcccauugugcaucucagcucaagaggaagcagaacauuagucuauggugaguauggaauauuagggcaaggugccugaggugugccugggagcacaagugucucugacuacuccaaggggagacugugccaaugcugaguuuugcauuggcuccauccucccugaccuggccaggugccaagaccccaagaaaggcugagcugggagagcaaggcuagcaggagugaagggugugccugggccuugccaugaagggauaggacuauggguagagcuuagccauccacccagcccugccucagugcucugggcagcacccugggggagcucccuguccauccccagaagcagagaagcaacgcauaggugagcuuagcaacugggcacugucagagaggaaagggaaaggaaggguaggaagaaaguucagggaagagcguggggagaagaggcagaaaugugguguugaugaaaaggacacaaagccuuuggugggugcccugggggaauauagagagcagcaaggagacaguggaaguauagacacuggggcggcaagacuagaugcggcagggcugguguggagacagcaggauugccaacaucuuuggcugaugaggguacagcauagccagaaaugaagacagggaggacagauggaagucuuugucgagagaguggagucaguucccggcgugagcaggcccuaccuggggagggacaagcagccaggugcaggcugcuuaguugguggacuagguugucaggcugucgguuugucuguccgucagggccaaccgggagcagcugcucgcuccugggcaguucguggagagagggagacagaggcggugggagggaagcuaaaggcug

SEQ ID NO: 9547 - RNA, 4131 nt, Mus musculus
ucuguucaguaccuuaaauaaacuguuuauucaggaguaacaaugaaagaaugugauuaugauguggauuacaaaaacaaagacaagaugguccugcugccacagguauugccagcuccaggcugaguaugugagugggcuaguguguacacacacacacacacacacacacacacacagagucuacaacgggguguggacugcaaugaaugaccaugugugucugcagcuuggccccuucccugccccccaaaccaacaguggcugugugagacucacaguagcaaaauugaggccuucaucuuucccucccucccccucagcucuagcucugagacccuaucuccuccgguggcaguuugaccacccucagucacaaagagucucagugauccugucaagacaucugggggaggaggaaagaaacagucagggcaccagauguguggcugggaucucgcccauuggcucccaggcccaugcccucccaugugacacugcccagcaaaaagccacccagagaggcugucccuguggaugcggagagcagccauugugucucuggguucacacccuacaguuccaagaagucuaagcccuagugagagaagcaggaaggagucuacacgagucaaaguggccaggucugcucccacaggugggcauucggggacagguauggagccaagagcagguuccuguggcaaagaaugauacacucuuccugaaaaugaaacagcaagaagggccagggcccaggcagcaaucuggaauggucucuuggauaggaagccccacucccacccugaaaaaagaaaguaacagucacagacgaggcagguucuggagcauggccccgcucuagagcggugagggucaggcccgaagcccgggcccaccaguaggcacgugaaauagaaucuggggcuggccuugaguggguggggcagguuucuacucuguuccugccuugcuccaccauccccacaugagguauugcgcuuucccuccccccuuccccuuuccccucucccugcuuauggcugcaucccaucccugcuuauacuaggggucauaaguagggaccagccuaucagcuccaugcggcuuuaugugggguccagcucaaagaccccaucacugguagggguaguaaagaaggaaggugggucugagacgguggacucuggucccccacugccccgccccccggagcgcuucccccccaggcgcaggcugcguucaaagucuagcagcugccccauaaaguugaaguuaggugagauguuagacuucuuccgcuugaccaagucguaggcaucguugagugagaggugaagcuucugcaugagguaggccacggugacagugacagagcggcugaccccugccagacaguggacgagcaccccacaguucugcgacaaggccucaucuagguaaaacaggacagaacagaaacacccccuaagggucacuaugagugagaccaaagcuauacgaauuucugggaucaccaucacugccucccuacccugccgagaccauaucugaaggaucucucucacuggcaguugaccugagcucuacccccaccuccccaagugucacgugggcucugggaauggagucaggaggacgagaggccaagaaucagucugguggguggagauuguggagggggagggacagggggacaaaguagggaggacuuaccaaugaaugcaauggccuccggaaagaacugggacagauucuggcuccaauggucagagauggggaucugcuuguaguggaagucaccauucuucucaaagagguuaggaagguugggggugacauugaggauauagcggaugccaagcuuggccaggcucuccaaauuggcugaaucucgagcacugccuagguagagauugggcaggaucuggacugggaagggugguagcagcccagcuggaggggaugugguguucucagaaucuaggccacagcucaaggugucacggucagccucagacucugcaucagagaaaucagagcucaagcacaggccaccuagccccaccacaggcacugggcuagacauugagcccaggccugagccggcacgaccacugaagcugguuucacacaggugaggacacucggccuggaacuugcugaagccaccugucaggaaagaagggcgaggucuuacuaguuaauauagccucugggcagccaaguaucccuagcuggggcuagggagcugacaccacacagcucuccgggguggggguugcagauauugccaaagggaacgcauaagccagcagauuuguuuaaaccacaugugcugugcuauagacagccauccacccucacucagcauuagugacuguuucuuuggcugauaagugcccaaugcagcccuuagucuuggggcauuauccugugaaccagguuguuucaggucaauucuccccauuauccagacuuauaaaugggcuuggagggaugaaggacuugcccaaggucacggucagcucugccuccccaaaagcuguugggcagguuaucaggagggaggcgcuuacccuauauuuuagacaaaauaagauugaguuugcugaaggauaaaguaauuaugaaauccccuuggaaagaaggaucuuuucuccugaccugaggccucuccagagugcucucucaggccacugacccucacuuacccuguagguaguaugcuggguagccuucuucccgcagcuucuggagcaggacgcccagcaccgagucagcaucccacucuucuuuggccuccgcuuuggccuccgcuuuagccuccgcuuuggccuccgcuuuggccuccgcuuuggccuccgcuuuagccuccgcuuuggccuccgcuuuggccuccgcuuuagccuccgcuucguucuccgcuucagccuuagguucggccuccgcuucagccuuagguucggccuccgcuucagccuuagguucggccuucgcuucagccuccgcugcuucacgauggcacuggccacugcuacccuggucguacaggagcacaggggccggugggggaggcugcagugguggcccaggcaagagcgaccgcaccgacaugcucccccuccgcaggcggcgcagcaucagcgagggcagggccacgcucagcgccccgcagaugcgcgccgacucauacagcucccggcugcggcaguccagcagcagaagcugugggcgcggggacgacagcuccugacgcagccacaggcaugaccgacucagacucuccauggucgcgcagcguccugcacgucgggcagugggugcuguggagagaggcaaggcgcggagugagggcaaguuugucucuacuccugcagcguggaucaggcuacugaggcgggaagucaaccccuguccugagggcaggcuuucaguguccccgcagggacauuccucuaccgccugcuucucuccucgcgcuccacccacagugagaacaccaaggaaggcgccccuggaaaaagacccgaggcugccgccacuugggcgcugcucccugccccgcuuacauggaguuuucgugagacauaccccagaagauagcugggcgucuaccggucucugaagugcuaggaggacuaaaaccaguucccuccacaccccuuuucugacuuucucauuugcucugaucuccaucacuccccaaguucaauuuuggauguguggagaaguuggguucaaggcccggcucuccucuaaagcccggaagacccagagaacaagagggucaccgagguugugggccucggcgagucccguaagagcugacucggccccacuccuacccaccccaggagagaacaaaaggagagaccuggagcgagauccagaggcaggcgacugcacccggacguccuggccacagcuagugccacggcagggcguagguaucguucauggagacggaucccccaggcuugggcgcucggagagggcggggugguggagcaggcucgcacguggaagccaagccucgcgccacucgugcgccggccgcuuccuggcagcagaauccagauuccaccuuggaaggcucugccuucggaccgacuaaguagcagcucaaag

SEQ ID NO: 9548 - RNA, 9376 nt, Mus musculus
aguugguucuuaagcagcagcgggucgcgucgggaaagagagggacaguuggagugccaaggcgagucuuugaguccgccgcggcccggagagcggcuguagccgccgccgccgggaaggagggggcuagucguacccgggaccaccggagccgccagcgccaggagagccgcaagcgaacaggacagccacuuggggcugggccggggccgcgggccucaggccccuugcuccggccgccgcuugcagacagugggcuuccgaugccacccgcgacgcgcuagggugagccuccggcagggcgagcaguccucgcugcagccgccaccgccgcccgagccgcgggcaggagucucgggagccgccgccgcccggccaggcuccaccgccgcccgcgcgcucccgggcccccgacacacaugagauucuucaggcucacuuucaagugcuucguggacugcuucugacugcgccgcccccgccgucccgcaccccucccgcccacccgucgccccgucccccggcccggccgcccccgaggcccccgggcgggcccgcgcuuucggggcccucucuccaggugccaccggagcccccucgcccgcccgccacccucgaggcgccgcgacccccggcccggccucacggccccgcuggggccauggcgaaaaagagcgcugaaaacgguaucuauagcgugucuggugacgagaagaaggguccucucaucguguccgggcccgacggugccccagccaagggcgauggcccugcgggccugggggcgccuggcggccgccuugcagugccaccgcgagagacuuggacacgccagauggacuucaucaugucgugcgugggcuucgccgugggccucgguaacguguggcgcuuccccuaccugugcuacaagaacggcggaggugagugccuugccccugagcauccuggcuuuucaucagggaccaauuccaaccccagccugccacaggcccaccagagcaguggggcaaaguccagaggguagggaggcccgcccaaagcggguggaggccauggugcccccucaccaaccaagcguucugugacccagcacagcggccuccaccccccucaccggucaugugccuggcaguguggaagagaggcaaucaaggguagcuuccagaugaacugaggggcugccucucagacuuccaguccaaacugggagugauuggccacugaggugggaagggaagcccugccccccaauggagggggcucuaggaggugaggagcccuaguugcccucaugggucaggcacacaagugacacauuguguggacccccccacguguacacauaggaauacguacacacacacaaugggccacucugucccucccccacacucuccucuacccucccucuucucccuuuucuccucuccccuccccucuggcccaggcuuggaacacugggugcuugagccaggcuugggaugucugcggccuggcccgccuggcgccgccacuagacaggcuucaugcacaucccaugcucaguugccuaagcccagcuuagcaacaguagugggugcuugucuguccugggacuacaaagcagcacuggauuucuggagaacugaagcagcugggugaugggugagaaacugagucccagaguggaggccucuguccaaggucacacacagaaggaugcugggagcaggagcccaguaaacugcaauuaacucugucacugaguagcagagaaagcugauccugugcagauaggguccuagagagcaguaaagaggaauaggucagagcugcagcugcucagcucuccccucuuccuaccacuccacauaauugcuggaauacugccucagccccuuuccuugauuugucucucuuuguccuacaccaauacccccauaagcagagaauugccaccuacccagcuuccuccugggacucucaugauuacaaaguacaggguaguugggcucacugccguuugacaagcccccaagccugagcacccagccuggcacauaugaacaaaccuuggccauucuuuccuguucugcugccugccaaaaagaaguguggcacaagagauggccuguaugcauaagucuguguguuuucaauaccugcuaugucacccuaggugucuauaggcucagaacucagugagccaagggcuccccaugguauagggaacacuggcuagacacugcugcugugccuccucucaacagaccuagagcucaucugcugggauuguucacguugagccucugagucaguggccacccuugugcugauucacucagugggaagucacgggacuggggugcaagcugaagcuggggcucugucugggccuucuaggacuucuggagucugggcuggugugaggccuagacagcuuggcugauggguuuggguuaaguccccuccugcugcaggaggugauuuggaagcauccugagcccacuccacacuuccuccuccagguguguuccuuauucccuauguccugauugcccugguuggaggaauccccauuuucuuccuggaaaucucauugggccaguucaugaaggccggcagcaucaaugucuggaacaucuguccccuauucaaaggugagccgccaugggccaacucucaauucuccauuuuucaauuauugggaugagggccagggaacacaguauggcugugacccacuugaagaagucuuuugauuucuucaaugagcacuagacuugggggguagguaauuacccccccccccaugagcuuaggagagagucugcaggauacuagaucacacaauuaauuugaagagucaggaacuaggggacaggcuugcuucgaagggaaagaauggaacagaaacagcguagggacaggaccuguuggacacacuugacucaccucagagguccuacuacuguccuugaagaagcuggacacaaaggggugaagcaauuugccaagguuguccucugacgggaugaguauuuuccacacuuccucggguugcuagaaagcucucucagcuuauguauaauagaggcuacuggguaacaugggguggagacuugccuucugugacugcaucgugguacuggaaccugggaaggagcaagcauuugaagcuagacaaucaacaggauguaguaacuauauagguaggaaagagcuaucuuuagcucugggcuugguggaggagcuaaagcacagagauaguggaagaacauggcaaaucuuagccagagacagacagacaggaaagguagccuagaguugggacacacaauagggcuuuaaaagcuuggagaagccucuggcaggaugaaaagagggagaagauggagggagggauggaggcauauagggaacuugcugucaggaacucaucagggaucaaugccaacucuggaaggggagauaaugugggugguaggaaaauggccacagaggagcccagaaggaguaaaaguacucauucaucuucaggucugggcuaugccuccauggugauugucuucuacugcaacacuuacuacaucauggugcuggccuggggcuucuauuaccuggucaaguccuuuacuaccacuuugccaugggcuacauguggccacaccuggaacacuccugacuguguggagaucuuccgccaugaagacugugccaaugccagccuggccaaccucacaugugaccagcuugcugaccgccgguccccugucaucgaguucugggagugagucaggugccugugggccaagcccauccucucucaucccuuggucuuuccauauguggucaagcccugggugcacauggccaaggaugcaaaacaaccaaccacuccuggguuuugucuguccccauccuccaggagugccuaggcuggucuuggggcuugaauagacauugcuccuauagcaacaugacauuugcuauugucuucucauguugaccucauuacagagcugaaacugcauauuuguagaagguugggguaaauaugaugaccccaggguaguccuccagacaccugaugguagggccuggaccuagggcugugauaagggaggaccugccaacuccaaagcaaaucccagucacugugcccuuugcugacaugacccucaggugccuuccuuucuucucuacccuaggaacaaaguauugaggcucuccacggggcuggagguuccaggagcccucaacugggaggugaccuugugccugcuggccugcugggugcuggucuacuucuguguguggaagggggucaagucaacaggaaagguacaagugggggcauuguagggugggggcaacauuaccugggagguguacuugucugcaagggacacaaugacaauaggaggugacuagacugaggcucaaaccuacagagaggacagguuccuaaacucacaccuuuugcucucacuuguuggugggcaucuucuucaaucuucaccuccaggaacaauaaccuucagccacugagagugaaagguccagacaguaacuacccuucccugugucuacugcccauccuggcccuuuccauuuccuccucuucuacugccucgccuucuguuucuuccuacucuuugcuagaugcuuaaguuaauuuugucacucugggugaacgugaccuguggggacucucaacucugugauccucaggcccccaaggaagacuccuucagagguuuccucagguuauagagacagaugaaccaacacauuaaaauugcuaaaccaggugacacggucaggucccuggaggaucaaacuccagugcaucaagguuccuucacagcaggguccuuaaaugcugaguguuucccucccucccuccuucccucccuccuuccuucccucccucccuuccuccuucccucuuucuuuagcaauaacaccaagcugcaaacccaacucugucuuucucuugcccagcuagagucccuaacugcuaaggagcccagcagccuaccaagaaugaucuggaguuugggaccacagggcucugagggauaugugcuuauuauaauucauuguaacauugccauggguuuucuguguccauacuccccauaucuuccaacccccauauaggcaugccccauaggaacaaacuuuccuucauuagauguuagauacaccuagggacccucaccuuggaaugcuauggcccuguuucuucccuccuuuuauagcuaacuagagccugcuaugaggcugcaugggguccagccuggcuccuagcuucccuggggguagucccucacucaggaauagaaucagugcuacuggcuuuccuaaucaaauucugagcaugacugcaauuuggggauaugacuguugcccacguuaugagcucacaguagcgcugggaaccagccaccaagcuuaggcaggaggcaucuuaagggggaucagggauccagagccucucugagcacccuggccccccagaucguguacuucacugcuacauuccccuacgugguccucguugugcugcuggugcgaggggugcugcugccuggagcccuggaugguaucaucuacuaucucaagccugacuggucaaagcuaggguccccucaggugaggaaagguaguuuguggcaacaggguugggagaugcugccuguuguugaacagggucccuugugacucuucucuugacccaucccuuccagguauggauagaugcugggacccagauuuucuucucuuaugccauaggccugggggcccucacagcccuaggcagcuacaaucgcuucaacaacaacugcuacaaguaggaacccgccccugcucugcuugcccugucuugcccugcccuggagcaguggaacugcuuaaaccagaauauucugucccuccacccucagggaugccaucauccuggcacucaucaacagcgggaccagcuucuuugcuggcuuuguggucuucuccauccugggcuucauggccacagagcagggugugcauaucuccaagguggcagaaucaggugagcugcuugaccuuggccaaccuccagagcagaacuacucuguuguagggugugugugugugugacacaugaguuuagcuagcucucugcagcugagacaaacaauucucuggagcuggggacccccugucauccacucccagaacugcagcguguauccuguuuguugggugcuacagauaggaauaaaggagaugcuccuucagcucuguugugucaccccaggacaaccagcaacugucauggcugcuggagcccagggaggguagugagucaggaauccugcuaaugcaggguggggcugccaaggaccacagccuuucagaacucugaugugagaugccuauaggaccucaguggguuuagccaugcuaaggcacaaacaguccucagauuuuuauuauuuuauuaucugggggacagggaggacuugagcauuaggauauucaggauggugcugagggccagucucacccugcaucuuuccacucagggccuggucuagccuucauugccuacccacgggcugucacacugaugccuguggccccacucugggcugccuuguucuucuucaugcugcugcugcucggucuggacagccagguuugcaggagcucuagggcaggaaugggguaggggauggugguggucaggggacuuggcacauugggcaagaggugcauggggacaugggggaccugggccugagguacccuggccacaguuuguagguguggagggcuucauuaccgggcuccuggaucuccucccggccuccuacuacuuccguuuccaaagggagaucuccguugcucucugcugcgcccucugcuuugucaucgaucucuccauggugacugaugugaguggggguaagguggguuacugucaguuuccaaccaugggccaucuucucugaccugacucuguuccucaggguggaauguacgucuuccagcuauuugacuacuacucagcuaguggcacuacccugcuuuggcaagccuuuugggaguguguaguuguggcuuggguuuaugguaagucaaaaugaagggcuggguuagaaauuguggaguggaauggggauaaauggucuccaauucuagccuuccuguccaccucauccuguuccaggagcugaccgcuucauggaugacauugccuguaugauuggguaccgaccuugccccuggaugaaauggugcugguccuucuucaccccauuggucugcaugguaaggcuggggaaguaagcaaguggugugguguagugaggcaccagugaccgcaggcaucuguguccacagggcaucuucaucuucaacauuguguacuacgagccacuggucuacaacaacaccuacguguacccaugguggggugaagcuaugggcugggccuuugcacucucuucuaugcuauguguaccccuccaccuccugggcugucuccucagggcaaaaggaaccauggcagagguaaggucccuaccuaccuuguuccucaaaggaacagacuauugcucacaagcauggccagcucagacuggagggggcaauagauggaaggaaagcuaacccauuaugaccucauguagcagcaaggaggcaagacccaccucucacuucccuggcuccacacaaagacaacuuaacccacuacagggaggcacaccugccuugguggcagauaguaggagcuagagaguggaagcaguugcaugugacccaugggaaguucaacaugcccuccucucccacagcgauggcagcaccugacccagccuaucuggggccuccaucacuuggaauacagagcucaggaugcagaugucaggggccugaccacccugacucccguguccgagagcagcaaggucgucgugguggagagugucauguaacaggcacccccagcucacaucaccagcucauccuuugguagccauagcagccccaacuuuagcccccacucaucccuccgggggcuugccuuuccuugacaguuugggggucugccugggggaggggagggagcaccaugagugcuaacaaaaauaacuuuuuccauuuuuaauaaaacgccaaaaauaucacaacccaccaaaaauagaugccucuccuccccaccccacaacuaagcugguauuugcauugcuuccaggcccuaccuccucuccuucuuuccagugcccaggacccaucuccuagccuugccaagcccaccugccugccucccaagcucugcucuguaacauaccuuugcccuagaaacaacaguggcagcuuggguaacaggagaggagggaaaauaagguaggacaggaggagaagagagggacaguggaaccaaugugaauauugcagcugaauuagacccuuccuaccccuauucuagaagcuagagagccagucagcaauggaacuuuguguuccugcgccaauugccaccaauauuaacugugugagcuugggucugagugcacaccccccucuguguguguguguguguguguguguguauguguguguauguguaggucuguagaucucuuaucccuuagugaaggugaauaccagaaguaaacacagccucugggcaaaggaggcuuauauuuugcacauuuuauaagaaaaacuugagagugagacuucugcuuguauauuucuaaaaagcccccaccaucuccacauuuccacuccuuuccuucacauccucaccuuucuucucugacccuagccaaggagugugaauuuauagacuuaauuuucauaggcaaaacaaaagcuucaggcuguugaguauauauaugagucuguuguauggauguucuguauggucuccagccagagacuggagugggaaagugggagccucaaugguguccccacacugcuccuuugccucuaagucugugggacggaaggcuguaacacuguuccagggaaucugggucugcucaccugacaugcucagacuugcccacacccagcucccugggcaggauugcagggauuucccauggacaaagcccgggaaagggauccugggcauggcucccaccuccaagcuaaaaggcugauguacuuucgacaucucaagucuuccguguagcagcuuaaacccacaucugugucccaucaagccugaaacagccaaguagcccuuagaaaggcuuccuucacacagagcuggacuaagccagagagguggggcuggguaagggugcaagccuuuggggacauucuuacugugcuaaaaaagccacugcaaacauagcaauaaaaacacuucauuuuccaaaau

SEQ ID NO: 9549 - RNA, 9376 nt, Mus musculus
auuuuggaaaaugaaguguuuuuauugcuauguuugcaguggcuuuuuuagcacaguaagaauguccccaaaggcuugcacccuuacccagccccaccucucuggcuuaguccagcucugugugaaggaagccuuucuaagggcuacuuggcuguuucaggcuugaugggacacagauguggguuuaagcugcuacacggaagacuugagaugucgaaaguacaucagccuuuuagcuuggaggugggagccaugcccaggaucccuuucccgggcuuuguccaugggaaaucccugcaauccugcccagggagcugggugugggcaagucugagcaugucaggugagcagacccagauucccuggaacaguguuacagccuuccgucccacagacuuagaggcaaaggagcaguguggggacaccauugaggcucccacuuucccacuccagucucuggcuggagaccauacagaacauccauacaacagacucauauauauacucaacagccugaagcuuuuguuuugccuaugaaaauuaagucuauaaauucacacuccuuggcuagggucagagaagaaaggugaggaugugaaggaaaggaguggaaauguggagauggugggggcuuuuuagaaauauacaagcagaagucucacucucaaguuuuucuuauaaaaugugcaaaauauaagccuccuuugcccagaggcuguguuuacuucugguauucaccuucacuaagggauaagagaucuacagaccuacacauacacacacauacacacacacacacacacacacacacagaggggggugugcacucagacccaagcucacacaguuaauauugguggcaauuggcgcaggaacacaaaguuccauugcugacuggcucucuagcuucuagaauagggguaggaagggucuaauucagcugcaauauucacauugguuccacugucccucucuucuccuccuguccuaccuuauuuucccuccucuccuguuacccaagcugccacuguuguuucuagggcaaagguauguuacagagcagagcuugggaggcaggcaggugggcuuggcaaggcuaggagauggguccugggcacuggaaagaaggagaggagguagggccuggaagcaaugcaaauaccagcuuaguugugggguggggaggagaggcaucuauuuuugguggguugugauauuuuuggcguuuuauuaaaaauggaaaaaguuauuuuuguuagcacucauggugcucccuccccucccccaggcagacccccaaacugucaaggaaaggcaagcccccggagggaugagugggggcuaaaguuggggcugcuauggcuaccaaaggaugagcuggugaugugagcugggggugccuguuacaugacacucuccaccacgacgaccuugcugcucucggacacgggagucaggguggucaggccccugacaucugcauccugagcucuguauuccaagugauggaggccccagauaggcugggucaggugcugccaucgcugugggagaggagggcauguugaacuucccaugggucacaugcaacugcuuccacucucuagcuccuacuaucugccaccaaggcaggugugccucccuguaguggguuaaguugucuuuguguggagccagggaagugagaggugggucuugccuccuugcugcuacaugaggucauaauggguuagcuuuccuuccaucuauugcccccuccagucugagcuggccaugcuugugagcaauagucuguuccuuugaggaacaagguagguagggaccuuaccucugccaugguuccuuuugcccugaggagacagcccaggagguggagggguacacauagcauagaagagagugcaaaggcccagcccauagcuucaccccaccauggguacacguagguguuguuguagaccaguggcucguaguacacaauguugaagaugaagaugcccuguggacacagaugccugcggucacuggugccucacuacaccacaccacuugcuuacuuccccagccuuaccaugcagaccaauggggugaagaaggaccagcaccauuucauccaggggcaaggucgguacccaaucauacaggcaaugucauccaugaagcggucagcuccuggaacaggaugagguggacaggaaggcuagaauuggagaccauuuauccccauuccacuccacaauuucuaacccagcccuucauuuugacuuaccauaaacccaagccacaacuacacacucccaaaaggcuugccaaagcaggguagugccacuagcugaguaguagucaaauagcuggaagacguacauuccacccugaggaacagagucaggucagagaagauggcccaugguuggaaacugacaguaacccaccuuacccccacucacaucagucaccauggagagaucgaugacaaagcagagggcgcagcagagagcaacggagaucucccuuuggaaacggaaguaguaggaggccgggaggagauccaggagcccgguaaugaagcccuccacaccuacaaacuguggccaggguaccucaggcccaggucccccauguccccaugcaccucuugcccaaugugccaaguccccugaccaccaccauccccuaccccauuccugcccuagagcuccugcaaaccuggcuguccagaccgagcagcagcagcaugaagaagaacaaggcagcccagaguggggccacaggcaucagugugacagcccguggguaggcaaugaaggcuagaccaggcccugaguggaaagaugcagggugagacuggcccucagcaccauccugaauauccuaaugcucaaguccucccugucccccagauaauaaaauaauaaaaaucugaggacuguuugugccuuagcauggcuaaacccacugagguccuauaggcaucucacaucagaguucugaaaggcugugguccuuggcagccccacccugcauuagcaggauuccugacucacuacccucccugggcuccagcagccaugacaguugcugguuguccuggggugacacaacagagcugaaggagcaucuccuuuauuccuaucuguagcacccaacaaacaggauacacgcugcaguucugggaguggaugacaggggguccccagcuccagagaauuguuugucucagcugcagagagcuagcuaaacucaugugucacacacacacacacccuacaacagaguaguucugcucuggagguuggccaaggucaagcagcucaccugauucugccaccuuggagauaugcacacccugcucuguggccaugaagcccaggauggagaagaccacaaagccagcaaagaagcuggucccgcuguugaugagugccaggaugauggcaucccugaggguggagggacagaauauucugguuuaagcaguuccacugcuccagggcagggcaagacagggcaagcagagcaggggcggguuccuacuuguagcaguuguuguugaagcgauuguagcugccuagggcugugagggcccccaggccuauggcauaagagaagaaaaucugggucccagcaucuauccauaccuggaagggaugggucaagagaagagucacaagggacccuguucaacaacaggcagcaucucccaacccuguugccacaaacuaccuuuccucaccugaggggacccuagcuuugaccagucaggcuugagauaguagaugauaccauccagggcuccaggcagcagcaccccucgcaccagcagcacaacgaggaccacguaggggaauguagcagugaaguacacgaucuggggggccagggugcucagagaggcucuggaucccugaucccccuuaagaugccuccugccuaagcuugguggcugguucccagcgcuacugugagcucauaacgugggcaacagucauauccccaaauugcagucaugcucagaauuugauuaggaaagccaguagcacugauucuauuccugagugagggacuacccccagggaagcuaggagccaggcuggaccccaugcagccucauagcaggcucuaguuagcuauaaaaggagggaagaaacagggccauagcauuccaaggugagggucccuagguguaucuaacaucuaaugaaggaaaguuuguuccuauggggcaugccuauauggggguuggaagauauggggaguauggacacagaaaacccauggcaauguuacaaugaauuauaauaagcacauaucccucagagcccuguggucccaaacuccagaucauucuugguaggcugcugggcuccuuagcaguuagggacucuagcugggcaagagaaagacagaguuggguuugcagcuugguguuauugcuaaagaaagagggaaggaggaagggagggagggaaggaaggagggagggaaggagggagggagggaaacacucagcauuuaaggacccugcugugaaggaaccuugaugcacuggaguuugauccuccagggaccugaccgugucaccugguuuagcaauuuuaauguguugguucaucugucucuauaaccugaggaaaccucugaaggagucuuccuugggggccugaggaucacagaguugagaguccccacaggucacguucacccagagugacaaaauuaacuuaagcaucuagcaaagaguaggaagaaacagaaggcgaggcaguagaagaggaggaaauggaaagggccaggaugggcaguagacacagggaaggguaguuacugucuggaccuuucacucucaguggcugaagguuauuguuccuggaggugaagauugaagaagaugcccaccaacaagugagagcaaaaggugugaguuuaggaaccuguccucucuguagguuugagccucagucuagucaccuccuauugucauugugucccuugcagacaaguacaccucccagguaauguugcccccacccuacaaugcccccacuuguaccuuuccuguugacuugacccccuuccacacacagaaguagaccagcacccagcaggccagcaggcacaaggucaccucccaguugagggcuccuggaaccuccagccccguggagagccucaauacuuuguuccuaggguagagaagaaaggaaggcaccugagggucaugucagcaaagggcacagugacugggauuugcuuuggaguuggcagguccucccuuaucacagcccuagguccaggcccuaccaucaggugucuggaggacuacccuggggucaucauauuuaccccaaccuucuacaaauaugcaguuucagcucuguaaugaggucaacaugagaagacaauagcaaaugucauguugcuauaggagcaaugucuauucaagccccaagaccagccuaggcacuccuggaggauggggacagacaaaacccaggagugguugguuguuuugcauccuuggccaugugcacccagggcuugaccacauauggaaagaccaagggaugagagaggaugggcuuggcccacaggcaccugacucacucccagaacucgaugacaggggaccggcggucagcaagcuggucacaugugagguuggccaggcuggcauuggcacagucuucauggcggaagaucuccacacagucaggaguguuccagguguggccacauguagcccauggcaaagugguaguaaaggacuugaccagguaauagaagccccaggccagcaccaugauguaguaaguguugcaguagaagacaaucaccauggaggcauagcccagaccugaagaugaaugaguacuuuuacuccuucugggcuccucuguggccauuuuccuaccacccacauuaucuccccuuccagaguuggcauugaucccugaugaguuccugacagcaaguucccuauaugccuccaucccucccuccaucuucucccucuuuucauccugccagaggcuucuccaagcuuuuaaagcccuauugugugucccaacucuaggcuaccuuuccugucugucugucucuggcuaagauuugccauguucuuccacuaucucugugcuuuagcuccuccaccaagcccagagcuaaagauagcucuuuccuaccuauauaguuacuacauccuguugauugucuagcuucaaaugcuugcuccuucccagguuccaguaccacgaugcagucacagaaggcaagucuccaccccauguuacccaguagccucuauuauacauaagcugagagagcuuucuagcaacccgaggaaguguggaaaauacucaucccgucagaggacaaccuuggcaaauugcuucaccccuuuguguccagcuucuucaaggacaguaguaggaccucugaggugagucaaguguguccaacagguccugucccuacgcuguuucuguuccauucuuucccuucgaagcaagccuguccccuaguuccugacucuucaaauuaauugugugaucuaguauccugcagacucucuccuaagcucauggggggggggguaauuaccuaccccccaagucuagugcucauugaagaaaucaaaagacuucuucaagugggucacagccauacuguguucccuggcccucaucccaauaauugaaaaauggagaauugagaguuggcccauggcggcucaccuuugaauaggggacagauguuccagacauugaugcugccggccuucaugaacuggcccaaugagauuuccaggaagaaaauggggauuccuccaaccagggcaaucaggacauagggaauaaggaacacaccuggaggaggaaguguggagugggcucaggaugcuuccaaaucaccuccugcagcaggaggggacuuaacccaaacccaucagccaagcugucuaggccucacaccagcccagacuccagaaguccuagaaggcccagacagagccccagcuucagcuugcaccccagucccgugacuucccacugagugaaucagcacaaggguggccacugacucagaggcucaacgugaacaaucccagcagaugagcucuaggucuguugagaggaggcacagcagcagugucuagccaguguucccuauaccauggggagcccuuggcucacugaguucugagccuauagacaccuagggugacauagcagguauugaaaacacacagacuuaugcauacaggccaucucuugugccacacuucuuuuuggcaggcagcagaacaggaaagaauggccaagguuuguucauaugugccaggcugggugcucaggcuugggggcuugucaaacggcagugagcccaacuacccuguacuuuguaaucaugagagucccaggaggaagcuggguagguggcaauucucugcuuauggggguauugguguaggacaaagagagacaaaucaaggaaaggggcugaggcaguauuccagcaauuauguggagugguaggaagaggggagagcugagcagcugcagcucugaccuauuccucuuuacugcucucuaggacccuaucugcacaggaucagcuuucucugcuacucagugacagaguuaauugcaguuuacugggcuccugcucccagcauccuucugugugugaccuuggacagaggccuccacucugggacucaguuucucacccaucacccagcugcuucaguucuccagaaauccagugcugcuuuguagucccaggacagacaagcacccacuacuguugcuaagcugggcuuaggcaacugagcaugggaugugcaugaagccugucuaguggcggcgccaggcgggccaggccgcagacaucccaagccuggcucaagcacccaguguuccaagccugggccagaggggaggggagaggagaaaagggagaagagggaggguagaggagagugugggggagggacagaguggcccauuguguguguguacguauuccuauguguacacguggggggguccacacaaugugucacuugugugccugacccaugagggcaacuagggcuccucaccuccuagagcccccuccauuggggggcagggcuucccuucccaccucaguggccaaucacucccaguuuggacuggaagucugagaggcagccccucaguucaucuggaagcuacccuugauugccucucuuccacacugccaggcacaugaccggugagggggguggaggccgcugugcugggucacagaacgcuugguuggugagggggcaccauggccuccacccgcuuugggcgggccucccuacccucuggacuuugccccacugcucuggugggccuguggcaggcugggguuggaauuggucccugaugaaaagccaggaugcucaggggcaaggcacucaccuccgccguucuuguagcacagguaggggaagcgccacacguuaccgaggcccacggcgaagcccacgcacgacaugaugaaguccaucuggcguguccaagucucucgcgguggcacugcaaggcggccgccaggcgcccccaggcccgcagggccaucgcccuuggcuggggcaccgucgggcccggacacgaugagaggacccuucuucucgucaccagacacgcuauagauaccguuuucagcgcucuuuuucgccauggccccagcggggccgugaggccgggccgggggucgcggcgccucgaggguggcgggcgggcgagggggcuccgguggcaccuggagagagggccccgaaagcgcgggcccgcccgggggccucgggggcggccgggccgggggacggggcgacgggugggcgggaggggugcgggacggcgggggcggcgcagucagaagcaguccacgaagcacuugaaagugagccugaagaaucucaugugugucgggggcccgggagcgcgcgggcggcgguggagccuggccgggcggcggcggcucccgagacuccugcccgcggcucgggcggcgguggcggcugcagcgaggacugcucgcccugccggaggcucacccuagcgcgucgcggguggcaucggaagcccacugucugcaagcggcggccggagcaaggggccugaggcccgcggccccggcccagccccaaguggcuguccuguucgcuugcggcucuccuggcgcuggcggcuccgguggucccggguacgacuagcccccuccuucccggcggcggcggcuacagccgcucuccgggccgcggcggacucaaagacucgccuuggcacuccaacugucccucucuuucccgacgcgacccgcugcugcuuaagaaccaacu

SEQ ID NO: 9550 - RNA, 4560 nt, Mus musculus
auuucaguucccacuuuauuaagaaacaaacaggcaguuuuccccauucaggagcaucuagaaggaucacaaguagacagguugagauaugggccuugccccagcaucucauccugucaugggggugagcacccagcaggauggaagagcagcucccacaggguggaagaaguugccugcuuucccucaaggcaccaagagcuagcauagucucuacuguccacagcugcagcaaaaccuauggauuaagccagggaugcuggaggcagucggcagcacuggcccgcuucucagggauguacuccaucaugggcaacaggaaggcacugaacuguguggccugcuccaggggccacucauacuucuccaugagcaccucauauaggccccagugcuugagguuggggauguggcgcagcucuccuagagggugagcaacauuaggcacuguccccagauagucuggaaccuguacuuguacccacaauaggcaccuauuguucuuucucucagaaucaagguccuugaccuucccucugcucucuuagccccugugaccuaagccuacuuuaauccccaccucuacgguugaagaacucccgugaauaucggccugagagggcaaaagcuggagggaugucuccuagaaguuccacgauaugagcaauguggucuguaggcaaagagaaaguuuggaguugggguaggacagcuggagguccugaagccaagccagggccugccuccccuacccucaucacgacuguagucuucuccagaguggggcucaaauagguagucaccaguggccagcucaaaagccuggaaaggaggggagaagugaggcuguggcaggugucugauccuaggcauggaggcagcuaaacuaacauaccaugcaugcugugcuccagaugucagcugggggcccauacucggcaccgaucagcaccuccacggcccuguacugccgagucugaauauccucagugaagugcuugugcugugggggagggagccaccuugggaaaaggauccuagucccaggcuagccugcccccacagcccacuccugcuuuugguccaugaaccugagcuccauggagcucacucugauucuuucugauucugaguuccucagaugucccaggagggacuuugucuaggugaccguuuucuaguggccccugaccauugccaugggcacaguucuggccuggcaggauucugaugcuuggagagagcagcaagaagcagcucuuagucguagggcuccccaagaccaagcacccucucgucccaggcuggucagcauaccacccagcaggcguugccaaggucugcaaucuugaucuugaucuugucugcauuuuggggcuccagaggguucacuaggagauuggaagcaccaaauggugcugaggaaagaagaagaagagagacugaucuggcccugcucuuuaugguccugucuacuacccacuguaccccauacuuacugcuaggagauagaagaccuccagucucacgcugauuagaugaaccugagaggauggagcaggaagccguggagaacagggacccugaaaaaccugaggucugcgagcugggacuaaggcuucguucccccccaggcacaggggaagaagaggcuggagaagggccagcucuggugcccuccggguggcagccugaagaagagguggagccgcugccccguucuagucuugagcuggagucuagggagaaggagcagaagagcacaugaguagaagccugcaguccacaugcaggcuuaguggcucagugcucucccugcccccucacccucagcuuguacugcggccuccauagccucuagccucugcaagucccucagccgcuccuccagcagccucuucuguugcuuccuuuugcgccucaucuucuuccucuuguuuuuggacagcuugccaaucugcugucagagucagggucacacccccuccccauguuuucuuguccagcccugaaccccagaacuaacccccauggguaucagacuauggaugcuaucuucugucucacccuuauucccaaccccugacccauuucucugccucuccuccuaucccccuccuaccuugugcuuuggggagaaccuagugggccugcucuacacuguuccuugucuacucccagaccuagaugaagcugccugaaguagccaugugggguaucacaguauccuuccauugagguagugcugggcucauuggcgaccagaggcagcuuggagcacaugauccacucugucuaaucacucucuucucagguacucagcuuuuuagaaguucaaaagguagaacagguauggcugaggauccaagcucugaggacauggccucaucuagcuuguauuggaagaggagacagggaaagaggggguaccacaacuuaccaagaccuccuggggggcagugcugacuggauguaagggguagggagagaaaaaagaacaguaauucagguagagauugagguccagaguccugguaucaguccccacacaugcucuugguaccuguggaacgggaugggggcugggccccugacugcugccacucuguggcuucagcagccaggcgccugauguaggcaucuccaacacacaguaagauguucucaggcuugauguccguauggaugaucuugcacuuaguauggagguaauccagaccaugcagcaccuggcaaaagcuacagcugaaucccagcagccaggccuagccaaccugagcaguguaggggcagcaccuaccugucuaacaaugcucuuaacacagggcacaggcagacccugguaguuggauuugaugauccacuugaggagcugguggcccaggaccucuagcaccaugcauacaucuggaccuggagugaagggcagucaacaacacagcuaaggcacaggcuuaccuacccuccaucauggaggagcacuuagacuccagaaaugcagagguuagggaaguagggcuuucccuugaccauccugguggccaccacugaccaaguuuauuauuuagaauguuucugucacugucacggauaugccagucgagaugguaccucuugucauccuacagauaucucacuccagcuuuacucuucugcccaaguaggccucaaaaguagccuuuuauauuugggagucacucagcagauaaucacagucaaccuaauuaccuguguucccccuacucagaaacacaagugcccaaagggaugaaguuguuuuauaggcucuucccgcaagggcuaaaucccaugaugcaauguggaucuuugacugccauauugcucguucugcaaaggauacggacuccauuuacuccugagauccugaagucaucgauaaguugaacaauggucucccuuuuggggucacuagggucacugucccugaccugaaacaaaaggcaaggagccacagaugacuccaaccugcuccucaacacugcucugcucauauccccugaagcacuucuaucccccuuucccaguccagcuggggcccacuugaagaaagccagcugccucugcucuccggguccuuuuacuuggcagagucagcuggagccuguccccucugggagccccgccccacucuguagagccccagcaggcccugcauucacauugccaggcccaaggcaguucaaggggcugggagcaguaggggaggugccuuacacauuucaggagcuugaucucauccacggcugucucaguguaauguccugcacucuucaccacuuucagggccacaaagcgcuugcgccuguaauauggagacccucauaggcugccagaccuugccagagucacauguucucacggugguggucuuaaccaaacccauaggcagaucccagcuacucacugaauaucccagcagagccagacuguagagaaauggccccagccuagcuuucgcaccacaugguaccgcccauugaacaaaucaccgaucuucacuggguaguaaccaccugcagaagggaaccaaaagaucagaguagggcaucucucccuuauaccucaauaucaauguccugcuggucaucuaucucacgugggccuagucuuggcaacuuuuuacucucaagcuguccugagcccuugcaguggcaauccggcuggccacaugcagccagggccaggccuuacccuugcaauaguccuuagggucuuccuguuccucaucaucagagcccaggagucccugcagcaaacgaggugcugguguggcuggaguuaauucagagccugaggacucaggcccacaggaagucugagagcugugggugaaggaggaggaugcagacagugagcucacagggagcaggggaccccagucuccccagccuggucauaccugcugcugcugccgccacaauccacacuaccacuaccaccggcauuggcacucauccugaugucgcagcccaaagcucuggugcacuggaccgcuguuccuguggggcccagccguggccagugcauuuauagcuucug

SEQ ID NO: 9551 - RNA, 4010 nt, Mus musculus
caucuuggggaggggaaggcugagaaggagggaagugcgaccgguugggacccuggcuagggaagcggacacgucagugccgccagcgacgucaccaugcccgacccagcccgccgacgcacgauugggugcugaggccgcuuacgcgucgcgcuuccucgucugcuccgcauguccaggguggcuugcucucuuuuccccucggaagagaagaggcgauggcggcgauggcaucuuucggcgcccuggcacuacuccugcugucuggccuaucuugcugcucagguagcggccuggccggagcuuguuucggggcgcgccccugcuguuggcagguggugcuggggggaggaagggugugcgcgagguggggaucuggcccuucccggggcucgucgcuacugacgggaucuucccccgauggguguugugucguggcgaccaaagcaccacacacacguuuacccgacagccagguugcuuccuugucugcuuuugggagaacccccaaagcaguaccaugcuccgaccaccagcuccagcagggaaggugauauguaugucccugguuccugugucaaaagguagucgcacaagagcagugcuggcagcuacgaaccaaugcugcauaggccaggcuuccccaagagaaaccuaagagagggaggcagaucagaguaagggcacuaggcgaguuagauagggaaccgaugaagugagcaagggcuuuuagugcccagagccucgacuuuuugugacgccuugguauaucccaccccaaaguucauagcaaaauugaaccgugcacagacccguugauauuugugagacaucuguaacgugguaguggggcugagcucaaucuggagugccggcauguguuuugaaagauguuagcaccucagaccugagagccugaacuaaggacgauuugguuucuguacauacagguagccucuggccaucccuucuacccaccccucagagaauccuucagucuguugcuagcagugucuuaaaaagacaaaccuggcuguaacaucuauuagggguuccauagugucuacagggaaaggcccagcugagcaggucacagaaggguugguggaauauggccuugagagccauucccaggcauuuuccuccugccauuuaugccgguacaaggucuucucuagcuuaaucggucauucuuucaagacaucacauuuggagaagaguuggaugaaaacuuuuccucagggguguuuaguuuacaggggcagguuugguguuugggcccagaauuuacuucucucaggaaacacuagaaccagucuugacauucugucaccuggaugggucuagagacccuuaucuugaaagucccuguguguuaacaacaccccauuuagugucugcagaaugcuuucaguaggcuauugaagaagcucugaauugaggcugccuugaccuacugggcuucugggguacuuuaggagcaggugagcugcuuuguggccucccuaucauagauucagauacuaauuucaucagccuccugccugccucaaacauggcuguugcuuccauguuguugcauccagacucaccucugcagagcuuucccuaccucacucuggccuggcucaucagcccucacuggccccuuccacucuacuuuugacugaguacuaggauccaucucccagaccccacuuucugucaggaauagaagaguauguguauccucagcucaccaagucugagagguggagccaggguaagcccuuuugccuggaacacacaaauuggcuuugccuccucuccacagcagaggccugccuggaaccacagaucaccccuucuuacuauacaacuucagaugccgucauuucuacagagacuguauucaucguggagauuucacugaccugcaagaacaggguccaggugagacaguagggacucagcagagagggugcaggggaagagaugaggguggcagacucauucacuggcaguugacagugaccugaggauccuaucaacagggagaauaaggauuccaauucacagggugcaggagagaugagggcacagcgaggccagauccuagcaaguacuucaagagcauuuuccugaccugcuugguaugcuuugccuccaugcaguaauguggguagacaccccacuguuuccuggaugaaugucuggaaugggagaaagaacuagggucaggccccucuaucuuuuuuucucguuguaguuugccugaguaugugucuguaugaauguucuguaaguuuaaaauagaaaaacuccagccugaaccuuuaaccugcucuuccaaaaaucuaaagaaagaaauuggaacuuuuucgggggggaacaauacuccuaggguuaaauacuucauuuggcacuuccuucucaagcuccaagaaauaacaaggccauuuuuuuuuuuuaucaucccaacccuguguacagcuaacagacuuguuguggguuaggauaaacugguuauaagggauauguaguucuguucaccucuagggaaacagaugaagaaagacaugacaguguccaugggugaggccuagcauggcucugggcuguggcaggcccauuuccugagucuuccacagcaaccccuaccaacauacuauagcccucugcuggccuacucucccuccccagucauaguacugcuuugggcagcacaauggaggguucuauguaugcccagagaagagaggaaaaugcgauucuugcuuuuauuaccccccccuccagaacauggcucuuuaugccgacguuaguggaaaacaauuuccuguaacccgcggccaggaugugggucgauaucagguaagggauacugcauccaggguuguuggggaaaugguucaaagcaggguuagagaccaaagauuuaagcacugcucauggugguauugugccagcacuagcagaguaaucccccauguaucugcuaugccugccccuuaccaaacacccaaccagguguccuggagccuggagcacaagagcgcucaugcgggcaccuaugaggucagauucuuugaugaagaguccuauagccuccuaaggaaggugaguaucaucuggaacuccucugaggccccaaggagggagggcaugccccauuucugaaguccucuuuacccuggucauucuguauuccccuucugcaacaucaguacucuaggggccaggacaagugguugucuuccugcacuucugccccugcuuccuucuuugucucuugcucauuucucccuuuucuuggcaaccuacccagcacuucuugaccccagcaccucccuuacaggcucagagaaauaaugaggacguuucuaucauuccaccccuguucacagucaguguggaccaucggguaagugcccuugucuuggaagcagagaauacagggcauaccucaucuuuugggguugucuaaggaaaagcucugauccucugcagcccagguucugggcugcuguugaucuguguguccugagaacaagugauuaagggugacugcuccacucccuggcacuccccugagcugucuuuuggucuucuucuuuuuuuuucuucucucucucucucucuuuuuuuuacaggguaccuggaaugggccuugggucuccacagaggugcuggcugcaguaauuggcauagugaucuacuaccuagcuuucagugcaaagagccacauccaggccugagggcagcaacuucagccguccauugcuucuuucaauaaacagucacuauuugacaugaguacauucaagacacggggcuccugugucuauggggaaagcuggggauccagcugcccuugucugccuggacagcagauaguaauucugagcagagcuauauuuuccccaauguccucuguuuucucuguccuuguccuguuugucaggauaucuugggccugucuucucuuuucuuguguguggccucuaaaauaagaccaucuuggcugggca

SEQ ID NO: 9552 - RNA, 4010 nt, Mus musculus
ugcccagccaagauggucuuauuuuagaggccacacacaagaaaagagaagacaggcccaagauauccugacaaacaggacaaggacagagaaaacagaggacauuggggaaaauauagcucugcucagaauuacuaucugcuguccaggcagacaagggcagcuggauccccagcuuuccccauagacacaggagccccgugucuugaauguacucaugucaaauagugacuguuuauugaaagaagcaauggacggcugaaguugcugcccucaggccuggauguggcucuuugcacugaaagcuagguaguagaucacuaugccaauuacugcagccagcaccucuguggagacccaaggcccauuccagguacccuguaaaaaaaagagagagagagagagaagaaaaaaaaagaagaagaccaaaagacagcucaggggagugccagggaguggagcagucacccuuaaucacuuguucucaggacacacagaucaacagcagcccagaaccugggcugcagaggaucagagcuuuuccuuagacaaccccaaaagaugagguaugcccuguauucucugcuuccaagacaagggcacuuacccgaugguccacacugacugugaacagggguggaaugauagaaacguccucauuauuucucugagccuguaagggaggugcuggggucaagaagugcuggguagguugccaagaaaagggagaaaugagcaagagacaaagaaggaagcaggggcagaagugcaggaagacaaccacuuguccuggccccuagaguacugauguugcagaaggggaauacagaaugaccaggguaaagaggacuucagaaauggggcaugcccucccuccuuggggccucagaggaguuccagaugauacucaccuuccuuaggaggcuauaggacucuucaucaaagaaucugaccucauaggugcccgcaugagcgcucuugugcuccaggcuccaggacaccugguuggguguuugguaaggggcaggcauagcagauacaugggggauuacucugcuagugcuggcacaauaccaccaugagcagugcuuaaaucuuuggucucuaacccugcuuugaaccauuuccccaacaacccuggaugcaguaucccuuaccugauaucgacccacauccuggccgcggguuacaggaaauuguuuuccacuaacgucggcauaaagagccauguucuggagggggggguaauaaaagcaagaaucgcauuuuccucucuucucugggcauacauagaacccuccauugugcugcccaaagcaguacuaugacuggggagggagaguaggccagcagagggcuauaguauguugguagggguugcuguggaagacucaggaaaugggccugccacagcccagagccaugcuaggccucacccauggacacugucaugucuuucuucaucuguuucccuagaggugaacagaacuacauaucccuuauaaccaguuuauccuaacccacaacaagucuguuagcuguacacaggguugggaugauaaaaaaaaaaaauggccuuguuauuucuuggagcuugagaaggaagugccaaaugaaguauuuaacccuaggaguauuguucccccccgaaaaaguuccaauuucuuucuuuagauuuuuggaagagcagguuaaagguucaggcuggaguuuuucuauuuuaaacuuacagaacauucauacagacacauacucaggcaaacuacaacgagaaaaaaagauagaggggccugacccuaguucuuucucccauuccagacauucauccaggaaacaguggggugucuacccacauuacugcauggaggcaaagcauaccaagcaggucaggaaaaugcucuugaaguacuugcuaggaucuggccucgcugugcccucaucucuccugcacccugugaauuggaauccuuauucucccuguugauaggauccucaggucacugucaacugccagugaaugagucugccacccucaucucuuccccugcacccucucugcugagucccuacugucucaccuggacccuguucuugcaggucagugaaaucuccacgaugaauacagucucuguagaaaugacggcaucugaaguuguauaguaagaaggggugaucugugguuccaggcaggccucugcuguggagaggaggcaaagccaauuuguguguuccaggcaaaagggcuuacccuggcuccaccucucagacuuggugagcugaggauacacauacucuucuauuccugacagaaaguggggucugggagauggauccuaguacucagucaaaaguagaguggaaggggccagugagggcugaugagccaggccagagugagguagggaaagcucugcagaggugagucuggaugcaacaacauggaagcaacagccauguuugaggcaggcaggaggcugaugaaauuaguaucugaaucuaugauagggaggccacaaagcagcucaccugcuccuaaaguaccccagaagcccaguaggucaaggcagccucaauucagagcuucuucaauagccuacugaaagcauucugcagacacuaaaugggguguuguuaacacacagggacuuucaagauaagggucucuagacccauccaggugacagaaugucaagacugguucuaguguuuccugagagaaguaaauucugggcccaaacaccaaaccugccccuguaaacuaaacaccccugaggaaaaguuuucauccaacucuucuccaaaugugaugucuugaaagaaugaccgauuaagcuagagaagaccuuguaccggcauaaauggcaggaggaaaaugccugggaauggcucucaaggccauauuccaccaacccuucugugaccugcucagcugggccuuucccuguagacacuauggaaccccuaauagauguuacagccagguuugucuuuuuaagacacugcuagcaacagacugaaggauucucugagggguggguagaagggauggccagaggcuaccuguauguacagaaaccaaaucguccuuaguucaggcucucaggucugaggugcuaacaucuuucaaaacacaugccggcacuccagauugagcucagccccacuaccacguuacagaugucucacaaauaucaacgggucugugcacgguucaauuuugcuaugaacuuuggggugggauauaccaaggcgucacaaaaagucgaggcucugggcacuaaaagcccuugcucacuucaucgguucccuaucuaacucgccuagugcccuuacucugaucugccucccucucuuagguuucucuuggggaagccuggccuaugcagcauugguucguagcugccagcacugcucuugugcgacuaccuuuugacacaggaaccagggacauacauaucaccuucccugcuggagcugguggucggagcaugguacugcuuuggggguucucccaaaagcagacaaggaagcaaccuggcugucggguaaacguguguguggugcuuuggucgccacgacacaacacccaucgggggaagaucccgucaguagcgacgagccccgggaagggccagauccccaccucgcgcacacccuuccuccccccagcaccaccugccaacagcaggggcgcgccccgaaacaagcuccggccaggccgcuaccugagcagcaagauaggccagacagcaggaguagugccagggcgccgaaagaugccaucgccgccaucgccucuucucuuccgaggggaaaagagagcaagccacccuggacaugcggagcagacgaggaagcgcgacgcguaagcggccucagcacccaaucgugcgucggcgggcugggucgggcauggugacgucgcuggcggcacugacguguccgcuucccuagccagggucccaaccggucgcacuucccuccuucucagccuuccccuccccaagaug

SEQ ID NO: 9553 - RNA, 31617 nt, Mus musculus
acauuaacagcaaaaaggcagcuugcuuuauucuugggguguauguagguggggagcaggggcauccuguagcauccaaugagcuucaccaagccugacaggcaccaaacauuuuaaaguuccaucaccuggaaaagguucuaggcaucucucagucagcccaccuuccuuucauugggcccaggccuuccaacucccaccacauccucucuagacucauuagguuuggcccuccuugcuuaagccacugagaagagugacucugcuccagauggcauagacagauucuuuugcauggauacugugccccaaaucccugugaucucacuuuccuucagucacuggcaagagaggugggccuccaugguuaagccuugaaagccaaggcagagccccuagaggccaccaggacagcugcuuuuuauucuuccccaucuuuuuccuuucccucccacccaacccucccucuuuuccuccccccaaccuccuuuccagccagcacucggugggguccaccuuugucaggcugccuaaaggagcugccagcccccagagcaggcccacaaaacagaaaacaacuauuggcaagcacagaaaagaagaaaaaccacaaaauucaggguugccuuugucuacaaauaauugcagcuccuaggaggggagaggucgugcucagcaugaagcuggacauucucuugugcuuaggauaguccaccucaccucucugcacugauuucccugucuccaagaaaauagcaagaauaccauguguauacacaaagaggugcccuuuauggguaugccucuauguugguuguuagcauagcuucuuggggaaaaggaacuaggcguaagagaagugucccuucuuggggcuuucuauuaccaagguccugugcacacauaacauacagguaaggagugugcaugagcacaucgugcaagcacacacaucgacacacacuagauucuaagggagggugagggucaggcuuucuagaccugggcugggcuccugcuggagcagcucagacaguggugacagagagcagaggguuguagauccuuuuuccaucagcugagcgggcaccaugagccaacaucuccuggauggugauccaguuguccagaaucuucuuguuucgcuucuucaugguuuuacgguggcucagcgcaaugauguugagcucagguuugcugucaccauucugcugcucccuuagacacuccagacggcucugcaucaugaacucacgccgcuuccguugcucccgugcucggaucagguguugcuuccucucuuccuugcuccaguagcggcccaucuucaucucacucacugcaucaucaucaguggucauaccacugcguuccucucggaucuucagggcccuggccuucagcagccgaucucgcacaggucgcuuggccacauagcggguuccaucacuucgcaccuucaccuuccacuccaugcggggugcuucgacagcugcagcugccaccccacccacccgaggaccacuagccaagcucaaggagccauggcccagauccuccagggugcguggcggggccaacugcacacagcugugguacugcucaaucuccuggccacgauggcgccuggagagguaagggcugccuucagggcccacacgcuccagaguaacacuugucuuggugcuccggcggacacgcucuucugugugcugucuccggcccacuucaggaucccgagagagugaucggaacuuagcugggcucccuggugaaggagcccccuugagguggguggugacaggagggccagaagggguccgauucaaguuggaauugccagcaccagaucgcuucagcgggcucucaggcagaggcuccacaagaaguggagugcugcggcagcucucccccguguuguaagcgcuggugcuaucuuugucugauuucucuggcaguucagagauaucagacagcucaugcuuuuugggcucacuggcugccaggucauagagacuuuccuccuccagcagccaggccuucauacagcgcucccgcaacugcugcaucuucugugcccgcaagauauugcggcacuugaacucuaggugccgaagcucuuccuccagcauggccaucucauggccuaggcucucauugcgguugacaucuagggcacuguugccacuggaggcccgggagaagaagaugcccagcugguugccauuuuccagguggcacuugaucuccagcagcucccgguagcguucauacuccucaucagugagcccagguaggucagccccucccagcccugcccccucagcuaacagagaauccaugcugaaguggaagucccugcucuguagggcauccccuuguagaccaaauuugcguaggcuuccaggaguguugguggugcugggagguucaucccccagcaggucauguucagagcucucuucauugcggguacucucaucaguccgacccaccccgcuguccagguccuggcuguuguuuaagccugggcccccaucaggagcccccuucucaucauuuccaaucugggacagaaaugacaaacauacucaguuagguucucacagacaagugugcugcagaaggacuagaaaguucacagcuugcuccucuccaggcccaugcuggaagacaguagacacauuuccuuucuccuuccucccucucuuucccuacccaguuagcaggccuucuuccuuccuuaccugcuggacaggaggugacuuuagcuuccuagcacgaagguccccuucauucucagauccaaagucaucuaggaagucaucucugucacugucuuuccaccgcuuugcuagcugcagagacaagcaugagauagucaacacuuuaaagcccuccccaaugcccuuccaccuugcccuagacccugcgcacucaguaaaguaaaacaggccagcagccuucaagacagaaagccugugaggagcccugugucgcccuuucauaaagacauacacaccuggcucucaggucgggccaccagcagggagauguuaguguucuccuccuggcucaggauggccacugccuccucucgauuuuggacauccauuccauuaaucugcagagguuuagagaauagucaacaagaaugcuagugggggacucuggcugugccaaggacaggguguugaacucugggaaggcauaaauuagcagaaugcauugggggaaaggauggccuggccuguauaagagcauaugugcucagagaauggagaaguagaagagggcagggaggugcuggcaggaauacaugggagcucucagggaaguugagcagaacagagaugagauuuggcucaggacaugguagauuccaggguagaaggccagguucucagcagaaaagaucuaggaagggguugaaaagaaggcagggcaggcacggcagccugauuucuagugcucaccuggaugauucugucucccucacggauccggccaucuuuggcugcaaugcuguugggauuuaccugcaggacacaugcaucuuggggacuuuggcaacuuugaugcccuuuucaguguguguguguguguguguguguguguguguguguguguguguaagcggggaaaaugccagucuugcucacuuucccacuucaccucagacuagcagcuucuaagcuuuaggaagcaggagugggacagugagccaaggcaguuuguuccaucagcuugggagauacagggugaccagaaacaguucccuagucccuacccaacacuucagugguuuugccucuaucccuuguacuacuauacuguauauaucaaagucuuuuuuuuucaguguuaaggaaccuacagccuuguauauguuaaaaaaguauuuuacuauugagcuauacccccaacuucauugaagcuuuauuuucuuuuuguuugcuuccuuucuuuccuucuuucuuucuuuucuuccuuccuuccuuccuuccuauuuuuucuuuuucuuuuucuuuuuuuugcauguaugugcacagcugcauggagguauugguuaaauccagaagaagguauuagauccucuggaacuggaguuagaggugguugugagacaucuaugugauuucugggaacugaacuuggguccuuugaagaagcaguaagaaucauccuccuaaaacacuucccacaugcauacuccccuuuaaaacaguuucacuauguagcucuaaugaaccgcaagcuccuagaaaucugucuuugccuucuaagugccucugaguuacccacacccaacuuauuuguuuuuuaaauagggucuccagaaguucagggugaccuugaacuacuaaugcuacaaucuggccugagccaccacacccagcucagaggucuuucuuucuuuuggggggcggugaggggacaggaacuaggcacuggcauguggcuagaugcuucuucauaaugaaaauacauaaaguuguguguucugggcagugggaccuuuuccauuuggaagaguagcuuuaguaggauagugcuagcauacauagacaucugccaaagggaagaaaauggggagagaaggugggccccauuaaauccuugaugccugcguacaggucagcagggcugucuccuuggauauacugaaaccauagccacccuggccuugacaccaacaaccuacugugacaccuaguggguaguuaggaccucugggcagcccuaaagccuggaaagacuuuguggaaagaccacagagcuggacuagaacagcucuggggcucggugugccaaagccugcugcagcaccucuccauaccucuccaacguagaugccuagguccuccuccucaucugugcgauagcacaccaucaggcccagcuugucuugguggcuguuuuuacacagcuccaccuccugccacaagagguaggggaggaaguagagguauaaagaacugaaguguauaagcaaggacgccugcagccuuggcccaggcccuugccccuagcacccccuugccuucugcuucaguuaucugaacugaguguguagcccuucccuuugaggguucccuucucuuaccauccuaaaugugcgaguguucagugguuucccuaccaggaaacgcccaagacacaagauguacagaacacacaggacacagacaugcaugggacacagagucaccaacagagacauaaggaacacacuaccucacccacacccucccugacucaggcugcucucuacugggaaaggucaugaggcccagccaccagggggcggcaggagccaagccugggcagagcugcagaaagugggccugcagacucuugguggcugcagguuccggccaggcaggccagccacuaggcucaccucguacuccagcucguccauucgcucugccuccugcgggccgcccuccaugaacuccgcugggucauaauacucauggcugaugggggggcugcccaggagaagggggggucagaugggccaucugcuuccuuggcacccuagccccagcuccaagcuggcuagucccaguacaguaaacaaagaacccuguucuagauguacuuucuagaaaagguggccaagcugcuuuuagaacccuccucuuugaucgacacaaauggcuguggaaggauuggaaaugcuccucaaacgagcucacagggguccauccuaaggaccuaggcagguacaccuagcucuccccaucccaacucccagaccaagagcugauuucuccaaagcucuaaguucccaggcugccucuggcacuguacccacucaugcagaaccuucaggaguuacccaggucuucuacaaagcagcauuauucuucugccuccaggaagggguuguccuccuugccuuaacauuaaaacugacagcucacugcucuauggccuaccucucugaacaaaaggguucccagggccaccucccuauagccccguaggauuaacagaaugagucagugcugcucacauggucacagccaccaggccaggaugaaaggcccuucuucuuagaaggccaaagaaacaagccgaagggauggaggaaauucagagcaaguagaagaaugggacagacaagggaugcaagaagauucaaagagagaugcuugugaggaggcagagacgauggcagcagaagaggaaagaggaugaaggagcagccaggucccaggaacauaggugucacuucagccuuucugccagcuggugccaagccugaggccagaggccuggagguucugagccugagugccauggucagcucuagugaucaagccugcuuaaugcccaagaguggcagcugaguugugucuccccaccauggcuagagcugaaagccgccugugggucacauggggacagcugcccagguggcauguccucucuggaggcagggcccaggcccuccugagggcaacucacagcucagagaggacguacggcuccaagaugcccauggguggggugggcgggcgcagcuugcccagcgccaugauaugcucgaaggugaugucggucugagugccacuguccaccagcugaaggucauggcaggagcuguccccccgcagacgggggcugcgucucagcaccuggaucaccaggggcuccuuggaggcacgcagggccucuaggguuugcuccugagacagcuuggagagcuccuuuccguucaccuguggcagagauaugccucugugagaacccucaagagccgacuucuccccucuggaagugaaguccagcaggacccugaguugcuaaccagcacccagaccuguucaaccgagaaaugugcucuccacccacagcccuggcuacccuuagugcccuccuucccaggcagaccccauuuaucagccuucaacccagaguucugucuguguguugcugaaauucccucaaagccaggugacugaguaccuguacagagugugaaaguucuauuaucaccuugaaacauuugcagucccuccuccaucaagaaccauccgcagcuccuugauccucccauaggauccuccucucuucuggcugcaccgaggccagagacaacuagaagacugcacugcaaauuuccuuaauaauaacugagacaaacuagccaaccucagggacugucaauuuguacuacccaacacuggggccagaggaugacugaguugaacaaagcaacaaacacagggaagggguaauggagaaaagaguaaaauguacaaggcuguuccuuuugaugacaacugacuugcugaagagaagaaggucuccugacacuaaaaaggucuagaauugcaaagugucuuuuaaaaggugccaaaugguggccaacacaauuuguuggggcacuugcuauacaccagguugcaggcaaggcccuuuaaagugaguccucaccaaauccauagcccuggcaaauuuaagggagacacacacagguauugcuucuguugagcagaugagaaaagugaggcucagccaggugaacaaauugagucaaguagaguuugcccagugccuauacagggaggaugccugaggcaaaagcaggacugggaagagcagaaugauggggcaugggggugucuuucagacagaagcaggcugagacccuggcugagaaaggaaaaagcccauuacugagugggcaagcagucucagcugggugucaagcaagugccccuugguaaaaggcugaccucagcccaaccagaaucuguuaaguucugagcaguuugcuuuacuccuuaggucuuccuuggaaauugaccaaaaaaaaaagaaaaaagaaaaaaaaagaaagaaagaaaagaaagaacgaggacauaaaaaaacagauaccaccagaauucaggguacuugucaaaguccagcaaaaaaaaugcaggaagcagugucuagagauggcaguuacuggaaaacauucuggacugagcaagagcacacccauugguccccacugggaugagcauggagccagcaauccccccucccccgaccuagaaggaagguaggcagaauccuugauuuggugcaaagaaagugaugggccaaaaacagaggugacacuuaggaggcuagagaggaucacugugaauuugaggucagccugacauacuccccuauucucccucccagggugggggguggagaagagcuagguaugguggcuuauggcuuuaauacaagaccucagaaagaguucaaagucauccuaagcuacauaacaaaccagcauagguuacaagaaaaccugucagacauagaaaaaagaaggaagagggagggaagaaaaaccaaacaagugagaaggcuaguuuucuuaggauacugaacaaggaagaaagcacuuggaaaggauuagagaugacucccuugcuaugacuguggcuacaugcaguuguagaaaaugcaguuguaagcccucugcuuugccuaguugccccaauaucugcaaagacccucacagcaucagcaccugucuguuucuucuuucuucugcccuuucaaccccauaacacuagauuugggggguggggauaaagaggaaaagauagagaucccugacuaaaggcagagucuggaaagggcgagacauuaucauuagacuacuucuugcugacuaaagacaucaaguuccuuggggcaaauuugaucuucgccaucaggauaucugauuucuucuuguuguuucuucuuuauuuaacaaaucaggaccaacaaccaaccaaccaauaaccuaccuaucaggucucuaccauuuauauacccucugaaaaauucucagaauuccaaaugucacacaauugcaggaacuaucugcaacuggcaaaaccaugccccugcuagagcaggagguaaauuauagucagcugcuauggacaaccugaagcaccccacugcugcaagcuccuuuaauaccuuccacuugcuccuggagucuguaucguugacucugcgacaucucaccuccaacccccaaggacagguaggguguggcagugaacaguccagggcacaggcaacaccccauaucccuacaucugggauuaaaacgaacacacauaccuauuucugugucuuuuaaagaaaacaaauucuuacuauauuuccccuucuguuuuaagccauuaauuaugcuguguguauuggaaaauuauaaacauaauaaauuaucuuggguaauuuccuuuggaucuauauucauuacuccaguggcaacucuugccucaucaccuguacaccccuggaagccuagaccuucuuucuggcuuauauuuagaaaaauuacugcuuuuagaaaugccuuggguuggagugauggcucaguaguuaagagcacugacugcucuuccagagguccugaguucaauucccagcacccauaugguggcucacaaccaucuguaaugggauccgaugcccucuacuggugugucugaagacagcuacaguguacacauaugcauuaaauaaauaaauguuuaaaaaaagaaaugccuuguucauaauuuugauacaaaugaccaaauucucccacaaagcacuguacauuuugagaucugaaaccuuuagcagcuugaucacaauuagucucuucacaaaugaccauauuuccugaauugauauuagagaccucuagcuauaacuucaccuauauuagcaugguacguguuagaaccaauauuggucguaucccuuauccacucguccauaggcuaugcuaacuccuugaaugaucuaauaacuuuuuuacauucaguauucacauuuucagaugccaagaucucuaucaacauuguucuauaguagugucaucaaauuaaaucuguucuguuauuguauaucagaguacugcccuucauguagcaacugaucuuuuacuauauucauuccccucgcucuauuucacucuucaacauucaagacuucuucccuaugcuauuuuaugaugucacuguagguaaauuuguuuccucugucuccuuucuccccugaacuuuuuguuguuguuuguuugucucuuuguuucuguuuugagacagaguuucucuauguagcccuagcuaucuuggaacucacucuguagaccagacuagccuugaacucacagagaucugccugccucuucuucccaaguguuaggauuaaagguguguuguaccaugacuggauucuuuuuaaguaccuacccugaauuucauguucuaaaaugcaauuuauaaaaacauccauuuuuauugugggucauaccuauaauuccaacauuugggaggugaaagcaggaagaccaagaguugaauuucaacccgggcuacaugauacaugagguccucaaaacaaaaacaaaaacaaacaaacaaacaaaaaacccaaagcuuaaaacaacaacaaaacuuccacuuugucugaagaggcaccagucuauuguggaacauuuuaaaacuauagaaaaucaaaauugcuagagcucucagggauguauguuaugcuguggcccugcaggcauacucucagucuuuucuuuauguguauaaugagguagugguagguccuuuaaacccuacuggccuagauccuacuauauagcaagaaaaccuuuccaguuuuuugauauaaagaguauagcaaaggucuauuuuaggguaauuuuuguguaucuguguaaucuauaguuaucccacuagauaagucuuucuuuuuuuuucauuuauuuuguuuuauuuuauuuuuuuucauagcagccuuauuuauuuauuuauuuuuccauuuuuuauuagguauuuagcucauuuacauuuccaaugcuauaccaaaaguccccauaccccccccccacuccggaacucucacaauauguacucacugauaaguggauauuagcccagaaacuuaggauacccaagauauaagauauaauuugcuaaaaacauuaaacccaagagaacaaagaccaaaguguggacacuuugccccuucuuagaaauggaaacaaaacacccauggaaggaguuacagagacaaaguuuggagcugagacgaaaggauggaccaucuagagacugccauauccagagauccaucccaugaucagcuuccaaacgcugacaccauugcauacacuagcaagauuuugcugaaaggacccagauauagcugucucuugugagacuaugccagggccuagauaagucuuucuuuaaguagaauuauugaaacaucuucaagggaaaccauuucuuucaggaaaaacauuuuuuuuuguuuuuuuuaagauuuauuuauuuaauguauauguguacacuguagcugucuucagacacacaagaagagugcaucagaucccauuacagaugguugugagccaccaugugguuacugggaauugaacucaggaccucuggaagagcagucagugcucuuaaucacugagccaucucuccagcccccaggaaaaauguuuucuaggaaaguauuuuuuaaaaaauacauggagcuaggucugguggcacagagcacuuaggaggcagaggaaucaugacuuuaagguuagcuuccuuuauauggggaauuagagauuagucuaggcuacaugagauccugacucaaaaaaggggauaggggaugggaagauagagaggaagauaggggaaggucagaaaagcacugcauccacuacuauagaggucauagcaggcaggcuaggaaagggcuaagcacaggacaccagcuggacaucagccaagaagugcugggaaaggccuuugacacaugaggaauggucuucacagcaauggccagaaccagcuagcuguuaaacacggguuuuaauaucagcauugugacugagaaacuuguaacugaaugaauggaauuaaaaacaaaagcagucaugggucuugggagagaucagaggccugguuuaagguaagacuacaggaguagcugggcgugguggcacacgccuuuaaucccagcacuuggaaggcagagguagguggauuucugaguucgaggccugccuggucuacaagagugaguuccaggacagccagggcuacacagagaaacccugucucaaaaaaaaaaaaaaaaaaaaaaaccaaaaaaaaaaaaagccaaaaaacaaaaacaaaaacaaaagcaauaaagacuaaaaagccuucuggcucucuaaucgcuuucuuacacuuugcugucaucugugugcuuggcaucauuuccauucuguaugucuggaaguaaacacucgaugguauguggcuguacauuucuucacccugcucagugguagcucauaguaguggcuugaaauuggcuuuaguagaggauacaccacaaaaaucagcaaguguuccagaucacuucuuaguuuuguuuuguaauauuugcuagcucaucacuacucaaguggaaacaaagaagcagaagauguuagagaugaucugaggauuucaguguggaagaaguuacccugaaaauccuagggcagaaagacaagcacaagcacaggguuguguucagguaacacagaacugcaggaaugccuuuuucccuagaaucauuaaguuacccagcagcagcguuacuauggaaaccagaaccaggcacugggaagagcuugcaggacaggcaugugggggcugggaacacacagucuuaccaccuuagaaaaggagccaucagagggacaggccagagaacucuccuggcccaaguuguggucauacccacuggauucuauuccccuuucuucaucaggucauagugauucuuaagaacuaguggagguagauaggaaagagaaaaacugacaaaaaaagaaguucuuuuagagugaacagguuuccuaauaagagggaaauacaugagacauugugcaaaguagugcaaagacaugaccagagaugacagcggcucuucugcauggaauucugccugguucccaacugguaugaggcauuucugaucuucagaguaccauucuguacaaaguauucaggccuaggaguguagcuuagcaugcacaaggcccuggguuccauuuccagggucggaacaaaaauggcauagaaaucuaguccuguagagauagcucagugguuaagaguacuaacuacucuuccauaaguccuuuuccagcaaccacaugguagcuuacaaccaucugaugcccucuucuagugugucugaaggcagcuacaguguacucauauaaauaaauaaaucuuuaaaaacgaaaggaagaaaggaagaaaggaagaaaggaagaaaggaaggaaggaagaaagaaaggaagaaagaaagaaaaaggaaggaaggaaggaagaaagaaagaaagaaagaaagaaagaaagaaagaaagaaagaaagaaagaaagaaagaaaaaugcaggugugcuuccaccagccuccccuuuggccucacaggcaacaguauccaugugaugguuuaaauaggugggccccauaagcucaugugcuugaaugcuuggcucauaaggaguggcacuauuaggggguaugaccuugcuggaauauguguggccuugugagaggaagugugucacuguacgggcaggcuuuggggucucauacaaucacacuaggccuaguggaacagccuccuucugcugccugcagaucaagauguagaucaguuccuucuuuagcaccguaucugccucccugccaccauguuucuugccaugacaauaauggacuaaaccuuggaacuguaaggcagccccaaauuaaauguuuuccuuuauaagaguugcuguggucauggugucucuucacagcaguaaaacccuaagacaauucaaaugcuggaacuuaacuguaagacacucaggaugcucucugcacucacauaucuguuacuaucacccaauacaagcuccaccaaacaaaucaaaauagaccagagauauaauuggagcaaaguaaacacccugccucgggggauaaguaaacaguauauaugggguauagaaaagagaggauggggcuagagagauagcuaagcuguuaagagcacuggcuacucuuccagagguccugaguucaauucccagcaaccacaugguggcucacaaccauuuguaaugggaucugaugccuucuucuggugugucugaagauagcuacaguguacucauauaaauaaaauaaauaaaucuuaagagagagagagagagagagagagagagagagagagaggagauacuccaaagaugaaaacugggggaacagcaguagagacaagaggcugcauaagacacagcaauaauaaaacaaaacucaguagcuacuuagcaaaggauaucaaagggcagcaaagcuaucaggggaaagaagggcccaaaccaguccaguacuagauaagaaggauaccuguuaggauccuugggacagagacaccaaaccacgagagcauguauguauuccacauucuagacuagaacaugugugaucuagacuaagcauuuauauccuggucacagcaaccaaucaaguuggucauuggcagaagaggcacacuacacagacagcaagugugcgaauuucuggaagagcauguguuucuuuuugcaggggaguuaagacauaaucucacuaaauuacuuaggcuggucucuuuuuuuaaaaaaauaauuuuuauuuauaugaguacacuguaguuaucuucagacacaccagaagagcgcaucagaucccauucuagaugguuauaagccaccaugugguugcugggaauugaacucaggaccucugaaagagcaguuagcacucuuuuuuuugguuuuucgagacaggguuucucuguauagcccuggcuguccuggaacucacucuguagaccaggcuggcuucgaacucagaaauucgccugucuuugccucccaagugcugggauuaaaggugugcgccaccacugcccggugcagucagugcucuuaaccacugagccaucucuccagcaccucggcuggucucuuaacucuguagcaaaggcuagccuaaaaaucguuuucaucuuccugccucuaccaaguucuaugguuaaagguacacaccacugucugagucacaucuaacuuccuaaaggcaucagcaauggaaaaccuacauaaaaaucacuuauacagaaucccucuucaacacuugcuugucacuucuuaccucuuauuugcaacaucaugcaagcucaggaaguaauguuccauuguuaaaacaacuaaccugucugucacccaaacuguuaugggaucugcacuauguccuagaaacagaaaggcaaguggguugaaugaacacuugaauggagcacaguaaagaaccuccaaaauuaugcaagauauuaucucuaaaauuauucgagauaaaggcuuacacaacaugccucauagggaugggccacaaaagcuggggagauugcucagucugaaagugcuugccacguaaguucaaucgcuagaauacugugcugcuaauuuuaaugucaacaugacagaagcugaagucauuuaccagauuggucuuuaagcaagccuguggcacguuuuuuuuuuuuuucacuuaugauugaugcaaguaggcccaucccacaggggacaaugauaccccuagacugguaguucuuggcaugacaagaaaguagauuuaaaaagccaugggaggcuggacaguaguggcacaugccuuuaaucccagcacuuggaagacagaggcaggcagauuucugaguucaaggccugccuggucuauagagugaguucuagaauaggcagggcuacacagagaaacccugucuugaaacaaaacaaacagaaaagaaaaccaugggaaacaagccauuaagcagcacccuuccauggccucagcuccaguuucugccuccagguuccuguucuugcuuugaugauagauugugaugugaaaguguaaguuggaauaaaccauuuuccuuuuuaucacaauaaaaacccuaaaaaaccccacauuuuaugaaaaaugugccaguucugcugcugaccucuaagugaggaugaaguguaucugaggagacaguuaaaaaaaaagaaaaagaaaaaagaaaaaugugggcacuucagaggaagaggcaaguugacugcuauaaguugaaagucacucuggucuauguaucucaagugucagggcuguauagcgaagcucugacucagagggauuggugguagacagagacagacacagagagacaaagaggaagagagagaaagaagaaaaaugcugaaagguguacacuuguaaucccagagaugaggaggugagacaagaggcuggccugggguucacuggccaaccagcauaguuaaaucaacaguugaauaucaaagccagauaaaacccugucucaaaaaccaagguggagggcuagaggugugggcuagauugcucagugguuaugaacugauugaaaacaaaacaaaaauaaaaaaaagcaacagugcucuuccagaggaccuggauucaauucucagaacccacauggaaauugacaaccaucugaaauuccugucccaggggauucaacacccacuucuggccuccacagacacuguauacaugcgguacacagauagacauauaggcaaagcacucacacaaauaaauuuugaaacaaacaaacaaacaaaaaaccaagguggaaggccaggcacauaaucccaguaaugggggauggaagcaaaagcaucaagaguuuaagguuaucuucagugauauagaguccagcuugagguuuaugggaugggggggagaagggaggaaggagguggaggagagccagaaccacccccccccucccaagaugaaggaaagcagaaagcuagggagaugguucugagcucaaaugaccaguacccauguaaaagcuggcagugauagcaugugccuguagucccagaacuggggaaaugagggagguagauacuagaagcucauuagcugguucacugagaguugaagaaugauagaagaauuauauaugguguccuucucuggccuccacaugcaaugcaaacaagcacaaacacacauguaugugcaacauacugcuuacaccacaaaaaauuauaaauuaaaaaacguggaggcugggagaugguucauuagguguaauggcuaguuuugguuguuaacuugacuacaucugaauagaucauuugacauuggaagauuuaacaaaacaaaggagguuucuuccuugcugccugauugcgcucacauucacuggcaaguuuaucuauccugauguagagacacuccuuugcuggcauuaugaccuacuucuucaaacuuccaauguggacugaagaccagcagcuauaagggguaaacaaagaguuaaagaagagggcaguagcacaccaugaugaaagcagaacaguacacauguuagaaggccaggaaaauggggagaauguggagaaaagagaaucaacaacaucgaauuguuugaaaauucuguaaugaagcuaauaugugcuaauuuaaaaaauaaaauuagggcuggugagauggcucaguggguaagagcacccgacugcuuuuccgaagguccgaaguucaaaucccagcaaccacaugguggcucacaaccacccguaaugagaucugacucccucuucuggagugucugaagacagcuacaguguacuuacauguaauaaauaaauaaauuaauuaauuaauuaaaaaaauaaaucuuaaaaaaaauaaaauuaaauuaaagaaauugcuucugagccagguauggugacucaaaccacuaacugccaguacuuaggaaguagaaggaggaucaagacuucaaaccuagcuggguugucauggcccauaccuuuuaguccaagcauucaaggcuaaaauaaugaguuugauggcagccugaaauaaugagauucugucugaaagaaaaaaaaaaaucaaacacugaaaaguuucuggacugguaggaguuuagcaacagagugacugccuacuagcaucuccauuacugggggaugugggggauaaaaaaaguacuucuuucauuaaaugcaacccugccucuccuuuagaacaauguuaaaggaauggacugguuuucaguaauagaaaaauggcacuugcuaaaggaaacuauugucagaaaacaaaauuguuuccuuuaucaaauacaaucucuaccuacuuuauaacaauccagaaaaauacuuuuccucccaacacuuccuauacuuccuaauccacuccagcugccaauacaauucauugcuggcauucuccaaggccuuuguuggccuuagucugcacuggccauaguuuaugcuguuuucgucaaauacaagucccaagguuguucacaccaguugcuccuucauccuacacuaacaccauugcuuuugugcacagucacaucuuuuuugaaacaauagaagaacucaaagcaauacacagaagauacagaacaucuuaagauuuguacuuaaguccccagcaauugccacauaagaaacaccacucccuggccuaggacuguuuucuuuggaugacagacccuucagcauucaagacuacucauuucccaauuuguugcugaguuuggaaccuguacuggcuaguuuugugucaacuugacacaguuggaguaaucacagagaaaggagcuucaguugaggaaaugccuccaugagauccaacuguaagacauuuucucaauuagugaucgagggggaaaggccccuuguggcggggggggggggggggggggagggggaaccaucucugggcuggcagucuugguucuauaagagagcaggcugagcaagccaggugaggcaagccaguaaagaauaucccuccauggccucugcaucagcuccugcucccugaccugcuugaguuccaguccugacuuccuuggugaugaacaacaguauggaaguguaagucgaauaaacccuuuccuccccaacuugcuucuuggucaugauguuugugcaggaauagaaaccaugacuaagacagaaaccuuggccugacagggauuccaagcacaguggccaccucaagacaucauggcacuaggcacuccucauuccaaccuaauuuaguauccucuccaaacacacagucaauagaacuuuaucucagaguauaaauagucaaccuuuuguaaaguaacuagaaaggccuuugaguaaaggcaacuauuauucaaauuuaauugcaauaauauuugcaucaguguuauuauuaugguagaauauaucuaacacaaaaguacuuuuuaaauauacaaccaaguugagcauaguggcacauguauuuaguuuaagcauuuggaaggcagacacaggcagaucucuguaaguucaaaggcagccugauucacauaguaaguaccaggccagucagaaguacacagugagacccugucucaaaaaaugauaauuuuuuuuaaucuaaagaguuuuuuuuguuguuguuguuuuuguuguuguuguuguuuuucgagacaggguuucucuauguagccuuggcuguccuggaacucauuuuuuagaccaggcuggccuugaacucagaaauccgccugccucugccucccgagugcugggauuaaaggcgugugccaccacaaccggcaagaguuuuuuucuuuuuuuauuuaaauagacaacuaagaaauguuuaauccaacuaagaauccauaaugcuauacagcuaccugcauaacgcaauacuauuauuuuauuucacauuuaaauuacguagagcuguuuuuuuuuuaauuuucagagagggucucaguaguccaggcuagccuugaacccuugaacuugucuccugucuccaccuucccaaugcugagauaaugaguggguggcugcuuugugaauagagaauaacugaggaaaguaggguccuagauguaccuacuucaguguucugucagaggcagccagacugggcaucuuguggagaguagcccauagucccaggggcaaagcacuggugauuccuggaaaccccccuggaagauggagaggaguccugcucccacccuagacuaaaacaguugaaaaguaaggcaaaggccaguggcaacuacuucucugugggacagagggccuggaacacacugccccacccccauguugaagaguauaauuugaccaggcaguggugguccacaccuuuaaucccaggaaucugggaggcaggcagaucucuaaguuugaggucuacagagugaguuccaagacagccacagggaaauccuguuucaaaaaaacaaaacaaaacaaaaaacaguacaauuggaaagugaugggacagggcagacaguucuauccaacacuacauggcaaauggacaugugacucuaagucagcugggguccccugaguacauaggaccaacagaugaauauguugugauccaugucaaguggauuauuauucuaccacaaaauggaaaaugaacugcugagaugugcccaaacauggauggaccuuaaaaaugguuuauauuaagcaaaagacacauauuguacagcauuccauacaauaugugccuuuuauguugaaauggaacaucuccaucagcuaaauccauggggacagaaaacuguagugguugccaggagcuaaaggaaggugagugagaaguggcaguuuaaugguccuguuuucuuuggagguaaugaacaugcucuggaaugacagugcuagugguugaacauugugaauagaugaaaagucacuaauagcacauuuuacauuauguguauuuuaccacaauaaaagugaaagcuauugcugauauacacagagaccagggauguccuuacaaaagaaaggaaggcugagggacacucuaggguugagaccuaacuggaaauggaaaugcuugcuuccuuuucagacaagaucuugcuuaucacauauucucuuuguagcggauauuaucuuuaaacuccuguuucucuuuccuuuaucaucuaaguacuaagauuauaggcuaaguuguuuccuucacugcagcuugaaaguccuaaaacccauaagugucuccgaugcuccauuacaccuauaguuauagaacaagagccagcaacuugaguauccuguaagcauuguugcugagguuuguuuuuugagacaggcucucacuauauauacaccucuggcuguccuggaauucacuauguagaacagucuggccaaaaacuuaaaagagugcugggauuaaaggccagcaucaguacaccuagcuguuuuaauuacgaaugguucuugauuugagaucauaaggaggcggucauaagaaggaaaaaagaauggaguccuuugacauugauuuguuggagagagacaaccaaggacaagaaaccagacuugggaggggggagauagauggagaagaaacugaccugagugagacagaccuuuuagcucagucugaguaggcagacuucuuuggaagcuuuuucagguggaugaggacaacucaaggcaccugcucccuuugguuuugaguguuuugcuuuggguuuuuuggugggggugggggggcacuuugugggguggggauuaaugcugauaaugguuacugaaggaaaaaauuccuaaagccaaagguggggaaugacuaggaaccaagacccugagaaggcggggccacgaggcagcagcagauaugcggaggccugaggaguacucgccccgccuucugaauccgaagcugcagacaaagggagcguggcggcggcagcagcggcgagauagaugcagaggcagaggcagaggcaggcacaaggaggcccccaauaucggucauucaccagagaguaaggcccuaccuaaggauaccuacugcguugugcauuguuuggccuggccuuccuccuagugcggggucuccagaaacacaagggagagguggggccaaaagagguugggauaucuugcaagaccugagacuuccuauauggcuugauaacccaagggguagcuggugaaaguacauuauuucuagggaaccuagaaucaguuugcccuccccauucuucagaugagaacugugaggcuggggaagaaaagaaacuggaaguuagcccccaguuuccacggacuaucaaucaguucugcuuacuggagauaccuuggaagcagcuuccuaggcucacacauguuacugugacauagaagugagcagaucaacagaguggaaagaaaccccaaggaaacacagugagucuucaacauucugaguuuaucccccacaguggcccaacagaaguuccccuuuauguuuucccaacuuguguuucaaaaacugucaacuuccaaggauaaacagcugcauguuuccuuuacccagaucuucccagaaugcacaccugcucucacuuacauauuuucggaagcauuugaaaaccccaaacuaccacuccauccaccuuaucauguaguuuaccacagaucccacccggcacuucugaaucuccaauuguacccuuauuacuucuucuaaucaugaaucaaauuagggaacguacaucacuuuugacccuuaucuacuguagucaaaaacaaccuaugcaguuuuucuuuuuacccuuucaugauacggggcuuuuggcagaguccuaaauaucccaaaaucuacacuugcugacuuguucucugugaugagacucgaguuagucauuuuguuuuuugugggguuuuuuuguuuuuuguuuuucaagacaggguuucucucuauagcccuggcuguccuggaacucacuuuguagaccaggcuggccucgaaauccgccugccucugccucccgagugcugggauuaaaggcgugcgccaccacgcccagcggguuaaucauuuuggcaagaaugccagccaugugaugacaauguccucacuucuaccccacuguauuccaagguuggagaugcccaacuucauuacacagucaaaguaguggcugcagaccucucuuauaaggugcacuuugugacagggucuugccauaaaacccaggcaggcuagccuccugccucugcuuccuuaaucuugggauauguguaccauuacgccuggcauaaggugcacuuucuuucuuauucacaguaacagaagcugacccuugccuaagugaauuauuccacugguagcuaugaaugccuuaauuucuaguacugacacagcacacauugcaccacaucugccaaccugggaaaggguuuggcugaucaccacuccuaaucucucuguacccauccuuuccaccuaucuuuccagggcaggaagcaccugcaagauauuuuugaguagcuggggaagugguaacuucaggguugcuuaaauguucugaagaaaugugagugguagauagagagccagcugcacguggcaccgaagaauacauuguuccucuuaaggccugguuuugagauuuaauaggucuguggugaggucuuaacacuuccuucugauacugacaaaacuugaggcuuucacugaucuucuccaaauucccaucucacagcaucaggaaaacaacuucacucccaguuuuugagaaggaaaugaagacuccagaaacagccagucccaccaccacucaccccuacaucccuuaaucuggauuuacauuugaacaagggucuuccucugguggggguggagucuugccuggggccucggaggggauaaaccuggggaggagggggucaagcccugagaaacagagacaaacaagacuccuccacaaaaacuccuuuagaaacuagaccaggcuccagcaccuucuuucuucuccaaagcagcaguguggguaaugcuggcucauaguugacugagauucucccacucccugacuuuucagaggccagcugccccuccacaaccuuguaguccugccugagaagcagacaggaagaaggaauguccuauaaggucaauagacaacuuccugaaaccauucucuuuggguguuuguucaguuuucuugugcacaauaaauauuagcggcagagagccaaaucucccaccaccuccugccagccuggcaaaucgauggcaagguccacagcuagccauaaccaggauguuauuuguuccaaccauuagugaagaucagacagaaugcauuaugagaagcaaguauuuuggcaucuaguucugcaacuucuuagccuguuccuucugugcaaaaagacaaacuaugccucuacuguugucccuguuccucuccuaacucacccugcaugcuauuauguccucaaaauuuggagcccuuuucuguuguuuuuauuuuuuccccucccuuuucuuucucacuagagaaacucucagaauaaaguaagacagucuucugucacuggauguuacagggguucuaugucuaaggaucaacugaacgggcugcagcaacaaugacuuacuucuaccucugcuaugccagggacccaauguugaccaugaaggagauauaugcaaggugcuuccaucagcuuauccacuauaaacaaaugcuuucacucauacauacuagcuggggaaauugaggcacacagccauacaggaacuugcccacagguaagaauuggggucaggccaggcagugguggugcaugccuuuaaucccagcacuugggaggcagaggcagaggcagaggcagaggcagaggcagaggcagaggcaggugaggccagccuggucuacaaagugaguuccaggacuacucagagaaacccugucucgaacccccccccccccaaacaaacaagaauuggggucagaacuacuuuuaucuauugccacaucaaccugaauucaaccauggaaauacccccacaggucucagggcuaaacagaaacauacauauucuguguaaauacaaaauucuuaguuuugaaguuuacugagguaugauuaccauaugguuacugcauguauuuggaaugugaagugaaacagguuuuguaugucuacauaccuacaacugcuaauguguuucugucacaauuuauuucaauggaugaucugcgccuauuccagaaccuauaugguuaaaaaaaaacaaaaacaaaaaaacaaaaccaccccuggaagcuauccucugauccccacacaugcauccucacauacacaauauacauauuuuguauauugugaucaaaaguuuagggcaucuauuucauaacaugauccuguauaauaauaauaauaauaauaauaauaauaauaauaauaauaauaauaauaaugccaaaagauggagaaauaguucagcaguucaaaguacuuguugcucuuccagagaacccaaauuugauucuuagcacccauauuuuuacauauauauguauguaaaaaugauaaaagagaauaucuucggauaaugguacaaagcagauugacuacgcaugaaaaauagcuguuaaaacuaaauaaccugggggcuaaaaagauggcucagugauuaagagcacugacugcucuuccagagguucaauuccuagcaacaacaugguggcucacaaccaucugcaaugggauccaaugcccucuucuggggugucuaaaaauagugacaacauauucauauacauaaaauaaauaaaucuuuuuaaaaaguucaauaaccccuuuuccaugcauccccuccagugauuucccucccucaagaaagguuggugcaaaugugucagcaucacagaaggaacgacagguuuaggaagaccaggauguagaacuugggaucugauuagaaacuucaaugacaagagggucugcucauuuagaauggggguggcaagcagaagcaucaggaaaaccucugggaagaugcuuuguagcguggucccagacacauacugcuuccaaucuuuccaccuuuccuugcuuccucaacauacagucaucgcuuuugucagagggaagucuuacauuucacaagcauacuuacuccugcacuccauucagccugaauagacauggacaugaaguucugacauccuacacuaaagggccuguaagagaucuuaucaaauagguuacaaauuuacacaaucaucacaauaugaacagaaaaucaaaauaacaaucucucauaaaaauuuuuaacaaacuccagacagaagggagcuuccucaaccugcuaaggccaguguggugguacacaccugggacuccaauacuaaggccggaaaaucaacagguuagggccucuacuuaauaauaugauccugaaugauaauaauaguaguaauaguaguaguaauaaaauaaggccaggggauaaagaaauggcucagcaguuccaaguacuuguugcucuuccagaggacccaaauuugauucucagcauccacauuuuggcuuacaacuaucuguauguaauccuaguuccaggaaauuugauggauggccagaggaacagcaaggaaugaauauggggcacagacauucaagcaggcaaaauacucauacacauacauuaaauuauuaauuuuaaaagguacccuuuuucuuucuuuuuuuuguuuuuguuuuuuuguuuguuuguuugguugguugguuuuuuuuuuuuuuuugauuuuucgagacaggguuucucuguauagcucuggcuguccuggaacucacuuuguagaccaggcuggccucgaacucagaaauccgacugccucugccucccaagugcugggauuaaaggcgugugccaccacgccggccccuuuuucuuaugguagaaaagugaacacuuuuuccuaccuccaccacuaaaaaaauaaaaaaauaagcauuuuuaugccuuggcaaugagaaagacaaaaaugaaauuuagaaagcaauuccgggcuggagagauggcucagccguuaaaggcuaggcucacaaccaaaaauauaagaaaacaauuccaagccuggcauauuggcucauuuacuugacuugagucaggaggacuguuaaugagcucaagcccagccugcuacauaguaaguucuagacuaaccugggauacagcuacacugcuuuaaaaugaaauuccauuuacaauagcaucaaaaggaauaaaauacuugggcuagagagauggcuugucaguuaagaguauuggcugcucuugcagaggacccaauuucaguucucagcacccacauggcucaugaaugauuguaaugguaguuucagaagucccucuagucccucccuccagucccagggaucuaaugcccucugugaccuuuuagagaaccaggcaccugauguacacacacauucaugcaggcaaaaugcucauauacaauuaaaaauaauaauaaaauccuaacauagccaggcagugguggcacacaccuuuaaucccagcacuugggagccagaggcaggugaauuucugaguucgagggcagccuggucuacagagugaguuccaggacagccagggcuacacagagaaacccugucucaaaaaacaaaaacaaaacaaaacaaaacaaaaaauccuaacaauuuuuuuuaucuaacacaaauuuaacaaaggaaauacaagcuauauuugaaauaaagacuuggcccaaauaaacaggcaauaaauacucuacaaucugauuuaaugccaccccaucaaaauuccaguuuauuuucagaaaacaagaugaucccaaaauucauauggaaagaaacaaaggacccaauaaagccaaaacaaccuuuaaaaaaagauaaaguuggaagacuaaguacuuccuaacuuuaaacuuccuagacuguuccaucauaauagcauacagauauguaaaugggcaauaagcacaagaaaagaugcucuaccgcauuuagccaauagauaugcaaauugccaaauccacaaugagguggggggauggcuccuugguagagcucuugccuggcaugugcaaguccuuggcuuccaucuccagcacuauaucugagcaaacaaacaaacaaaaaauccacaaaaagaugcaauuuuauuaccagaaaauuacaaguguugacaagcauguggagaaauuggaaccuuguguuaguguuaaaugguaccaucacugagaaguaacuguacuucuguaaguuaccauaugauccagcaacuccauuuuuagguauuauucaaaagaauugaaagcagagauucagauaucuauauaccaguauucauuguaguauuagccacaauagccaaaagcacugaaauguacucuuugaaaagauauauuguaucacugugaauuugauaucuaaaagcuaugauuuucuuugacguucuaguguaucauggugagaaagucuguacuggcaaguuguagaggucaugaguauacauggaugaaaucauuuugaaagauacaaggagggggcuagacagaugguucagcaguuaggggugcugacugcucuuccagaggacuuggguucaggucuagugcccauguagugggucugggugccucacagcugucuguaaccccaagaucugacacugucacauagauaugcaagcaggugggaugccaaugcacauaaaauaaaggcaaauacauuuaagaaagagagaggcagggagaagaguacucaauauggaggaaguacacauguuuaaggaucuuaggaagcagaauucauuaauucugaaaacuaccuggguuuuaaagcaaaaauugccuucugcucugaaggaaacucuccuugaggccuauaugaguauucaucucccauaagcuauucauucaggcuaccugauagaucucauuguuuuccauauauuguuucuauauucauuccuuuuguuuuuacuuuauuugaaaggauaguucuuccuuuaaaaaacaucuggucucuaauugggucaaggagaaccaggaaaaugaaaguuuguguccaaacuuuaaaaaaguagcaucccaugggagcugaacacagggacucucuuaccuagggucaccucagccuuccugcccauugaaaccucaauggaggcaguccuaguuuugaaauccaauggguucugcugaaccuauuuuguugguacccagagcuagguaauuucagauuguuuguuuguuuuugagacaggguuuuucuguauagcccuggcuguccuggaacucacacuguaggccaggcuggccucgaacucagaaauccaccugccucugccucccggauuaagggcgugcaacaccacuguccggcucuuuuuuuguuuuguuuugcuuuuuguuuuucgagacaggauuuuucuguaguccuagcuguccuguaacucacucucuagaccaggcuggccuugaacucagaaauccucuggcucccaaaugcugggauuaaaggcguuugccaccacugcccggcuuaauuucagagucuuauuccaauagguguggcauugagcaggugagaacuucaaacaguaggaacaagagaggagaaacaacacugauguggucuguuuggcuuugugcagacaacaggagaccacacauagucaaauagagaagaccagaaacgccagcaggcuuggacaagaccacccccaaccuggcccuccaugcccacccucucuugcacauuaccucuuauucuuucuaauagagaagguaagaucacagcaaaaauuuugggcucccgaggccaccucaauaccacuacacuacuaugauugacacaaucuccccuucuacucccgccacguuccugaagguuuuuccucuauucauccaggaaccuacagguucucccccagccaacaccugcgcgcacuaauucccugguucugaucaacaaguucaauagcuggggcacaagucacuagacucaccugucugcucccacuuuggcuccuggucccgacucccucuuuucucuacacucagcccuaguauauuucagugcacaucauccuggacacauuucacuaaaguacucucagggugcacacacagaaaguauagacgcgcggggcuggcaagccucggcgcacacacagacggggcacaggcacgcacucacguagucacgccacgcacaggcaaggaaaccccacucguggcugagaagguggcucaaggugcaagcgggcagcaggguaucuccugccgccccgcacgcgucgcucucaacacccuccuuguccucaaggcccaacaggccaaagcggaugccaacaggcagagcacgugcugggcaccaccgaucgauccccgcgucacccacucacccaaaaugccugaggcccugaaaucgacagucgugacuuagucuagagaguggaugggaaaauggguacucaaacccagcuccauugacgacguuuuaaaucuggccugccaggcccgggauucggccucugucccgcaggcacuucacugcuucuuugggucaggcuccaacccugggaccaugugccgggaauccagaccguugcuaugcaaccuccaucccgcgcgggccacugagcgccucacugucccgggacagaaucuuaacuucccaccugggcugaucuggacacaugguuaguggucguuacgcacucggagugccaggugaugugccuugaacaccuacauaucuucuucacccaguuccuuccaucccuggaugguucccacagggcgccagcacccagcaacccauaaucugagggcgagaucagcucccuaccuuuuucucucgagcccucucgcccucccacaccugccuuucuugacucuaccuggcccucccccucgggguuuacaguuuuccuagguccggcugcgacccucuccccagcagcccaggcgcccuaccugaagcaucacuuuguacugcuccuccgguuucuggaccacacacauauuacaucccaugaugcuggccggcgagggaaagaggagagcgggaagaggaagguaucuuucacuggccagugcgugggaccacgggucccgggccugggcccggggccauaccuuaccccggggggccgagccgccuagcgggggaggggggcacgcccccaagaggaaggcagcuccaagccucucgacuuaacucuuugcuggccgaggccagacacaggcaugcuccuucgcacccagccaggggaaaaaaagggcggcgggggaugggcgggcgcgccgggcguugccuggcuacggcccccccaccccaggaggcgcgggagcgcgccugcccgccggggccgucaggggcugucaggggccgugggccacacggcuccccgcccgcggggccggccgcugccgcugccuuugccgcugucgucuccagcucccgcccauggccaucagccccgggaguccagccucugggcuuggcgacguggcccggcccgccgacggagaggcggccaggcccacgccagcuguagccucgcagggucccgcuucucuagcucacggcgcucucucagagccuggcccacagccggucgcuugucuccagcuccugccuggaacaccggaacgcgcgcgcg

SEQ ID NO: 9554 - RNA, 4046 nt, Mus musculus
auuagguuuggcccuccuugcuuaagccacugagaagagugacucugcuccagauggcauagacagauucuuuugcauggauacugugccccaaaucccugugaucucacuuuccuucagucacuggcaagagaggugggccuccaugguuaagccuugaaagccaaggcagagccccuagaggccaccaggacagcugcuuuuuauucuuccccaucuuuuuccuuucccucccacccaacccucccucuuuuccuccccccaaccuccuuuccagccagcacucggugggguccaccuuugucaggcugccuaaaggagcugccagcccccagagcaggcccacaaaacagaaaacaacuauuggcaagcacagaaaagaagaaaaaccacaaaauucaggguugccuuugucuacaaauaauugcagcuccuaggaggggagaggucgugcucagcaugaagcuggacauucucuugugcuuaggauaguccaccucaccucucugcacugauuucccugucuccaagaaaauagcaagaauaccauguguauacacaaagaggugcccuuuauggguaugccucuauguugguuguuagcauagcuucuuggggaaaaggaacuaggcguaagagaagugucccuucuuggggcuuucuauuaccaagguccugugcacacauaacauacagguaaggagugugcaugagcacaucgugcaagcacacacaucgacacacacuagauucuaagggagggugagggucaggcuuucuagaccugggcugggcuccugcuggagcagcucagacaguggugacagagagcagaggguuguagauccuuuuuccaucagcugagcgggcaccaugagccaacaucuccuggauggugauccaguuguccagaaucuucuuguuucgcuucuucaugguuuuacgguggcucagcgcaaugauguugagcucagguuugcugucaccauucugcugcucccuuagacacuccagacggcucugcaucaugaacucacgccgcuuccguugcucccgugcucggaucagguguugcuuccucucuuccuugcuccaguagcggcccaucuucaucucacucacugcaucaucaucaguggucauaccacugcguuccucucggaucuucagggcccuggccuucagcagccgaucucgcacaggucgcuuggccacauagcggguuccaucacuucgcaccuucaccuuccacuccaugcggggugcuucgacagcugcagcugccaccccacccacccgaggaccacuagccaagcucaaggagccauggcccagauccuccagggugcguggcggggccaacugcacacagcugugguacugcucaaucuccuggccacgauggcgccuggagagguaagggcugccuucagggcccacacgcuccagaguaacacuugucuuggugcuccggcggacacgcucuucugugugcugucuccggcccacuucaggaucccgagagagugaucggaacuuagcugggcucccuggugaaggagcccccuugagguggguggugacaggagggccagaagggguccgauucaaguuggaauugccagcaccagaucgcuucagcgggcucucaggcagaggcuccacaagaaguggagugcugcggcagcucucccccguguuguaagcgcuggugcuaucuuugucugauuucucuggcaguucagagauaucagacagcucaugcuuuuugggcucacuggcugccaggucauagagacuuuccuccuccagcagccaggccuucauacagcgcucccgcaacugcugcaucuucugugcccgcaagauauugcggcacuugaacucuaggugccgaagcucuuccuccagcauggccaucucauggccuaggcucucauugcgguugacaucuagggcacuguugccacuggaggcccgggagaagaagaugcccagcugguugccauuuuccagguggcacuugaucuccagcagcucccgguagcguucauacuccucaucagugagcccagguaggucagccccucccagcccugcccccucagcuaacagagaauccaugcugaaguggaagucccugcucuguagggcauccccuuguagaccaaauuugcguaggcuuccaggaguguugguggugcugggagguucaucccccagcaggucauguucagagcucucuucauugcggguacucucaucaguccgacccaccccgcuguccagguccuggcuguuguuuaagccugggcccccaucaggagcccccuucucaucauuuccaaucugggacagaaaugacaaacauacucaguuagguucucacagacaagugugcugcagaaggacuagaaaguucacagcuugcuccucuccaggcccaugcuggaagacaguagacacauuuccuuucuccuuccucccucucuuucccuacccaguuagcaggccuucuuccuuccuuaccugcuggacaggaggugacuuuagcuuccuagcacgaagguccccuucauucucagauccaaagucaucuaggaagucaucucugucacugucuuuccaccgcuuugcuagcugcagagacaagcaugagauagucaacacuuuaaagcccuccccaaugcccuuccaccuugcccuagacccugcgcacucaguaaaguaaaacaggccagcagccuucaagacagaaagccugugaggagcccugugucgcccuuucauaaagacauacacaccuggcucucaggucgggccaccagcagggagauguuaguguucuccuccuggcucaggauggccacugccuccucucgauuuuggacauccauuccauuaaucugcagagguuuagagaauagucaacaagaaugcuagugggggacucuggcugugccaaggacaggguguugaacucugggaaggcauaaauuagcagaaugcauugggggaaaggauggccuggccuguauaagagcauaugugcucagagaauggagaaguagaagagggcagggaggugcuggcaggaauacaugggagcucucagggaaguugagcagaacagagaugagauuuggcucaggacaugguagauuccaggguagaaggccagguucucagcagaaaagaucuaggaagggguugaaaagaaggcagggcaggcacggcagccugauuucuagugcucaccuggaugauucugucucccucacggauccggccaucuuuggcugcaaugcuguugggauuuaccugcaggacacaugcaucuuggggacuuuggcaacuuugaugcccuuuucaguguguguguguguguguguguguguguguguguguguguguguaagcggggaaaaugccagucuugcucacuuucccacuucaccucagacuagcagcuucuaagcuuuaggaagcaggagugggacagugagccaaggcaguuuguuccaucagcuugggagauacagggugaccagaaacaguucccuagucccuacccaacacuucagugguuuugccucuaucccuuguacuacuauacuguauauaucaaagucuuuuuuuuucaguguuaaggaaccuacagccuuguauauguuaaaaaaguauuuuacuauugagcuauacccccaacuucauugaagcuuuauuuucuuuuuguuugcuuccuuucuuuccuucuuucuuucuuuucuuccuuccuuccuuccuuccuauuuuuucuuuuucuuuuucuuuuuuuugcauguaugugcacagcugcauggagguauugguuaaauccagaagaagguauuagauccucuggaacuggaguuagaggugguugugagacaucuaugugauuucugggaacugaacuuggguccuuugaagaagcaguaagaaucauccuccuaaaacacuucccacaugcauacuccccuuuaaaacaguuucacuauguagcucuaaugaaccgcaagcuccua

SEQ ID NO: 9555 - RNA, 8732 nt, Mus musculus
cggggcccuucggaacucugaagaggaucaggugggugggacacugcucggucagcugagugauagucacgggaucgcgaccaagucugaauuccuggaggaaagcagaugauggaccuaggacuccuaauguuacagguaugugguaguggaugguuccaacuaaugguggggucagaagcccauugaagaggugggaguacuguauccuuggcucgaggcccugugguggugggguggaaucaaguagcucuggggccuacucgaguugguucaggaagucccugugaaggaagagcugugcuucccugcucugcccugauucacuucacaggacauggagaaggaacgggagacacugcaggucuggaagaagcguguggaacaagagcuugaucgugugaucgcuuucuggauggagcauucccaugaccaggaacacggguuagcuauccugccaugauccuccuagggccccccucccccuaucucacuuggaggugacacacagaucuacugaccugaggagaguagugaagcuauggagaacggcucuuuccuucacuuucugacaacacuugucucacaggggcuucuucacaugucuuggccgugaugggaagguauaugaucaccucaaauauguuuggcugcaggggaggcaggucaguuugcacacuuaagguguucacacaacaauaggguauacccagggauacuuaggauucccuccaccccagcuacuccucucuaaacuguguucccucacagguauggauguauugucgcuuauaccgcaguuuugagcgcuuccgccguguugagcuucuggaugcagcaagagcagguccccucuccuagcccuaucuccccaggggcuucaguggguuauguauucaauguaucuaaagggcucuagaagaggaaagggacuggcagguuccaagaggcaguauauucagaguccuuaccuaccaugcauacuuuccaaccaccagguggugaauuuuugcugcguuaugcccggguggcaccaccuggcaagaaaugugcuuuugugcugacucgggauggccggccagugaaggugcagcggaccauuuucagcgagugcuucuacaccauggccaugaaugaacuguggaaaguaacgggggaagugcguuaucagguauguaggagccuguaggggaucacaggcuguuggacaugaguguacucuaaugacaggccugggaaccugccacaagacccauuuacucguuuccuaccauuuugugaccacauguuuccucagcgcucucuaacccuaacccuaaagggacccugggcaaacagugcccuguguccagguagaaaagguuuucgcuuucuucacugggcccuucugccugagagugaccugaaucccagaguccccgaaaauaguauugggagaagaagcugagcccugaguccuugggggaagaaguaugugcugggacagggcagccucucuggucuccucacagagugaagccauagagaugauggaucagaucauccacuggguacgggaggacccggcuggguugggccggccucagcucucaggggcacuggccacagagcccauggcagugcccaugaugcugcucagccugguggagcagcuuggagaagaagaugaggagcugaccaacauguaugcagaacuaggggacugguguguccacaggauucuucagcauguccagguaggcacaacccaggguccucaggaagguggagcccagcuugcugagggcggaaauggguguguccuaagacagaagaggccagagcaacagacacauucugagcuauggaaaggaggucuugaucuauguucuucccuuugaugccucuguggcaucaaacucagucuugccugucuccucauucaggguuuuacccucuucacuugagagacccagaccuaagcaagaaggaucagaaccuacuggguucaugggagacaaucagccauuccaaaaauguucuggagcagggcgugguacacauaucuguaauuccagaacucuggagguggaaacaggagaauuuagaguucaaggucagccuugcuuguauaguuugagaccagccugggcuaccaagacuaugucaaaacauacaaccaaaaaugccccuuuagaccuauugaguagguauauggcugguaccaagggcagaggaagggauuuucgaaguuagaucuuucuucuucuucuuuuuuuuuuuuuuuuuuuuuuuuuuugguuuuuuugagacaggguuucucuguguagcccuggcuguccuggaacucacucuguaggccaggcuggccucaaacucagaaauccaccugccucugccucccgagugcugggaucaaaggcgugcgccaccccgcccggcuccaaaguuagaucuuucugauugggugaccugaacuggaaacauuugucucuuguccuuuuccuggcagagggauggacaaguuguacuggagaauguaucagaggauggaaaagagcuuccugguugccuuggaagacaucagaacccaggugaaggcaugugcuaugccuguuaggaaaaaaaaaaaaaccucaucauugaguuugggguauaauaugggagggguagcccuccucccuccaccaaggagcaggcaaugggcggggacagacugcccaggagugggcauggaguccaggcggaaaggcaggguaucuugugacagaguucaagcaucucucacccuugauaaggaagggaggugccaggagcuccagcccucagaugccuugaagugggaaaccugauccuugccuuacuuuccuccaacucugacuaggccacacacuggaagcuggcugguuucugcuccaguaugcccucaggaaaggugaccccaaacuucgaaugcacaucauugacaaguuucucuuauugccuuuccacucuggaugggacccugaacauggaggccucuucuacuuccaggaugcggauggucucugcccuacccaggugggagugcccagaauagcuugcaagaagccuauuauauaguaggagcuggguaugauugugcaugccuuuaauccuaguacuugggaggcagaggcaagcggaucucugugaauuuuaggcuaaccuggucuacaaaaugaguucugggacagucagaucuacauaggagauccugugucaaaaacaguagcagcagccgggcgugguggcgcacgccuuugaucccagcacuugggaggcagaggcaggcggauuucugaguucgaggccagccuggucuacagagugaguuccaggacagccagggcuacacagagaaacccugucucgaaaaaccaaaaaaaaaaaaacaaaacaaaacaaaaaacaguagcagcaacaacaaaaauuugaaccuagagccaaagucucuccaucuuauauccugggaaauccauuagagaagagaauuugugcaaaugcugaugccaagacacaugucccucugucuggugccagcagcucaaagggcucuugggugauucucacuugguggcaggcagggguggaauuguuccucugauuguuuucugauccuucuggagaucugcagaggauauuguacaacauggguagcagcaguguccaaaaggccaaaagacagugugacaaggcagacagcauucuaauucaaagacuaaagucuucccuaguacuugucuccuuuuaaggagcugcuuaggguacauacaggucagaaggcuagcccuacucuuuuuuuuuuaauuaauuuauuuauguauaugaauauaccauugcgcgcucucucucuuuuuuuaaagauuuauuuauuuauuauauguaaguacacuguggcugucuucagacacaccagaagagggcaucagaucuuguuacaggugguugugagccaccaugugguugcugggauuugaacucaugaccuucggaagagcagucagugcuuuuacccguugagccaucucaccagccccccccuuuguuuuguuuuucgagacaggguuucucuguguagcccuggcuguccuggaacucacucuguagaccaggcuggccucgaacucagaaauccgccugccucugccucccaagugcugggaucaaaggcgugcacuaccaccgcucagcuaccauugcucuuuagauaugccagaaaagggcaucagaucccauuacggaugguugugagccaccaugugguugcugggaaaugaacucaggaccucuggaagagcagccacuggucuuaaccacugagccaucucuuuagccccaggcuagcccuacuuuuaaggacuauucaaacucuaucccccaugucucccccaugauuaaacaacaccaaguccuaagccagacagacugaaucagaacagaggauguuaagugucuuccuagggccuucagggaccugagcugcccaucucugcucuguucucagcuggaauggaacaugaagcugugguggccacacagugaagccaugauugccuuccucauggguuauagugacaguggggacccugccuugcugcaucucuucuacaagguggcugaguacaccuuccgccagguaagugcucucuccuuguccccuggaagcccaggcagcaggagagggagaaacaggggcuguguguaaggggguccaggaggcuuucccucagcuucuucuagcccauucacuagauguugcucucagcugcucugagagucccaagacugucuuuuguuuggugaaccaagaagcucugccucaaggaauacaccuuucuggaugaucagauucuaaucgaguaaacaagcaaacagagaccaaugagcuguggaaaacaaagcagaugccaaaugauacagaacuuucuuauagagggggcagagaagaccuugugagcaaggauccaaagcaaaggagggcaggguguaucugugucuauucaacagaaaggaaacugugaggguacaaccauguggguuccacguagcaggaacauccuugaucugccagggccaguaaaccugagccuugacagggaauccaacagcuaggaugucaggcugguaaaucaccaguuggauuuuccucccuguccccugcacgagcucgugugagagagaaagacauacacacaguagguuagaggacaaucucaggugguauuccucaggcacuacauaccuuuuuguugagaagauaggguugugaacuagcuacacugacaaacuagcuacggaggugaauccuuagaauacucuaucuuugccucuccaguggugggauuauaaguaugcuauccuugacuuguuuucauaugguuucugggaccaaauucaggucuuccuguuugcaaggcacuuuuuuguuugcuuuugguuuucaagacaggguuucucuguguagcccuggcuguccugaaacucacucuguaggucaggcugacauccaacuuagagaucugccugccucuagccucccuggucccugggauuaaaggcgugugccaccacugcucaguuaguuuguaagguacuuuacugacugaaguauaucucuuaguacagcagaugaguuuaagaggcuauaguucagagagagaaauuuggcuugcuacaaagccuaguugucauaaaaaaaauguaggugacccgggcauggugguacauaccuguaauccuagcuauuggguggcuggaaccagaucacaacauagagaccagccuggucuacaauaguaaguuugagacuaaccagcuauauagggagauuuuucuuuucuuuuucuuuuugacuuuuuuucgagacaggguuucucuguguagcccuggcuguccuggaacucacuuuguagaccaggcuggcuucgaacucagaaaucugccugccucugcuucccaagugcugggaucaaaggcauguaccaccaccaccgccuggcaggagaucuugucucaaacaaauaacaacaauagauauuauggagagccaagaguaagguaauuuuuuuaguauagaagauaaagaggagaaagaaucagggcuagugaagacuagaaucagucaugaacuaggaaagaaaacaaaucaagggccuccagaggguaguguuccuaauggagauaguguucuugaagacuaccgguguauuucuaaagucacuauuccagugguuucccuacaacuguagcagggacucuuuaauucuacaguuguggcuuugguucuagaaaaaaaugacaauuugugugauuauuuuuuuagauaucucauguaaccuaagcuggccauaaaaauucaauauguagcugaaguuccuccuaccuccucucccuugaucccugaggccugggaugacauguguaugucacuacacuuggcuaguuuguacuaacuguaacugaaaucuagcaugguuuuauugugauuagaggcaaaaaaauccaagccauguuucuauuacauuguaucuaaacaagcaacuggagcugucucagauagucaccccuacuuccaaaugacaucacccauuagguugaaucacugccugaauacugaauacauucauuaaggguauggauuagaagccaccaaucuuaaccauaaaaggaaauaagaaugcacuugaacaagauggagaugacauuaaacaauucuaagagcccacugugcaucccuguaauauuagcacuugaaaggucucaaaugagaacaagaaaaaugaauugcaaaaguuauaaucaagccaggugguaguggcgcacaccuuuaauucccagcacuugggagacagaggcagguggauuucugaguucgaggucagccuggucuacaaagugaguucuaggacagccaaggcuacacagagaaacccugucucgaaaaaaaaaaaaccaauaaaauaaaauaaagacaaugaggcaguuauggugcaugacuuuagugucagcaauggggagaucucaagagagaacuuuuuaccagggcagccugagccacacagcagauuccaggacagccagggauacacagugagacuucucaaaaauaaacacacaagaagggacaaggccacucaaaaguuauaaagaauagauacagaacugguuauaccucacuuggagaauguaccaccaaccacucuuugagacaaaaucuggacugcucuugaacuuaauucuccugccucagccuccugagugcugagauuauagacaugaaccaucacacagcuuaaaauguacaacucaugucacaauuuaaagggaacauuuugguaguaaacuuuaaugcaauuugguuuguucuauaagccuucuaagaagggguucuacuuaauuauuuuaucaguaggagcaaaauuggaagcaauggauaaggaucugggcuauauuuuguggaggugaaaagccucagugaaagaauaaugggguguacaaugaaugggucuguccagccaccugagcugcugcuccccauaucugaagcaucagacacacuggacagguucaaaagaagugagagauguguucagaaccuauggucaagacaggcagaagaccagguuggcaugaaccuuauagaaaugugucaagacuuugccuccugaggacugggacuaagggcaugccccauuacauagggcuaaaggaaagacugugagucauaauaaaaaccuugguacgcaaggacaggagcuaugugucucugcuuguaauccaaagaucuuuuagacuaaaggccugugaaguagaugacaugaacuccagggaagucacuaguuguaaaguuugcugaaacgucaaucuaggauucuuuuuauuauuuuuauuuauuuuuaauuuuuuugguuuuucgagacaggguuucucuguauagcccuugacuguccuguagaccaggcuggucucgaacucagaaauccgccugccucugccuccggagugcugggauuaaaggcgugcgccaccaccgcccgguuuaggauucucaaaaaaaaaaaaaaaaaaaaaaaaaauucagauaagguaaaauguauccauuuuuaaaauuuucaauuuuaaguguuaucuaacaaaccacaacugaauauagaacaccuguucucucaguguagcagcacacagccugcaaccccuccccccaucagguuacaugcuaaggcaaacugccuacuacccacagcuuucaucuuuuuccaggauacgguccacuaaaaguacugauuugugaaacugcgcuuuuuacucuaaccauugguaccggugcaaaagggacagcgagggccccuuccucaaccggugacauucgaguggguccuaccagacacgaacugucauugucucuuuauucuaguuucgugauccugaguauggggaaugguuuggcuaccugaaccaagagggaaagguggcccucaccaucaagggagguccuuuuaaaggugagcgaggaacggggcgagacuguagggguuuguggcacccggcucgccggauccucccuaccccgggguucauucuccccacaggcugcuuccaugugccgcggugccuggccaugugcgagcagauucuaggagcccuacuccaacgccuugagcccgccccccucgacuccucgcccgcugucucuacccaugaaggcucgaaauaaagaugacccuguuccacau

SEQ ID NO: 9556 - RNA, 24187 nt, Mus musculus
cacaagauggcggcucccagggaggaggcaugaucgcccugccguuaccgcuucuucugccguacaauugucacuucgggucuuaacuccugcucuuucgagcggcuccugugggaaggagucuuaaggagggaagcgaggauuggacgcugccuugcguuugguuugcuguggaagaacuguccaggaagaagaggauagguggggugggggggggaagagaagcuagucucaagauggcggcucccagggcggccgccacagccugaauagcagaggcggacucaagggagaggugcaaaaccucucgagccauacgggucggggcuucgagcagcaacugagaguuggagcccguuccgccagccucugacacgccuuuauuacuuaggaacguugggguucugcgaucggugguuguacuaagugcuggguggggaagcaggacgguuucaagauggcggcuuccacaauuguggucugacugucggcgaaguugagacaaccgcggcauuuguggcucuuuuccacccgccccggaagccagccagugcuggggacggggggugugggaaccgggccggggcuccgccauuuccggcgggggagggcuacgacugaggaagggaggagagagaggcggcucaagauggcggcucccagagccuccugcucgagguucuaagcgggaacacccaggcaaauaguuagagcgacggcgcucaguggccuccagcuucucgggaauaggugcucugcaguucugagaagcuuuuaaggauacgagcugagugagaagggggggaagagccaaaggaaggaggauaguuaagauggcggccuccauggagucguccaccgcuguguaaggagccgcuucuucgugagagcugccuuagacgaaagggggugugugaagaauuaaggguauccucccauucagugaccucuucccacugcauccuuaaccggaacuauggcuucggcugugucucccgcaaacuugccagcggugcuucugcagccccgcuggaaacggguggugggcuggucgggucccgugccccgaccccgccacggccaccgugcaguggcuaucaaggagcuuauagugguguuuggcggcggcaacgaggggauaguggacgaacuacacguguacaacacugguaagugcuaccgcccuggguuucucaaagucuucccuccaucucucuccuaacccuucuuuucccuaucuucucuuuuccuaucucacuccccugauguguuuuccuucucucuuugcacuuauugccaucuuugcuuucucccugauuuuucaacccccguucuuacacccccguacucuucuguguuuaaagguugcauuucgguacuuagagaaacccucuacuccgacuggugagggggaggggaugucgcgggcgacagugacuucagacguacaccguuacccagugggcuggggcuggcgcggcagcggauguguucucuuggcgcaggcggaauccuccccccuccugcgauaguccucaucuccagcgcccaugcucguucgggagaaaagauaauauuuagaucacagauccguucucuacacccagaaaaaaagagggaagcauucuuuaaggugcaggcuuuuaacagacuaaugagacccucguggcaaauacgaauggcaugaugacuauacugccccccccuacacacacauggggguauuguaccaguugugaauuuuuguaguuuuuuuuuccuucaaauuauuucuuuuccuaaucuggugccuuaacaauugaguucccccaccccgccccccauagcagacuggagggcucagugugucuuuugugugugugugugugugugugugugugugugugugugugagagagagagagagagagagagagagagagagagagagagagauugaagggguuaacuagugccuccuuccccaaacccaagcccuugcaaauugggaggagccuaucugcagguauagcugaucuaaagccuggccucuguccccucccuuaugggagccacauguuguuccuugcuugcuucccuugcucugucuuuagggcagaaagcuuugaguccuucucugguagccucuuggcacuuucugcacauguaguacgggggauuggccugagucgccgguugacugcccaagagccuucaggaccuuuuccuugcccuaagggaaaagaagugcuggggcuugccaaagcugaaaguaugugccaguuguguccaggugagagccagcccccuugccucugguagacuagaagcuucccucugcugcaguaggugcagccugcagugcuuccucccuugccagcuccuuagccucuuccgugcacccucauccuuucugggccccugcggucccaggcaccuccucuucauuugagggcaggaccaagugugaagcaauugaccccacccuccaucucacacacuccacacugaggaggcagaaaguaggcaggagaucguggucugggguaguucauggaacaagaauuggagccagacucuccuggcagcuucucagcaccuccccugccaggcugaguauacaggccugccucugcaccucugaacuauucccccucccaaguugacucugaaagacugguggguucaacccucuugaguuccuugucucuccacaccuguugccugcagggagcugggcuuuucucagggccucugcagaaaggggggugggaagguuggugaugcuuaugucagcccaggcagcugugguggcagaaauuagcccaguaagguaaggcuaagggcagggguacaacuuguguaguaguagagcuguuuuuagagaugucuuccacaggagcagcagcaacaccuucuccauuuccuggaccaccuuucuucuacuaaggcccggagcagacuuucuggcagggaaauacaauuuuagaaaguagggcaggggccuaauuacagucagcuccaaaguccauugcaggccuaugucuuagcuuccugggaccucuacauauucauuaguuuacugaaaacaauugaccacuuugguguuaauuuguuaccauuuugcagagguuggauguuagaagguaaccagguuucuaaaaagucaaguucccuuacaacaaaggccuagaauccuccaaaacaaaguuuucaaauuguucugaucaaguuuuagguggcuugagagagcaacuagcagacccugcuauacccucuucuucaccuuaauagguguaccccuuguguugauggugacagggucucguguauuuggcaggcucagaguucuaacaguucuugugcuauucuggcugcccauccuucauuacaacugccucuuuugcuuaccuucguuuuguuuucaaagaggccuaaguucauaaucuguucaugccucugccuauagcccuuugcuuuugugggaucaguacuuaccccuuuaaagaguaugcucuucuagaaacuccucuuuuccucuuugaaagaggaaagagauucagggugugugugcacuuggcuguauuggucagcucuucaguuugcaagggguggaguauaauucacccagggguuacccaauggaauuacuggguuugugugugcuagagagugcaugcauacaugacuuugccccuuuagaggcagucaccaugggggcugagagacccuucacuggcuuuugguaggucuugggguugcaacugccugugaaggaauuuuauuuccaugaggcaauucagauuacucaagaggccucaagcucgaggauccauacaggcugaggugaaaugugcuguguugaagcuggguguguauggucccucuuccaggcuguuuuugccuugguggauauuggaaguaaccacccccaccccccaggguuggguguggaucagagccuugagcaaguucuguaccacugagccacaucuccaaucccuccauagacuggagggggggggcgguuuacaaaauaucuaaugggacuuccuacuuauaaggaaauuggagucuaagaggggaagugacaaguccaaacuaggacacugcacuggcuacuaguagaagugggccagagugugaaccuuaauagacuuagaaacacauccauuuaccucuguccauauaccuaaauuuuauuaauucaaauggguaucacaucuguuccccugucuauuucaggcccuccuuaacaggcucacuuccuuauugguuaguuuugcugauuaggaaauagccuacuuacucuucaaagcucugucuuaaauguuuucuacucagagaaaccuccuucaguuauguccuuugucacccuugcucugcucccaaggguugggcaugguuccaggcucuuucagcuuuucuuccuaucaguggagagguucacagccuaccuaccagaugggaaauaggaggucugggccuucuuugugccuuccagcauggggccugccucaucggaaaugauuuugguauaaccaaucacacugaaaggaaaauaauuucuugaacugcaccguguucuuugcuucauggguguuaucagucuauauggugauggggagacaagcuacaaaugacguuggacugaagaaagggaagguaaaaaaguaucuugagcuggagccugaagacagguggacuccuuuccucaaauuccccucuucugaugagggucaggcuagagggccagggacaugccuagguauaucaacaaugagggacccaaggauuggguuacaugauaccccacuggguguuugagggcaagggagagcagcuguuagauuuacaagguagacagagaaauucacauacuuccacacuuguagggcguaaaauggggauuuguaggugagaugagaugguauguuaucuccauaccaagaguuuuacucccuaacagacucuugauggaaguugggaagggcugcuucugccuuaccagaagaagagacauucuagagccagauuagguccucuuaggucucaauaggagaagcugcuaaucugggaggcucaagaacaucauaguuaacuucuggccuggucguuugggucagaggaucagcaugauaggaaagcugugggcaagcuaaucccauuugccauuuaacuuuuacucaagacucccuaccuguugcuuuaacacaaggguuuuuagcugagugagggacugcccauauaugugacagauaaugaaucaguggauuuuauucugaauucaggugaguuucccuucguguguguguguguguguguguguguguguguguguguguguguguguuuugaaacagggucuuuuauaacccaggcucaccuucaacuccugaucuuccugcuuccaccuuucaaggccuaggauuacagguaacuggggacuggauugaggcugccucagagguuuccuguuagcuuuucuuuuguaauuuggaugaaacuccuuccauggauuauuuacuugugcaaaguugauuuaccucaguauuggaagcuccuacauuucuugauucauguuuacacuaggaguaaggacauaggucaagagccaacguuuggaugugugggcacaugcgugcaugcauguccacaagcaguacaagcugcaucacuccagcagaaaaauggcagagaggauggggacuauaguauugucuuuagugacucagcuaaaccacugaggagucuuaagagcuagcugguuguuccaggugcaccuggggagacccuccucccuaaagcaaggcagggcacaguuguugccuauauggccuuagaguugagaaacaggauuuuacaaauggugucugaggagagaacuuuguccucgaaugcaucuaaauaaagggagcagaaaaagcaaaacaagcaguuucccucuuucucaguacauuggucuccaaaucaaacaucuauuucuuguagagauacaccuuuuccccugcauggacaauauggcugagaagcagauuaacaacuuagacugguccacaaaagccuccuguguccccuccuccaaaacaaccugacuucccaucuacuucuuggaggggggcuggucuugacuuugaagccuuuccucacaguagcugcagccuccuucuccagauccaggacuugaaauccuuccuacuuccuucucagaucucaccugacugacaugcagcaggucugccucugggcccuggucuuagauuuuggggacgaacaaacggacugacugagcacuuauccuuuaaauguguggcaugguaaaaggauguguuugccuauaacauaaccagagcccuugccacuguagguaugacagacauaggagccuaggugaaagagcaaacugccagcaaacuagggaagagcuccauuccagcugaaggcuugaccacugucuaauacugucuuugggaaaccaggagguaccugagggaugauuucccuuucuuggugacuucuccuuugccccaguuagaagugugaguggcuccugagaacuuucugucacagacacucugcuuugguugccacuucaggcuugagaacauugugcguguggggaaggggcacugccccagagccuguggaccaucaccuaggagaugaguggggaagucaaagcagaggcagcuaggcuuucguggucagcagagacugcuuuuugccucgggcucuucugagccagcaaucucuuuccugucugucagcugccugcaugaagggaaggcaucagccuauaauaguuucuaggaccaccuacaggugcagcuguaggcucuggcugucuuuaacucugguacagagagaaucaugggcucugaauaggaggaacaugagcuuuagggggcauuugggguauagaaguuuaaugaucauguaaacagugggggaaggaagucauggucuacuagauucucagaggcuggugaauuaucuuggugacuuuacugcuuucugagaugaccuuaaugagaaguugugcaauuguuugaaagccaggguucugcagaugguuugaauaaaaugacuagagauuuguccauaaugcucuaaaaggauagugugcuggcucagccucuucucucuuggcuacauuugaagacuaggaguuguagaguacaagacuuaaggaauaagaauugugggguggggggcacuuggauucuagaagcucccggauguuuugacuuuuguuuccuuuucuucagcaaccaaccagugguucaucccagcugugagaggggauaucccuccagggugugcagccuauggcuuugugugugaugguacucgccuauugguguuugguggaaugguagaguauggaaaauacagcaacgaccucuaugaacuccagguaauaacauagagccucugugggccuggguuguuacacugccucgggcccuauggaacucuccauaguguucauugugcugguuugugaggaaaggcaguggaagggguuacuugagagucuaccaaggcuguucgcuccuugaacagugucagaggagagaacaggaccaaacucuuuagaacuuacauguuucagcaaugugcucucucacucccgacaaucuuuuccuugugccacaaauagccccuggccccuaaccagugacuucucaucucuuaaauauuauugauuuuguaggcaagucguugggaauggaagagacugaaggcaaagacacccaaaaaugggccuccuccauguccucggcuuggacauagcuucucccuugugggcaacaaauguuaccuguuugggggucuggccaaugauagugaggaccccaagaacaacauuccgaggugaggcuuuguccuauuuuuuucucugaagcgucccaccagagugggucuacuuuccccagguauaagauucaucugaaauucuaaaguugguugugccagcugacuccaccagagccucuccugugcuggguugucaaugagagaauacagugcccuuucaagacauucucaucuuugagaucugaaccccuggguaggucuuguaggagaaaccuaggcaagagguagaauuggccuggucccuaucccacaggucgaaauuagaccuugcuuccuuugaagcuuuugcuacuuaaacauaucugaggccuauagccaaagcuccuaauacguggagguaguuccaagcugacacccucuuacucuagggaagcccacauauaaugccugguauuguggacaugauugccuaaaaggaccugccucugagucugaacuuaaggcugccaucauagcuuuacacauacacccuuuccauugcuccaauuggacucaaacuguaagcuucuagcagucucuuuugggggaaaggauaguagagugugugguuuccauggccuuugcucuuuuguguucuaguaaaucuacugcucauugagauaaccuggaaaaaccuguggugcauguguucaagguuugcuaugacugaucuuccucagguaccugaaugacuuauauauucucgaacuacggccaggcucuggagugguagcuugggacauccccaucacuuacgguguccugccuccaccccgggagucacauacugcuguggucuacacugaaaaagauaacaagaaauccaagcuggugaucuauggagggaugaguggcugcaggcuaggggaccuuuggacccuggacauugguaagaaauugcugcuauuccaguagcuucagagcaaggccaaucuccuggauagcuagccuugaguggcuguuguugcccggugaggugggacucaugggaagcuaguguuccccuuagucuucuuaucagugguggauaggaaacagaguaaggcuuggugcacuacuaacauggacuuuugagagaauagggagagaguacagucuuuucacaauggaauucccucaaucuagguagaguuuugacucacuuuucaguggacagucuauauguggaaugguauauucugauauaacuagugugauaaaauuuauuacccuagauaagauuuuuuacuugggcuauaaagugggugauggauuagguggagguagauauugguuauagugcccugugggucgcagcacccaaacauuugaacauaagcaaaaguugaguuuuugucuagugcuaaaauggcauggagguaaauaugcucuacagggaguagaaguacaaaggagagguuggggugagcuugauacccccaugucaucccugagaauggugaugccuuauagcaggugccuccuacuuuugggaagaaaccuccuugcccagaucaucugaacagcuuuacaaaugcugaaauauacuugugaggauaguaaauuagagggcuugcugagggauuuagaaagacaaagaugcaguuuuauguugguuuagggcccaguuggcccaaguacugggacuguggugucugauccagcauagguaaucuuuccauuucugcagagacacugacauggaauaagcccagccuuagugggguggcaccccuuccucgcagccuccacucugcaaccaccauaggaaacaagugagugucugcucuuuucuucuuugaccugagcugccccuaaguccugaagguuucucaagucaguuuugucaacugucccucaaucccaaggaggccuuuuucuggugggucugucauuaaacaaccccauacccuccuuauuaaacauuuuuuaaaaagacagauuaaggguagagggacugcauguaaugcagccugagacccuuucuugaccuguaaggccucaucaagguauagacaguguagcucuucauugaaucaggguucuuugugaaugccaaggucuagcguccauggaggcaucuuagaugaacaaaacaaugcucuccuuacaaagaaauaacgggcuggagagauggcucagcgguucagagcacugacugcucuuccaaagguccugaauucaaaucccagaaaccacaugguggcucacaaccaucuguaaugaaaucucacgcccucuucuggagugucugaagacagcuacaguguacuuacauauaauaaauaaaucuuaagaaacaaagaaacaaauuuguaagaguaaaccaucagguaauaagugccauauuaaacaguuccaugcauccuuggggacuccuggggccuucuagaaaacugaauguguucagaacuuucuagguaaaagagguagccucuagcuuggugcuucucuucaauccucucuugcuuuuucuuuauccuccuagaauguauguauuugguggcugggugccccuugucauggacgaugucaaaguggccacacacgagaaggaguggaaguguaccaacacacuggcuugucucaaccuggguauggccuucucaggcuuagaauggccagggaugggguggcccugggaaauuauuaggguguccaggaagcaaauucgggcucauggauauuaccagaaauauccaauggguagaaaacucucagguaguacuccuuuuaguaugaaugggcucuucauaugugccugacauccauaagugcaaaagcacauauagugcagaaguguuucuuauacuccauuuguagggacucuacuaauaggcuauagcucuaggaccuuagcuugccauacacagggccaaguagcccuuuucccuuacuaucuuggagaucauuucauacccaugcauaguucuucauauucuuuaauaugcuguacagcuuuaauucuagcaucuaggaggcagaaguagauggaacucuugaguucaagaccagccagauguuugugaaaccccaucucgaaaacaaaauacuaaacaaaaaauuugaguugcuuuaauuuugacuggaugcacacauuaucuuaagauuuuuacuugagccaggcagugauggcacacaccuuuaaucccagcacuugggaggcagaagcagguggguuucugaguuucuggucuacagagugaguuccaggacagccagggcuacacagagaaacccugucucgaaaaaaaaaaaaucuugauuuuuuuuuuuucauguauuguuucccuuugcccaucucuuaggauuguauuauuuuuauguacaaggaguuaucuuccaaauacuuucccaauauguggcuuaauuuuuuaugccucuuugccucauuuuuguuuucucuuaauuugauacuccaauaacuugaccuucccugacaaugaaagaauagagggcaacuugggaguugguggaacagguuccuuuuguccucugugugaccuccagcaccugugcaccucuagauaccauggccugggaaaccauccugauggauacauuggaggacaacauuccucgagcucgagcaggccacugugcuguugccaucaauacucgucuguauauuuggaguggccgugauggcuaccgcaaggccuggaacaaccaggucugcugcaaggacuugugguauuuggagacagguaagguacuuagccacugacauuccccacugcugaagccucucuauucccuaucuuaacaguugcuuuguuguauuacagaaaagccaccacccccagcccgaguacaacuaguacgagccaacaccaacucacuggagguuagcuggggugcaguggcaacagcugacaguuaccuucuacaacuccagaaauaugacauuccugccacagcugcuacggcuaccucccccacucccaauccagucccgucugugccugccaacccucccaagagcccugcgccagcagcagcugcaccugcuguacagccacugacccaaguaggcaucacacuugugccccaggcugccacugcacccccaagcacaaccaccauccaggucuugccgacagugccaggcagcuccauuucugugcccacugcagccaggacucaagguaagccaugagggccauaggcauuugugugaggcuuaaucacuggagacauucauugccugaaugguggcugcugcuuuguucuugguugauuuagcuuugguuuuguucuuaaaauaggggauaaaagugcugucuuacugaugcgauggucuugggggcauagaaaagucauacauaaaaacauguaggucaaggaauaggucaagucuaccuuaagucugacagaguagaagaguaucuccugaugaucaacccuuuuccuuaucaggugucccugcuguucucaaagugacugguccucaagcuacaacaggaacaccacugguuaccaugagaccugcaagccaggcuggaaaagcuccugucacugugacuucccugccugccaguguucgaaugguuguacccacacagagugcccaggggacggugaggacaucucucuguguguguguguguguguguguguguguguguguguguguguguguacacguacauacacacacauaucucuaucccugggacugaggguguagcuuacuuguuagaauguuugccuagcaugcaugaagcccaccagcucccaucauaggcucuuguuuguaagaugcuacugcauuaaaaaugccacaggccuuugaucccaagacucaggagacaggaguucaaggacagccagggcuauacagagaaacccugucucaaaaaaccggggguggcaaagguggagggauccuugacauguucauugugguuuuccugauuuggaagguggaggagaauaucuaguuaguugcauuugacccaagucugugagaauaagcuguauuuaacucaaagguuguguuuuguuuuggguaggcuaucuacuauuuagagauuguccugccucagccucccgaguucuggaauuauaagcaugaacaauacccagcagugauguugauaguguuguaugugaaacccaucacugccuugugcuaaguauguguucuuauacugagugagauauguaaaaugaauuauuuuuauuauaaauauauguaguaaauuaaucuaguggccuagcuugauuaugguucuuugauuaaaaaucuacuuaggggcuagggguguggcucaaucguuugagugcuugguuagugugcacaaagcucuagguucaauuucuaacauugcauuagccauguaguugcaugucaguaaucccaacuuucgagagguggaagcaggaagaucagaaauugaggguuaucuuuagugugaguuugagacuagcccgagcuaugugagaaccuuucucaaaagaaaggagcacuuggcgagcaccugccuacuuguuguuugcacuaggagagaggagcccgaauuaggaaaaaacaauaugcugcugagcccuucuggcagguucugaaagggucauugaauuuggaagcagguggcagguggaacccuugcagcucacaugcuuuguguccgucacaggugaucggcagcaacccacagaugagugggauggccgcauuggcugcugcugcugcugccacacagaaaaucccuccauccucagcacccacggugcugagugucccagcagggaccaccaucgucaagacaguggcugugacaccuggcacgaccacucuuccagccacugugaagguggccuccuccccugucauggugagcauugaucuucugggccugguaaucgaacaagcagugaccguuuguucuggguuugggccaaccuuucgggccgucgguuuacgaucaguacuggcaugggcuauggaacaugcaguuaccuuuaaggguguccagccuuagauuagaccuguggagaguucaggcuguucucuugcugcucagccaaccaaacuggauggacagguggucagcagagcuacagccauuauguugcugcuauguucauaacucaucucugcuucuccaggugagcaacccagccacucgaaugcuaaagacugcagcugcccaaguggggacaucuguguccucugcugccaacacaucuacucgcccuaucaucacaguacacaaaucaggaacuguaacaguggcccagcaagcccagguggugaccacggugguagguggagucaccaagaccaucacccuagugaagagccccaucucugucccaggaggcagugcucuggugagugacagcuaccaccuggccguguaugacaguugcuagccuuuggugaaugccacuggugacucgcuaucuugugccaauuccaauauaguucuagcccaggccaugcccuuguuugguuccagauuacugccugcuccauccuuuccuuuuuagauuuccaaucugggaaaagugaugucggugguccagaccaaaccaguucagacaucagcagugacaggccaagcaucuacagguccugugacucagaucauccaggugagcacucacucucucaggcccaagaggaugaauugacacugggaaacaaggccuugcugauaccacagcacccacaguauucagaauauucucugaguuauaguagcucaaccuaauguuccuuucuggcaguauuuccuguuaauuuauaacuucuccuuuuuagaccaaaggaccccugccagcggggacuauccugaagcuggugacaucagcagauggcaagcccacaaccaucauuaccaccacacaggcuaguggggcagggaccaagcccacuauccugggcaucaguaguguuucucccagcaccaccaaaccuggcacaacuaccauuauuaagaccauuccuaugucggccauuaucacccaggcaggugccacagguaaacaggcagcuuucaaaaggccuuugcugguuugcuggugaguauaaaucaaaaagauaaguccucacagcuuauuuucucugaauccuuccccaaugcagguguuaccagcaguccuggcauuaaguccccaauuacaauuaucaccaccaaagugaugacuucaggaacaggagcgccugcuaaaaucaucacugcuguccccaagauugcuacuggccaugggcaacaaggagugacccaggugaggcacacaugaccccucuucacuucagucuagcauagaccacaugugucauccuaacaggucugagaggggcagcacaguccauucagccugaaagugacauugguggcacuuugcucugcuguuccagguggugcuaaagggggccccuggacaaccaggcaccauccuccguacugugccuaugggcggcguucgccuggucaccccugucaccgucucugcugucaagccagcugucaccacauugguugugaaggguaccacagguguguagccugcaggccagguccucagcaauggcugggggaggauaacagguccucucuccagagccuucuguccuugguggcuacauggcagggcucccauucccuagcccucgagagagagacaggcugcuagauagaaagugguagcaauaggccucauucugccuuugccuuucccuccauuuagguguuacaacgcuaggcacagugacaggcacugucuccaccagccuggccggagcuggggcacauagcaccagugcuucccuggcuacaccuaucacuaccuugggcacuauugcuacgcucucaagccaggugaucaacccuacugcuaucacagugucagcugcacagacuacacuaacagcugcuggugggcuuaccacacccacaaucacaaugcagguaaguggguccuaaggguguaccaccauacacagcagcacucccacaugaaaguagggggcauuuuagccuuucuccccuuuccagauucaguucuauagaccuauauaauuaugacagcuuuucugcacauggugugaucucugucucagucuuuccuggugacacauuugagcuauguccaguuugcagacacuaggaucucauaauguacauacaguauuuguucucuugucaucuuuucuucuuaacuggacaagaagugguaagggaacuuauuuuacuggccuuuguacacugucuggaaaaaggcuugacuaucguacaacuccuccugccccagcucugccucauugucccuucauccucggcucuaaguaagucauuguuuugagaucacgggccaaacuuuucuuagauuugccuuggauaguuaacagaguugguggucccagucaacaugggcgagcauaggauaguaggagagguaaaugcaaaaucacauaguccaggcacuaacuccucuguucucuuuccccagccugucucccagccuacccaggucacucugauuacagcacccagugggguugaagcacagccuguacaugaccuuccuguauccauuuuggccucaccuacuacagagcagcccacagcaacagucaccaucgcugacucaggccagggugaugugcagcccggcacugugacacugguguguuccaacccacccugugaaacccaugaaacaggcaccaccaacacagcuaccaccacuguuguggcuaaccuugggggacauccucaaccuacccaggugcaguuuguuugugacagacaggagacagcugcuucacuugugaccucagcuguaggacaacagaaugguaaugugguccgugucuguucaaacccccccugugagacccaugagacgggcacuaccaacacugccacaacagccaccuccaacauggcugggcagcauggcugcucgaacccccccugugagacucaugagacaggcaccaccagcacugccacuacagcaauguccagcaugggcacugggcagcagcgagacacucgucguaccacuaacacccccacuguagugcggaucacuguggcuccuggggcauuggagagaguccaggguaccgugaagccucagugccaaacccagcagaccaacaugaccaccaccaccaugacugugcaggccacuggagcuccaugcucagcuggcccccugcuuaggccaaguguggcacuggagucugggagccacagcccugccuuugugcaacuagcccuuccaagugucagaguugggcuaaguggccccagcagcaaggacaugcccacagggcgccaaccagagacauaucauacuuacacaacuaauaccccaaccacaacccgcucuaucaugguugcuggggagcuuggugcagcucgggugguccccacaucuacauaugagagccuccaggcaagcucuccuagcagcaccaugacuaugacagcccuagaggcacugcugugcccuucggcuacugucacccaagucugcuccaacccgccaugugagacccaugagacggguaccaccaacaccgccacuaccuccaaugcgggcagugcucagcgaguaugcuccaacccgccuugugagacucaugagacgggcaccacacacacagcuaccacugccacaucaaauggaggugcaggccagccugaggguggacaacagccugccaguggccaucccugcgagacacaccagaccacuuccacuggcaccacuaugucagucaguguggguacccugauuccugaugcuacuuccucucauggaacccuggagucgggcuuagaggugguagcagugcccacugucaccucccaggcugguuccacauugcuggccucuuucccaacacagaggguaugcuccaacccuccuugcgagacccacgagacagguaccacgcacacagccaccacugucaccucuaacaugagcucaaaccaagguaaguagaaguguccgguagaggagguacagauagucuauuuuugcgcgggggggggggggugaauccuaggaaaccuguggugguaaaagcaaagagagucaacugaucuccccuuugacacacccacagacccuccaccagcugccagugaccaaggagagguggcaagcacccaaggugacagcacaaauaucaccagugccagugcuaucacuacaagugugucuucuacauugccacgagcagugaccacugugacacagucuacaccagucccuggucccucugugccgguaagccucaccccaaaggauccuuucuguggccuuuugcccacuuucaucugugcuguccauaaauggacacuagaugucgcccuuguuccagaaugguauuguuccuugguuguucuucuagaccauaaaagggcaaucuuggugccugggaggcaggaggcaaacagucccuuagaggagcguugguacuuuaucuccacuguugguuuccuucuuugcuguuccccaucauuugucucuacagugaagucuucugggcaugaguggaaacuugacccaggggcuuuccucuugucacacccuugcugaugcuucuugacucacauuccucauuuacauuuacccaagauaaauguugugggugauaccauaggccuacagggacaaaacaaaggcuaucuuguuuuucugccccacugccugguucuagccuuugucuccuccccucucccucugacgggggcuucucucccuuucuagaacaucucaucauugacugagacuaccccaggggcucugaauuccgaaguccccaucccagccacgauaacagugaccauagccaacacagaaacuucugacaugcccuucucugcuguugacauccugcagcccccagaggaacuccaggucucaccagggccucgccagcagcugccuccacggcaacuccugcagucugccuccacaccccugaugggggagucuacugagguccugucagccucccagaccccugagcuccaggccgccguggaucugagcagcacuggggacccaucuucaggccaggagccuaccaccucugcugucguggccacuguggugguccaaccacccccacccacacagucugaaguagaccaguuaucacuuccccaagagcugauggcugaagcccaggcgggcaccacaacccuuaugguaacagggcucacuccagaggagcuggcagugacugcugcugcugaagcagcugcucaagcugcagccacugaagaagcccaagccuuggccauccaggcugugcuccaggccgcacagcaggcugucauggguagguaucagcuggcagauuugagggauaggccccuuaggaugagugacagacagccuuacagagagggcuaaggcaccauuugggggcuacuugagaucugcuuccugugaggguguacaauguaacucaagagagucaagagaggcuuauguagaacgaguaguccagggaggagacaugggaccuaguggugagggguauaauaaggugugggcaggauaaaaaugcuuagggaaacgaaaucucggggacgccauugcugcccauugggcuaggcacacuuguguuccuuuuugaauaguaguuuucuugguccuggagcaggcacuggggagcccauggauacaucugaagcagcagcagcagugacacaagcagaacugggucaccuuucagcugaaggccaagagggucaggcuaccaccauacccauuguguugacacagcaggagcuugcagcccuggugcagcagcagcagcagcuccaggaggcucaagcucaagcccagcaacagcaccaucuucccacugaggcucuggccccagcugacagucucaaugacccauccaucgagagcaacugccucaacgaguuagcuagugcugucccaagcaccguggcuuugcuacccucaacagcuaccgagaguaagcugggcugcuuuuuggcagggguaaaucauuaauagaguugaacggaugggaggugaacacaguguaacaaaguggcguggagguucugccucaaaacaguaccuucucccagcugauacuuuguuucuuuccaggccuggcuccaucuaacacauuuguggcuccccagccuguuguagcuaguccagcaaagaugcaggcugcagcuacccuuacugaaguggccaauggcauugagucccuggguguggugagucugggucacuggcccuaggagauagggcagcacugccuuugggccacaagggcuugauauuaucucauuucuguuccccagaaaccggacuugccacccccacccagcaaagccccugugaaaaaggagaaccagugguuugaugugggggucauuaaggguaccaguguaauggugacacacuauuuucugccaccagaugaugcuguucagucagauguaaguauugcccaguaacugguacccuuggauagugggguggaaccugcugugccugugagaguuugucauaaaaacaaacuuuaguuucccugccuugugagaggagcucacagaacuccaucuuugccacuugaaaaguuaggaaguacaaguaagaaagucaaacugauccuuuucuaacagcaccaagccccaguuaaccuuaccaugucccuagggccucgcuauaaaagagacagccaugacugaacuuucuuuuggucccauguuacucuaggacauuggccauccuagacaagcacucuagaacugaacugcccccucguccagaguauucuuugugacuguaggccucaagccauuuucuucuuuacuaauuuuccaccucuugccuuaggaugacucaggcacggucccagacuauaaccagcuaaagaagcaggagcuacagccaggcacggcuuacaaauuucgaguugcuggaaucaaugcuuguggccggggacccuucagugagaucucagccuuuaagacuugucugccuggguucccaggggcuccuugugcuauuaaaaucagcaaggugagacuuucuaugggccaucuuucuguuuucuguuggucugcugucugcucuagggugguacauaugaacagagccaggaggugacuggaccaggaguauaccagauaagcucaaguagccuacauucacccuuaauaaacaagauacaugccaggugcuccguugguaaauguuuuugucuaauccugaaggucccaaggagaccugggucuuguuagucuauuuucagaugcagaaacugaggcaccaagaagcuaagugacaaguuauggauuagaugauggguuggggaggguguuauaaaggcucuuuaaaguccuuuaauauuugaugugggguaucuggguuguuuuggguuuuuuaaaauuuuuuauuacauuuguauuuaguuggggggugcauagcugugacacggugcucauuugaaggucagaggaggucaugugggucuuggaaauugaacucagucaucaggcuugguagcaggcauguuuaccauacuguugagccaucucaccgaacccuggaauagcuguuggauugggggagguuuuuuuuuuuuuuuuuagggauuauuagcaguucuaauaagcgucuagcccucuugcucuugaguacaggcagggugggcugugaagccacaguggcugaagaagacaaggcuugacuuuauguccuggguucuagagcccagauggugcucaccucaccugggagccaccgucugugaccuccggcaagaucaucgaguacucuguguaccuggccauccagagcucacaggccaguggugagccaaagagcuccaccccagcccagcuggccuucaugcgaguguacugugggccuagcccuuccugccuagugcaguccuccagccucuccaacgcccacauugacuauacuacaaagccugccaucaucuuccgcauugcugcccgcaaugaaaagggcuacggcccugccacacaagugaggugguugcaagguaaguguucacaagccuuuuggggcaauuuuuagggaagguaugggaaagcacugaguggaacaaagauacaccuagcuagacuagggaugcuucagacauuggaugagagcauauaggguauuauagaggaugcucuuguguucuaggggugcacagaagauacucuaggaugucuaaaaguaaagguuaggaggaggggcuugaagaaagcaaaagcuguuaggcucaagaacaacauguccuaaagcccuuaaaauggguagcugaggcuaggucccggaagguaucugucucaggagggauauugagaggcaggaacugaacccgaaggauggcaugggcagucaagacugugaaaagugggguacacccaagugcuucugccuuuugccuggcugcucaccaucccauuccuuucagaaacuaguaaagacagcucuggcaccaagccggccagcaagcggcccaugucgucuccagaaauguaaguaaucucuuugaggaaucuuuuguggggaguacuuaagaguggaaguaagcuccguuucucaucagcugcuugggauuauaucuacacaagguccugaguugguguuuuugugaugcucuugggacccucuauaauuauuucuucucuuuucucuuauauaaggaaaucugcuccaaagaagucuaaggcugauggucagugaggaagcuggccagcaacuggauccuccagaccccucugcuucaggaaggcccuauagggcccaccuucccgcccugcccaccuggccuuugcacuucacccucaccagcuacuggccaccauucagucucccccuuuuccucuguuuuuacaauaaagaaagcacauuuuaccauugcuauugggaggaagcagaaggcagauuggaaagaacagcgaguaagugcaaguugugcuccuuccuuuucccuaccugguacccucccuggguugaguaugaauggacagcucagagacuuugggaagagaaauuaaaacugaaaacaaaggagauaacacccauacuuaagccugcacuuguuuguaguucaucgcccuuggccugagaggcagccaaggacuagagggggaaggauaucccccaaguucccucagaggcuuuucccagcagguaccccauucuggguaucugucugguucuauuuuguuuuguuauuauccuuguauuuccagccaccucccaucccuucuucaagcuuagccagauccuaucucgcccagugaaaucacaggaaguuuaacguaucucagaggccuuugaguucccacucaauaccucucccucuuuacagaagagagggguggggggagccuugguuggucugagcaguggcugugaaauccucccaaugggcacagaauggcccccaggaacccuggccuuggccuacuuuuuugagccugggggccacaucaccaacugcugcauauguuguauuuuuuaaguugaaauuaaugaaguuaacauuuuuauuguaauuuuagccuuagcguguggggguuuaucccuuuuuguuagcuguguacagaauguguauccuaucuccuccccuccuuggcuaaucauuggcaggggucuuccuggggaaaagcuuaaagagcagcuagggaaggagagaaacaguguccugggugagacuugguagauacugcuccaauauccuguugcuagcccccaccuccuucuggaacagugugagacaauuaaacuucauucccuguggguuagcacuuaauauguagaagcuugggcuugaaggugauguccaccuuaaucagcaucacuugcagagacugacccuaaacaacacagcaggggcagggaacggguaggacuugacccucuugaaggcagcccaggaugggaguaggguaugccauaucccacaggggcuaugaguagguaccagauaccaacucaguaauuaauuuuguagcauuguccccaagcucuggauuuuuuucucuccaggacccaaguuuuaggcagugaguaaugcuuauaagcaaauuacugaaggauuuaaaaauggacagccaauguguucagccgcucuggccuguacccccuggggccucuaguguauuguauuauauuucuguggaaagucauguuuagucaaauuggaauccacucaccuguucccuuuguuuucccuaucccuucuccugagcacccuuugauuucugaggacaguacuacccauucaucuauuguagaguaacccuugugacucaauauuaccauagugcgauguuguuuugugcuauuuugaacaauuaaaaagacuuuuuuugaaauaacc

SEQ ID NO: 9557 - RNA, 519 nt, Mus musculus
uuagccuuagcguguggggguuuaucccuuuuuguuagcuguguacagaauguguauccuaucuccuccccuccuuggcuaaucauuggcaggggucuuccuggggaaaagcuuaaagagcagcuagggaaggagagaaacaguguccugggugagacuugguagauacugcuccaauauccuguugcuagcccccaccuccuucuggaacagugugagacaauuaaacuucauucccuguggguuagcacuuaauauguagaagcuugggcuugaaggugauguccaccuuaaucagcaucacuugcagagacugacccuaaacaacacagcaggggcagggaacggguaggacuugacccucuugaaggcagcccaggaugggaguaggguaugccauaucccacaggggcuaugaguagguaccagauaccaacucaguaauuaauuuuguagcauuguccccaagcucuggauuuuuuucucuccaggacccaaguuuuaggcagugaguaaugc

SEQ ID NO: 9558 - RNA, 1166 nt, Mus musculus
ugguuuuuaaagaagcuuuuaauucuuuaugagcuuuggguccuuuaagaggcuugagaccagagucaaagacgugcgaaggcggggaggagggggaaaggugacgucuucugaccccgcccccucgcccgauagccgccauguuuaguuguuacuucuucacacaagauggcggcucccagggaggaggcaugaucgcccugccguuaccgcuucuucugccguacaauugucacuucgggucuuaacuccugcucuuucgagcggcuccugugggaaggagucuuaaggagggaagcgaggauuggacgcugccuugcguuugguuugcuguggaagaacuguccaggaagaagaggauagguggggugggggggggaagagaagcuagucucaagauggcggcucccagggcggccgccacagccugaauagcagaggcggacucaagggagaggugcaaaaccucucgagccauacgggucggggcuucgagcagcaacugagaguuggagcccguuccgccagccucugacacgccuuuauuacuuaggaacguugggguucugcgaucggugguuguacuaagugcuggguggggaagcaggacgguuucaagauggcggcuuccacaauuguggucugacugucggcgaaguugagacaaccgcggcauuuguggcucuuuuccacccgccccggaagccagccagugcuggggacggggggugugggaaccgggccggggcuccgccauuuccggcgggggagggcuacgacugaggaagggaggagagagaggcggcucaagauggcggcucccagagccuccugcucgagguucuaagcgggaacacccaggcaaauaguuagagcgacggcgcucaguggccuccagcuucucgggaauaggugcucugcaguucugagaagcuuuuaaggauacgagcugagugagaagggggggaagagccaaaggaaggaggauaguuaagauggcggccuccauggagucguccaccgcuguguaaggagccgcuucuucgugagagcugccuuagacgaaagggggugugugaagaauuaaggguauccucccauucagugaccucuucccacugcauccuuaaccggaacuauggcuucggcugugucucccgcaaacu

SEQ ID NO: 9559 - RNA, 10010 nt, Mus musculus
auagguuggcaauggaguaaaauuaucuuuauuuucagauagguugauuguauacaaacuaucucagaguaaucacccccaaaacaaguggggcuaagaaguaaggccacagaauaaagaucaggaucaaaacuuaaugaaauuucuauauaugauugaugaauaauucagacaugaaggcuucaauuccaauagcaucaauauccacgaaaucugcaagacaagaaagcaaggggaucuauccccagucuggccugacaagagaaaagaacaaaugcuaggggccugaguuuuggguggacacuuaagagcccagagauauaaagcauuaggaaagcauaacacuuuuagcacaacaaauuccacaaguuuaaccagacagugaaauguaugcuuuuauuacucaaggacaaauuggaugucaccaauuacacaggggcauguagugugacucaugacucaaacacagaaucacuguaagccugggcuauagcccugggcuacuugugaagacacuuaauuauacaaaaacuuguuguuuuuuuuuuaaauguaacauucuucccccucaaauacuuagcuuugcucucaguuucuucuuucuuggggcuucucacugucuggguaccacaaagcugggcuuugcuggaccuuucugccauaagcagaaccuugggcauccacagucaauuugcaggguauagagagagccugccuaggcaggcagguagucauaugaaacuagcucacugcuaucuggcaaggcuugcauauauccacccaagauggggagggggguuuuauuagacucuugggagaaucucagagugcucacuucuagcuaguggacugaacuguaagacacucuuuuuuuuuuuuuuuuuuuuuuuuuugcaauuuacaagcacaacagcuacuuucgcuugguguuuuagggaaguucugaggaauagacucacagacugcagauauauuaucuagcucucaggggagcuagcucccaccauacaaacagaccuacuuguguccucugggccuguguagcuagcagucuucuguuuuuuuuuuuuaaagauuuauuuauuauauauaaguacacuguagcugucuucagacacuccagaagagggcgucagaucuuguuacagaugguugugagccaccaugugguugcugggauuugaacuccggaccuuuggaagagcaaucgggugcucauacccacugagccaucucaccagccccagucuucuguuuuguacuacccaauuccuuagguacucugcuugccuugcucacaaaugcuggccucacauugccugccuuaucagcuucuaucaaguucuuuggcuggcccugucuguguucacauucugagaacagcaggguccacugcccucucuccuuugccagagugagcccccacaccugaugccuuugggcuacugaggaguuugcacacuaugagaacuuccaagcaugagaacuuugaccucugagucugagggauuugucagagugaacaaaucagcucuggaauucaucacuuucuucaggucccuggcucuuuucagguucuaaauccaagccuauggaaaagaaaauaucacuuaauaaguuggggacaacuucuugucuuucaaauacccugacaugaaccaugagcacagaacuuugugggcccccucccacuccaaacugagcaugugggaaggagacuggaacucagggcacuucgcuugcuaagcaaaugcucuacaacugagcuaauucccuaccccaccccaccuuuuucucacaggguuuuuuugucuguugcccuggcuauccuggaacuugcucuguagaccaagcuggccccaaacuugccuguuucugccucccaagugcugggauuaaaggcaugcguuaccacugcccagcucagggcagucuuuggagccaagguuuucuuuauaccuuuaguuugcuuuuugaaaauaagauuuuuccuuuuauauguguguuucuacgugaguuuuaaauacaccauguauauacaaaguauauacauguauauacaaagguaucugcggaggccagaagagggauucagauccccugggacuggaguuacaaguagcugugaacuaccaaauguggagucuggaaacuaaagccaaguaaaucugcaaaagcagcccauugccuuauucacugggcaaucucuccggccugcuaguuuggaugaucuuuacagguacacucuuauccccagcuaagguaucccagcaauuccuaggcccagaacaugcuuggcuaaacagcagcuuuucauauaguaccuggaguagaaaauuccugcuggaacuucacauuuucuaggagcaugugggagugcuacuggugggaaguaagggauugagccaggcaucucccuacagauguugagcaaaagcuggguccuauauucuugguaaguggagccuuaauugugcagccagaacaaauguucugcuguuuaggguugacauaaggaauuaugccuguaugcccuggagcugcagaguaugacuuuguaugcauguuuguauguguguaugacagcggugggaggcucuucuggggaagcugagcuagaguuauccacagguaccugggaaaaagccugaugacagcaguugcaggcuauccaagaccccuucuucauaaagagccagcuuuuguaccaucuucugucgggcuggguugaugaugaucuguggugguucugaugacagcagggaugagcugcccgugggugagccugagcagagauaguaacuucuuagcugucccugcuuuuuuuuuuuuuuugguuuuuucgagacaggguuucucuguguagcccuggcuguccuggaacucacucuguauguagaccaggcuggccucaaacucagaaauccaccugccucugccucccaagugcugagauuaaagguaugcgccaccacgcccggcuugucccugcaaucuugagugacacucuagccuccagagucuucccagcuccccccugcuagugaugcuggcugcagggcagaauucuccaguauauucuggggcccagguugggagagaucagaucacagaccaggcucccaggcugccuagacagaaccuagaauucuacacuuuugauuuuaggcaugggguggggagaaggguuaagaagggagauccuauuccgaguuaccuuccaugguuguaggcuggaagccugggcuacuccucacacuugauucucugguagugccucccuggguacagcuagccucucugaaggacgcugggcuugggugggaaccuggagucaagugccaggaaugcaggguagcagagaggccgggaacacucucaucacuuuccacuggcugguugggacuucucuggaguugcugggcagccugggcuggggcucuuguggucacuacuagaggcugccaugguucauccccacucugggcacugccagugguagacauguaggaguucuccuguggggaaggggagccauggccggcaaccucuagcucccagggaggcccugccugaagcccuucuagucucuuguauaccuguguggagagagaggcucucaggaugggcagagcauggguuccuggcugggcaaggcagccuagaucugacacccuguggucaaaccacacagcuacucugcugcuucagguuggccuagacuugccuauguucagguuaauaccacaggccccauacagccaacagaaugacagauaacacaaagcuggugcacucugcagcugagaaaacauugcccuuuguuccuuugucucaucccaagaacuauugagauucauggccaccaaagccaggaacucuauucuuaaccaucaccagaagagguggaagguaagacaaaaagacaaagguagugaguggcacagcacccccacuuaggggcaugaucagagcccuuuccuucuaccuguuccugggaucugaggcucauccagcaaagcagcagcccuuuaccacuuaguuccacagagcaccuccccaaauagagccaaagggcaagcaaggaauguugggaguuuugccucuguaagagaucagguagguacuuuguagcuauugcuaucaagcagggcaaguacgaaaguuuucuugcuggccacuauguccccaugguuaacuggccuccccagggcuaccugggucauggggggccucuucuuggcccgacggugcaugcagcagcaagcuaguugagccagggccaggcccaacuggggugggcagggcccaggucuggaguccaggugcuucuuauagaucugggcagcaauuggagcagcccaagcauccguggcuacacccacccacagaguaggcugggugcuuuucagggucacuccagccucuucagccucaucuucaaucaggucuuucuguaaaacaaauacugucaguucagcaugguuccaccaaaacuuccaggccacugccacucaguccucuggucuucuuucccuagguucauuaaacaccacugugugccuagugcugucuggggcucuacugauaacagccacaaaucaaacacucugggccguguuuuacaguccugacaucccauugcagugggggaaacagaugccaacaaaccuacuagucuguuagcaagguccguggggucugaacaaccaguacuugagcugggaugugcuaauggacgcaguaaaggaaggagggauggguagaaucugguucaguuuguuggguugguuaaaucccccacugggcccaacaguggacaaaaauaggcuucauccuggagaagcaaugggagauguaacucuguaaaaggugacgacccagcauuagccaagcauguucugggccuaggaauugcuggaauaguguuccuguguuaaagucuguuuucuauaugggaaacugaagcucaaugaagagcaagaauuugacccaugaccacuguguugaugggacuaaaacccaggucucuugucuuuuuuuguuuuuuguuuuuaaaaaaaacaaaaaacaaaaaacaaaaaagacaggguuucucuguguagcucuggcugcccuggaacucacucuguagaccaggcuggccaaaacucggaaauccgccugccucugccucccaagugcugggauuaaagacaugugcuggcacugcccagcuucuuuguauguuugagacagugaaccauguaacuuacucuggucuugaacuuacuauauuacugaggauaacuuuaaauuucugaccccccugcuucuaccuccuaaguguacaugccaccauaaucaacuaauuuuguuguuguuguuuuugauagaaggucuuguuauauagccccagcuggccuccaacuccuggcaauccuccugccucagauuuuugaauguuggaaccaaaaccauguacucagaugcuaagcuuuaggucucuuauuccuuagcccuaucucaguguacagcaagguagacaggaauguaggggucaggauggcuuggagcugcuacuuuaacagccugccuacuuccuacugccuuuacucagcccugcucuaaguuccacugaagguuugguccccgggguaucuggaauagcccccucucuauccccaguccaaggcagagggggaaccugucaaaguucuuuuuccccuuugauggggauaggacccagggccuugcaugcaauaagguucuaccacugagauuacaucccuauccucaaggucuagguacaaacuaaagauagguucuuccgugcaagguaaaagaaacugcuugggacucacccacuuuuaaagaugagucagcagcagcaguagcaggcuauuguggggcaauguaaaggaucuguaccaucccacccucuggggcuguacccacuggcugcagcugccccucccucccuccaugcuccaccuuaggaggcucaccaaauacuuggucuuugcaccuuguguccucacagcccucugaccagcaagggucuccaguauuaccuagaggggggauagacaacaucacuuuagcagggagaaauuguguguagaagaggcuuguagcaugggcauggaucaggacuagugggaaaguagucccggaacaggcagguacagaccaccucccagcaagggcagcauuguuaugggaugcaagcuuaagcaaaaggaugcaaauuaugaccacaauuuagugcaagggaagagggagguguaugaggcagggugaucccuaaggccaaagcuaugcuagcuccccacuaggcucaccucugccuuaggccuagaauucucuaggcuuuccugacuuuacuuacuggugcuuuucccuccccaagccaacagaagggcugguggcucaccaccccaaagcugaagguaucgguguccacagccagucggccugucuugauguacuccucaggcaaguaggcgaggguaccucgaacuguggaaguccgggccacaguacugcucuggcuugcuuuggcccccgcaaagcggcugaaacgagccaggccaaagucucccagcuugggcaucagucucucauccagaagcacguuagaacuuggaaacaaacggaagaauggcaccaguucagguccuacuaccuuucuguuuuucuguccccuacacccaaaugguccugauaaacuggacuagaggcguacugcuuauggaaaguggcugcauugcaucccagcugucugagggcccgcagucccugagccccuucacauuguuuggcuucugcucaccaccguggcuuuauuuguauacuugcaccaugcagggguacucauagcccuaaguacucucagcucugaggucccaggcaacaccuguucccauauucacaggacugggcaggaagaauaucacagggacacucagaacagagcuguucauugagcagagggucacugucucccuggccauaugacuuucuauagcucuucugagccccuccucaccucuugaugucuccauggauaaggcuggggcuauccugauguaaaaacugaauagcccgggcugugcccagaagaauguccagucguugaggccaggaaaguggggagcaggccugggucuggagugacaaagacagaagcacagaggcagcucagggcagcuguucuuugaccccccccccccaaauuccccucaccugucacugugcggcuuggggcaagcuuuauucugagccucuggagaaugaggaguaagacugucuaugaccuaauucacgagcaagugguagcuaaagcuauaccgaagguuuuggcaagcacucuacagcugggauaccagcuaggaacauuucacaggacucaagacaaaaugugaugggcucagcucuaccuaacagaaagugcuggugcccuucucccucuccucucucaaaacaguuugagaaggaagcucuuauccuguauaugugguggcuugugaguaugacauucaggcauggcucaagcuuggguucagucugacagccugucuccacugguccucauuccucaagagcuauauguggacuaaauacuaaauccuuuagcuacucugcuugcaaagccaauaacucccaauagaggaacaguggggagaggacagaggaaagaauuguauggaaaaucuugggccaagcugaguguaauguaacucuagcauagagcaggcugacgcagaagaauugccagcuugaggcuagccugagcuggguagugagguauugucucaaacaaucaagccaguaaaaaggaagaaagaaaacccugggccaaaucuugaguuugagggggagccagaagcccaaguccugccugacacaggcuaaggggcuaugccaauaaaggugccagaucagcaaggacuaccugaagguggagcugauccuccaaggagccauugggcaagaagccauaaacaaggcaguauaagccacucucugcacaguagccagcaaagucuacgauauuugggugacgaaaccuguuauaaagaguggagucugaguucuuuaauuuucuggguucuacuacuuuucaucaggccaggcuagguaggcagcacuugauguucccucacccaugccaggccaggccuugagggcccaagggagccagaucuuguguugugcaguccuaaagacugaugaggccgugguguggcucaccuugugccccuagacaggagggacccccaaggcucaccuugauagcuguuccaccucuguuaagaagcucuguuucaccauaguccacucuaggucagcuuccuguagccccaggcauggugggguaagagguagggaaaguaggugacaugagccaagcuugccaguuguuuccaggcccaaaucuauggaaggcuugggguccuugaaggaauugcuuggggaggcuggagacugcagaagugaggggcugauggagggaggaacuagacaaauaaggacugauagauugucuuccaggugucuaccccaauguuacaccuaccuccuucagucucuucacagcauauguaguauuucucaugacugcucgguacacacauccaaaaccacccucuccaauccugaguucuucagagaaguugcaggugccuugggaaaucucacagaagggccagcaaaacggggagggaugggcucuuuggaggccagacacugggcucucugggcuugacugcuggaagagaccauggaccaggcgaggacccuaucuauucccuuugguccagguugaaagcucccuucaacacuaguugucucucagaugaccuggcugugcugauuugggcucugugguacaccaaagguuaaguuucuuccucuuugucuggaaaauucccuggggguuaagagacaccuaccuugguggaggaaggggcugaagaugguagugguggcccgagggaaacagggaguggaaccuggaggagcucugacucagaaugggucugggagccuggaaaagcuucauaaagauggcagugagaggcagagaccagcagcagucuacagccaugucagcagucaugguggccuuuuccucaggcauaucaagcccaacacccggguucuuuuuaccuggggagaggaagguggaggcagaggacugcaauuuccgggggcuccaguccccggccucagagccugcagagaugcugcugggccuuggggcagcggugcuugggggcacaacgggggcaggagggugcccugggauaacaaggaaggaaaggaggguugugacucagagcucucuaucucuaagugaaggggugggggggggggaguucccauaugguucccugucucaggaaacucuguacccgucaccccucuuggguucccaucccuagggucccuggggcuaugcucgcucacaggcugugaugaugucccucgcacgcagcagcugcaggugcgugaggaugugaacgaggucagcuacgcgcgcguugcgguugauccagggccacagaacacuggcugugcgcugcucggagcgcucgcacagccgcagcucugucuggucgcgcacgaucaaggccgcugcgggauggggaacaucaggcuucagcuccagaagccugaguccaccaccccacgccggccugccgucacccaccgaacuggcaccagucggcgggcuccagggcguccaucacuuuguagaagcggcacauaacccaggguggcaccucguacaagaagugcugggcgccuggaaccacaggcuccccggggcccggccccccggccauggccgccgccgccgcccccgggccgaggccucucggggccucggcgggcgcgggccuuagcgggccggguccgcggacacugacucacuuccccuucaggccggccucgugcgacacccggccgggcggaagaggcggcgcucgacccgccgccaucuugcccuccgcggccuuccg

SEQ ID NO: 9560 - RNA, 10010 nt, Mus musculus
cggaaggccgcggagggcaagauggcggcgggucgagcgccgccucuuccgcccggccgggugucgcacgaggccggccugaaggggaagugagucaguguccgcggacccggcccgcuaaggcccgcgcccgccgaggccccgagaggccucggcccgggggcggcggcggcggccauggccggggggccgggccccggggagccugugguuccaggcgcccagcacuucuuguacgaggugccacccuggguuaugugccgcuucuacaaagugauggacgcccuggagcccgccgacuggugccaguucggugggugacggcaggccggcguggggugguggacucaggcuucuggagcugaagccugauguuccccaucccgcagcggccuugaucgugcgcgaccagacagagcugcggcugugcgagcgcuccgagcagcgcacagccaguguucuguggcccuggaucaaccgcaacgcgcgcguagcugaccucguucacauccucacgcaccugcagcugcugcgugcgagggacaucaucacagccugugagcgagcauagccccagggacccuagggaugggaacccaagaggggugacggguacagaguuuccugagacagggaaccauaugggaacucccccccccccaccccuucacuuagagauagagagcucugagucacaacccuccuuuccuuccuuguuaucccagggcacccuccugcccccguugugcccccaagcaccgcugccccaaggcccagcagcaucucugcaggcucugaggccggggacuggagcccccggaaauugcaguccucugccuccaccuuccucuccccagguaaaaagaacccggguguugggcuugauaugccugaggaaaaggccaccaugacugcugacauggcuguagacugcugcuggucucugccucucacugccaucuuuaugaagcuuuuccaggcucccagacccauucugagucagagcuccuccagguuccacucccuguuucccucgggccaccacuaccaucuucagccccuuccuccaccaagguaggugucucuuaacccccagggaauuuuccagacaaagaggaagaaacuuaaccuuugguguaccacagagcccaaaucagcacagccaggucaucugagagacaacuaguguugaagggagcuuucaaccuggaccaaagggaauagauaggguccucgccugguccauggucucuuccagcagucaagcccagagagcccagugucuggccuccaaagagcccaucccuccccguuuugcuggcccuucugugagauuucccaaggcaccugcaacuucucugaagaacucaggauuggagagggugguuuuggauguguguaccgagcagucaugagaaauacuacauaugcugugaagagacugaaggagguagguguaacauugggguagacaccuggaagacaaucuaucaguccuuauuugucuaguuccucccuccaucagccccucacuucugcagucuccagccuccccaagcaauuccuucaaggaccccaagccuuccauagauuugggccuggaaacaacuggcaagcuuggcucaugucaccuacuuucccuaccucuuaccccaccaugccuggggcuacaggaagcugaccuagaguggacuauggugaaacagagcuucuuaacagagguggaacagcuaucaaggugagccuugggggucccuccugucuaggggcacaaggugagccacaccacggccucaucagucuuuaggacugcacaacacaagaucuggcucccuugggcccucaaggccuggccuggcaugggugagggaacaucaagugcugccuaccuagccuggccugaugaaaaguaguagaacccagaaaauuaaagaacucagacuccacucuuuauaacagguuucgucacccaaauaucguagacuuugcuggcuacugugcagagaguggcuuauacugccuuguuuauggcuucuugcccaauggcuccuuggaggaucagcuccaccuucagguaguccuugcugaucuggcaccuuuauuggcauagccccuuagccugugucaggcaggacuugggcuucuggcucccccucaaacucaagauuuggcccaggguuuucuuucuuccuuuuuacuggcuugauuguuugagacaauaccucacuacccagcucaggcuagccucaagcuggcaauucuucugcgucagccugcucuaugcuagaguuacauuacacucagcuuggcccaagauuuuccauacaauucuuuccucuguccucuccccacuguuccucuauugggaguuauuggcuuugcaagcagaguagcuaaaggauuuaguauuuaguccacauauagcucuugaggaaugaggaccaguggagacaggcugucagacugaacccaagcuugagccaugccugaaugucauacucacaagccaccacauauacaggauaagagcuuccuucucaaacuguuuugagagaggagagggagaagggcaccagcacuuucuguuagguagagcugagcccaucacauuuugucuugaguccugugaaauguuccuagcugguaucccagcuguagagugcuugccaaaaccuucgguauagcuuuagcuaccacuugcucgugaauuaggucauagacagucuuacuccucauucuccagaggcucagaauaaagcuugccccaagccgcacagugacaggugaggggaauuuggggggggggggucaaagaacagcugcccugagcugccucugugcuucugucuuugucacuccagacccaggccugcuccccacuuuccuggccucaacgacuggacauucuucugggcacagcccgggcuauucaguuuuuacaucaggauagccccagccuuauccauggagacaucaagaggugaggaggggcucagaagagcuauagaaagucauauggccagggagacagugacccucugcucaaugaacagcucuguucugagugucccugugauauucuuccugcccaguccugugaauaugggaacagguguugccugggaccucagagcugagaguacuuagggcuaugaguaccccugcauggugcaaguauacaaauaaagccacgguggugagcagaagccaaacaaugugaaggggcucagggacugcgggcccucagacagcugggaugcaaugcagccacuuuccauaagcaguacgccucuaguccaguuuaucaggaccauuuggguguaggggacagaaaaacagaaagguaguaggaccugaacuggugccauucuuccguuuguuuccaaguucuaacgugcuucuggaugagagacugaugcccaagcugggagacuuuggccuggcucguuucagccgcuuugcgggggccaaagcaagccagagcaguacuguggcccggacuuccacaguucgagguacccucgccuacuugccugaggaguacaucaagacaggccgacuggcuguggacaccgauaccuucagcuuugggguggugagccaccagcccuucuguuggcuuggggagggaaaagcaccaguaaguaaagucaggaaagccuagagaauucuaggccuaaggcagaggugagccuaguggggagcuagcauagcuuuggccuuagggaucacccugccucauacaccucccucuucccuugcacuaaauuguggucauaauuugcauccuuuugcuuaagcuugcaucccauaacaaugcugcccuugcugggagguggucuguaccugccuguuccgggacuacuuucccacuaguccugauccaugcccaugcuacaagccucuucuacacacaauuucucccugcuaaagugauguugucuauccccccucuagguaauacuggagacccuugcuggucagagggcugugaggacacaaggugcaaagaccaaguauuuggugagccuccuaagguggagcauggagggagggaggggcagcugcagccaguggguacagccccagagggugggaugguacagauccuuuacauugccccacaauagccugcuacugcugcugcugacucaucuuuaaaagugggugagucccaagcaguuucuuuuaccuugcacggaagaaccuaucuuuaguuuguaccuagaccuugaggauagggauguaaucucagugguagaaccuuauugcaugcaaggcccuggguccuauccccaucaaaggggaaaaagaacuuugacagguucccccucugccuuggacuggggauagagagggggcuauuccagauaccccggggaccaaaccuucaguggaacuuagagcagggcugaguaaaggcaguaggaaguaggcaggcuguuaaaguagcagcuccaagccauccugaccccuacauuccugucuaccuugcuguacacugagauagggcuaaggaauaagagaccuaaagcuuagcaucugaguacaugguuuugguuccaacauucaaaaaucugaggcaggaggauugccaggaguuggaggccagcuggggcuauauaacaagaccuucuaucaaaaacaacaacaacaaaauuaguugauuaugguggcauguacacuuaggagguagaagcaggggggucagaaauuuaaaguuauccucaguaauauaguaaguucaagaccagaguaaguuacaugguucacugucucaaacauacaaagaagcugggcagugccagcacaugucuuuaaucccagcacuugggaggcagaggcaggcggauuuccgaguuuuggccagccuggucuacagagugaguuccagggcagccagagcuacacagagaaacccugucuuuuuuguuuuuuguuuuuuguuuuuuuuaaaaacaaaaaacaaaaaaagacaagagaccuggguuuuagucccaucaacacaguggucaugggucaaauucuugcucuucauugagcuucaguuucccauauagaaaacagacuuuaacacaggaacacuauuccagcaauuccuaggcccagaacaugcuuggcuaaugcugggucgucaccuuuuacagaguuacaucucccauugcuucuccaggaugaagccuauuuuuguccacuguugggcccagugggggauuuaaccaacccaacaaacugaaccagauucuacccaucccuccuuccuuuacugcguccauuagcacaucccagcucaaguacugguuguucagaccccacggaccuugcuaacagacuaguagguuuguuggcaucuguuucccccacugcaaugggaugucaggacuguaaaacacggcccagaguguuugauuuguggcuguuaucaguagagccccagacagcacuaggcacacagugguguuuaaugaaccuagggaaagaagaccagaggacugaguggcaguggccuggaaguuuugguggaaccaugcugaacugacaguauuuguuuuacagaaagaccugauugaagaugaggcugaagaggcuggagugacccugaaaagcacccagccuacucuguggguggguguagccacggaugcuugggcugcuccaauugcugcccagaucuauaagaagcaccuggacuccagaccugggcccugcccaccccaguugggccuggcccuggcucaacuagcuugcugcugcaugcaccgucgggccaagaagaggccccccaugacccagguagcccuggggaggccaguuaaccauggggacauaguggccagcaagaaaacuuucguacuugcccugcuugauagcaauagcuacaaaguaccuaccugaucucuuacagaggcaaaacucccaacauuccuugcuugcccuuuggcucuauuuggggaggugcucuguggaacuaagugguaaagggcugcugcuuugcuggaugagccucagaucccaggaacagguagaaggaaagggcucugaucaugccccuaagugggggugcugugccacucacuaccuuugucuuuuugucuuaccuuccaccucuucuggugaugguuaagaauagaguuccuggcuuugguggccaugaaucucaauaguucuugggaugagacaaaggaacaaagggcaauguuuucucagcugcagagugcaccagcuuuguguuaucugucauucuguuggcuguauggggccugugguauuaaccugaacauaggcaagucuaggccaaccugaagcagcagaguagcugugugguuugaccacagggugucagaucuaggcugccuugcccagccaggaacccaugcucugcccauccugagagccucucucuccacacagguauacaagagacuagaagggcuucaggcagggccucccugggagcuagagguugccggccauggcuccccuuccccacaggagaacuccuacaugucuaccacuggcagugcccagaguggggaugaaccauggcagccucuaguagugaccacaagagccccagcccaggcugcccagcaacuccagagaagucccaaccagccaguggaaagugaugagaguguucccggccucucugcuacccugcauuccuggcacuugacuccagguucccacccaagcccagcguccuucagagaggcuagcuguacccagggaggcacuaccagagaaucaagugugaggaguagcccaggcuuccagccuacaaccauggaagguaacucggaauaggaucucccuucuuaacccuucuccccaccccaugccuaaaaucaaaaguguagaauucuagguucugucuaggcagccugggagccuggucugugaucugaucucucccaaccugggccccagaauauacuggagaauucugcccugcagccagcaucacuagcaggggggagcugggaagacucuggaggcuagagugucacucaagauugcagggacaagccgggcgugguggcgcauaccuuuaaucucagcacuugggaggcagaggcagguggauuucugaguuugaggccagccuggucuacauacagagugaguuccaggacagccagggcuacacagagaaacccugucucgaaaaaaccaaaaaaaaaaaaaaagcagggacagcuaagaaguuacuaucucugcucaggcucacccacgggcagcucaucccugcugucaucagaaccaccacagaucaucaucaacccagcccgacagaagaugguacaaaagcuggcucuuuaugaagaaggggucuuggauagccugcaacugcugucaucaggcuuuuucccagguaccuguggauaacucuagcucagcuuccccagaagagccucccaccgcugucauacacacauacaaacaugcauacaaagucauacucugcagcuccagggcauacaggcauaauuccuuaugucaacccuaaacagcagaacauuuguucuggcugcacaauuaaggcuccacuuaccaagaauauaggacccagcuuuugcucaacaucuguagggagaugccuggcucaaucccuuacuucccaccaguagcacucccacaugcuccuagaaaaugugaaguuccagcaggaauuuucuacuccagguacuauaugaaaagcugcuguuuagccaagcauguucugggccuaggaauugcugggauaccuuagcuggggauaagaguguaccuguaaagaucauccaaacuagcaggccggagagauugcccagugaauaaggcaaugggcugcuuuugcagauuuacuuggcuuuaguuuccagacuccacauuugguaguucacagcuacuuguaacuccagucccaggggaucugaaucccucuucuggccuccgcagauaccuuuguauauacauguauauacuuuguauauacaugguguauuuaaaacucacguagaaacacacauauaaaaggaaaaaucuuauuuucaaaaagcaaacuaaagguauaaagaaaaccuuggcuccaaagacugcccugagcugggcagugguaacgcaugccuuuaaucccagcacuugggaggcagaaacaggcaaguuuggggccagcuuggucuacagagcaaguuccaggauagccagggcaacagacaaaaaaacccugugagaaaaagguggggugggguagggaauuagcucaguuguagagcauuugcuuagcaagcgaagugcccugaguuccagucuccuucccacaugcucaguuuggagugggagggggcccacaaaguucugugcucaugguucaugucaggguauuugaaagacaagaaguuguccccaacuuauuaagugauauuuucuuuuccauaggcuuggauuuagaaccugaaaagagccagggaccugaagaaagugaugaauuccagagcugauuuguucacucugacaaaucccucagacucagaggucaaaguucucaugcuuggaaguucucauagugugcaaacuccucaguagcccaaaggcaucaggugugggggcucacucuggcaaaggagagagggcaguggacccugcuguucucagaaugugaacacagacagggccagccaaagaacuugauagaagcugauaaggcaggcaaugugaggccagcauuugugagcaaggcaagcagaguaccuaaggaauuggguaguacaaaacagaagacuggggcuggugagauggcucaguggguaugagcacccgauugcucuuccaaagguccggaguucaaaucccagcaaccacaugguggcucacaaccaucuguaacaagaucugacgcccucuucuggagugucugaagacagcuacaguguacuuauauauaauaaauaaaucuuuaaaaaaaaaaaacagaagacugcuagcuacacaggcccagaggacacaaguaggucuguuuguauggugggagcuagcuccccugagagcuagauaauauaucugcagucugugagucuauuccucagaacuucccuaaaacaccaagcgaaaguagcuguugugcuuguaaauugcaaaaaaaaaaaaaaaaaaaaaaaaaagagugucuuacaguucaguccacuagcuagaagugagcacucugagauucucccaagagucuaauaaaaccccccuccccaucuuggguggauauaugcaagccuugccagauagcagugagcuaguuucauaugacuaccugccugccuaggcaggcucucucuauacccugcaaauugacuguggaugcccaagguucugcuuauggcagaaagguccagcaaagcccagcuuugugguacccagacagugagaagccccaagaaagaagaaacugagagcaaagcuaaguauuugagggggaagaauguuacauuuaaaaaaaaaacaacaaguuuuuguauaauuaagugucuucacaaguagcccagggcuauagcccaggcuuacagugauucuguguuugagucaugagucacacuacaugccccuguguaauuggugacauccaauuuguccuugaguaauaaaagcauacauuucacugucugguuaaacuuguggaauuuguugugcuaaaaguguuaugcuuuccuaaugcuuuauaucucugggcucuuaaguguccacccaaaacucaggccccuagcauuuguucuuuucucuugucaggccagacuggggauagauccccuugcuuucuugucuugcagauuucguggauauugaugcuauuggaauugaagccuucaugucugaauuauucaucaaucauauauagaaauuucauuaaguuuugauccugaucuuuauucuguggccuuacuucuuagccccacuuguuuugggggugauuacucugagauaguuuguauacaaucaaccuaucugaaaauaaagauaauuuuacuccauugccaaccuau

SEQ ID NO: 9561 - RNA, 1551 nt, Mus musculus
ggauauugaacucgaguuggaagaggcgagucuggucucaaaauggagguaaaaccgccgccuggucgcccccagccugacugcagccgucgccgccggggcggggggggggcaugauccaaaggaaccagagcagcugaggaauauguuuauugguggucugagcuuugaaaccacagaugauagcuuaagagaacauuuugagaaaugggcacacuuacagacugugugguaaugagagauucccaaacaaaacguuccagaggcuuugguuuugugacguacucuuguguugaagagguggaugcugcaaugugugcucggccacacaagguugauggacgugugguggaaccaaagagagcuguuucuagagaggauucuguaaagccuggugcccauuuaacggugaagaaaauuuuuguuggugguauuaaagaggauacggaagaauauaaccugagagacugcuuugaaaaguguggcaagacugaaaccagagguuauggaagacaggcagagugggaaaaagagaggauuugcuuuuguaacuuuugaugaucaugacacagcugauaaaauuguuguucagaaauaccacacuaucaauggacauaauugugaagugaaaaaggcccuuucuaaacaagagaugcagucugcuggaucccagagaggccauggagguggagcuggcagcuuuaugggucauggaggaagcuuuggaggugguggaggaaacuuuggucguggaggaaacuuugguggaagagaugguggagguggugacagcagagguaguuguggagguggugaugguggauauaauggauuuggaggugaugguggcaacuaugguggugguccugguuacaguaguagaggagguuuggaggugguggaccaggauauggaaaccagggugguggauauggugguggaggaggaggcuaugaugguuacaaugaaggaggaaauuuugguggagguaacuaugguggugguggaaacuauaaugacuuuggaaauuauuguggacagcaacaaucaaauuauggacccaugaaggggggcaguuuugguggaagaagcucaggcagucccuauggugguggcuauggaucuggagguggaagugguggauaugguagcagaagguuuuaaaauaaaacagaaacagcuacaguucuuagcaggagagagagcgaggaguugucaggaaagcugcagguuacuuugagacagucgucccaaaagcauuagaggaacuguaaaaaucugccacagaaggaaugaugauccauagucagaaaaguuacugcagcuuaaacaggaaacccuucuuguucaggacugucauagccacaguuugcaaaaagugcagcuauugauuaaugcaauguagugucaauuagauguacauuccugaggucuuuuaucuguuguagcuuuuucuuuuucuuuuucuuuucauuacaucagguauauugcccuguaaauugugguagugguaccaggaauaaaaaauuaaggaauuuaaaaaaaaaaaag

SEQ ID NO: 9562 - RNA, 258 nt, Mus musculus
ggucacagccuccacgacuucuuucuuguucaccuuagauccuggccugucaacuucccggacgaugugggucaugccagccuuguaacccagaaggcugugaggugaacgggcuuggaagcgucauccuuagggaagcucuucacuuucccacgaugccggcugcugcgcuugcgaggcaggaagcccaaggacccaugccugggagcugagaauuuccugugagacaucucgccgccacacgccgcagacagagca

SEQ ID NO: 9563 - RNA, 26362 nt, Mus musculus
auucacaggacaacggaagcaaaauuuuauuccucuuggcugggaaagagaacuagaaggugguuguacauaggacuuccaccucccagaaccaaagaagacaugcucugccaccaaauggcucccucugcccaagugaaagcccagagacaggugaacacagugcagggcaagggcgaaugcagugaagagcggccagagugauccagggaagggaggguccagggcucaggaaaggaaaauggggcuucuugggaauaggacagguguggggaugcucauugccaugggagcuucuagcuggcacaggugccaacuuagguggcaggcucaggguaccauaaugcgguaugggcugccugggauaugcucaucaccccacuugaccaccaguguguacuccccuuuguccuugagcagguaagagacacuauagaggcggcugcccauguguuucaccaggaucucuucacaggguguccuugggccaugcacgcccaccagcagcauguuguuaccuaaggcaggaauaggucucaguggccuuagauccuuucuuugucuauaauugcucugagcccuucucacuauuccacauucuguuccuugccugauuauuaacauucccaagcaagcaucucauaccccagccuugccacccagaccaccagaggauaaauuacagcuccuccaggacauugguguuuugccugcauguauaucuguguaagaaaauagaggaggaaggagaagccaccaugagcuggagucaagggcccugagagcugcccaauuggaguuaagagcaacccaaaugaaacauaguaaguaauaacuugggguuauccauaggaaaauaaauucuaacaacauagagaguaguaucugccaagcucuuguauuguuuaaggcuuacuguaaauauaaagaucauguguguuuuuaaucugagaacuaaucuaaggugggguagaaacccuggguaaaacaguagggauuaaauaauuucuacaacagaucccaugaaacuggaauuacagacaguugugagcugccaugugggugcugugacuugaaccccaguccucugaaaacugcugagccaccuuuucagcagccccacuccaggacauuuucuugaaggguagaaaggaaaguacgaaggcccaaauagaagguagcucuaaaagcaauaaucauaccccuaaaggcaguuccuguacuuccuacaugcugaccauccuguuauuuauggcuuugcacuuccagaagcuaaaaauagggcuacucaccugcuuugcugcaaucuacugugaaguugcucuucuggccuacauaagccuugcuuagccccaggccuuuggcuacuaccuugcugacaucagcaggaccugggccugagguugcaugcuggggaaccguggcaacuuuagucaaagaguccacaaacacagaugaugucucauggaggcugugguugcuuacaagacgaggaccuacaaaacagaaugggugagacuaagaagcugcucaaguaucaaggcauuggguggccaccaacagcuuagccuaaggcucaccugugaccuuggcuuuaaagggacuuccaccaaugugauaggggccaccauacuugauggagaugagguagcugccaggugccauggggguauaggugacacgauagcccucggggcacuccuggcaauccaucuucaccuuggaggggccaucaaugguaaccgaaagggcaccagcuccugcauugcuuguguucacaauaaacucugcugggcucccugggaaaauagaaggucaggcagaaucuaucucacuggcuuccuugcauucagcuacccagcacagccuugauacuuccacaugcuuccuggugcuggggcuauacaucuacacucagagcuguacccauaaaccuaccugugacaccaccuuccaggccugcuccauaggcggacacuaagccuggguccccuccaugcccaggcuccccaacucggaucuugaagggacuuccaggaaugugaguaccauugaacuugacaucaaucaaguagaugccauucucucgugggaugaaacgcacagcauacuuaucugaaaugcagguaagggauuugggguacuuuuuuguaugcaacuugaaaauacuaucugaaaggaacagaauugguuaacauccccuucacuucucuugccacuagcaggaauccagcugcucaauggagaucccucugcuuccagaauuauucuagguauucauccaauaacauacauccugagacuaaggcuaucaauaccuaagaagucuacuuguaagucuuuuggaauaacaagcaaaaugccugccuuacuguuuccuuagagaguguacuguagcaguguacaaagcagcaggcuuagagauggggaggaaucugcuucaggucauggacuugggggaaagggaaacuagugaaacuagugugcuucaauagaauugccauuucucuagccccagggauugacuaucucucugucucuguuuuuaugucuuucucauguaugacacugguguaagguguucuuccuaguggccaugauggaaagccauuaucuuccugggugcuugucaaucugggaaggguuuuuuagcugaggagcccacuuuugaaucacuacauuagccuacuucuagucagcuaggucaaaugguuggaugaauaggcagggauagagccucaccuuggucaaucucugugacauagcacuccuccagagcuccugaggggcugugcaccuuggcaucaauugcccccuuggcuccauucagacugacugcaaaagaugcuggcugguugaccuuuaacccugacuccuggaagcauagcagaugugguuagacaggauguauagaaccagggcaaaugggagagcagaagaccgacagagucacuuacccaucugguguccaacaugguuuaaagagggagagccauugaucugugagggcagcaagccacaggcauacccccaaccuccuaucuccuaaacauguucuccacaaucacacacccagguagcagaaaggcaagguggcccacccuguagguagcacucagcucuaacaggcugucccucuuuaaaccucagcccuggugcucaaugggcacaggguucuguucaaagccuuuagaccugagacacgagaaaaacuccacgcggugggcaggguacuuccugccaaccucaagcgugggcuguacccggccagagcagaagccuaccauccagaauuauuucugcguaggcacucagcccagggccaagaccugcuugcuauggugacucuggucuggccgggcccaggagccccagaugggcaguuucucucagugccucaccugaagacuagaaacaguaaggcggcgggcgucaccagacggagaagccacaggcaccacgaaggggcuaucagguaugugcuccucguugaacuugacugagaccucauagucaccuggaaaggaagagaacauaaggcuauaccuggaggugccacauauccccaaaggcuagccuaggaaaggccucuugccucccucccacaguccccuugguugucccuggaaccuuacgauggagaauaagaaccaaguggagacuauguaacaccuggguucaacauacccacacucagguccuaccucccccuaccccagccauuucuguuuccaauaccuggcuccugaacuacguaggccacaccacaggagccauccuuucgguccucgaaagagaucucagccuugcuggggccuucaacagcaauggccaggccuccagcgccagcuucccuaguccaaaugccgaacuccgcugugggaaagcagugugugcucauggagcagaggacugguucccagccucagccaagucuaagcaaagccaagaucaacaugccugcuggcuacuuccuacaaacacccaccuaggcccaccuaggauagcaagaauuagacaaguacaccuaccuggcacuccaacuucagcccucucuaggccagggccuccagcacggaccuugugagcacccccuucccccagaggccccacagugaacuggaaggggcucccagguacaugcuggcccuuguacuugacacugacuguaugcauucccaucucagcaggcacaaaucggauacaguaaguaugguucucuccuucuacgaucucugccucaugggucuugccugaugggcuggucaccugggcugucauaucuuggaugcuaauuucuacaaauagaagauagcuuggugagcagggagggcccugucucucuacuuaugcuuaggguugccccagaaacccuccugaucuuuucccuaccaggaaucuucaggcugaggucacaaugacugccaauauuggccacagaaggggcacgucgccugcgugugauacucucuuucacccggcccucaccugucaccuucacagaaaagggacugccuguaggaaaaaaguacaauccauacuaugcacaaguuacaggugggcacugaggugugugacuagcaaugcugccaaaccacagguaagggguauggcugccacacucaccaggcacaugcuggucagcaaauuugauguuuauaauguaguuuccaggcucugugggacaguaggugacccugcaugugccauccuccagauccucuguguugaugucuacuuugcuagggcccucaauggacagacuaagcccaccguagccugggaaauagauagcagcuauaagccagaaugccaaggaaagcuagcuguauugccccaacuagcagaccacacugccuaccugcaucucuggugucaauaauaaacucugcaggcucaaagguaugaccuucaugaagaccuugaccagagacccucacacggcuggcaucaccuaucuccgacuggcugaucacuacugggaugggacugcuugccacaugcuggccauucuucuucacauguaccaggugcuccccugucuccuugggcacgaaggaaaucccuaggcacaggauagggcuaucaacaagaugugggcccacaaucuucuuccuugcucccuuugucugaacacaggguauuuauuacaggcuaaaaugacuuuaacucauuauguagccaaugauugguuccccugauucuucuacuuacaccucccaaguauuaggacuaugggcagucaccacaccuggcuuucccucuuucacagaaacuuuugcucccucuugaccucuuacccacguggccauuucgcaaacguuucagcagacaggguuccucucgacccgaagguggcaccacaguggcugugaguaggcuaaggucuguuucugagauauugauggggauaucagcagcagaacccaccuuuaggugggacauacgcauggaaucgucaccugguaagggugcaagccaucagccacuauagauccagcccaaagagacugugaccucaugccaccuguuccugucauuacucccgaugcuccguaccuguuacucuggcaguaaagggacugccugggauguguugaucauuguacuuaacuaggaugcuauagucaccaggcaguacaggcagguaagagacacugcauguuccauccugguugucagugcaacugauuucugcuuuagauggacccucaauggccagagacaagcccccugaaaaauaucacagauaagagugagaacugugcccagagacacauugcugaaccuuugugggugaguugacuugauggcucagcaugaagguaagguagaaaacaccauucaggaucaucucccacauacaguucucagccaauggaggacaacuugggcaggucaaaccuagagcgucuccuuacccucuccugcauccuugguguugacagugaagguggcagguuuguugaccacuccauggguaaggccaggaccauaagcagugauguggccacaguugacauaaucaacauagaacugcagagggcuuccugagaccagaauagaagccacauggaauaccagacucauucauuuguuagucauuuugguucuguuuuugaaacagggucuuuauguuucucuggcuggcuuugaacuuacuaugaagcuaaggaugaccuugaaccacugauccuccugccucgagggcuaugauuacaggcaugugccaugauaccuaguuuauucagagccugaugcaugcuaggcucuacuaacugaccuauaacccagcccuagccuguucuuccugagaugauagcaacacgggccuaggauggaguggacaagaggcaauacacccaccugggauaugcauauugucauagcgaauguccauuucaugcaggccagcuucacugggugaguaacguacaguaacagugccaucuuuguuaucaguaauggaaggcugggccaccuugccugagggcauucgaacuuccccuacagagcagugguuucaaugucaggccaggagauuggaacacccuggccaucacuaguuuccaaguuucuuccuagcccucacucaccagugaucucccccuucuugauagugaaggggaugacaagaucaaagggccucaggcuggucacauccagcccauuaacgcccaccaugggccucucuggaaucugcaauagagacagaagaaucaggugaggggcuaugagaagauaugggguuucucagggccacaugagacauccagguggccagcuucaagugucccuauggguuagacaaauugaauaauagaccaggcccaggccuuacccagguuugcuggcuacccugaggauaguuauacuguggagccagcugcugagaccuuaauggggucugcacuguugguugguccccagccaaagccuguggggcaaagugagaggguuggagacuguugucacaaagggaccuggaaggacaggcuaggacuuucccagaucucccugcccacccauccuuggccucuucucacuguaacuuggaaggggcuguugggcacaugcucgccaccgaagcgcacacagaugacauauuugcccgguuggggagcuguguagaagaugucaaaggugccauccucauucuccaccacguccacgucuaccucugagccaucaggugugcacacaguacaagucacuuugccuuugccugcugcuuuuguguccacaguaaucaccgucuccuccccaaucuggaugguggggccaaugccagcaccugguaaagcagagugaauccccagaggggagccagcaggugagccgaacauuuuggcuacccccaucagcuugcuacccauccaggccucuuacugcuacaaccaagcacagccagccccaaucucuagcccaacccauaccccaagcuacgauggugagugguuucucagaaggcaggaaggauucuccugaccaccucaagccccuuuaugagagaagaccaacaagugguacccagauaccugggaagacaaguaagggaccauccaaucccagcacaagcauuuacugcuaccuccucugccaacucagccucagcugguaucauggccuaugcuaacuuauaccggcacucuggccaggcccauggcuaccuacacccguggucuggcccugggccccagugcuauguguggaugaagugaggcagaguccugcugcagugugggggaugugaaacuuuccucccuacccaaccccgaggccugaaggugaaacuggagucuccugacaacugagaacgcuugcucaaccagaggcuugcaaugagaggcagcauagcacagccuggcacaggcaagagcaagcagcagggaaguagaaggguuagcagugcaucacagcaggcuuggcaaagcaguggcagcacccaaggaacaggagacaggagucccaagccaccacugcaggguugcaaggguagagcaucugagcagccucuagggccccauagugcccaagaaaagagaaaggacaguaauguuaugaucuggggcucagcuguggaggcuugggagcuguggauuguaaggccuggcagccagagcaccccugcagcccagccucccacaaggaaagcagcuaggaacaccaaacuuauaugaggaccaaguuuaaggggcccccuugccagccugccaccaagcccccuuuucgaccuuggucucacacuggcuacaugagacucagauagcaacuucagcuauuacccuaguugccugcugcccaugcugccaugaacuuccuuuaugccugcccuguaucaucuagcuaaugauuugggccuucugaaagcuucuugauuucucauuucuguacccaagcuccaggugaucagcaagucuugaccauagcauccucaaaguacaccugcuaauugggcuacugcuuaaugucccaauagccacugaccgggcccaagacaaccuucuggcuuacccaaagaugauuuaaguucccuggcugggcgcccugacuccauuccacacauaauggccaagaaaauugaggccacuccaaguuccuggccuaauucuguccuccccuguguacacauauaugccaucuucaaccccauaaacuauucuacaaaauaaucuagccuuugccacaaaaaccuagcuaucuuaaauccuguccuuggccaucuacccaaaugccugucugauagccuucagaagucugcaaguaguuguagucucauaucaguauuccuaggaugucuuugucuuagggcagacaaaccugccugauagggacugucuaacaucauugcugggggaaugggaagaaagaaggaaaaaagauuggucgcagaaugcacuuuggagcucugaggcugggccaggcccugccaugcuggccacccaagcaguugacacuggcacuacuguaccaccacccagccccacccacucaugcaccucccccagcccaggacacagaggccccugggaggcggggauggaagucuguggaucugacaagggcuagacucccaguggguggaggaaaccaccuuguccccugagcccaugcaggagcccauacaggagcccuugugagaaggaagcaccugcugcccauccccaggugcuucccuggggugccaagauccccagaccccaaaauccccauugaggugccuccuaggauauacuucaccccaaagcucucagcugcaacccaaguucucagauggggaaauggaggcccagagaggggagaaccagagcgcucaugcuuagcuccagaaaccucccugggcccugacccuccagcccacggccuugucuucacagccuccccaacucuguccuugccuagagcugcagcuggaacuguccugggaaugaauuagcaaugaagaggaaaggaaacugccucucugggcaguaggggcauugggaguggccccagcaagcagcuuaccuagcccgugaccuccgauugacacugaggugagagggcagagagcaaggagaaaggucaggugagucacucaagggggcggcccccacucccacacgccgccccaagcagcgagcccuugcacacaggcacacccaagccccgugccaagcaacaccauggccgacggugggcuggcucaccugugacugugcacuugcuggcauccccagugggcacagcccggacacgguacggggaaaagggaaucucaucaccaccauacuugaugaggauuguguaccggccuggcacaucuggcacauaagccaccguguaugugccaucaugauuaucuugaaugugugucuucuugggcuugccuucaggauccuguguggcaaagcaaaggugaggagguugguccaagcccagcaagaccugaacuaucucaggccauaaaaacaccaaguacugguauaacagggaaauagcuucugggacccucaaccccccauggccccaguggcugccugucugguagagaccagaccggaagcuccccaaacaucuagcauucccugacaugacaagagaucagagagcaguuuggugcccaggcucaguccuaggccuauccuaguggcacuaggagcuuacaugaaagaucucaguguugcaacauuauaccuguccugugagaauacugcauguggagaaucugaagcacuacagguuuugguaccaugcuuaauagcaaugacuguguguuuggggaagcuuguuucuuucaacuugaagaaaacugcuauacauccuaauguuacauaagcagaggcccucuccuuagaguacagcuccaagcagacuaguuagcaaaacugagcugccugccuaucuguagcccuacauuccagcugcucagagcugguuccuugccucuccucccuacagaccaggaagucaggaagcucaccguaaucuggacagccaacagacccuccccagcauccuuggcaucaauggugaacuccacaggcaggcuagcagguacaccagugguguugaguccagguccacuggccuucaccuuacuggcaucauguguaggcagcaccuugaccuugaaggggcugugagauuaggguguuauaaaccaucagacaagcuuaaguaccuagccugcccccaacaagcaagugaacucugcuucuuaccuccguggcacuucuucuucaccauacagcacagaaaugcuauaggacccuucucggcugggcacauaguugacagucugaguaccaucagcauuguccacuacauccacuggcuccaccaggccuagccccaguccgaagaacagaaccuuagguuggcucuuuguacccacucccaacucccucucccugaaggacuaaggcuagacccaaagacuagaccuuauguuuuuaacuacccaauuccaggaauuccuuaggcccucccucuugccauaucuauucagugaccaagucccauccauuauaccuucucuaggguucugccugguuuugugguuaucugaaacccuucuacuaucugugcuaguccauaugauacuaggccuaaaaaaaaccuauguuuucauaacucccuguuaccaguaugugaagucuuaccuuugggccccugcacuuugaccugcaguggggcaacuccagcuuugcuuguguccaccugaaaggacugagggagguuggcacggaccaugccugggcuuaggccagguccagaacacuugacuuuagaugcaucugucacaucauguacagggaccuugaagggacuaccugggggucgauacagaaggauaauagcuauguaagacacugugaauauagcagagaguccuaguucuauccuugucaucaucuccucaccuggcacuuggugaccaccauaagugacauuaaggcuauagguuccagcuucauaggggauguauucuacugagcagcugccaucuuuauuauccauacaagacaucuuggccucugagggacccucaacagccaagcccaggccaccugugccagcuccccugguacaaacagacagucugucauuacuugggguucccaagcuuacucacugcuugcccaugcaucuucagugucucacucaccugguuucuacugugaacuuguuggguuuguuggugguaccacuuuggaugccugguccauggacacgcacccgggaggggucacagcccucuguuacaggcaccuggaaggggcugcugggcacagggcugccaucauaagucacauccacagaguguacuccugaaggacagggcaggucaggaauaacuaggcugcuccacuuacucccugcucugccuaagguauccccaguacauucauaccuuccucauauggaguguauuccacuuuguaugugccauccccacagucuugcacauagguaucugucagauugccugagggguuggccacucgagccuugacauguggcccuccagucuguguaagagcccgggcauccacacugaacucagugguugccucucggaagacaccuggaaaaggccauagugaggaggcuguggcuacaggacucuuugcacccuguaacugcuagccaaccccccuacagcgggccuccuuaccuugaccuucaaucccaggcccauagcacuguacaccugagguaucuacagcagguuccaccuguagcuugcuggggaaguugggcacaggcuggccgccauacuugaugguaacaguguaagccccaggacagagaggaauauagguaauggugugugugccaucaccauggucuugaauguauacuucagcuggcaguccugccucagagcagaucucaaucgucaacucagcacugccagcacuugaacaguccacuuggaacugcccuaccucaccagcaguagcccgcuccagcccagggccugagcacuucaccuuggaugcaucaaaacaaggagccacaugggccuugaauggggauccaggaaugugggugucagcaaaaaggauguugauguuguaguccccaggcucaguggguacauaagacacagagcauguaccauccccguugucuaggcacucaagcugugcuucacaggggccuuccacugucaggcccaggccaccagugccagcacccuuuguaucaauggugaagcgggcaggggagccugcauugccccccuguagcccugguccaaacgccuucaccugagggaaggaagaaaucagaagcaucuaucagcccaaccuuucaucugucuccuuuugcccuagguuucuuccuuacccagagacaugaaaggaauaggcugccuaauagaucaccugcucaaucauaccaggucuauagagugaguuccaagauacccagggcuggaaggaaggaaggaaggaaggaaggaaggaaggaaggaagggagggaggaagggagggagggagggagggagggagggagggagggagggagggagggagagagggagggaggaaagagagagagagagggagggaggaaggaagggagggagggagggagggagggaggaagggagggaggaaggaaggaaggaaggaucuucaccuuacagcuucaaaagaaaggaaggggaggggaggggaggggaggggaggggaggggaggggaggggaggggaggggagggaagggaagggaagggaagggaagggaagggaaggauggucuucuccuuauagacucccaaaccuaauuaccuugcuggguuuggugggggccacagcuucuaguggaaagggacugccagguacaggcacaccaucauaggucacuuccaccucauagggccccucuucacggggcacaaaacguaccacgcuguugucagcucccaggccuggcucuaccuugcaggguaccgcugcaccugagggacucacaaucuuggaugcuacuuugccuugaccaccugcacccuuugacuuuacugugaacucuugaucuuugccaacguccacuucuguugcaaugaugaaagcagagggaaaaaacaucauucaugcagcuccaggcaagacuaagcgggaugggguugacuggucuucaauggcaauggcaauuauagcaacuacuuacugucaccaaggccagacaccuugauuuugcugagauccaggcuuggagauacucccacugaaaauggacucuuggggaugugaucuccuccauaagugacauugacaccuacugggcccuuaaauggguacagaaggacagaggucacuaauuaguaaccccgguaucuuuggccuacagauguccagcuugaacaaguaugugauauuugcuccucagaccccuucucaggugagaaauuagaaaccccuugcaggagccuaccuagcauaccauauaaggaggauagagauagcuaccugcugcacaggaauguacuugacuguguagguauuaucaugguggucaaugauguccacaucccguacugcaucucccuuagccaguccugagaauuggacauccagcuugccuuucccagcaguuuuagcauugacugugaaauggguggguuugccaaguucaacaccugaggagauaaaacaacaaaauagaggcacccuacucugaguucccuauccuugguuccacucaaccuucuauaguacacucauccuuaccagugcgauuuaggccaggacccucagccuucaccuugcuggcaucaugagaaggcuccacuuugacucugauggggcugguggguguggccuguaagugaugggagaaaaacagcuaaggagagcagcauccuagcacuuggcagucuaggaacuaggagcaguaacaccuaccuggucagcaaaaaggaccaugaugguauagcugccagccccacaggguguguauuuuacagugaaggugucauugucauugcggaugauaucaaagucaauaucagccucaguggggcccacuacuccaggggcacacuugauaccaaugcugacaucuccugucauugagaagugggguaagaggaggcugggacuuuguggagacagccugcauaccugucaucccauucaaggauaggccuuacccuggccagcuucaguacaauccacaguaaaguagguagguucaugggccuugagcccagucuuggccacuccuggaccauacaccuugacuuuguuuggauggcugccagcucccacauucaccuguaggauauaggggaaagugaaaagacaggacaagccuguagcagaggagcuaagaggcucgcuucagccacuggugguagacagcaaauauugcugcugccuuggaacaacuggcaguuccucaaacagguaaaagugagcacaugauacuguaauucugcuucuagaaaacugagcaccuagguccacacaaacacccauauguuccuaccaacuauucauauagcccaaaaguaacaccucacauauccacaaaauagacauaguguuuuccauucacacaauuugauugaaaaauuauucagccauuaaaaagguaugaagcacugacaugcuacaauguugaaaaaccuucucaugacacucagugaaaaaaaacaagucauacaacgagcaugguagugcacaccuuuaaucccagcacucaggagacaaaagcagguagaucugugaguucaaggccagccuggucuacagagaguuuuccaggacaucuuggucuacauggugagauccuuucucaaaacaaacaaacaaacaaacaaacaagaaaaaccacaaacuaaaaaggucacaccguguaacacacacacacacacacacacacacacacacacacaucuauaugaaaggccccaaaaaggcaaauccauaaaucagugguugccagaggcuagaggaagggaaaugggaaggguaggaguuuccuuggagaugaugaaaauauccuagacuauagugauggcugccaacuacucugugaauguacuaaaagucaaguccacuauaaaugggaaaacuguauugauaugcaagcuuaaucuuguuaaaacuaauauaugaacaaaggagcucugggaugacuuacccggaaaggacuguuggggaugcugacaccuccccaagaaaccauggcugugugcuucacuggcuuucugggcacauaagaacagcuguaaguaccauugccauuguccuugacugucgcuuccacagagcagcccucauuguccuguaaggcaggcaaaagcaagcauucuguuagucagcacccaguccuaggagucuaucaguccuauccccaacaugaguaggcaucccaccugaacuugaacucgaagaggagccuucccagcaugcuuggcaucaacugugaacucugcuggcuuguugacagccacaccagucuucuccaauccaggcccacgugccuucaccuaguaagaaagaagaccaagguaaggccaccaaagucagacagggguaaguaacacauaguaaaagcauugucuaggaauaccagccagggucugagcucgugaccucagccuugcuggcaagaugagauaacgcccaccacuauaagccuucccaagcaaaagcagaaggccaggcucaggucaguuuugugugcacuuuacccugucugggugaaaauccuggggugccucacggaugucagccaugaaaggacugagacggauauccucacuguuacacagcacaugaacagcauacucgccagccuccuggggccaauagcgcacaucacaggagccaucacccuugucgucacauucaaucuuugccugugauggaccuuccacagagaaaccugacaacagccaucaguucuauuggugcucuggagucuugggauaggcugcccuugccacccucuaguccagguacccacucugaagccuccaacuuacccaaggugcccacaucaucaccaauggccucuacuacgaagucugcugacuugccaacaaugccuccuuccaggccaggaccccaugcccgaacuuucugauugccacacucagugccuaccuucaccucaaacggacugcaggcaagaguaccacacagguaaacaccaagagccacugcccuaugcccaacagccacuggccccucaccagauagaugguagggcucagaacaugaugaauaguggagggagcuuaccuucgaccaauguucuggccaccccaugugauggugacaguguaugugccagggauuguaggguaauauucaaagccauacacaccauccccuaaguccuucugcuuuacacgcuccucacccucugcaaaagcaaggaagaacuuaggccugcuuguccaaccaugaccugaggucuaucacccaccaccccaccagauaaacuuacugggacccuuuacagugaccuuuagcuccccacugccagcgcccuuuguguacaccuugaagucggcuguuuccuucacucgaacacccuugggcugaaggccucuaccaauagcccggcaggcagcuggguuacaggcugugggcaaauaagccagcugaguuguggggaacuggggcuggguauccccucccuugcuacccagaaaaccaggccauuaggauuggaagguuccucagaguuuaggaccacaagcuggugaagcacaugcaagaaaaaacuuaaaugggucuagaaccuguacccaaagcaaagacaugacaggcuuuuucccaccugcuugacacuaaccccaauaccccuacccaguccuccccaccaagagaaagguagauccaaguaccguugacccugcagguagagcagagagcagcagguuucuagacagcuggagcgagcucuuccgaagguaaaagcauggagaaaagagacgaagaggggcaaagagaggaaggagagcaaaagggcuccaauaugggaaaggaaagauagugcuugcccaaacaguggaagcucagaaacuggggcucccaaacaugggcuucagugggacagucccaguugccaacucccucccuagagccccaggccauaguaccacaguagaagaacacucaugggcaggccuaccuuggccaacagugacaguguaggggcuacgagggaugggaacaccggcgaaggugacauguacuguauggacacccuccauggugggcugauagcuacagcgauaggugcugucaccccuggccuccagcugagguuccacugugccuuucuguccuguaggguccuggaugacaacuuccaccucacccaugccagcuccugucccaaggcacagacucagcucuaggaccccagcacagcucucccccauggcuggcugggccugggcugucuccccucaccugcagugaagaucucaaaguagguagucuuguuggcaauauugccacugggcuccagaccagggcccugggcagucacuuugcuggcaucacccugugacuuguccacauacaccucaaaggggcucuuggcaauauguuggccagcaaagagcacagucaccuguucccagaaggggcaggcugugagagugagguaaggggcccuucaccaacuacccauggccaccagcuuccuucucagccaaggacucaccuuaugagucccugucacuucagggacauaccagacagagaaaguacgguucuugucauuauuggcagucacuuuugccuguaaugggaagaguguuaagagcaaccccuuuaaaagggggcauaacagaauccugcccugcuaauggauaauccuaccucuuccugguguccagcuggguccuccacauauacaagcacuucucccuguccagcacuucgggucuccacagugaauucugcucucuucuucaccauauugccuguaggcucgaugccugucagaagaugagaaagccaugaaccaacuaguagggcuacccucucaccucuauacccugguucccagacccuaaaggguuauggacacagcauuagagacccuaucccucugcaggcucagugccccucccccagcuagguacaauccaaucagguagauuuguucaauguaaacccagcauugagccgggccucagauccaugcuauaugggcuauugccaccaagacaggcccaugccuguucucugaaaaaucugguuugcuguacuuuccuaaccccuugcaccugcacaauccugacugcuucaucuccaauuauagaauagcaguacacgaggucauccuucauacgugagguucuucuccuucaaucaagaagcuuccuacaagccaguaugacuuaaggaacuuacuaguauucccuugccaaggcaccauuuuuaaccagguuuugauccauucaucuuccucaagaccucuuaggacccaaaaugaaagagaauacugucccauggaccggauauaagugcucagccccuuggaaugccacugaccaggcccccucaccuggcccauaggcucgggcuuucuucggguucaguuugggccgaagaggagccccuggcuucagcuuggccuugggaaacugagacagguaggucauaacagaaugcucaucuacauugggguccacaauuucuucugggguaaucaccuguuacagacagaagacaagagccauugggucucucuucacuuuaaccaagcaccccuuagcugcaggggucaguccgggagcauaccugaggaaugccuagccagucaucagccugcugcauggcuucccgugcauuguucacaggcuuacuagcaucccaggagucccagucaggacauaggccuacaacacagaaaagaacuuguugugagucuggggcuauagagcuaccuucuagguugaccagacagucuuagcccaagaucucccuuaccuggggcacagcuaucaacaagagcacccagggcccggccacucugccagucucgacugaaguugguaaugggaagcugugguagcuuguucugaauccagccuagaagccucugcuuggguguuugcuucuuggccuccucauccucuuccucaucccacaugggcauugagauggaauagugcaggaucaggguccagaugaggccuaagaucagcuucagauuuccauccacaauagccuugcugucugugggaaaaggcguggcggcauugcaguuaggguauucccucaugaaggccagcaaggagggaccuaggucugcagcacagcaaaucaauuaggugacaagaggccccucccaacuagggguagaaaguggaucaggcacccucugcccagggcaucuaaaugguguaagaaaauauuuugugauaaaggagaguuugggggggaaagacucccauagacacauaauacaauccaauaaaagggacccugccaaaaaccgcaaagcccagaaggaggguggaagagcaagugagauggaugcuguacagcugcugagaucaagaccugcccuaauaucuugagaucuaugggaauugggagaaguggcucagcccuaacuggccaagaaacagggccccugaccucaagcuggguuggaaccaaagaagaggaaggcuaaguuggcaaagaguaguuaggaaauacaacugcugcuccagagugggggaaaagacagaggaaguguuggcaaggauccuuguguaaaagggugcgagcuccacccuuugcuacuuccuugucucucuacccccaaacuaguaaauaggagguggaacaaaagagggcuagcuuggggaagggggccacaagucaaaggaacuauguuuaguucugacucauugaggcuuauagggaacuucuggggugacagcccccauugcccagcugaaagaggaagaguagaaccgccaaggaaaccauagguccuuaguaggcuggguuagccugccuuuggugccaaagagcacuugggaaccccuguugcagaggccuugggugguguucuuaaguccugcuguuucagcauaaccugcuuagaugcuacucaccacccagccuacuugccaccuaacgggcuaggucucaggcagccaccaggcuuaccacaaaggaagugguuagggcgggcacccuaaacacccaucacuauggcaacuccccugagccccacccaaagccaccucuuuaaccuccucaaggguggauggcuuauggugaguagcauuuucuaaggcucaucuuuggaaacccuacaggacuucccuguaaucagagaauguuuaucuagugagucaauggagaauggucaugaaaacuaggauaucacugagagagcagguaacauuccagugcagugggaaagcaccuggagaacugcuaucugagccucucaaacagagugaucuuucccauucacaaacugguccuggcccuucgagaauguuuuucauuguuccaaaauacagagaggaugggaaaggaaguugaaaaaaagucaaggacacaaagauccuacccuaccaaacaaagccacaggcccaucacaaaaacccccaaggagaucauagguccuuaguagucuccaaggggaagaacaaagacagacccaucaucccaguaagguacaucuggucccuccccuggucugauuaggugagcuaugccagcuucauaucccucccaagaggagaggaucagggcccaguguugggaagcagcuugguaagauggccccgccccaucccaccccuuauccccagccccugggccagccggcccccucccuccccuaaucacugcugcuuuccaacauuuuuuugccuuauauggcaaagcucugggaacuaggccugcuccagccagcucacaagaaggaggggagaaagaaggagggaggagacccccccuaaagagcugggguguggccugccuccccacauccgguugcccccuuccaagacuuagaaaugacucagcuggcuagacugaggcugggacuaggggugaguuuucauacauccacuggcacaccucuaugagcauuuaaaaaaaaaaaaaaacucagcacuuaaaaucugcucucugaagggccuuggucccucgcuguuuuaacuagcauguaccauuccaaaguuguaaggauaauagaaaacccuuuguauuauggaguaaagguccacucuucuacucucccuguuccacauucccaagauaacaauucuggugccuguccaugagcagccccuacuuugagaaaagcaugggauccugcaagagacaauaccaaugccaaccucuccaguucaaagacuugggaacuggacuagcaguaaacccugugcacauuggagcaccuuucaaccaaucucugcauucuagauguacaaaaccaagguuuacaaugaaacaagaauuugauccaugauagacagcaaagcuaacaaccaagugcucgugccuuuagucaaccacacucauuacaccuggaguacaguuuugccagcaguauaucucuuugccccccuccaaguucagcaaaaaaagaaagaaagaaagaaagaaacuggggauuugaacuaucuccaauggggaagcauguuccagggcaagaaguugagggaguccuacauaaauaggagaacaagcuacaaccuucacuuuagaacugcagaggcagccaaaugcuagaaggguacuuuuaaaauuguuguagguggaaagcauggguaucccagggauggggugcggcucucagaggcagaagccuagucugugccugucccaccucgggugcagcguugggggcgcggccuacagaggaugugagcucagccugggagcaggccagcaaggcgcugcgggcgggggcgcguagcgguucgcaugcucgccaggccagccuuuuguucucgaggaccucaaagaacaaggcggcuaaggggccuagugguagccuugguugugugcagcagcuagggaagacaacuaggagagacucuagaggagaagaaaggaagaauuuguugcgaccacgcccgcacccacucagcgccccaguguagcccgugcccucaccuauggacacgagcuugaugcucucacgguccaggaauucaagcgccaccgacacauuuucgagcugcaucuggcggaaagugggucuuugguugugcuugcggugcauuuucuucuggcugaguaccucgagcagcgcgaugagccgcaacccaucgcucagguccgucugcagauuggcgaugcgcuugcuuacgcacuuaaggugcucauugcaccagcgggugaauguguucugcugaauuuucuuccacggugcaucuucugcuaggucuuuuucgguagccggcaucuccgcgucccgugaaucgauacugccucccggagacgcaaccgccgcacucuggccacagcgggagugagagcuacucauuuugaggcgcgaggaacggaggggcggugcugcagcuucgccgaugggacggcccuuuaauuaaagcaguaggcaccuccgagcaugaacgacgaggcacagaacagagguugcacugcggaaagagcgagcccuuuaaauguaugcgaaaggcggagccagaggcaaaguuuccuugggggcggagccucuggguggggcuucugggccgcgcccgccccaccucgccccucccguuggaaugccccacaacgccccccgcccccaucccccgaagcugccucugcacuccgccaaaagcaacucagccccgcugcuucagaaagggucuuugagccccaaagagcacaaaaaggucuggcaacauccgcuacaguacuacaggaaacggaccccagaucuaggaacgcuugagcaauucugucacagaauugcucagcuccagcaggcacacccuuacaagggacuuucuuuccccaaggucccugcagaaggcggagcgaauaaugucccgguaucacuugggcuccgcccugacccuguacccucuucuacauucucuauucuucccgagcuuaggguucucagccacagugugauccacagcagaguaaagcaauccugugagcgaacccuuccagagcgccuaacgcugcugagagcucuuuguaugcugucagacagggcucucaucaccuaacauagacacccacagagcccuggcacucccuacccaucuccuuuggucuucccagucuccaugacccuggccugcacaccugcacaggcccauucccaccgucgucuucucuacugccuaguuccauccgcgaggaaauggggccagcacugggccaaguggccaccagcacuacaggaucaagcagcuuuccaaagguccaggguaugccaaugcacacaaucagagggcgccugccugccugccugccugccugcccugugaugcauguagaucuguacaccuuguaccugccauacucacuguucuaccuugggcccugaggaauucuggggggagaggucuucucuggcugaacagucccaagccuugcugugacccuagagauguggaggggcucagggagagggucccagauuacugaagaaaggagagucaccagacaucaaggcuugcuaaggagccugaguguguucccuaaguagugugaagcuacucacuaaaaguuaauuuaaugauagauauucucuggagauagugaugaggaugcugugcugggacagaaaggagcgaagauacagaaaaagaaaacuguaggggauacucccaaccauccucuuuaguuaaggggauucaucuuaccuaugucuuucccgugguagacuuuuccaucuacuuacucuguacuucaagccucuccagaauguuaaauuguuuuuccagaaagacaggcuucugucccuacuucucaauucuaagaccaguggccgccggggcuggagagauggcucugugguuaagagcaguggcugcucuuucagaggacccagauucaauucccagcacccauaugaaagcuuacaacugucuguaacucuagcuccagggaauaugacaccuucacacagacaugaaugcaggcaaaauuaugcacauaaaauuaauuagauagauagauagauagauagauagauagauagauaaagaccaguggcugaaagaggccuuggguugaccaacaugucaugcccaaauaugguugacucucccacagccuggagugucuucauugccugugguagggcuaugauagggcuuugaucacaaugggcagaaccuuucagcauagucaucuugagauugucuaugauaucgccagucaaauaacauuuucaguacagaaucccucccccccauucuaccuccagucaccugcauaaauaucugcaccaagugagccaaagguugaguugggggacaugauggcagaacugugcagggauaacccaaauggaaacuuccagccauguuauucaagacacaauuaggguaauauuuuuggucccccugaucuacuggagagcaaagccccauguacggaauugcauuaauacaugauuuuucauucaaugccauuuggcuggaucacaugaguucauuaauguacagagaacaaggaaaacugaaucauaguaauagagcacaaagaacuugaguuuccuagcuuccagcccuaugauuuggcuauuuagggggaaaagaggaaauggggggggguguccuagccuuagagugcacaagugccaccaccagaugucgcuccaucccaaagauccagaugaggcagccccaggaagccaaaauccagcucuuucauauuuucccuuauuuggaguagauucuuggaugguagacacaccccgcccaccuccccaccccacuccucucagaccccagaccaggcccucccacagggaacuauaggcccaagcccaccagcuauacugggauccugaagagcuauuucuagaccuguguagccagggggcgccaggagggaaggaaacagaaaauccccaaagugagaccaguucccuuaaagcaaauccagguguggcagaagagaacagugauuuccugagcucacaccuuggccaaacuggagcugcaauugacugcggguggauuccacccacuuuuucuggccccagucugacuuugguaucuaggaaugcugaugcuuauguccuggccgucaaugacauaagcauaaccaaccugagacaggacccaaaacccagacugaaaaaucuaguuggccaugccccugccacagcccuggaaucagcuccccauagccaaaccagcagaggacucuuguauccacccuuguuucaucucucuuguguccacguuugacacugacuaaaaaguguccuuccaaguugucacucacccuuauccuaaucaggguacuagucuuaaaagaccuuuccgggauagguacacaaugaccaguuuaugggcacccaugccuguacccaucucuugccaaacgcucagauacuagcccccuuuucaaggacuccccccauaggcucgaguuccuggauuccuggacauagacacaauaaguuugugguaaacuaugcaaggcuaucucuggacaccaacgcaaugccugggaccugaguccacacccaaccugcuccuggucuuggccucucgcuuuccagaccucuucccagcucaggagccuugcauccacuaucuggagacuaucuggcguggagcugaccacagagcccucaccugcugucccucuaaccgccggguggcgcccagcucuucgcgcccgcgccggaagccucagagcuccacuggcguccgcugcgcgcugcgcgc

SEQ ID NO: 9564 - RNA, 2019 nt, Mus musculus
ucacaggacaacggaagcaaaauuuuauuccucuuggcugggaaagagaacuagaaggugguuguacauaggacuuccaccucccagaaccaaagaagacaugcucugccaccaaauggcucccucugcccaagugaaagcccagagacaggugaacacagugcagggcaagggcgaaugcagugaagagcggccagagugauccagggaagggaggguccagggcucaggaaaggaaaauggggcuucuugggaauaggacagguguggggaugcucauugccaugggagcuucuagcuggcacaggugccaacuuagguggcaggcucaggguaccauaaugcgguaugggcugccugggauaugcucaucaccccacuugaccaccaguguguacuccccuuuguccuugagcagguaagagacacuauagaggcggcugcccauguguuucaccaggaucucuucacaggguguccuugggccaugcacgcccaccagcagcauguuguuaccuaaggcaggaauaggucucaguggccuuagauccuuucuuugucuauaauugcucugagcccuucucacuauuccacauucuguuccuugccugauuauuaacauucccaagcaagcaucucauaccccagccuugccacccagaccaccagaggauaaauuacagcuccuccaggacauugguguuuugccugcauguauaucuguguaagaaaauagaggaggaaggagaagccaccaugagcuggagucaagggcccugagagcugcccaauuggaguuaagagcaacccaaaugaaacauaguaaguaauaacuugggguuauccauaggaaaauaaauucuaacaacauagagaguaguaucugccaagcucuuguauuguuuaaggcuuacuguaaauauaaagaucauguguguuuuuaaucugagaacuaaucuaaggugggguagaaacccuggguaaaacaguagggauuaaauaauuucuacaacagaucccaugaaacuggaauuacagacaguugugagcugccaugugggugcugugacuugaaccccaguccucugaaaacugcugagccaccuuuucagcagccccacuccaggacauuuucuugaaggguagaaaggaaaguacgaaggcccaaauagaagguagcucuaaaagcaauaaucauaccccuaaaggcaguuccuguacuuccuacaugcugaccauccuguuauuuauggcuuugcacuuccagaagcuaaaaauagggcuacucaccugcuuugcugcaaucuacugugaaguugcucuucuggccuacauaagccuugcuuagccccaggccuuuggcuacuaccuugcugacaucagcaggaccugggccugagguugcaugcuggggaaccguggcaacuuuagucaaagaguccacaaacacagaugaugucucauggaggcugugguugcuuacaagacgaggaccuacaaaacagaaugggugagacuaagaagcugcucaaguaucaaggcauuggguggccaccaacagcuuagccuaaggcucaccugugaccuuggcuuuaaagggacuuccaccaaugugauaggggccaccauacuugauggagaugagguagcugccaggugccauggggguauaggugacacgauagcccucggggcacuccuggcaauccaucuucaccuuggaggggccaucaaugguaaccgaaagggcaccagcuccugcauugcuuguguucacaauaaacucugcugggcucccugggaaaauagaaggucaggcagaaucuaucucacuggcuuccuugcauucagcuacccagcacagccuugauacuuccacaugcuuccuggugcuggggcuauacaucuacacucagagcuguacccauaaaccuaccugugacaccaccuuccaggccugcuccauaggcggacacuaagccuggguccccuccaugcccaggcuccccaacucggauc

SEQ ID NO: 9565 - RNA, 2019 nt, Mus musculus
gauccgaguuggggagccugggcauggaggggacccaggcuuaguguccgccuauggagcaggccuggaagguggugucacagguagguuuauggguacagcucugaguguagauguauagccccagcaccaggaagcauguggaaguaucaaggcugugcuggguagcugaaugcaaggaagccagugagauagauucugccugaccuucuauuuucccagggagcccagcagaguuuauugugaacacaagcaaugcaggagcuggugcccuuucgguuaccauugauggccccuccaaggugaagauggauugccaggagugccccgagggcuaucgugucaccuauacccccauggcaccuggcagcuaccucaucuccaucaaguaugguggccccuaucacauugguggaagucccuuuaaagccaaggucacaggugagccuuaggcuaagcuguugguggccacccaaugccuugauacuugagcagcuucuuagucucacccauucuguuuuguagguccucgucuuguaagcaaccacagccuccaugagacaucaucuguguuuguggacucuuugacuaaaguugccacgguuccccagcaugcaaccucaggcccagguccugcugaugucagcaagguaguagccaaaggccuggggcuaagcaaggcuuauguaggccagaagagcaacuucacaguagauugcagcaaagcaggugaguagcccuauuuuuagcuucuggaagugcaaagccauaaauaacaggauggucagcauguaggaaguacaggaacugccuuuagggguaugauuauugcuuuuagagcuaccuucuauuugggccuucguacuuuccuuucuacccuucaagaaaauguccuggaguggggcugcugaaaagguggcucagcaguuuucagaggacugggguucaagucacagcacccacauggcagcucacaacugucuguaauuccaguuucaugggaucuguuguagaaauuauuuaaucccuacuguuuuacccaggguuucuaccccaccuuagauuaguucucagauuaaaaacacacaugaucuuuauauuuacaguaagccuuaaacaauacaagagcuuggcagauacuacucucuauguuguuagaauuuauuuuccuauggauaaccccaaguuauuacuuacuauguuucauuuggguugcucuuaacuccaauugggcagcucucagggcccuugacuccagcucaugguggcuucuccuuccuccucuauuuucuuacacagauauacaugcaggcaaaacaccaauguccuggaggagcuguaauuuauccucugguggucuggguggcaaggcugggguaugagaugcuugcuugggaauguuaauaaucaggcaaggaacagaauguggaauagugagaagggcucagagcaauuauagacaaagaaaggaucuaaggccacugagaccuauuccugccuuagguaacaacaugcugcuggugggcgugcauggcccaaggacacccugugaagagauccuggugaaacacaugggcagccgccucuauagugucucuuaccugcucaaggacaaaggggaguacacacugguggucaaguggggugaugagcauaucccaggcagcccauaccgcauuaugguacccugagccugccaccuaaguuggcaccugugccagcuagaagcucccauggcaaugagcauccccacaccuguccuauucccaagaagccccauuuuccuuuccugagcccuggacccucccuucccuggaucacucuggccgcucuucacugcauucgcccuugcccugcacuguguucaccugucucugggcuuucacuugggcagagggagccauuugguggcagagcaugucuucuuugguucugggagguggaaguccuauguacaaccaccuucuaguucucuuucccagccaagaggaauaaaauuuugcuuccguuguccuguga

SEQ ID NO: 9566 - RNA, 2325 nt, Mus musculus
aagauaggccgccuauauaaggcgugagcaggcgugggagcgucucuuuuccucuggcgcggugagugaguucggucacgguuuuuuacgauggucucguaauuuuucuuugggauuuuuuuuacacuuauucugugucuguauucuuugacuguuucauuacagccaccgacgauccuauugucaucaugggccgccgccccgcccgguggugagugcugaacccaugcaaucuuccuacugugaaaacugagggaaaaaugcauuucuuucgaaagacuuuuuuuuuauggguggacucucugccacuuagagacccugaaguaaagacugacuucggguuuucuuuaauacuuuacugggaccuuuauuuugaggcuguggguggcguuacccaauacuaaagcgcuuggguagaacuagcauguccgugugcauccaauccucugcgucgcaaaugagccuuuuuacaacgccuaccaggccuucuuggucacuuuugcguccgucuuuuauuuccggccuugagcuuugugguuuuuaacaggacaccaagggcugaccaguccguaggcgccgccuaaacgcguguccugaagaggacgccauauucucuuaacguggcuaaggcgggucuucugucacaugcuaggaaaauugugauaucucacccaacucugguuagagggugaugcuagugcaugauucuuuuucuguuuuauaauuuguguaauuguuuaacaacaaguugccuuagaaucaguuacccugaauggaaacuggauucagagcugguuuaguccuguugucaccauuaaucacaccugaguuuccuuccuucuauaguuaccgguauuguaagaacaagccauacccaaagucucguuucugccguggugucccugguaaguagugacaaacuucgaacuggaucgguguuugucuauuccccacuucucgagaacuuuaaaccacguguuuuucagaugcuaagauccgaaucuuugauuugggacggaagaaagcaaaaguugaugaauucccacuuuguggccauauggugucagaugaauaugagcaacucucuucugaaggugagacagcucccauuuguuaauuggcucuuuuuuuuuuuuuuuuugguuuuucgagacgguuucucuguagccuuggcuguccuggaacucacuuuguagaccaggcuggccucaaacucagaaauccaccucccaagugcugggauuaaaggcauggaccaccaugcccgguguguuaauuggcauuucuuguguacuuguggauuauauauuauaauuuauucaauguccugacacccuguuucacugcuguuauuuccccauucagcacuggaggcugcccguauuugugccaacaaauacaugguaaagaguuguggcaaggauggcuuucauauccgagugaggcuccacccuuuccaugucauccguaucaacaagauguuguccugugcuggggcugacagguaagcugguguuuuauuugguuuugagacaggguuucucuguaucccuggcuguccgggaacuuaauguacaccaggcauaucugagaucugccugccucugccucccaagugauuaaaaaccaccacuguccagcaguauuuuuagggauuucuuugauuuuuugugcagcuaauuaagccgaccaaguccccuuuucccauggggacuuuggugugcaaugguugcaaacagcagccuccuugguaguguauguagccuauuaucuauaugggcugccucaagggaccuuggagacaauuuucuggcaguugguaaucaggccucugaucacaauguugucccugaucuaggcuccagacagggaugcguggugccuuugggaagccccagggcacaguggccaggguucacauuggccaggucaucauguccauccgaaccaaguugcagaacaaggaacaugugauugaggcucugcgaagagccaaguucaaguucccuggccgccagaagguagguagugguauuuaaguucuucuguuuucuugcucugguccuccuugcugaguuuguuauuuucuauuuccuucuagauccacaucucaaagaaguggggcuucaccaaguuuaaugcagaugaauuugaagacaugguugcugagaagcggcucauuccugauggcuguggugucaaauauauccccaaucgugguccucuggacaaguggagagcccugcauuccugaaggcuucaauaguucuccuauacccuaccaaaucguucaauaauaaaaucucgcaucaaguucgcuuaugu

SEQ ID NO: 9567 - RNA, 95454 nt, Mus musculus
agcccaggugguggacucuacccaaggcacggccggggcagaagcgaaggccgggaggcgggacugaagaaugcgcaggcgggagccacgaggcgggcgcgccccuuucacggcuuccggcggcggcgggcgguuccggggcggcggcgcgcggcaggggaccguugguguuugcguuggccguaguggacugggccguggacaccaugcagcugaccgugaaggcgcuccagggccgggaauguagccuacagguaaagucaccccgcaggcugcugcacucacuccugccgcugggggccgagggcgggugggggaggccgggagagcugaccucaggagggggugcgagggcuucaccgcccagggaauucgggcugagcccuugccucuccaccucggccggaucagguggcggaggacgagcuagugucuacacugaagcaccuggucucggauaagcugaaugucccugugcgccagcaacgucugcuguucaagggcaaggcccuagcagguaaucagggaaaggagccauccagggagcuuuacagaaagcugggggacgggauguacaggccaguguaguggaucggggcacuggcugccacuggaccucagaaaaguagcugagccaucaccaccccaccaccccauagccagaugcugcagugcuucacucuggcugucuguggcaggauugcuucccagccaccuccacaucagugaggaaggaaccacaccaaucucucuuuggcagaugaaaaacgacugucagauuacaacauugggcccaauucuaagcucaaccuaguuguuaagccuuuggagaaggugcuacuggaagaagggucugcccacagacuggucgacuccccagccacccccaucuggcagcugaucuccaaaguccuggcccgucacuucaguguagcagaugccagcaggguccuggaacaacuacagagggugagaagaguaaugcuggcccuccauucuuaauguuucuacccguccccuaccuaaugcagcauacgccuuccccacuggccucucugaauacacucggucuucucuccucaggauuaugacagguccuugagccgccuaacacuggaugacaucgaacguuuggccagccgcuuucuacacccugaagugacugaggcuauggaaaaaggguucugcaaauagcauucugggauuguggggagaaaucccaggucaggccacagcugcauguugcauuaaauguguucucaugucgcaguuuggcucauagugauaauaauagcugguauguauccagcucuugcuaggugcuagguacucaaaguacauggccugaguucucuucugccucccacagcaaaguugaggcugcacuguagagacaccuagcaauggcuugggacagacaggguccaagucuagccagccuauagaagugccucuguaggagaaagagugugcuguuuucagagaugggucuuaguauucccauuuagcccacucagcauacacccucaaaagacucccucaggaaaccacuaguuccugucaccugcccucuggugugucccuuggcaaaucucuauaggaggccaaguguuagcuauccagggccccuccacugcugcagccagugugcucuugaauaacaagcagguuaaggggcuggaggaucagaaagauaccccagcuccaucauaguuugagucauguuucuaugccacuuugguccccaaccaaagugaaucugucccauguuaggcacuccucugaccugaauaaguuuccuuucuccuuuaucaguucaaggugggagucuuugcucucaucaccugcaguuccaccuuguguucagaaagcaaaagugaagugauagccaagcaugggccacuagauggaguauccugggccuuuguagcauagcucuucucuggagcacccuauuugcuuggcucuuucuggaaguaggucucacccaugagggacaacaggugacucagaaaggcagugucacaacuagaacacucugccuuggucuccuuauccagugcucacccacaguaugaaauggaugcuuccucugccaccuguauacaggggcuuuuacuuugcacaccuucauugcuuaagaagaaacucagggugcugagaaagauauguaugcugaaggcugugauuccucuuuuuauuguaccuaugccugggugcuaaaggucauguaaggacuaguuccuuugaggaggacccccugggagcagucaagcuggaagauagcuaccugcaagacacuacugucccucuacuuuugccaggaaagccacucuacuaugaauguuauuggggcuacacuugccuuucuugcccaagggccuccugcauagaccuugucggucaaaucuugaguccuuguacagaaaugauagaggccugagggggugugcaggugauagacccugguacuccuaagaccugggguaucauaucagggaccugcuugugaacauguguauagagugccagcucagauaauaagcuuaccagugaccuuguucacuuugagucagggaacguauuuguaaaauuaacacuaaagaugcaugugagucauuucaccaaaaggaacucuauuaauaagcuagacugcuuuugguuuccaguaauugguuuaaaaacacaguaaauuuacuggcuuauaaagcugaaaaagccuaggaguacuggcaguggaugaacaauuucaccaaacauccagcuuuuuuccugccucccucugaauucuccaggaucugcuucacccucaccaccaccacuuccaaggaucaaagcugucuacagcuccaucaaaaccuuucauucacugccaaugaggagcacuuucuuucuguagcauagcuucugucucagaugccccagcaaauaaaugcugucucuuauuggucagaacugaauccuguguaauauuuggguugggaauaugggaaaauaaguuguugauuauccauuagcaccuauuuggccagucuuggggucucuuuccugaacacaugagcuguaccagggagaaaaaaaaaauaaauggauguccuggugaugucuuggugugugcagauggcaacugucaacuacaugcauucaccagaaagaucauaacuuccuuggagauaguagaggaggaagggaugaggacucagacaaggagcguuucugacacuuucauucaaaaacauucgaaguuucuaaaagcaggaacaaacuauagacauguuccugaaucuuuugagccaaugcuucucaauucagaguaccagaugccuguaaaaugcuuaccuuggcaguguuuugaugaguuuauauaaugggacaauugacagguuuugcuaaguagcuaccuauagaauaagaaacuauuauugagaguuccucaagaaucaggcuauggcugaaacagaaaauacaaauguaggaagggguucaaugucaucuaguugccuugggaggcuaagauggcuguguauauggaaggucagagacagaggagaugagauuagacauggagauaagugaggagccuacaaaauaugcauuguggccccuauaauagcucagaaaagcaagaagauggcuccuuuugauagcuauuggauucuuaugaaucuuuucuaugcagggcacuuauuucauccuuauaugacugccagaugugggaaguggaugauccacaacccaggcauagcuuuaucccugagcucauuaaccauacugcuaugcccaggaauuaucuguaaacagggagccauagauacuggaaggaugauugagguggcugcccagagaaagggggcuuacaaagaagagugaggucucaaccucaaggggucagcuuuaccaaccacagaggaauuuaaagaggagccaaaggcaaaagcauaggcaggagauggcaccagugcaacucaaggacaggcaucuacaaggaagaccccauuagugcugccacuacagggacaagguggagguuguucccauuguaugguaggccaaggaguccucagaaaccuuauucuacaaguauguguacaacugaauggcaacaaauaagugguguuaagccuuggggagcucugacagagcaagguggcaaauaggaagacaagaggcaacaaauacugccggggugagaaauaagaaggggaccauaagaggacgcuagugaaaauagagugaccacaggaugcagaugcugcauuugccuugaauuucauauggcucccuauacacaacaggcucuaaacucuaagggcccuaaucaaggauagaucaucagggauaggaauauuugccguagaugcuguguccuguugagccacauauacaacccaagaagugacaucuacuuacugcccccugccaaauacaaguuccugagagccacugccugacucucagauuggggucaagguauguaaugugaauacaaucucacuaggagauagcaugaaugaaggacccagcucaaguggccucccaaagacagaaguauuguaaggagcugggacauacucacgagcucagcauuuauggugaagcucauuaaauuagauauucacagggaacaaauuagagacguuucuguuuguuuguuuguuuguuuguuuguuuugagacaggguuucucugcguagacuuggcuauccuggaacucacucuguagaacaggcuagccuugaauucacagagauagggaucugcuaccucugcuucccaaaguguugagauuucaggccugugccaccacugcugggugaacuugugauuucuuucaugucuaauggccuccucccuauuauaacauccuuuauucuagcaccacaauauauccuaggcccacccuguauauuuucuugcucaugacuaaggaucagccuuuuacuggagaauaguauuuguuuguuuguccaauuguugaauggcauuuagaaaccaagaucuaugaauacauuacugugaaugaaguaucacugcuuccagaccccuuuaguagauaaaccuuagaaauauauauacccauauauuuuaagaaaucacaaguucaugcugacaccuucccucauaccucagugagaauucuaguuucugacaacauugauauauuuacucauuuucuuuaccagauaaagaaaauguuaucuuaacauagacccaaaauagcuucacacucaccucaucuacauuauccacauuaaauaugcuaaaaggaaaaccaauuauuuuuguccuuaggauauaucccacaagggaauaugguagcaguguuguacuuaaagggaacugaauuggcugaguguggcggugcauaccugcuagcuacucaagugacuaaggugaaagggucaccucagcucagggcauaaagaccagcuugaccaucaguaagacccuuuacaaaaauugauuuuuaaaaaaguggaaaaaaagacagugagguggcucagcagguaaaagcacuuuaccugcuggagaguagccaucucaaaccccuauaguaaagcauuuuaaguaguuucugcuuuagcccuccuggaauuuuuaccucaggguuauguauaccagcauguguguucaauucccucucuggugguuuugguuuggguuuggguuuuuuuguuugcuuguuuguuuuuguuuugucuuuuacuuucuuguuucaugagacaggaaggccaccaaacauucuuuagguagccuaggcuggccucaaauuuauggcaauccuccugcuucaucuucucaaguacuuggauuauagguuuauuacauguccagauuugcuuugggguuguuugcuuauuuggguacuuuuggugguaauaggaauugaccccaggacuuucaccuucuaggaaacaauucaaacagugaauauacccucagcuuuucuccaaauuuaaaauuaaucuuaaaauucaggugggguggagcacaccuuugauccuaccacuugggaggcagaggcagaaggaucucuaagaguuugaggccaacuuugucuaccuagugaguugcagggcaucuaaggcuguguagagagauucugucucaaaaacaaacaaaaauaaauaaaaaauaaaauuaaucuuucagguuacccuaagaaguaauuaguuucaucauuacauuuuuauuuguuaacuucuuuuuaauucuuucccuuuuauugaaaauaggugguggugcaugcuuagcacuugggaggaagaaacagaaugaucucuugaguuugaggccagccuggucuacagagugaguuccaggacagccaggguguagggcuacauagagaaacccugucucaaaacaaacaaacaaacaaacaaacaaacaaacaaggaaggaaggaaggaaagaaggaaggaaggaaggaagguuuuuuuuuuguguaugguuuuucgagacaggguuucucuguguaguccuggcuguccuggaacucacucuguagaccaggcuggccucaaacucagaaaucugccugccucugccucccaagugcugggauuaacggugugggacaccacgcccaacuaggaagguucuuuuuucaugcaauagauccugauuacaguuucccuucucucuacuccucccaguuucuccccauguccccuuccauccagauccacucccuuucugucucucguuggaaaagaacaggcuucuaagacauaacaaaauaaaauauaauaagauaaagcaaaagucaucacaucaaaguuggacaggguaaacuaacagaaggaaaagauccccaagagaaggcacaagaaucagagacccacuuguucacacacccaagagucccauaaaauuacuaaacugaaagcuauaauacauauuauguauuauauuguuauauuguauuauauauuauauuauacauauaaacagaggaccugguacagacccauguaggcccugugauugcuacuucagucucugaguucauaugaacuuugaucaguugauuuagagagccuucuucuccuguugucuguccuucaucuccucuggcucuuaccuuuuuccaccuccucuucuguagggugcccuaagcccugaagaauuugauggagauacuccauuugaggcugaguguuucaagaucuccaucuccuucucucuccucccuccucccuccucccucccucuccccccuccucccucucucucucucucucucucucucucucucucucucucucacacacacacacacacacacacacauucugcauaauaucuggcugugggucucuguauuuguucccaucugcugcaggagaagcuucucugaugauggcuaaauaaggcacugauccauggguauggcagaauaucauuaggaaucauuauauugcuacuuuuuuagaccuguaguauuuguuuuuacccugggucucagaaucacccaagcaguguuggguauagguuccgucuuguggaguggccuuaaguuaaaucagauauugguuggucacucccacaagauuugugucaccguugcucuggcauauuuuuucaagcaaaccaaagguuuuguggcuggguugguauuuauguuucucuuuugguagcacgcagaguagggaggaaacuugcugucaauuugcagacagcaaccuauuaucuugacaacagccuggguuguuuggggguuucauggaacuccuuuggccaccaacccaauugcauguaacccagaguccuuguacuggacguguuguuugauaacaagagauggccaguugagacuauagcuugagaccucauuguuuggagaacugcacuaggaucaccuucauauauuuuagaaaguuuucacugcacuagucuuucaugccaccccucaaaugacucucaauucuguuuuuccccacauuccuucccucaaucccaucuccccuucccuuccccacuugauccuuuguucuugucccccuugccccuaguccacccacaaaaaucuauucuuuuucaccuuuccaagacgaucuauguaugucccccaugaccccagagcccuccucuuuaccuaaccucuuuugggcuguggauaauaguaugauuauccuuaacagcuaauguccaccacguguaagugaguacacaccauguuuguauuucuguggcuggguuaccucacucagggugaucuuuucuagauccauccauuugccugcaaauuucaugaugucauuauuuuuagcagcugaguaauacuuucuuguguaaauguaccaccuuuucuuuauccacuuuucuguugagggaaaucuggguucuuuccaauuucuggguauuaugaauaaagcugcuaugaacguaguugagcaagugucuuuguaguauaguggagcaucuuuuagguauaugcccaggaguaugguauaacugggucuugagguagauugauuacacaauuuucugagaaaccaccauauugauuuccagagugaguguauaaguuugcacucccaccagcaauggaggaguguuccucucucuccacauccuugccagcaucugaugucaccugaauuuuuuaucuuagccuuucugacuggugugagguagaaucucaggguuguuuugauuugcauuucccugauggcuacggaugcugagcauuuagcugcuucuaggccauuugagauuccucuguugagaauucucuguuuagaucuguacccccuccccccuuuuuuuucuugguuuuucaagacaggguuucucuguguagcucuggcuguccuggaacucacuucguagaccaggcugguuucgaacucagaaauccgccugccucugucucccaagugcugggacuaaaggcgugcgccaucaccgcccagcuuugcugauguuuuugauucuuuauauauuuuagauaucaacccucugucagauguaggguuggugaaaaucuuuuccacuucugucgacuaccauuuuguacuauugaugguguccuuugccuuacagaagauuuucaguuuuaugagguccuguuuauuaauuguugaucuuagugccugagcuauuggcauuccguucaggaagcugucuccugugccaauaaauucaaggcuauucccuguuguguguagcuuuuaaaaacccacgucuggucaggcuagguucuagaaucgguagcauguuccucuugccagaugccaaaacucccuucugccccugguucccgaggcuggcuuguuaaucugcccaaaccaguucuucuggugaacgccuggagcuacugcuccaguuccacugacugauuggcccggugauuggcuacacugaccgccaaaggcgacaccgagguuuugcccucucucucacccaccuaaaucaucgcaaauggaaaacaggcaguucuaacacuuuaaaaccagccagauagcacaacugguggcgaagaauaucuugcucgaucuuccuuggccuccacaggcugcugaggccacaaacuauuggagccccgaggaaccuauaaguccacaacuucucaucaacacauuaccccguccaacucuaauccucuccccuucucuugcuguccugcccggaaaauccugccuccauaucuucgcccagcaauuggcuuaaucagcaauuagggaauuaauuaguuaaacucccccuacauuuccccacuuucuuuucuaucagguucaguguaucagguuuuauguugagguuuuugauccacuuggacuugaguuuugugcacagugauagauaauagaucuauuugcauucuacuacaugcagacauccaguuugacagcaccauauguugaagaugcuggguuuuuccaguguguauuucccagcuauuuacaaaaaagaaaaaaacaucagguguguggauuuaugcccaggucuucaauuugguucaguuugaucaauguaucugguuucauaucaauagcaugcugguuuuuuuuuuuaaauuacuauagcucuguaauacaacuugaaaucagaaaggugagaccuccagaaguuuuuuuuuuuuuuuaagauuuauuuuacuuauaugaguacacuguagcugucuucagacacaccagaagagugcauuggaccccauuacagacaguugugagccaccauguguuugcugggaauugaacucaggaccucuggaagagcagccagugcucuuaacugcugucaucucuccagccccacaaguucuuuuauuguucagaauuauuuuagucauccuggguguuuuguuuuuccacaugaaguugagaauugucuucucaagaucugugaauaauuguguuggaauuuugauggugauugcauuaaaucuguaaacuacuuugguaagauggccaucuuuacuauauuaauccuauagaaccacggacaugggagauugugccaucuucuuucuugucuuuuguauugguguuuguuuuguucuuuuuuuuuuuuuuugucuuuuuucuuuuuuuggucuuuguuuguuuucgagacaggguuucucuguguagcccuggcuguccuggaacucacucuguagaccagucuggccucgaacucagaaauccaccugccucugccucccaagugcugggauuaaaggcgugcgucaccacugcccggcuguuuuguuauuuuuugagacagguuuucucuguguaacaguccugacuguccuggauauacuaaauagaccaggcuggccuccaacucacagagauccacgugcuucuaccucccaaguacugagauuaaagcaguguacuacuacugucuagcaauuuuuccaucuuuugauauauucuucagcuuacuucuucugagaccugaauuuuuugucauauaagccuuucauuugcuugguuugaguuacccccaauauauuucauauuauuuguggccauugugaaggguguuguuuuccugauuucuuucucagccuguuuaaguuugugggcuacuuuuuuuuuaaguuaauuuuguaucuagcuacuuugcuguaaguguuuaucagcuauaagaguucucugguagaauuuuuguggucacuuauguauacuaucauaucauaugcagauagcaauauguugaccucuucuuuuuuuuuuuuuuuuaacaaacagauuuauuuauuuauuuauuuauuuauuuuauguaaguacacuguagcugucuucagacacuccagaagagggagucagaucacauuacggaugguugugagccaccaugugguugcugggauuugaacuccggaccuucaaaagagcagucgggugcucuuacccacugagccaucucaccagccccauguugaccucuucuuuuccaaccuguauccccuugaucuccuuuaguugucuuacugcucuaacuagaacuucaaguacuauauuuaauagauagggagagaauagacagccuugucuugucccuaauuuuaguagaauugcuuugaguuucucuccauuuuuuugaaguuggcuauuggucuguuauauauugccuuuauuguguuuagguauauaccuaguaucccagaucucucuaagacuuuuaaaaugaagggguguuggauuuugucacagguuuauucagcaucuaaugagaugaucaugugauuuuuuuuucuuucaguuuguuuauaugguggauuacacuuugaaccauaccugcaccucugggaugaagccuacuugaucaugauggaugauguuuuugaugugauuuuuuauuuguuugugaauaauuuauugaauacuuuggcaucaauguuuaugaauuuauuauggucuguauuuuucuuuuuuauggagucuuugugugguuuggguaucagagugauugugacaucauaaaaugaauuuggcauuguuucuucucuuucuauuuuauauaaugauuugaauauugguauuagcuugucuuugaaagucugguagaauucagugcuaaaaccaucugaccccuggcuuuuuuuuuuuuaauuuugauugggagacuuguaaugacugcuucuuuuuuaaaaagauuuauuaucaucaauaaguacacuguagcugucuucagacacaccagaagagggcaucagaucccauuacagaugguugugagccaccaugugguugcuggaauuuggacucaggacauucggaagagcggucagugcucucacccacugagccaucucagccguaaugacagcuccuauuuuacuaggcauuauagguauguuuaaauugcuuaucugaucuugauuuaauuuggguaagugauaccuauugaggaaauuauccauugcuuuuagauuuuucaauuugaugaaguacagguuuuuaaaguauguccucaugauucuuuggauucccugggugucuguuaugccucucuuuuguuucugauuuuguuaauuuggguauugucucugugucuuuuaguuuggauaaggguuugucuaucuuguugauuuucucaaagaaccaacucuuuauuucauugauucuuuuguuuguuuguuuuuguuuuuuguuuuuugagacagggucucucuguguagcccuggcuguccuggaacucacucuguagaccaggcuggccuugaacucagaaaucugccugccucugccucccaagugcugggauuaaaggcgugcgccaccacacccagcuuauuucauugauucuuuguacuguucucuuuguuucuuuucuucuucaccccucaauuuuauuauuucuugccacccacuccuuuugagugugcuugcuucuuuuuguucuagagauuucagguauacuauuaauuugcuaguaugagaacucucuaauuucuuuaugaaggcauuuagugcugugaaauuucuucuuagcacuguuuucauagugaccaauaaguuuguguauguugugccuucauuuucauugaauucuagacagucuuuaauuucuguuuuuauuucuucccugaccaagaagucauugagccacauuauacaacgaucuuauaaacuacugcagagacuuugggaaugaaaccaggaccuugaaaugucauauaagugcuauaccuaaugagugcugucgaacccacagccaccauucuuauuuuuagaguuuuaaaaauaaaaauguaauuauucuauuuuuauaugcauagguguuuguccuuuaugugucucugugcaucagacauguuacuggugcccauggaagccagaagaggacaucaggucccccuugaaccauuucuugugagcugcuagguggguagugagaauggaacccagguccucugcaagaacagccagcacucuuaaaagcugagccaucucuccagcuccaauuuacagaauuuuaagcaugcauaugaucuauauaagaauuuugaagcugggcagugguggcccacaccuuuaaucucagcacuugggaggcagaggcagguggauuccugaguucaagaccagccuggucuacagagugagaaacccugucucaaacaaacaaacaaaucugacaaagugaaaaaggugaguuggaggauagguaggaucaaaauacauaguauacauguaugaaauugucaaggaauaaguaagacauauuuuuaaaaaugaaauuaggaaugauuuuguggaggauaagcuguagacaguuguaaaagaaaaucucagggcuuuugaagguguucaaggagaggagcuggagcugcuucaguaauuaaaacuugcugcucuugcaaaggaccuggauucaguucccagcacccacaugacaguuuauaaccacccacaacuccaguuacaggauucacauagauaccaggaccugcacacaguaggugcacuuauauacaaacagggaaaacacucaaacacauacaauaaaaauaaauacauuuagcuggggugaggguuguguuuuaauccuggcacucagaagacaaaggcaggaagaucucugaguuugaggccagccuggucuacagaacaacuuccaggacagccagaccuacauagagucucucucuccucuuucuccucucuguccucucuguccccccucucuccuuccuuucccgaucccucuaccaccacccucaacagggccucacuauauagcuguccuagaacucacuaugaagaccagguugacuucaacuucacagccaccugcucugccuccaaagugucgggauuaaaggcauguaacccuggcuaagagaacuuaucuggaaaaauaaagaaaccucuugcuugcugauacucaaaaucucauuucacuucauuuguuuguugaugggguuuucuguuuugugacugcuuuugagaugauauaaauauguaagucuggauagccuagaagugguuauguagaucaggcugaccuccaacuuaagcaaagaacuauucccaccuccuaaaucagugguucucaaccuuccuaaugcugcaacccuuuaauauguuccucauguuauggugaccccaaccauaaaauuauuuucauugcuaccucauaacuguaauuuuguuacuguuaugaguuguaauguaaauaucugauaugcaggauaucugauaugugaccccaacuugggucaacccacagauugagaaccaugguccuaaaugcuaagauuucuucaggcaucaccacaccaggccacuugacaguuuuuugguuugauaguguuuugguuuuuguugugguuuuguuuuuuagaaaauaucaccuuaggucccuuuuaggaaacuguagggacaacuuggcauggugaugcacuuuggaggcagaagcugaccagaucaaccuauaaaucccuggagaguccuccugcccacccccaccccccccccccaccgcuccuccccgccccgccucccucccccccccccgccccucgccccuccccggccccaccaccuuccccguucgcgcaggcgcguguggaauggcagccugugcgaggggcggagcuuccggaggauaaggcggguucugggccgcagcaauggcagaggcggcgggcugguaacgcgaagguggguugaaaggaggaacagcagcagacaugcagacagcacacacagguuuaagccacacugcagauggcgccgauggucagacuagccgcuguuguccugguaaugcaggcacaaaggcaguuauucccaguggagcucacccuguugcaagagcacuggaagccucccgaaauuccagcaaaagcauggugccuuuaacccaaaggccuggaacccgacaucacagauuguauccuaccggacauggacauaucugcgggaugcuugaaacagggaagcggguagucuggaggaggguaaaaaaagaaagaaaagaaaagaaaaaaaagcagggaggagggaagcagagggacccgcugauugggguauggccugggcaugaaaaguuccuugacaacagaggaggggcagcaggguggagggaaaugagcaggaauggcccaagcaauguggaagauauagccuggggagcuuagaccagaugcgaugauuuuagagggguaaggaggcaaaguugauucaagauggugccuuuccugagucucuaccagcucccucuucgugccuuucccgaccucuuuggaggcagaaaucgccugugggucccuaguuccagaugucgaaccacaucgaggacugguagggaaggagcuuaaagugagcggcugcaugcuggagguguaaguguugaaagagucuaggaugcuggguaggugucugggccauccuccacccuaggcugcacuuccucagagacaucaucacacuagagugauuuuuaaggaaaggcaugaugcacuggaccagucuagucucuaccugcaguacaguggaugccugacagaugaagaaaggguaggagccaagagaaaggcagauggucugauuacugugaguuccaggccagccagauccacauagcaaucccuaagccaaccauggcuacauagugagagauuuucuaucuauuuccaaaaaaaaaaaaauaaauaaaaggaaagaaauaaggguagaaacuaccaguuugaauuugauguucuuuuccucacucuuagacgcuggaucgcggaagauucucgccuccuccgacuuuccaucaucaacuuucuugaccagcuuucccuaguggugaacaccauacagcucuuugggcccccaguuuccuguuaagccuggcuggggacccaugucugaccuuaucuccgucuccuccuaagcaauacaauuuucccuagggaaaagauucuagaaauaguaacuacuacauaaaugugggggccuaauauuuuuuuccugauuugguccucaggcacuuaggagccauuuggucuggugcuucaauguuuguugcugaagaaaauaaagcuauguugcuaaucugcauuugagcuuauuuucagccucuaaauuuucuuugguuuuuauuuuguguuggaggaggggcucuggaauucaggugguuucuuuuguuuguuuuuucuuuucuuuguuuuaaaaagauuuauuuauucauuuuuaugcauaugaguacacuauagcuguacagaugguuuugcgucuucaugugguuguugggaauuguauuuaggaccgcugcucgcuccggucaaccccauucgcuacggucagccagcuugcuccagucaacuccguuugcucagucccugcucacuccagcccgaagauuuauuuauuauuauacauaagugcacuuuagcugucuuuagacacaccagaagagggugucagaucucauuacgagugguugugagccaccaugugguugcugggauuugaacucgggaccuuuggaagaguggucagugcucuuaacagcugagccaucucgccagcccuuuuucuuuuuuuuuaagacaggguuucucguguagucuugucuguccuggaacucacucuguagaccaggcuggucucaaacucagaaauccaccugccucugccucccaaaugcugagauuaaaggugggcaccaccacugcccggcucagguguuuguuaguacaagguaagaguauucauuuaaaauguaugaagucuuugguucaauucccaguacuguaaaaauauauuagaagaaagugaaugaggauaauuucagaaauacaggaaaauuaaaauuccaugcgcuauggugguuugaauccuacaaagugauaggaaaaaaccaacuccuacaaguuguccucugaccuuggagaguguuugcacauaugcauaccacaaacaccaaauaaauaaaaauuuuaaguuuagcauuauaauucuucuuaagauuuuuuuuucaccuauagugcauuuuccuucuuucuagccaaguuguuuuuauuuuuugagaaagggucucauagccuaggcuggccucaaacucuucaguuucuuauccucaucucuacuuucaggugcugcugggaccucaggcauucaccauuaaacccggcuugugcauaaaaaauaauuuuuaaacacugaaauaggcauauauguggugcaauuuaauguaauuguugaauacuuaaaaaucauuucauucagccgggcgugguggcacaugacuuuaaucccaguacuugggagucagaggcaggaggauuuuugaguuuaagaccaggcaggucuacagagugaguuccaggacauccagggcuacacagaaaaacccugucucgaaaaaaucauuucauucuuccaauuuuucuuuuauuuuauaagagucucauauaccccagcuuguucucagacacauuaaauagcugggaugaccuugaaccacugauucuccugccuuguuuccugagaaauaauuuggauaugauucuuguaaauacauguuugaacaaaugauuauucuugauuaguuuaugagcucuuaguaagauuucuuugaauguucucgacauacccuaguaaauguacuccugaaaguaagucuacccaccagauacuguuuuuuucaaauucuuagcgcugcuaauauuucccccccuaaaccaaaugccaguacauccccucccaaaaaacuuuguuuauguaaaaacaaauaacccagaaauagagcuuaguuagcuucuccaccuuguaaggaaaagugucugacaucaacuccccauaaaacaugcccuacaacguggcuacccucagcccagugguuuauuuguacaugccaucagauuuucuguauagguuauguuucucagaauaaaagccauuguaccuuuuccuuucuacuaauauuuuuuuccuuucaucugaguugaguuuuccugcuucuuuguaucccuuggaggguauaugaaccuuuguauguuacuuugagggaaugcugcauggagcagagcagcuguguauagaaguaggcuuuucucauuacugaggcaugaccuuucugacccuuccuacugccauccaaaagagaaggcagcuacuagucuugcuuucagggcuaaggagaguugucacaggagcagauucuuuucccaggccuuagucucuuuccuugggugugagucaaugcauggguguuaggaauugaacuaggguccucugcaagaggaacaguugcucuuaagcacuaagccauacuuucagcccuccuuuuuucccaacauuaauuuuuaaaucucucucucucucugucucucucucucucuguguguguguguauacaagaguacagguaugugggggcuggagagauggcuuagcgguaaagagcaaugacugcucuuccagagguccuaaguucaaaucccagcaaccacauggcucacaaccaucuguaaugcuacuucgugcccucuucuggugugucugaggacaacuacaguguacucaugcauaaaauaaauacauaaaucuuuuuaaaacauuucccaaaaaaaagaaaauaaauaaaucuuuaaaaauaaauaaaaacaaaaacaaaacaaagaaagaguacagguauucauggaggccagaagaggacauugcaacuagaguuacaggcaauugugagauaccaugugggggaaccaaaccuaggucaucugcaagaguaacaagugcucuuagccucugagcaucucuccagccccgagaaaaaucuaucuuuacagcacuaucaacuuaucuugcccuccuuguucuccuauuaugagaaagggucucacugugugagaccugagcuuggauggccuggaacucuagaccaagauggucuuaaauucauagaaaucugcccgccucuaucuccugaauacugagauuaaaggcaugcaccaucacaucuagcuucaaaacugcacuuuuaaaaaauuauuuauuuugccgggcagugguggcgcaguccuuuaaucccagcacuugggaggcagaggcaggcggauuucugaguucaaggccagccuggucuacagaaugaguuccaggacagccagggcuacacagagaaacccugucuugaaaaacauauacauacauacauacauacauauauauauauauauauauauauauauauauauauuauaugaguacacuguagcugucuucagacacacuagaagagggcauuggauccuauuacagaugguuguugggaauugaacucaagacccuguaagagcagcuagugcucuuaacugcugaaccaucuguccaucccugagagacuaauucuuuuccagcagucauuugaugccuauaguucuuugcuagaguugggaccuugguagauuuccccauucuuaguaugucuauugauaucaucgauguucaagucuuguauuagguagccauauuguugaagugucaugguugugacuuccuugccauuucuaagagacacaauaucacagaugucuugguccucuauuagaaucuuuuugucuccuauuccacaaaguucucuuagccuuaggugcaggaguuuuguugaggcuaaucucucuacaauugguuaauuucuucauuauaaccaguuucuauauaacccuaacccugcugcaaagagaagcuucuuagauguguacugagagcuacacuuaucuguggguauaaguuuuagaacacaggaauuauguuggucuaguaaagcugugaugguugguucuccucugagacccaugaccucuccagcccugaguucucuaggcuagauuucuaguaccagacaugauuucucuuguugagcaggccuuaaguccaauuaaacagcucuuguuuuaacaccaaguuaugagugccacuauugcacuauagccauucuuuuguuacuuuguggguuuuucaacccccuaacacuagauaggagagggaaaaaaggguagagggagaaaggaaagaaaucccugaauaaacucagggguuggaaaggggacaacaggagcuggagagauggcucagagguuaagagcauugacugcucuuccagagauccugaguucaauucccagcaacuacucaguagcucacaaccaucuguaaugggaucggaugccuucuggugucucugaagacagcuacaguguacucgucauauauguaaaaaaauaaauaaaaucuuuaaaaaaaagaaagggacaacauuauuaaacuaauuccugcugauuaggggcauugaguuccuucaggcaaguuugaaucacagucaggauaucuaacuucuuucuucuuugugcacaacuauuuaacaagcuguggccaccaccaaucaaacaaacaaacaaacaaaaaaccucugccucuugaggccuuagcauuuauaugcccuccaaaaaguccccagaaugccaaauguuacacaaucauaaaaacuaucugcagcugguaaaaucacacuccugcuaaagcaugaggcaaauuauaggcagcugcuguagacaguccaaaccagucccacaugccacaccugggauuaaaagaacauuucuauuucuguauuuuuuaaaauaaaaaaaccaaaauccucacuacauuuuaccuuuagggcuaucuugccaugcugguuuuuaugauucauaggugucacaacugauuagagcuauuacuugcuucccucucuuggcagcuuguauagaccuuuugauaguauaaaagcuauuacuauuccguguagaugaagcuugaaauuaugaaaucuggaguuaaaugaauacaauggaaaaaauacuggaucgagugagguaacccauacucaucucucucagcuccaaauauucagauacacauacauauaagcacagaaaucaggaaaggaaacagggacuaugggcagggguacuagagagagaaauagcaggaugcagaugacaugaaggggaaaaugggaaagacgguauguggggggggcuuuaauuggagaggggaaggcacaucaauacaggaggaaagaagagggacaaauaacacuaaggauguuggauaaaacaucaaggaauagugucuguuugauauauuuuaauugaaguuaugccacuuaggguaagaaugcuccccauaagaguuauagacuaccuagcaaaaucccccaauaccaggcaugagaacaaguugucaggggaguuuaagugacuccugaaacaauauaggcuauugcugaagauaccacaugcuuuagacacaauauauuuuuuugagacaaaguaucucuguguagcccuggauguccuggaauucacucuauggaucaggcugaccccaaagucagauauuugccuuaacuuaucucccaagugcuaggacuaaagcugugugcgaccacugccugaucuaagauuuaguggguuuuuuuuuuuuuuuuuuuuuuuugguuugguuugguuugguuugguuuuggguuuuuuuuuucuguuuuggguuuuuuugguuugguuugguuuuugguuuuucgagauagcucuggcuguccuggaacucacucuguagacgaggcuggccucgaacucagaaauccugccucugccucccaagugcugggauuaaaggcgugugccaccaugcccggcguuuuuuguuuguuuguuuguuguuguuguuugagacagaguuucucuguguagcccuggcuguccuggaacucacuuuguagaccaggcuguccucgaacucagaaauccgccugccucugucucccaagugcugggauuaaaggcgugcgccaccaccacccggcuaguguuuuuuuuuuuuuuaagauuuuauuuuauguauaugaauacacuauagcuguucucagacccaucagaagaucccauuaaaaugguugugagucaccaugugcuuacugggaauugaacuuaggaccucugaaagagcugucagugcugagccaucucuccagccucucuaagauuuuguuuuguuuuguuuuguuuuguuuuguuuuuuaauuuauguguguguguguccuauauaugaguuuguguauaugaguucaagugccccuggaagccagaagagagcauaagauccccuggagcugaagcuauagguggguauguguucuuugcuaugggugcuaggaacugaacucuagucagcuggaaauauacgcccuuaaugacugagccaucuuuucagugccccaccaccaccaaacaagguaguuaaaauauuuucaauugagaauuucauauaauauucuguaaucauucaccccacccuuccuuagcucuucccagacccacuacugcuuccuuaacucccugauguugucuucuuuuuaaaaguaacucaagacgcauuugugcuuggagcaugguugaccuaugaagggccucucccagaagccgcacacucuugauagcuccccaguuacaggugggagcucaagaaccucucccccucaacacuugauuguugacuacacagccacagcuauaaaacaaauuuuuuaaccacuaggcacccucccuccccccccaaaaaaucucacaggccacuuguguuuuucaucuuauuuuuugagacagaggcucauguggcccaugcuggccucaaguuaagcauguaucugaggcuuuccuugaauuccugcugccaccugccaaguacuaggagcaaacuaucauuucuuauuugauuugucuuauguguguguauauccauguuccaguguuuauggguguaccuguuguauauauauguggaggccuggagcucauguugggagucuccuucuaucacucuccacuuuauucaauaagguagggguuuucaguugaacccagaucuuguccauaugauuagcauggcuagccagcuuguuccaguauacccuugucucugccuugugagugcuauaauuacagauggacuguccaaacuccaguccucaagauuguguggcaaagcuuuuuaucaaugagucugucuccuuaguuccaagcuaucccuuugaccacauaugcaccaucuaacaagugaugggguuaauucauagguagguucaguacaaugguaauuauaguccaaugaguugccacaucuucagaauuuuggguacaacugcagccauugaagaggguuuuaaaaauuaguuucauuuuauuuuauguguauaggugcuuugccugcauauaugucuaugcaccaagccugaagaggacaucagauuucuuggaacugaagucacacaaauuguaagcuacuaugugugugcuagaaauugaccugagucccauggaagaacaacuggugcucuuaaacacuaagccaucucuccagcccccacugaagauuuuuuuuaacacaauggagacaugugccuuauuucuuaauaguaucucuuugucuccaacuaauaaugggcuaaaggggucauggcaaaagcagggagcugggcauaucugaguggaaacaguacaugcaaggagaaggaagcagauuuauucagucuugaaacuagagccacaaggauugucuaauggacuauacauggccuuccucaaaucaucagaagucuucgugaguuacauuuuuccccucagugggaaucuaguucauccauagcccaacaggucuacccacuuucuccaaagacaaagacaugcacugaccccauuucccaacauuuaauuaggaaaaaauuacaacaacgaagaaaaacucaugcaacagaaggagagcggacugggggucugggaccauuagacagggccagauuccucaggggaagcaggaaacacaaaacaguaaggcacugccaccuuggcccuuaaggaugggcaugugauagggcagcugaggcugagagaguucagggcaagugccuacaacacugaggaaauuuggcaguagggacgugaggaaugucccagaggcccaggcccucaucaggcccaaucacagccugguuauaguucucucagagacaacaggccccaugaaaauguggucugacuccugagauaucugaagagggauauugcccuggccuggccuggccuggccaaucugagggcagcuucagaugcaucauccaaccccaaaugcugcugguacugaggaucucuucuuaggacaaguggggccugacacagcaaaugugagacgccagaggcugagccaaggcuugcagugucacaaaggaaccagaacaggaaacaggacccagaucaaccaaagaagaggucugugaggcuaguaacaucccauggggcauauauauuuacauauggaaauuaaaguggaauuacauuaauaaauagguggguaggaugucagagcaaggagggcaagggcucuucugacaugggaacaccagggcaagaggguggggauauugcugcugcuagugggggaagcuugguccugucauccccucccccugcagggcccaaagcaaggcacuaaugaagggggcccaggugugauggggcaucuuggcuugguaaccuccccaacaccaccagcucuggaucucagcccuggagacccaggcuagagccagacacuccccugacugggaggauggcucagaagcaagaagcccccuccucaccaucuccccacucagcugcugcuggacaccagggugaugaucugcuccagcuucugucgaagcuugugcuuccgacaagaggcaucucgguccagcgaggugaggaucuagaggaugaugauccauuggagcaagacuccaaggcagggcccuacuucugcauaaagccccugcuucccagaagugcucuucccucauuggcuucagucccugugccagccucaugcuccaaaccucucaccaaaacuacccacuuccccuugucugcaaauaccaccaccaacucuucuaccauggcucuuguauuguagccucuuuggagagugggcaauacuugcuguuuucaauuccuguucccuccuaacccaaacuccaacaucucuuuggcaaauuuggccaugacauccuucuugauccuggcucaggauaugaggcugauacuaccagguacuucuggguccccuccccauucccgaccaguucucucuuuccucuuugaccugugagucgcccagaaugcugugcuuggccagaucuccucuauagccccuugaucucccuuggugagcuccuuuuuauauauaguaucucacuauguaucucuaauuguccuagaacuugcuuuguagaccaagcuagccuugaaucacagagauaugccugucuuugcuuccugagugcugggacuaaaaguguguaccaccaugccuaucuagggcuuuaucuuuaguguaccugaucucuccugcacaucuguauuugucuguguacagcuguacauauggauacauaugcauguguguggaggccagagguucaauaccuggugucuuuaucauuccccaccuuuuaaaaacguguauagguguucugccugcauguauguauguaauaucaugugugucuagugucuucagaagccacagaaggagaccagauucccuggaacuggagcuagagggauaugugcugccuugugggugcugggaaucaaacucagguccucuggaagaacagcaaguguucuuaacugcugaaucaucucuccagccccuccaccuuauuauuugacaucucucauugaacauagaacucagugauugacuagugaguuaugggaaucugccuaucuaaaccacucaccagcacccauacccacacaugccaccacauccaauauuuuaacaugagugcuuagaauacaucuguucucacuuuccagucuuguaaccuuuauccagugggaccucuauauuccagcuagugcauugucuccuguauuccuuaaauccuagcaucuaaagaaauuauugcccaugcuggcccuaggcaagggauggacuguaaacaagauauaagauggacuuugucccaucuugcuuacaugcuugugugcuucucaacacaucucccugccuuugccccuaacuguaucaucaucagagccaugcaacuggggguccaugagguacaucaacguaccuccugacgguacuuggugacauagaaguagagcucgcugagugcacuuaggacauugaagucauuagcauggaggcgggacugcuccacuaaguaggcguccauguccuggucacugauggaugccaucuuugcgauaucucgauaguaccuauagagaccuugggugagugaaucaugcacaggucauaaaugccaaaacucaugccaucaguguuuggccagccucugaggcuuuuucuuguaucuggccagccucagacaggcuguuuaggcaguuccugccugccaccaggcauacacagcaguaucccagggcccaccucuccacccagcucuuguaauugggaauauccuuggcauagaggagcuuguuggaaggugaguccuugcccaggcggugcucugauguagaacaggaguccaugaaggucugggccaccacugacaaacaggcgucugugaugcuauucuuauggaugucaaacacaaauugcggauucuugaucacauucacccagaaacgcagagguaagcugaacagagggacauacacuugagacucccuaauggcccuaugugcccccuucccccacugccuuccuucacaccuuguccuguuuggccaggucauaucuuguccugaaguaacaggagagacuauuuuggauaaauggguuuuucuuuaaccuucugcugcacucaggcaaugagaaauaagaauagauggcuuucuguccucaaccuccaccccugaaacuuccacugucuccaccuaugccaagccaucagugucucuacccugcacaggacccuagagaaaaauggucaaucccagugcuagacuagcacuucccaucugcacaacccagcagcacccaccuucuauauacucauauucacuuccaggccauaccacugguccaucccuccugcauggaaggcuauucaguugcuagucaaccugucuccauuggccuggaggcuuggcuaaguaacuagccucuuccucccacccacccucagaagagccagcagcagucaggaaccaguaaguaccaguugcucuuccaggugugacgcacaucagggucacugaucuggcgcuggucagccuguucauccaggaagucaaacauguacuugauggccaaggguaaggcugagccccggugggcuguacugaacacaguuucaaacaagucaucuacaaacuucugcaacgugcccuaugagugaugguaaaggaaccaugucaggaaguucccaaaaucugacagacagggggcagaauagcucaguaaaaaaaaacuucucugaagggccaacauuccuaaaauagaccuuugcuugaccucaggcguagagguccuagugccaaggcccuaagaaagcagcucaucucauguuuaagacugggcuagaaggugucuauggggcaggcccacaccuugguggccagcagccuugugagauauauuucugagaccaucuugcugccgcggucuccuucucggugaucaguguggucgugguuccucaccaggugccacagcuugguaccugccuccuggucaggcgugagcauaggugcucgggaacggaggcuauccgggcugcuggcagcacggagcaagcucucuagggcagaggacagaugugacucuuaagcccuacaggcucuggccauuacccacccucuugcuccauuaucuucuagaagucuuugugggacccaccuauccuugccaccccucccuauuaggcucuauacaacugaagaccacccaggggcccaaaauaaugaaagucuuuccaaauggaucaagacagcuacuuggggauuccuaagauacagccuuaauuaaagggcacgggaccaggaaagccaccacaauauggauaccuaccguagcgacuaagugaccgggugaaggugaacgaguuggccauguuauaggcagacacuuguuugggcaccagugcuacuaaagaaccaucagucaccuggagguccaaagaaacagaaggagccaggggaccaccauucauucauacucuucaguauauauauguacaguggcaaucaaggcccuaugagaagcccucaugaguauagggauaagggacgagaggagaccuggccacuacuucuaggugucccuggagcugaauagguucaaaguuccucaccugguagugggccaaugaguugacccucuuccagucacacucaaucuuuguagugauguccucaucuuggaggaugauucgggccaugcggcccuggcgccauucugcaggccauagucagcucuuagggaaauucacccucacaaggacuuagacacauuccuuuuaaggaacagagcucagauacagaauaugagagcucccugggagggauuggauaggugggagcuaggagaaaagggagggaccuuacccaaauccauguccucagcuuuggggcgcugagaguauggaauacccuuguacacaguauccaacagcuugucuuuggccugggugaugcuaucacaguuaagaaccuucacagggaccugggcacugcccucgcucuccgggcacacacaaugcagagucuaagagugaaggaaccucagcaugauuccuaagcaaggcuccaccuuacuuccugcucgcauagucccaugcucaccagggucuuauagucgaucugcugccggaugagcuuguccucacuuaaggaguagcgggccucgccuguuauggcaucaauaggaccuuucuccaucugcugcuugauggcgcaguacagcaggaagaguggcuccccggcgcacuccuacacccaggguuaggggcauagcuggcugccugucuggcuuaucaaucaauugcucccacccccggacauuccucuccugcgacccagcccaccccagcacaccuucaggaacuuaugcagcaggaaugugaaccaguuggugagcaucuucucagccaccgacucuguccuaugguaagagauagguccuaaggcccuggccugacaagggugagacuugaacagagguaggggcccaagcaggaaauggaagacaggacuggaggagaggccaagcaagacaguuacauaccugcgcaauagcagcuuugggugguucuugcucucaagguuuuucucuaugaggucagccagcaguugcuugagcagcccaguggcauagucaagccggcucugcagggccaccauggugagugaggccacaguaccacggucacgcauggagaaacuacucugggccuccaaaguguggauaaaggugagcaggaaggcacggcugugcagcaacuguccaaauagacgcagggccuucuccacauuggggggagucuguggggaccagggaaucucagagaguagguagugguggcucuggggaaaacagaauaugggcaggcuuuggggguaggaggcucacauccagcuccuugagcacugggugagccucgaugccagggaaaagcacgcgcacagcauagguccgguaguccaagaaggggaucuggacaccauccaugugguuugucaguucauugauaucagucugcagcucagcaaaggcugggaaacaauacgguagagugaguugaacaagaagcaggaaagucccucagcucucacacaaugugguacacccccugcuuuaggcaccuuccuugcacuccaaggccacacgagacuccagguuguccauuuguagcugaagccgcuuaagugugcggucugcauccugagucuuacgcuuguaggcgaccagcacaacagugauggccagcagcaagagcccgcccccugcugcuagccccaccauagcugguaaggucagugcccgaucagcagugaugugcagcgugcccaaccagaacuccaggccacccaccagcaccuguaagggcaagcuugaggugaaccaacucccaugcacagccagggcugcccugguggccucuugagcccauacccaccauaacaggcugccggccugucuggcuuggggaaucacacagaaguugaguaucugagacaguuagugcacauggcuguccuccaaucaacacuguguaguugaggcgggagcugccagcugcagcagggaucagguucuugcccuaguaguggauaacccacacagaaacagucaagcacuccagcucucgguucuuccccuccuuucuacucccuauccuuauccccagcaccuucaauacaacaugugaaccagguuugacaucuagcacaccagagggcccaagugguucaaagcugggaucaggguaguaggugaaggaagaacgguugagggagcgggcugccugcacgugguccagcaagaagccaaacucgucagggugcucgccuugggcccgaggcugagggugcccaaggaagaugccaggggccuuacauagcauugcagugucguugaucaccuggcaugucugugaagacaacagcaaucaucucagcgcaugaagccaugaguagcaaugguagaacagggguagaaacccacuacucacguuaguggucucaauaccacgguacuuggcucguacacgggguucuugaacugucagcagauggguuccacucacagugauggaggugcuuccacugcagagauggguaaagagcucagacucccuuccccacccuguccaaaguuaccaaggauuuucugagagcucagagccucugaccuugguucauucagcaggugccaggcucuauaugggcaggacaacucuguggccccuacugaugagggcucaggaaggaggaaccacuugaugacccaaggccccaguaauagguaaggccccaagacucucagagccccaacucaguccucaaccccauucuccucagggucucacuugaugaugcuccaggugggcucaaggugugugaccguaggguccuggguguagguauagaugacuccaguguuggagauguuggcaugaucgauggcaagggugauagggcucugacuggggcccaggguggagacaggugagauacacacgauugccucggcaucucuccuacacagguaagcagguaggcaugaagcagauggccuggcaccuucaccuacccugcccccauagucuuucacacaaucagugcucaacuccagauggcuugugcucaggcccaccucacaaacuggcacucgccaucucuuauaaucacugugacccugcugccggcauccagagaaauuccagagaugguaagccgagugccuccagaagcugggccccgagagggacucacacggucaaauguaggggucugaggaagaagcagcccuugagaggagguagaagccagccugauccaagggacacuccacauuuucccagauagggaaggggaaggggcuaguuagaccacgcaccacaaagcuguagaguugcugggacugugugcggaagucagcagaacaauccccuacacagagcucagcaggcccagguggugggcugggcaccagcgauuccuccaucucacauacgauccuaagagucacagaaggucaggaccagcugugguaaacaaggacagggugcucacauagccacacucaccuuucagcacugacauauucggugggaauggaguugcaacguacaccagcuacucgaaggccaaccucacgggaagugaggcccagguucucacccacaauggugacccgggugccacccuccuuggguccuguaaguggaugaaucugcagagcaggagaagaagcaagaagaucaggccagacucacacaugccuaacaagcaagguaggauuuguaggugaagcuaaccugggugauucggggauggcugcaucgggcacccuucuggcuugggugcauccaguuacuuuugggagcugggcagugagcccucagcuggcaccugugcucugagaugcaccagccacaguugaaucggggaucagccuugaggcagaggccacagcuaggccgcugagcccagcacuuguaaagaagggcugcaggcacaggagacuacugauggagcaggcaauggcagaaaagcagggggcucuaggaccuacagacuugcccccagcagugccaauccugccccaggagccaugcuccuuggccccaugucaccccucaccucggaagcuaggaggcuuaucaauggggaaaucuccaucccaaaccacagagaaguccaguucggugucaccaaacucaucaccuucauagaaguacuaagaaaaauggaaccacaugagcacaaauaagaugagcaaaauccuugcccacuuuaggaaucccuuauaaaaaaaaaaaaaaaaaaaaaaaaaaaaaaagguuuccagauaaguaagcuaggcauagaccaaaaccaaccaaauacaaaauacaguaaaauauuacacgcacacacacacacacacaccacaaaacacaaaaauaaaacaaaacaaacaaacaaaacaaauuauuccuggcuggcccacccugcacucugggucuuaccgaggcauucuggcacugcacacugcugcuguuaaagcgcacugcagguacccgauguugccgucccuguacacggaccacgcauucauaauucuucuguccggacugaggcuguggcagguucuuagcccgcagaguuagaggcugcaugacacccacaggaaucaagagguccccuugaggcaggaucucagggcagcccugggaggagaacacuuguuagaggcacacuggucuacccgccuucuccaggcccauggaaaugggaggucaaacaaaaaaugugagaggccagcccccaaggagcccagccucuuccacggugcacugcaccaccucaccucagggcuguggacccugcccuccuggaaagagcacucguguggguggcugguacacacaugacgguacuuacaccaguggcagggguaagggcugccaacacaggacauacaccuggaggggggaguagcuuuagaaauaacagaggucauaccgaccuguaucacccacccacaagacacauuggggaacaaaugaauaggguaggcagaaccugcccaagccacauagggcacaucaggacuagacagaaguggcgacagcaggaagucccaacaacucaccccugaacccuagagaaaguuacagugcaauuuuuauauauuucagagcacuuaucuacuauccccagggcuagggacagauucuggaccagguacucacgacuggagggcacugcaguuguagaagacaaagucaaccccagcaaaccucacaccagucuccauggagagcagcugaagccgcacaguaugaguggccccugcagcaagccagauggcuauugccaacuagucuggaauucugcccugccccacaacaccccagauugccccaucccacugaccaugcccucugguaagugucuggagcuccugaagggauggugaaggacaucguaacucuccagagggcagcagaauagccucacuuucagucaccuccucaaaggaacagcucacacccacacugaggucuggcacguugcgcauggcuacggucagcuggggaaggcagaggguucagagcagggugcacccucccucaugaagcauauacagggccaaguauccucuaugucacuuaccugcaccccagaggaugucacugacacauuauugggacggacccgcaccuguauacauuugcucagcucuucugcaaagccauguggggcagaggcaccuggacaggccccuucacggcagcaccugcauggagacaggccagagcaguccgagcacugucccaggagggcccagaugggggugcaguaagaggcugaggugggacagaagacagcauacccagcucauacugccaggcaacaguguaccuuggccucauccccugagauccaagggacgucacucaggguagaaguuccgcucauuagcuggagaaaguggaggagaagggaggggggaaggcucaaggcugggaaaaacugggcaggugggugaaggaaaguauagcaaguguggcuggcuccuguccagcuggcaagguccuccuaaauccucugucucccaagauaauggccccagggagcccacugcugccccacaucccacacccucuucccucaccugugcuguagcacacaccaaccacaguguggguccccugagcccaggcaugcagcacagcucagauacugcucacaggucuccaccgggaguuggcucaccuggggacagccacaucagcacacagcccacccuugccccaccacacaccaccacccaccacgggcccaccugcuucucacucaggagguagaugugucgguggucagggcugaagagcaggucucgaaguauggggcugcccugcaccacagagaccguuucauauagcugggcauccugagagccaucgacccgcaccugagccacaagaccaggacagagaaaaugacaagccagcuucaugcuaccauagcucccugcacccagagcacgcucuucggccagggacuuucuagauuacaguugagcuggucagauauggccuccuugagucuguauucaguuuguaggcuuauaguuccaacagccauagccuuagacuaagacaaaugcuaccuucgaacaaugcuggcgaagguagauggcagaggagccaccaaaggaacaggauucaguucuuggagccuaaccugggaaguuauuacacccuauucaggguuauccaggcucauguucacauucugucccucagcccuucuucccauagugugaaaaacauccccaaucacauaagacaaggguucuaggaccaaccuucuucaaauuaccgcugcguguaccgaugaaaaccacagaaugcuggugguagguguaggcagccacacuggccaugccaucagugcugucagccagcaaggguagccccucaaucacguguaggccacccaaugguugauucaacacuaacccacagaaguuuccauugaucugcagaggcuggugacacaggaggggugagugagaguucaagcuaaacagaugcuaucagauuucacauucuguaaaggagcagaaccuggaagccacugcccuccagacaugcuugacaguuuguuuccccuaggaccccaugggaaaaugggacuggggauggaaagucggggcaaggaggagaagccugacccuguuagacuugagauagagcaaggagaaaggugggaaugaauauagaggcagaaaaggaaaauggcaguauacaaacaggacacuggccaagagaaaagaagagaaaagagaguaaggcucucaaguaagguagugugggugucaaaacuaaguugccaaucccaugaucaugccaagccuaggacuggacagacagccacucagcagaaaggcagaaagccacagagcugucauauccggcacagggacagcagggcaagcaaagggcucacgguguugaugcagggcagcuccuuauucaguagccaggguagggccagcgugcccucuccacgguagcacgauuggauucggcgccggaugugggcauuaaugcugcugagggugaaaaggcaaaggauggucugccgagguggguuggcucuguucuucuggcccugagagaagauggugaagaggacauccucgucggcuggcacacccagagccugggccaauagcaggccuggcuuggccagaugggcacucugcaccaagcgguacuccacaccacgccaggagcagccaauagggaacucuacauaagaguagaacucugaguccccugcacacaugcgcacgaucuuggaugugaagaauuucucgccugcuguauccaacagcgucugcuggguguccagcugcaacguuaagaaguacacgaaggaggcacugacaaagccauauauguaguagaugucaaaggcaggguacaaggacaaugugucugaagggaucuugaucugagaagagacaaacucauccugguacaccuggagauuagaacaaaguaugagagcagggugaaggcccaccuucacuucccaacccuguuccaacaaugcgguuuucuaaaggcuuccccagugaucucccaucugccccaccuggacaauuacuggauuccaugccacagagugcaaggugaccuuagccucucuauagacagacuuuccacagguaaacucugcccaucuuccuguccucaacagcuggucuacaucuaugugacagugaagggucauaaauuccucucucaaaccaaaguuuuccuaagaagcagggccaggacugagagaaaggagugaauaagaccugggcucauaagaaccaggggaaagaagacaaaagcaacaagcucacccaccagacugaacauaucuccacuguccucaucgucgaugagcuuacgggaacucaaggugggaaaguacucagacuugccaucaacagcggugcccacaaacaacuugcuaggccccuggaccuguucaacaaugacgccagccauggaaucaggcuccugggccccugacagauagugcuccuugcgaugguggggcucacccaacuugaagaggucauccagacgcaggaacuggcagaugcccugccagaugcugccacaagcuaccaaacgacgggcugcauagucuaugaggagcagcuuguucacauuguccacaggcaccaggcggugggagcacacacgcaugcuaggagguggguagcagcgagcauuguccucaaugggcccugugacaugggcccguagcucaguuagguuuggagccagcuugaaaacucgauucacggcaccuacaaacaccuccccagucacucggugcacagccaggugagucagagugguaucuguuaccacaaagguacgaaauggccugcugcuacccaggcacccuccuauggugaagaauagcaaugggagaaggcagacagugggcaugaccagcagcuguaacgagggacaggccugaggagagacagcaagugcaaaucagccccaggcccaagcuacucucccuccuucugcccugucugacccagugaaccuggcaggccagguucagugcuaucgaggggcaggcaacucauccaacaugauaaagccccagauggugacugaggcugaaagaggggaggggccucuaauagggcaaaugaaugagugacaagcacaggcaagcuugcaggccaucaaucaucucccacuccuguacuggaaagaagccaagaggccuugucucaacugggccacacccaagggggcaucagagucagcugcuagaaaagauggaauggaagguucucccagaacugggacccuaacauuacacacuaggaaaugcagggagagaacaaacacaaguuggggucaggggugcuucucuguuaguggcacugcuagcaggaguccuagagcaaagcucuggagaauuaaggccugagacugguuucagugccacuacaucuccaacucauggccucaggugcuuucucccuuugagggccuuggcugcuuauccaggagucugcugucuggccuuuccacugcaacacaaagccaagacucucgcugagacagacaucagucaagcuuugcucagacacaggcagacaaaugcucugccaggccuguguggcucucccugaagagccaaagguuagucagagagggauauuggcagaaggguauaacccacuuuugagagucccagaaguauuauauguagaaaccagcauccucaaauacaguugaagccuuaaggcuauggaguacuaccccuuccccuaaacaaauagggccaaugcuggcauucaccccccgggccacacccagccagccccaggcugcaaagacagcagagcagugucucuguaacuaauggggcagagcucagugcuacccucucagugcccaauucccaagagacacaggagggacucagaaugggguggggggugggggccacagcaaagagaaagaaaagccagcauuugcuagaacauggagcaauuccagcuugaaagugccaaguuucagcucagagugaucagcgcucuggggcucuuuugucgggucugcaucccagaccccucaugcaacaaccagagaagaaaggaaagcaaaagagaaaagcgacugcacccuaccuucaccucuucuacacucuacagaaaagccaaauuuuaggaacuggccgggacagguuggaaaggagaccuggaaagugguaauuggcagcccaagaccccaccccagcccccaccucuaaguggcaaccucaagcaucacagucgcacccagccccucugcuacaguccugccagcaaagagcgcgaugaugaggaaagcuccauauaaauaugcagguccacagcccgcucuuccacaaugcuccccucuaugccaugaacccaaccaguccugcccccaaugggggcacccugagcagacccgcagauaccuuagucaauacagaggcuacagcaaugcucagagaugcugcuccuccucuacaaaaggguucuaucaaccaauaggacuaugaucgaguuggcugucucuucccgcucaggguacggagugcuuggcaagccuggucuggagagguagggagggacagggccugaccccagaaaccaucuggacccccaggcugucugaaaccucugccauccagcagacuauuggcgcacaggcuuuaaggauggcgaccaccuaccugucccuccaccgcgacugacucgggguggccacccguggccacguggacgugcccccccgccccgugcccaacagccgccccccucgcuuggccccgcagccucgccucgcacgcugcaaaaucugcaaccgccgccgcccacacacugggcuggccugcggccgccugggccuuuuaaacccggaccguaccaccacaccgggagggggcucccagagagggcgggccggggcccuaagaagcagagcgcauggcgguugggggaggccgcuaggcccuggggcccaggacucuagugcaagaagcaagccucucaugggucucuggggaucccuuccugagaacagcccccuuugcucaauggcugaguccuaggcgcgggccucuccacacccccagcuccccgccugcugccuucagcaacccuggaaucugugcgcggccgcgccacacccccuugggccuggagugcgcgccuccaggagcccguggccaccugcuacuguugcaagauauugcuuuggccgguccaacaaaaccgcacaaacaaagauugcccccuaacucagggcucuuucuccaaugauccauaaacuggugggcuaauacccgccacgaagcuuggaguacugcaacuuauagccauuuucaccuaguucuuuccucagcaagucaccaugacucugaaucugcugaaucugggauuuaauuccauugcuuucucuuuuuuuucuugaauuuauuuucccuuuaguacagaguggucucgaacugacuacccuucugcuucauccucccaauacugggaucauuaugggucuaugccaucacagcugcauuuuuuccauguuguguugagauagugccuccuacuguaccccaggcuggccuugaacuuacagugauccuccagcuucaccuucccauguucuggaauacaaguauuuuccacugcuacaguuauucuuugugugugcaugcgcacgcacccaagaagaccaucugagagcauuagacaccauagagcugcaguacaguagcaggugcucuuaaccauugagccaucuuucuagccucuuuuuuuuuccguuguaaaccgcuuuauugagauauaauucaguuuucauauaaguccuguauuuaauguauacagacaauucaguggcguuuuaauauaauccuaaagaugugcaaccauuucugccaucuaauucuugaacauuuucaucacuucuaaaagaaacucuguaggaguuagcuaucagucucaauuccccucauauauauauauacccaagcucugggaaacgcucuguccuuacugacugugggguugccucuuaaggauaucucaaauaaauggaacuauacaauauaaauauauuuuuaugucgacucauucuuuuaauauuuucagguuuugucagaguuguaccauggaucaagacuuccuuuuggggccaaauaauauccuguugcauggguaagccacauuuuauuuauucuuucaucaacugacacauuuuuuuguuuuccucuuugggcuguuugcuuacuucuuuguaugugcuugggccagggaguggcacuauuaggagguguagccugguuggaauaggugugucacugugggugugggcuuuaauaccuagcugccuggaagucaguuucugcuagcugccuuuggaaccagauguggaacucucagcuccuucagccccaugccugccugaaugcugcugugcuuccugucuggaugacaauagacuaaaccucugaaccugugagccaaccccaauuaaauguuguccuuauaagaguagccuugaucauggugucuguucauagcaguaaaacccuaagacauuacuagaaacacuucuauguauuguuuguuuagaaaugaucauauaacuuuuucuaccuuuaccaccauuccaaaaauugggauugcacuucuuuuguauucauaugugucaguacaugaguguggaaagcaucuguacuuugcacauguauggaggccagagcagaacauuuguugucuucuucuuucccucugugacuuauugucacuuguugcugcucccccaaaguuguguuuguggaugcauguauaccuaugcuugacuuucuacaugugugcugagaauucaaacucauuuucacaugcuuacagagcaaagguucuuaccugcuaaaccaucuccccaaacccucuuuuaggauuuuugagacacuuucuguguagcucuguaacucacugaaauguagaccaauauucuucuagguugucuuuaaacucgcaguaaucucccugccccugccuuccaaguucugggauuggcuagaguauugaguucaauugcugacacuguuuucaaugaauaaggugaagaacagcauccuaaaauacaugaaagaccaggaaaauguuuauaugcuuauauuagacgguauauaagugcuuauauuagaugguauauaaguguuuauaugcuuauauuagaugguauaaagacuauucuuccccauauauggaagguaccuagauucuggauuuuuuuuuuuaagauggaaggcuaaagaaaugacucauugguuuagaacacuuauugcuauugcagagaaccuggaauugguucugaguaccugaaugguaacucaaaaucauuuguaacuccaguuaacacccuauucuaaccuccaugaauaccuaccuacacgcaaacaaaacucucauacauagaaaacaaauaaaucuaaaauuuuuuuagagaggcugacaagauaauucacuugcugccaaauuugaagaccugaguuugauucuuacaacccccauauagaaagaaagaacugaguccugaaaguuguccucugaccuacauaaacacuaugacaauauucacaaacacacacacacauacacacacacacacacacacacacucaaacacagauguauaaacauaacaaacaaaagaucaccaaaacuuggcaugguugugcaugucuauagcccccacacuaggaagguagaggcaaauacacauguaggcaaaacacccauacacauaaaauaaaaauaaauaaauuuucucugggagguaguagcauacaccuuuaauccaagcacuggggagguagaggcaggcagaucucugaguucaaggccagccuggucuacagcgugaauuucaggacagccaaggcuauguagagaaacccuaucucaaauaaacaaauaaaccaauaaacaaaucuucaaaacaaacaaauauauauguauauauauguuuauauauauauguuauauauauauguacauacacacacacacacacacacacauauauauauauauauauauauauauauauauauauauauauauauccuacacuucugcccccuugccuccucaccaccugaggcaggcagaggcaggcaggaagcuggcccugggauuaugagagcugaugagguguccccacccuucaccagcuuguagcacuugggagagcagguccugcaccucaacagggcagcacauuagagcuggccaagggcaugagaaggaaaacuggcccaacuguucaccagcugcagcacuuaggagaacgagcaaguaucucaacugggcagcacagugaaacuugcucuggagguaugggcacaggugaaacaccccaggggcauaaaagcaggagcagauccugcuucuagcugauggaggcauuggguggccuagccugaggaguucuggagagcucacccugaugguguggauaugguagaacuggucagcucaguuaccuaacucaggcccagauccagggcuuugaguuggcccaccacaaaaucuacaucaucugugaacugcugcagcugcaagauauccaugacacagggcaacaacaggauaacuggaaagucucuguaaauaucuaauauugauggugugacagaagcuagagaccuugaacuagacuaaugacucauugcaaugaacuuuacaagugaagauguguaaacaaaagguuauacuguggggcacacugugacacaccagagcuuccaugaugagauauuuucuaagcuuuguuuuauucucucucuuuuuuuucuuuugagggggacauuguaagggcagaggguggauacaagaggacagggagaugagugggaguggaguacaugauguaagacucacaaagaaucaguaaguuuuucaaagcaucacacuugagagacacugucucugugucuuccaugugagcuuagcuaauagguacaaagccuggcacucugcagucaaagcucaggggaucuggugcucucauacugcuguugggguugcaaaacagaacaaaccuugggaggaaacuguugauaucuccaauauucucuauauggcauaacaaauaacaaggcuaugcaugugugauaugaaaagacagguaucaaaugacacacgggaccagggagaggaguguguaggcaaucuacacuuuguauacaaaaguaugaggcaggaugcauauuuauacgcuguuaucuuugcauagagagacagaauggagaaucaauggguagaucacauccaaugugaucaugugguaacaagacugggccagaacccugcugcugggaaugaaugagguaucuugcuaucugccauccaugcuggcuuccagcugaccauucaagguaaauaugagggggauaagagcauuguauuaguuacucuucucacuacuauggcauaauaccuaaaggaaaaaaaacuuaaagaaagaagaguuuauuuuggcucacaguuugcaaaaagaccuggugauaagguaucuaaucauacugaagcagagagugauggcaacucacuuucuccuuuccuuuccuuccuuccuuccuuccuuccuuccuuccuuccuuccuuccuuucuuccuuccuuucuucauuuccuuucuuuuucuuucuuucuuuucuuucuuucuuucguuucuuccuuuuuuucuuuuuaaaauuuuuuauucaauuuggaaccuuagcccaaggaauggugcugcccauauucauggcagguguuuccuccucaguuaaaccucucugaaaacacacuuaaagacacaccuagaaaugucuccuacaugauuguggauuucguuguuuugagacaugcucucuuguagcucagguuagccucaagcuuaccauguaauuaagggugaccuuaaaguucugauucuccugccucuagcucccuaguucugggauucuguguacaccacuaagucuacuugauggcuucuugucauuuaaauaucaucccacuuuccagaccuuucuuccucucuccccuaaccccugacuccuuucguguauaguagugcuuugcagcccaugcuagccucaaacucguaauucuccuguccacaccuuccuaccucauaucaugcuacauguuagugaugcccuuuggccagaaaagauccaucauuuugcuucauuuuucauuucuuuguugcacacaagugauaggaaauaagggaugagaguguuacuuaguggcagaguacucucaguguaccuccagcacugcaaaagaaauauaaaaugaaagaaacaggaaugaaaccuaagcaagcagaccaauagccucccuucucacuguacuaccucuguacacacucuacaccuacaccuguuccuuggugaacucaugaauuucuagaacauagcuccucuacuucuuucugcagcucuauguucucuucugaucucuaccucugagacugugucacaccuaauuaacccuccucaggccaguacuagucuccaagaauuagcuucauacagagacaguuaaaccccaguggccacacagcacaggaaucugaggaacuagccccucuaguuguacucuuccagcuuggccucucugaugguuaguguugucaacuugucuagauucuagacucacaagaucgagugagauaggagaacccucuuuguggguucuucuaucaugccaugggcuagaguccuggaaugcauaaaugaaugaaugaacuaagcugaguaccagcuuucaccuuucccugcuuccuggcuguggaugcaaugugaccaccucaagcuccugccaccaugcuuucuuugccaugauggacugcaccaucaaacugugagccaaaauaaacccuuccuucuuuccuuuaaaaaaaugugcauugguuuuuuugccugcauauauauaugucuauguaaggcugucugauccucuggaacuauagcuacagacaguugugagcugccaugugaguaaugggaauaaaaccccaauccuuuggaagagcagcuaauacuaacuguugagcuaucucuaccaucucuccagccccccuuccguaaguagcuucugucagguguuuuacugcaacaagaaauguaacuaauacagcccaacauuucagacaaagggaucuuguguuccaccauggaacaccauucuaugucuucauuggccacaagaaugugaccucucuagccaggcauguugaugugucucauuuaaucucagcacucaggaggcagagacagguggcucuuugugagugaggccagccuggucuacagaguaagucccaugauagccacaguuacauaaagauucggucuuggggcuggagagaugguuuagugguuaggaacacugacugcucuguucuuccagguguccugaguucaauucccagcaaccacauggcggcucacaaccaucuguaaugggaucugaugcccucuucuggugugucuguagacagagacaguguacuccuauacauaaauaauuaagucuuaaaaaaaaaacugucuccaaaaccaaaacaaacaaaaaaguagccuuuuaaaaaagauuuauuguauacaguguucugccugcauauaugccuguaccccagaagagagugccagaucccauuacagauggcucugagccaccaugugguugcugggaauugaacucaggaccucuggaagagcaaucagcacucucaaccucugagccaucucuccagccugaaaguagccuuuuuuccuuacaaacucuuauccuuuuaaucuugaccuuaaggaauucccaggcacuugaaguuguuuccaggaaauagucuccuccaugaaaacucaggaucgaacuuuuaaggauuuccuuuucuagaagaugcaggacuagagguagcuccuaucuaggugugaccuaccuaggcucagaguccuuugggccucagaucuauaugaauguagaguucagggaacucaggggcuaaagaagggacuugaagcacuaauacauggaugagauagcagagaagggagucucccuccagagugccuucuuuucugaugguuucuuaaaagacagauuggaguuggcaccacagaggacuagaagauucccauccagggcucccaccagcauauauauuaggucuagcuaccuucuucaauguucccccuaagguacccugaccuacucuacucuaccuucugcucuccuccaagugauauuagacaucucuaccacagguacagggucaaggacauaagagcucauagcuaguagccaggccuccuccaaucagagcaaagcucacuacauaguaccaucagauauucauacuugcagggaaacaaggugcucuucauggcacaaacaagcaccuggccucaacaaggaagggaaugucaguugacauuccauacuuuccaagcaggucagccugucuccacuuacccaagaggaacugagaacuggccauugagaugucagggccacugguacuagaagcugaggugcacugcccaccccuagcuggauucugccccugaagcuguagcagugcccaugcagcugagcaggguagacagauauggcaaguaaacagugacuucaaggccccauagcagcugugagugcugggacuggggagaagcugggagagguugcuuggccaagaccccaugggaaaugcauuuaggaaacacaagaugacacaaggacauggaaagaggcuuaaauaaguauucccuuuccauuccagagcccugggcaagccugaggauuuguccucauuuuaaagaacagaauagccaggcaguggugguacacgccuuuaaucccagcacuuggaaagcaaaggcagguauaucugaguuugaggccagccugguuuacagaguaaguucuaggacagcuauggcuaugccaaaagaaccugucucaaaaaauaaaauaaaaugaaugggugaaaugaagaauccuuucguguggucuguggaagagguugacauaggaucuuauuccacaguucaggcuggcauggaacuugcugugcaucccagguuaaucucaaacucaugaucuuccugcuucugccucccaaguguuaggauuauaggugugcaccauacaucugguaaaaaugaccaaaauauucuauaaauuuuauuccaaguguuuuacagcugaggagauagcucaguugauaaagauguuugccuuacaaacaugagauuaugacuuuaauccccagaacccauauuuuuaaauaacuauuuauuauuaauuaauuaauuagugaguaagaacacuguaguugucuucagacacaccagaagagggcauuggauaccauuacagaugguugugagccaccaugugguugcugaaaauugaacucaggaccucaggaagaauagucagugcucuuaaccacuaagccaucucccuagccacagaauucauauuuuuaaagcccaacauugacaguauacauguguaauuucaacacuggagagguagagacaaguggcucuauggggcucaccaaccugccagccuaguguacuugacaaguuccaggccagugaaagauccuguaucaaauaacaaaaaaguuggacaacagaauaacaaccaggguugucuucuuguuuuuacaugccucccuccaacacaaauaugcuauaaaauaaagcgcagguucuuauaaugcaggcacuccagcuccaacauguggacuuuuuuauuguaaaagggaaaaucaguaaugauaacaucaggucaaggaauagcaacuaccauccucacagagggcucuggcauggucaccugagcccuggagacauggaggcacgcuggggagagccaaggucauguccacuuuuggaugcucaccggaucuggugugaggaaaaggggacacauaggacaaggaaugaaagccaagaaauaaaauaagcaggauaggcuagcauaccacccuauucucuacucccugucccuucauuccucuccuucucccucccucccucccucccucccucccccucccccucuccgugugugugugugugugugugugugugugugugugugugugugacaggagucuugcuauguagccuggguggcuggaacuugugcucgucuugccuuagccuuccuaguggugggauuacagguaugugcuaccaugucauacuagcuaucucuaguuuccuagcaagaugacugcagggccacugagagccaggaugaguccuacucucugacugaguugccuaguccagcaccagaaccacuaagaagagucuucccaggaccuauccuuccugccugucuucccugccuccuuaccguguacuugucccauuucuuuucugggucauagggcucccagcgacuggcaggaaaaaugugcuuguucuucucauaccagcuccuuagcacuacuuugccugcaugugacugaggaaugaaaguugugauucaggaccaucuuaccugaccuugccuuucuguugacuucuccccaagguuaaccucccugacagguucagggcaccuuugccugcccagugccauggcaccaucauaccucauccuucuccacaguggcaucacugagcagucguacaucaucaugaacgucgaaguugaagaguggcccuguaggagagaagcaguaagcucaaggccaugcuauucuccuucaauauguuggagcaaguuacagggugaacuaagauagaauuacucaccacuuuuuccucgugccuugguaacgaugaagucauagaagcugugaugcuaggagcagaggaugagaaagaccagcuugauaauccuucugggguccuaucacccacuauuccccauaccucuaccugcagguaucacugcguucagcagcccuggaagagugcacagcaguauggugacucuccuaugaaagcacagagugcaugacccaggguugaaggaacucacaugggggaugauuaaauccuccuugauguacaugagcuguuccaccccugcugaccuacaggaaaaagaggagaggacaacaacuagaagucaucagaguggccacaaggggccaggaagugcuggccacagugcuuuaagccuuaaaguuuaagggaagcuguguaguuuaaugaaucugggacgggaguuccaguguccuccacuucuggaccauaccaccaaggcagggcucucucaccuaugcuuucuacagcaggaagguaagaaaaaagagcacagcucuccuuuuugaggauuucagugcccagcauuccgccuucccagcuguggagcagucagcaggguugucugaugcccuggcugggaagucagccuccucacagaugcacagcacaggcacacauagugcauccucugcucaccugaguucacugaagucuuuccgcaagaucucuagugcuuucuguaggaacugcugcaucguguugccuuucuucaucugcagaaguagguauacuucaaguugaaaagaaaaaacaacagcccaaagaaauacuuccaagaaagcagagacccacccugcuacccacagagguuucccaagucaagacugucaguuacuuuccauugaauuuaagccaagggaggccuucuacugccuaccuuaacugugcgccggugcccagagccaucccaguaacuaaaggugauuucaaucucuucaccuacaaagaagaguugccuuauccaggugauggugcaagccuuuaaucucagcauuccagaggcagagagaggcggaucucuaaauuaaaggccaaucuagucuacaaagugaguuauaggacagccauagcuacauagagaaacccugucucaaaaaacaaaacgaguugccucuuggucuccagaccugagguuacaguuuccuugggguauauagguacauaccuuuagguauuugcaagaaaacuguuugggccuuagcccuguucucucacugccccaacacuggaccacacauugggucucauguagccaaggcuggcuucaaacuagccauguaguuaaagaugaccuugaacuucagacccucuugccucagucuccuaagugcugggugacagacagaccaagccaccauauguagcuauagcacucacucuugauuuuuuccugcuuggcuucccacuccuggcgcagcucuucccgaagccgauucuccuccuccuaagacaaaauggacaaaugaugagauucagggcugcucuaggugcaguauuaaccuaacccugggccagagucuccaccaaguucaugaucaacaccaaagucaguaccagggccaagcaguuuuuaccucccggucccggucaggcaagaagcuuguguccacaucaggguucuuccccaauuucuuuuucuuuguggugaucucuaaggcaaacaaaacaaagaacauuuuauuuuuucagaaaaugauucugugaguuugccuuuagacauaaucacguuuauguagcccuggauguaauucucuauguagagcagggugggcucaaacucagagagaucugccugccucugccucucaaguccuaaaaucaguguaccaacaugccuggccugaaaaugauuuugauuuaacgaacauuuaugaagucucucaggcucuuggagcuugcuuuaagaacuacugaccugggcuggugagauggcucaguggguaagagcacccgacugcucuuccgaagguucggaguucaaaucccagcaaccacaugguggcucacaaccauccguaacaagaucugacucccucuucuggauugucugaagacagcuacaguguacuuacauauaauaaauaaaugaaucuuuaaaaaaaaaaaaaaaaagaacuacugaccuguacagccaugguggcacauaccauuagaacuagcacuuugaagaauaaagccagguggaucuaaguuuaagcccagcuugguacacacaaugagugccagacaugccaaaacuacagagaaacccuuucuuagaaagaaaacaaacaaaaaacaaaacuaacaaccuagauaaauaauaaacaugaacuaaaacaacaacagcaaaaaugucagggcgcuggguauccagguccuugcuaagaccacaaaaugaaaucuccaguuggaaggggaagauacaccaggcugugcuuuucaaaagcuccagugaacuagaugauguggcaaauaccuguaauccuagcacacucagaaggcugaggcaagagcaguacaauuuggaggcuagccuaggauauauaauaagacuaucugaccuggcaugguggugccuuuaaucccagcacuugggaggcagaggcaggcagauuucugaguucgaggccagccuagucuacagagugaguuccaggacagccagggcuacacagagaaacccugucucgaaaaacaaauaaacaaccaaaacaaaacgacuaucugaaaaaaacaaaacaaaaccccagcgauacacagugagauugauaaccuuuccacuagucugugcacuauagaacagcuccuaagguggaagcaggauaagacccugucucaaaauaaaugaaguaaacaaaacaaaacacaacacuacuuuauacauauaccccugaguacuacugaauauguagcuagcuaaauaaggaguaaugguauuauuucagauacuguuggguuaaauguagugcuaaaauuacuguggaagggagcaguauaguaauucccccgugcuuagggaaagcagcaauucugaguguccugagcccauacugacccuguggccuggcaaggcacagaacagaugugcauacauaggguuguacuuuggaggcacaggauuucagcaaguguagauccaauucaccaaucacaauuaaucauuguccaguggcugcucguggugagcagucaccauacuugacaguguguucacaaacauucccauuacuucagaaaguuuuagcaggcaaggcuaguccagauuauauucuccccuucuuaguuuauccuaugugcugcaaagaacagcuucuggauccuuuuagaccaggcacuagaaguacucugauaacuucucacacuaguggcuccuauaaaggggcuauuggccuaguucugucucauggugacugaggcuaaaauuuaaaaaaaaaaaaaaaaaaaaaaaaaagagugugcuucuucuuugcuggcccaaaugucagcacaaaugccagaagagagcucuggugggcuguacccucaccuucccucuccaguuccuccucguacauagccaucucuuccuccucuucaacucccuccuccucuuccuccaaggugaaggacaggcuggagaucuuccgcuuggccuccuucuugcgcuccuucucucgaagcuucucuaguuuccuaccaaggcauggguggccaucaugccccauguuccugcccugaggccccuucccugacccagagccacugugugccuagcaugggguccacucagcacaggcuggaucuccccagcaccccagagggauucuauuugcccuagucacuucaagcucaagggcaggacucugugacacaucaagcauggggcagaaaggaauggggacaaugcaggcuguucaggcacccaggaaaaagaaagggcucagaaaggacucaccaccuuuacagaggaacagaaagaaagauaaaccuggaaagugagaaccaguguggagcucaauagauaccacaacugcucccaaagcaggaaauggguucucccuauggaaugggaauggaacagccugacccacccccaggaguucccaagcgcuaagcugcacugugaggggagagcugcugaggaugggggacccacagcuguagcuccuuugacugcuccuuuuuugccagcuguuucucucgcuccuucaccagugccuccuguuuggccuucaugucauucagagucacaagaccugugaggcaagaagacaugggaagaaaggcuagucagccagggccagcaaaagagugacaccuaggacuaaaaaaaaaggugguacauguguccugcucacccacaguacuggacuugagcucugcuuccacagcaucauagugugcagagaauuucuugucaauguuagauuucauuauguucuccugcagaggagggacauaucagugaaggccaucuaccacuucacuauggaagugacagaguggcuguggguucuagacccuaguucgaaauuugugccuuaacaugcuaugacaugaucuuagaaaagaaagacacccucccuuccuuuucugucuggaaggguccacgaaauugggaaggcuaaaggaaccaaaggagguccuucucuuggcaucccugaacugcucuggcccccucuucaggucuccugcuggggcccagcacccacucaguaaucuguagccaccaccacucaccuucagccuuuaagcugaagcuccugagacccaagccacgggauuucaggaagagauaaauggaaaaaaaaaagagggaucaaaauguccagacccuggaauucuccuuuuuggcccaggaugcugucagcagcucucuggaaggccacuguucuucagccugaccccauauuaauaagugcccuguagguacucugaagggaccuccaaaugaguagccaguagaggcaaacuuccagcugccaaugaggcaaugaggccggaacuguaggacuaggugucuauacaagcauaguugaggguggacaauacuuccaucuggccgggcaugguggcacaugccuuuaaucccagcacuugggaggcagaggcagguggauuucugaguuggaggccagccuggucuacagagugaguuccaggacagccagggcuacacagagaaacccugucucaaaaaaccaaaacaacaacaacaacaaaaaacaaaacaaaacaaaaaaacuuccaacugaagacugguuugggcguuugucuucucacuuccccagauagggccugcucucaccuggagagcuaaggcccccugcuccucucaggagucuugcccaaaggaucaagcuguggucagcuugguaucgcgcuucugaaugcagcgaccacucacuaaacaaacccugggagaaacucuaguacucuguaaugagugagacucaguggcauaccccugugccucuccacaggaaguggggucuucccaauaagcauuggaaggcugggagcucuguacucaggaggagugccaaggagucucacccaacaucagugugcuccccaucucugacauggaccaacacugagcccauuuuauagauuagacugucucggcugacuucuguuacuagagaugcacagcaagucucgccaccaacgcggggcccgcccuccgggcacucauagcccacuguugaggucucccagagacgaguggcaggagaccgccaggggguccgcgcggagcgcaagcucugaggugccccggccuggcccacaccucugcaauccucugcuucaucugcuccauuugcucacgcugcuucucccucuucuucauuaggugcauggcgcgucccgccucgcuugcagcgcccuuguacugggccaugguggcagcagcgguuucagcgaaggcaguggcgguuucagcggaggcagcggcagcggcagcggcagcggcagcggcagcggcggcguuggcagcgacgacagcggcaacagugacuuuugcuuggagaagucguggaggcgacggcgacggcaguggcggcggcaauuuagucagcugaugcgugacgucagccaccagggaacgugcggacgcaggcccugcccuacgcccgcggcucugacacgugaucgcaccucgccccgccucacaggaggccggacgaguucaucccauacccaaugcgaaaucaccaguucuuucugcugguuccuugugacauggagcuggguccucuagcuuccuguacacccucaaaguuaaaugcuaucuuaagcuggcccuccauuccuccuaacuucuuucuguuagucccaaggcugagcgcgcugcucccaacuuggaugauggaacugagagccaugucucagucagguguaccccuucccacggaggcuguuuuuccuccugcuuggucacacacugacacauuugguugcuuggauuuuuuuguuguuguuuuuuccgagacaggguuucucuguguagcugacuguccuggaacucacucuguagaccaggcuggccucaaacucagaaauuggccuguucucugccucccaagugcuggcauuaaaggugugugccaccccugcccagcugaauuuuuuuagcuaucauccaaggcuagguccaggucccuuugcucccccaggacugagacuccugauaccucuccuuuaaaaauuugugugaggcagaggagauggcucaggcaauggugaguacccagaaucgauccccagcauucaaauagcucacaacugacuguaacuccaauuccuggagauacuggcuucugcaggcagcagauaugcaaguugugcacacccaccuaggcaaaauagccauacacauaaaaauuuaaauguguuuguuuacauguugugcacaagccacugaacaugugcagaggucauauuguggaaucaguuuucuccuuccaccuuuacaugggcuccaaagaucaaacucagggucacauagaaaauaucuuuaugcauugaaccaucucaccugugcuauucugcuucggagaggucaguauagccuugaacccaaaaccuccacacugacuucugauuuggaaaccacuaguaaaugaugacccguccaacaccagaugaccuacuucaccugccuugauccuugcggauacaguucuaguccagaagcuaaauugccccaguccugcaaaacagccuuaaagcagagaaccuaaagagccaggcuuaaguuucaauaguuuuauugggagguuuuuguuuucugugaaauauacuagagcuuggggaaggggacacauucacuuugcaagguaaggguuucccaccacuaaaggaaaaggcauggggcaggguacacugggguuuggauccacuuuccuaccuccuucugcuuugcucacauuacuuuuucucagugaacacaacacaaaagaaauucaaaacagaucaaccuccagagggggucacaccuaaaucuucucccaucccaggcuuugccagcacugggagaggccagggcagcucacucuacagcccuaggcugcacagaaaggcugagggcucagacaauuacuccaaaguuaauaaauuagaauaaauuauaaggaggaggaggaggaggaggaaugcaauuuugugcugggagggucccuucucuccaacaccuaagaguugggggaggagauggguaucuccaaaggccacuacauuugggacuaagagcagugggggugggggucagcuuuuccuccacuccuucccaaacagcaaaauugggggugcacgaugcacacacacaugcacacacauguacacacgcacacacacguacguacacacacguacacacacgcacgcgcgcgcgcacacacacacacacacacacacacacacacacaaaguucucuuucccuagaacaaggacagaccaagaaagaggauacuauccaacucccaucucccaaaccaucccuaagguuaaggauauggucagugaauaaaaucaauaaggugggugauuggaaugugguaggggaagcagaagaugcuggaaacaaggaugccuagccauaccaucuccccugcccuagagaaggacauacaaguuggggagaggggaacaggggcuggaggaggggagucagcaaucacugaucagcuucuccaaagacaucauucuguuugcgcuucauguucucaaaaucaaaggcagaaccagccaugcguuuguagauaucuuugaugucauugcagguugucucaaagugugugguagcaucauaggagcaggaacagaacaccuguaaauagacagaaccccagggcucacggaagucaggcagaggaucuuggauagacugcaagaaccaaggcugacugggacagcauuuuuaccugacucucugaaccaucaucaaugggcucauauaaaucacugauagccacaaaccuaaggggcaaauaaaagaaaagaaagaagagaaaagucucauaaugggccuugcccauuccuaauccccaaccuccccauaaaguuugguucagccucucacuucuggucaauggguuccaacagcuccaaugcaggcucaacuuccuuuucugguucugcagucucuacaguggugcuggcaauggcgauguauuugcccugugcggccacguugugcgcauaggagaucaugcacacauagaugucugaccaugggaagccaauugguuaacauguaccagaggaaaauggccacacacaaaaaguaguuccuagaggcuagacaggaaucuggcccacaugcuccugcucccaacccaacauguaaacagcauucaaacugucauuuucaugaacaagguaagagcucaagccauccaagccgcagggauucuguaacaaaaugucacaagaagcccuaagauuucuugugagaagagaugcauaacagccuggccuaccugacuuccuguugaccugguucugagggaugauaauuuggcaggaauuggcaucauugguauucuugaugggguggcugaggauacagaugaugcgaauaaccuggccagccuuuugcacacggucugggauguaacugggaucacagaucagcugcuugcagcgggccaccugugaagguaccagaaggguuuguaccuguuggaaaggcaagccaggcagcucugagcugucaucacugucccuuucuuugaagcucagagagaucagcccucauauacagggcuaggugacccuacugcuaaaacacaaugaucacaaaaaugggcuuuuuuuuuucugcugcuggaguuuuuauuugagacuguuugacccaaacuaaucucaaccucaggaucuucuucacuagcagccucaauucucaugccccaccacagcaggcugaaggaugguuggggggaggcauguuaucucaguugguagagugcuugccuguuaugcauaaagccccagguuagauucccgcaaugcauaaagcaggucucuugacacacaccuguaauccagcaucaagaagguggaagcacaaggauuaaaaguucauccucagcuacauucaacaucugacgccagcccgggguacagggcacccuuuccaaaagaauacuuucaggaauacaaaauaugugacuucugaaggauacuucuugauugauuuauauucaucugccuuggcucccaaguacuggaaaacagcugugugccauuacaccuggcauuuugaaggguauuucuugccaacaggaauaacuauguagaguuucccugaccacccagucccuagcuguaagcuucucaggguuaagcagcagcaaacucaccaguaauaaggcucccuaagaacauagcccugaaaaagaccaaaccacgguaauacaaauguauauggcaggcuuaccucucccucagauuugacacccaccaccuugccauuuuccaugaugaugucauccacugguuuguucagcauguauguucccccauagauggcacucaaucuauaguaaggaaaaugacaagggagucuucucaggagaauggugaccgauccuacucuacucuccccaccccaccagugggguaaagaaacuacacagguagacagaguucaauuccaacuguuucaggugucucccccauaaauuugggcccauuuuuggcauauuccuucuucucugcuguuuccauccauaauacucuguucugcaaaugggucaauggaaggcagcaugaaggaguagcuccacacagaaauggcccaggagucaagaauaaagaacugucaguaaaagagccagcucccagggaagcccagacucaagguucugggguccuagacuuagaccugguacuaccaagagcuaagggaagcuauguucauggugaccuaguccuuuacuuuguauuucaucuauuuuuuaaauaaauuuuuauauuuauuuauucauauguguguuuuauuuacauguaugucuguacaccacauguaugccugaugcuuguggaggccagaugaagguuuuggauucccuaaaacuggaguuaugggugguugugaacuaccauguauguucacauuggaacugaaccuggauccucgguauaaacaagugcucuuaucugcugagccauuucuccagccucuacucugcuuuuuaaugcacuagcgcagugcccccauuacccagggauggaauaauauacaugaaaauuagaugggaaaguaggagaugccucaaaaauauucaagguaauuuucauucuuggccuuagucuuacuaguaauacuauccgaaaaagacagauccucaccuggcaaagcccuggggcagcucacccaggccauacaguggguauaaauaggggcucuugccauaccgggccagggacucgcuguacaacuugaugcgguuaauagucucaagacagggcugauccagguagcuggggaacaagagccaaggaagaugcuuuggcagcggcauccuugcucaccuacaaagacaccagccaaccuucccaccacccuuugugaccuggcaaagaugugggucaaauggagagggacugaaauggaacaggugagucuggagcugagcacaagagacaugcagggugggcaguagguacaauaggcagguguggggagggcaaggugugagccagagaaggggcucccaucaccagccagcuuuccccucacucaucagugcgguagagcgccaaggcauggccagugaaaucuaugacaucuugacccaggucaaacuuccgguagacaucacgcaugcugguguucuggggaucaacacccucaaagguuuuggggucauucucaucaaaguuugccacaaacaccaaaaauuuucggaagcgucguuuuucaaacaugcccaucagaucugaaagaaagguauugagaagacccuuagcauuacugggacauagaacuccucuuuccaccagagcaggccaagaaagcugguuguauguaauguagaguauuggcucccaccaauacucuaucauguaacacuaccccacccuucuugaucucaauuuucuuuuuguaggaagaaacccuucuaguuccacguagggaugcuacagggcaaguaggcccucugacaaaaaggaauccuguucugugaacuuucuggcaacuugccaggauggguagcacuguccaaucaauacacuauaaaguaaggguccucuaggacuacacagagcuaagauuaguuucaggcaaagaugagccuuuugccuaacuguccugaaaauagucugucucauccagccccauuauucucugguuaaggagacucauacucacuagaagccaaggccucagucucgguggauggcacuuuguagaucuugccccccuuauauacaaagcugcccucuaccaccuugaaguccagauaucgagucacuucuguauauaguagcaucuuuaccagcugaccuguguccagaggaaauaagggacauuguuguguuuuccuucaaaaacucucaguagucugacugaccauauucuugagauugaccaaucucuccccacuccgucuucccacucaccacccccaaaaccauauacagcaucuuuuuaaucucucucaccauuggccaugaggaauuuggggaucaagucaacauuccagucucggccccggcccauugauucagggggcccuuccaguaucugaaagcgcuuauauagcuguaagcaggacaggaaagaaagaaaaaugucaaggaccugucgcccuuucccacucuccugcccaguaccugagaauuacuucgcccccuuauaccuauguggaagacuaacaaggaucugggucuaagcccaggucuaagaauaagaaaucuuaccuccuccaggggugugauggaagagcucucacccccauaguagggguuucgguccaugugcagcaccuucuuuccauucacagacaugaugccagacaggaugcauuccuggggaaggagugacauuugcagcuauaccccauaacccuccaacuugcuucaugcccaccaccaauuuuauaaugcagcucuuuucagugccuaaaacuggggaggagaagauggcuucauaugauguuuccuuuacaacccugcugaguaaacuacuggagcauuaaaggagguuuggggggcagagcuuucagcuuccaagucuuccagcaucaacaagccaagagaaguaucuacuucucugagcccacaaaaagacaaugagucuacaagaagaaccaauucaaaggaccuuugaaagagaaggccaaguccuugaaaucccaggccccacccugcuccuccuucaaagggcaggagccccugacucucuucuggcccuauccacuggucuagacucaggguucaaacuaaaaagauuuaggccggggguggggguuggggggggcgggggcagggaagagacaaacacccucaccagucagucacuaacccaaggacaaaggcugaggauauauauucagucugagaucuccaugggaaaccaaguuggggcagagguaaaguggucacuaccccccccccacaccccccacacacacacuccugcugucucuggaacauuccauggguuuccuaucccaucccaaaaagcagaaaagcaugaugagggcccacccuuguaauguccccauacccaucuucauauuccauccccuaguuugaucacaagaugguaagggaugcuaaucaaggccuuggagcaggugaugaguucaggcaaagggugggggcugggugcaaugguuccacugugugugugggggggugaguuuuccaccucggugauagagauagggaagaauaggggucugagguuaaguacuagagugcaggaacacaggacaaaguggggcccucuacagagaauugggaacuggaaucgacauccuagggugagguaguggguugggcaugggguugguuuucccagggcuggagcuaggaugaugggaggauggaucggauaccggacucugcaucaaugcgggauggagugggguggggagggauggcgugggguggggagggauggcaugaugcagggcuaugagagccugaaguggcacuuacgguaagaccuguccccagcacaaucacaucguauuccucauccaugaucaggccuugguaccagcguccgcucugcuccuccuccuucaccacagcagccgcuaccacuaccucuacuauugcuacugcugcuacugccgcugcugcugcugccccugccgcugcuucugucacugccgccgcacugaaccaaagauggcgucugucgguugucuccugaucccuacgcagcguuaaugagucccucucucucuccgcuggccccgccccgcccaaccagucaucauuuccuugcuuguuuucugggagggcuucugucaccugggucccagcaccagaaugacugcagggguuaucggggcucuucgugagcccagaaaaauacggggcggggcaggccggcagcaggugcugaguccuccgaaagauccuugcgcgggagccgcgcgcgccccgccccgccccgcgcgcucccguaccgcccccugggagaaacacaagguauggaagcccugcuguguguuguugcacaguagcggagcuaccauugucaggauuccucccaaggccaggaaaaguaacaagccucuacucuaaguagguuuguuaagaguaucagcuuacugaagacccucccacccuuccucucucaccucuugcaugacuggacuacaucugagcacuucuucccuucagucaagaaaaaaaaaucuacuguucagugcagaaaugagugacacgaagcccaacacaaggcaacacgucuuuauuuuauuaggaaggaaacaacagagcaaccccccacacacaccuccggccucuugacaggcagucuuuaugggaauaauccagaaacccagugagcacacuuuguucaccaauccucgugaugguuucuuccuucccaggccacagaaauaaaccccaguguaccacucacucuuaacacaucaccccucccccccaaaaaacauaacagcuaagcuggacagacagucaaguagucuuuccacaccucgcaaauucaaggaaccucaaguucauggcuguugcuggaagcuccauaaagcuuggggagugagcauuuacuacacaaaagcacuauaaacagcaaggaauaauagcagaggggcaagaauaaauaaggagagaggguaaaggggagacccuagaauuaaggucccuuccccucuugaugaugaagccuggaagauuuaucuaauaucuaugaagaauacacuuuguugguagagaugggggauagccacaggggagucccucuccggguuaaagaggaagcaagagagacugaggguggcguauguaggguucaugcuauaguaggaagaggacaaaccuuuccauccacugugucacaaaacagaaacaugacaaccuagacaccaauacucccucaauuccucucagguguaugucacacaaucugggucaaagugaugguggggcccuuguggucaucaaagcgauccauggucuuuaggcugaguaucaugugcagaccauaggugaauaugaaaagcaugaagaggguggugagcagacccauccagaugcccggagagaagaaaccagcacagucgcuagcauaggagaacuguucaccagucacauugaaggccuggaucuaggagacacauugacauggaucagaugguuccacaagguuccacacacaguaagagcugggauucuggaaucaaugaauaaucuauaccuucagagacugcacaaggcuggaacucucagcuacaugcucaaaccauacugagauucucugggcccuucuucccuccccuuacugccaccagcuuggggcccaucacccuuucaauaccuggaaguuaugaagagucaucugccagacugagggcacguuggucacaaggagauugccuuucuugcucacacugcugacguacucacaguggaaagaauagaugcuagguccugugacuugggaaacauugaaaugggcaacagagccauugcuguggauuucaagucguuccauggcaaaccaauaucgggcagacacuggauagaagcgacuagccagaaugaaccugggaggcaggggaugcagagaugucagaugaacagaacagagugaagacacgccagcccugacaaacuucagccaacagaacuuacuugaaugucacuguugcaccaaagaguggcucauaggucagugaaagccuauggaacaaggcagaggaguacugucaggcucuagaaggaucuuaagaagguccucaucagguuggcuccaaccuaagcugcccuagauccauccuuauagucaccugccaauacaguguccccauuuaccauaugggaaaaguaaaguuccagucauaagcaaaucaggagcaguugugaaacaauuagguuucacaucuccaacuuaggauuccuuccucugguuccuaggccuccuucuugggguuauucagcugccugcugagguuucaaggguaggaaaccuaggacugguuuuaacaguugguuugauauuugccuacaugcagucccagggguuggguucaaaaacgguccaggaucccaagggacuaugugguaauaaaagcucaggacccaacaaccaauaccuaaaaaaacaugagaaggccaaacucuuaagaggcucccucaccaguaaccucccagcaauaucacccugcgauacugugacaucuauguccuuggugaacauaccacacaaacauaaucccacauccuuguccuguacugagcucacagugacaggaagaccaugugugauaggauagcccuuccuucucuuccuauaacccuuacauggcaaaggagucauuccagaaggagccggucaaguuaagauucuccacaccaaaggugagggaggucaagucuuuccacucgucuuuguaugccacagagaaguuuugugcccaaaacaggauccuuggggcagugucauuguaacucacaggaggauggaucgcaggagaugccaccugagucugaagcagcuggcgaccuagacccccagccaccaugguuauaucacgggccaccuguagaaacauccaacaagccuucucucaacagcccuaaaaacaaaaccuaauccacuggacugguauuccuuccccacugguuacccuguauaccaucugaaagucccuagaccugauauuccaucucccuaaacuaacaaucacacugcccaaaguggcucauaagcaaaaugaaaaaaggcaccauggauggaggaagcaauccucuguccauuaaucccccaaacugaagccuccugagagauccugccugugacauaccccuucaucucuagucacacucaccacauugccucacacccucauuccccagggccccugcuagaagaguacauacucuagaagggcggacugcaguaagagcugcgguguaagggacaucuucagacuugagugugcucaguaccuguccgaugaccucaucugaagagugacaagagaacagagagccaagucacuagguagcuugcuuagagaaauacuacccauugucugauucagagaccuucuagacuaugagaauucagugcuguuaguuuccacugaggaccucuaaaaaacagguauuucuccuucuacauacucugccagucucucuggggacaauuguagcucucugauggcaagcuaaaccuaaguaaacagaacauauagugauacagagaacucaaaaucuacacagcagaugggacuguccuuuaccacaaagaaguacuuugcauaauguuacuggucuauuaaauacagagauucauuguacuuguacaaaaacuagauuuuggagcucuugcacagggggucauaaggcacuuggauaucucugucagguggggcugacuacagaagaacauggccaagcagccagccacgauguacuugcucagcugucagccacucugagaaacggggacaaccuugugguaaggagaaaccaguucuauuuuccuggcccaagggcaaaauggggacauaaauuuuccaguaacacacucaccguuaccugugaggaccucccugggcgccaucagaccggagcuauggauaaaaaaagugagaggcccacagguugcucugcucucaaauccaaauagcuugccuggaucaguucucugaaacucacuaccuuucucucagcccuucuaacauuucccuuccuacuagccccacuuacuaagucuguggacuucaucugcugcucugucaugcagacacuuagcucagcaacagcuauucccacuuccacaccucuauuugcuucaguaccccugucuggaauccuauuccccuuuccccuauuugcaacuaugucuacaguccuauaaagugggcauuagugguaacaaaguuuucucauuucuggaggcccaauaggccuaacucaguggugaauacuuguaagucacaaccugacaggagguccuuucugucacuucuuggcauaaaaugaacuuucuguaagagucccaagguagugaacaggagaauacugucaucuuugauugaacucugccaccaacagaucccaggaucuuaccccuaucugaggugcaagguuagaggcuggaagccaugccaccuaggcuguaccuggcuguguagggcagacggaugagcagcagggcaggaaggcuggcauugagcuucagcuccuuuaagguagcuagauccacaugcaaggggcuagccccaagcuucuccuguagguagguggucagagugcugauugcauaccaguccacagcaggaagcaccagugaggagggggccaaguccagggcauucugaugguagagaagauguggaaggcaaagugagccagggaucaguggaucuuauaauaaccacuaaaaccucaccuggaaagccacaccccauagggacuggaucccagaaugagucagaaaguaaaugucccauaucuccaagccuugacagucacaucccaagcccucuacccucaaagccucugguccucucucugggagagaacacagaauguauugucuuuccuuuuggcugugagcagacccuuaccuccagguuagaaaaggcacuguccugcuuauuuccaaacacaccaccguaugcugugaaauccucaaugcuuagcuaaaaggaaagcagaagagauguccuaggaggcugggcaaggaacaaagaccaagggccaggacauggaggggagauucuccaggcuaacaaaagagugaaccaucaggacuugugguggaggugaguggaaggcuuacucuuuucucccagcacucugagggcaugaugacaagauauagaaggugaucauaggguugagagauuuauguacagcugguuugugauaaccuacaaaacaagggucaggcagcaagaagaacuggggaggaagagggaaguuagagaacaggaagaggacagcaaagaacaauuacuauaugccucuaaagagggaaguagaagucagagcaaaugaaccucuauacaguuugggcaggauccuuuucaaaggaggaaguccaugccccaccauuguuguuaagaaugaggggagacacgccuuuaaucccaguacucgggaggcagaggcaggcggauuucugaguuugaggccagccuggucuacagagugaguuccaggacagccagagcuacacagaggaaacccugucuugaaacaacaacaacagcaacaacaaaacaacaacaacaaaaaaagagugaggggagaggaagauauuggaacaaaaugggggaaacagauuucggagcucucaggacccuggcaaugccaaucucaugcccuucucucuacaaccuaaaaguguuuucacuccuccuucccucaacccccagcuagcuuccucuggcuucucccaguuaggcccagaggcaaucuuaaccagcuucccuaaacucauuauguuuacuauacauaagcccagucuccuuuccuauguuccucuccuauauucugugcuaccuaugcaaggcuugcuaucuuccuaccaaccuuuccccuuguggcauuuccuccaucucuaggugaccuagcggaucaucuccuaaccuuucaaucacauacuaggcuccagucucacaagcagccccuagaacugauuaagaacacucccuugcccagggcccuuacaccugcaguucuccugccaguaauggccugccucaaaagucacaugacuccuuccugccaauaagauguuaucuccagagacccugccugaucucacuguuaccuaaaacaguguccuuacuguguugucuuagccugcucccuucucuagacuaaaaagacugguaucauaaacauguaccaacuuagcucuuagccacuugccuucacaagaauguuuauacuuccaaacacauagcaagcacgccaccauugucaaaaggaaauguccuaagauugagagacuguggcuagaugacuuauguagaauacuucucgcagacuccugauauagguggauaucuucauuuugcacuuacagaaaaguaugguuaacaaagauuauuucaugcgcucaaaggcugaaaaaugauaggacugaguucuggucugaccuguuauuuaccaucuucugaaaggacuaucaaccagcacaauuacuaccaccgacacaggaacugaaggaaagcaagaacagaaagagcuagucaggcuacuauggaggaagggacaagcagagacuugacauccucuugaacaauaaucuuaugcuacauuagaaccuucucauaguucauacuccugcucuaggugcagaccucuggagugaaaggaaaauagaaugcuggcucagcacaaaacugaaggacaggucugauacccucaggcuggaaguaguguauugugcaaaucacaauucagcaauucauuuuaccucuucaacauuacuuuccuuagcaguuaaaacaagauaaugauaucaguugaauagaaugcacauaccagacuaaauaaaaggucauuuuccaguuauuccuauuacugccaaccauuagcuauuauauauauauauauacuacauauauauauauauauauauauauauauauauauauauauaugaaugaaugaaaugaaaccuugggcaagucacugaucuuaucccaaaaugagucuucucaucugugaaacugaguaguaauuuccaccacaguauaggacaucagaaaguaaugcuuaguacuagguagguaucuggucuuuaauccauugcuuccuuuuuuuuuucuuuuugguuuuucgagacaggguuucucuguguagcccuggcuguccuggaacucacucuguagaccaggcuggcaucaaacucagaaauccgccugccucugccucccaagugcugggauugaaagagugugccaccacugcccaguuaaucccuugcuuccuuaaaucaagucccugcuguuucugugggucuacuguucccacugaagcuucuccuacauaucuuuccaaaaaucuagccacaccugccuacagguggaaggaggucacuacagcuucaccuauggaacgggcaguaggggugggguggggucagcuuuccuuggacaaagacauagcaagcuagaacagacucaccuuguccuguaggaacagcaguacauuacggggacccagcuccagggcagggucuaaguagguagaaagcugcauaucgcuggugauaugacccucaugugugucggccacaggagcccacagauuccuggaaguggacagaauagggacugucagaccugauuucguugcuugagauccuaacccuaucggcuccuggcuucacaugcaaggcccugagaucugaacgcucgccgucaugaagcgagucccugaauaaaagacaaucuccaucugggccucgaagccucuggccaaggacagcccuggaguucagcaaaggcgacucauccaccgcggcgcaccgcauggcacucccaaacccaaccuggcccgauucaacucagccaagccggccagcccaaccaggccugucccugcccgcucaccggucacucgaccacaguaccaguggcaccugcugcuccguggccacugcugcugccacugccaccaacgacagagacagccacaugacuggagcccgcccuguccccguccguauccgagauaccacuguugccgccaucauagccucagcuuucagugagugccugggccucugaagccacugcagaucagaugaccggcaccuccgcccaagccccgcccucaacgaucugggaggggcccucucacauacucgucugugauugggccaagugaguggcacucaugaccacuccuuuucgcugguuggcuguacguguuuccagucgcgcacgcuccuuaugagaaaggaggcgggaucgagcgcuacaggcugcuacuugguucagccagucggguugauucuacagcgucucaugcuguauuugccuuuuucuguuuuuguccuuuuugcuuaaaaucgcgauacuggagucuuuuuccuaaagauagacccucccucugguauaaaagagaaaaugcacucccuuugaaugaaaaaaaggguccaccuccaccacaccaucaggggaacgccagccagguguuaaaaugggcaggauggaggacagucuagagaagagaacagauguaguaucagaacaggggggacgagggaacccucccuucuggcagccgagucugauggacaacauaaguaacaaugucagugucauuuggcacuuaaaaggcaggcaaaaucugucagagcaaaacacuguuucuuuuuacuaagcaucacuugccaacagacaagggcaaucccacuguaaauuagggggggacuccaaagggauuauccuuccuugugauuugcacuagaggaagaacugacagcuagagucagaaaauggaaguugccagcacaaacacauguagagacuuuucuggauuuuguuguuugguugguugguuuuguuuugaaacaggguuguggucugaacaaaaucacuauguaaaccucaaccuugaaucaagugcuaggauuacagcagugagccaccaaaccugccuacacuucugugccauuuuuuuguuuuuguuuuuguuucuggucuuuuuggcuggggguggggggaguucgagacaggguuucucuguguagcccuggcuguccuggaacucacacuguagaccaggcuggccucaaacucagaaauccuccugccucugccucccaagugcugggacuaaaggugugcgccaccacugcucggauucugugccauuuuugcuuuguuuugguuuguuuuuuuuuuguuuuguuuuuuguuuguuuuguuuuuugagacaggguuuuucuguguagcccuggcuguccuggaacucacuuucugugccauuuuuauuagucuuguugauuaucuuuacaaauaaguucaagaaauacuacaacuaaaucuuuaacucuccuaacauauaugcugauuaaccuaagguagugauucucaaccuaugggucacgaccccuucagggucaaacgacucuuucacaggaguugcauaucaacugucauaacuagcaaaaauuaaauuaaaauaauguagcaaugauaaauaauuuuaugguuggggucaacacaauauaaggaacuguauuaaaggauugcagcacugaaaaacacugauuuaggaggaacugaacuaaugucaagcuacaaagauagguguaugauaaaacacauaugcuaaguuucuaaaacagaaucuaggcagugguauguacaaauuuuuuuuaucuuuuugcuuuguguuguugguacugggaauugagcguagagucucuugugugccaaucguaaauuauauaacugagcuacuucagggguuaagagcaucagcugcucuuccagagggccuagguucaauucccagcacccacauggcagcucccaacuguugguaauuccaguuccagaggauuugacacccucacacaaguggauaaaacaccaaggcacaugaaauaaacauuuuuuuuaauugugguaaaacaacugaacuacuacucuaacugauguaugauuuuuacaguguauuuacaguguauuguuuaaauauguauuguuuaauuaguguuugacccaaauucaugccccccacaaaguuguacaugcaucuuaauuuggaaacaggguguuugaacauguaaucaguuuauaauaaacucacacugaugguuaaugucacaauauggaaggaugagccauaaccugaugacuggucauuauaaagagagaaauauauuuacuuacuuuuuguuuauuugugaugggcucacauaaccugggguggccucaaacucacuacacaggcaauaaugacuuggaauuccugguccucauguuuccaccucuucuaaaugcuacaugccaccacacuaggcaagagaggaaaacauagaggcagacagggaagaaagccauauaaagaaagacugcagugaugcagcuacaugccaauacacaaagauuucugacaccaccaggagaggaaaagcaggaaccaauucucuccuaguucccucagagcaaacucggcuccaucaaaacccugauuugugacuuguagccuagaaaauuaucagaaagaauucuguuuuaagaugucuaguuuguggcaauuugcuacagcacccuagggaacuaaugcacuauuuauuuggccucacaggaagaacauauaagaagaguauuuaagaguguuuguuggggggggauguguuuguuagaugaggaagguggcucagucucacacaaccugaucaaucacaggaacucacgugguagaagacagaacagauuucuucuuacaaguugucuucugaccuccacacccaugcucuggcaccugggagccacccccccccacacacacacacacacacauagagacuaaguaaauauuuuuaaauaucuccugucgggcuggagagauggcucagcaguuaauaggacugacugcucuuccagaagguccugaguucaauucccagcaacuacaugguggcuuacaaccaucuguaaugggauacaaugcccuccucugguuuaucugaaaaauauauaauaugauauauuaaaauaugauaguguacucacauacauuaaauaaacaaauaugaaaaaaaaaacagaaaaacaaaaagcugggcgugguggcgcacgccuuugaucccagcacuugggaggcagaggcagguggauuucugaguucaaggccagccuggucuacagagugaguuccaggacagccagggcuacacaaacccugucuugaaaaaaaacaaaacaaaacaaaacaaaaaacaaauaagucuccugucaacaaagauguugggaaauugugucucucugauugauacagccuuuuuaauuuggcagcaucuaaaaacuagaaagaaaaacaugucagcuucuauucuaguccaauacauccugguauuugccagggagguauggcagcagcaguggcugggcaauauccuuguccaguuaaacauuauuaaaaauuugcaacuauaaacggauuucuuugaauauacauuugugcuuggcugaauauuccuguuuaaugaaaucauaaguauauaccuguuuaguuaaaagcaauaaacuuauccacauaugugguaucugucugugacuuggagauaagagaauaaggaagucaaagccaguuuugacuacauaaggaguuggaggccggcuugaacuaugugagaacuucucucaaauuuuaaauaaauaaauaaacacauaaacagauacauaaacaaacaaaaaaguagccaggcgguggugguguaugcuuucaauaucagcauucggaaaggagaggcaggauuucucaguucgaggccagccuagucuacagagugaguuccaggguagccagggcuauacagaggaacccuuuccaaaaaaaaaagaaaaaaagaaaaaagaaaaagaaaaaaagaauagaaaaaacaaaaacaaaaacaaaacaaaacaaaacccaaaagcagauaggaccucugaguuugaaggcagccuggucuauacagauugaguuucaggacaguuaaggguuagagaaacuuugucuugaaaaacaaauacuaauuaaucccuagguuaggggaaguccucuuuauucgaguaauuuuuuuuucuauuucuugcuuuguuuguuuuuagagcuggauuuuaaaccuaggcacucaagaucucacacauaaguaagugcucuacuaauugagccacaucuccagcccuuuccaagauuuucuuuuuacauuucuguguguuuugugugcaugcauauauaccacaugugugccuggugcuggugcaggccagaacagagcauugaaucuuccauaccuggaguuacagaugguuguauguugccaugugggugaagagaagcaaacuugguuuucuggaagaguagucaauguucuaaacuguuaaaucaucucuccuacacccccuccuuucuuuuuagauuuuuuaaaaaaaguuuuauguuuguaaguacacuuuagcugucuucagacacaccagaaaguggcaucggaucccauuacagaugguugcgagccaucaugugguugcugggaauugaacucagaaccccugaaagagaagccagcacuuuuucuuuuuuuuuuuuuuuuuuuuuuuuuuuuuuuuuuuuuuuugguuuuuggagacaggguuucucuguagagagccaggguuuggcuguccuggaacucacuguguagcuggccucaaacucagaaauccaccugccucugccucugccucccaagugcugggauuaaaggcgugugccaccacugcccagcgcagcuagcacucuuaaccgccagaaucaucucuccaguuccuuaaggucuuuuuuucacucgagggaucaaacccaggacuucucauaugcuaggcacacacuauaccaacaagcccuguguugccauuguuguuuugaaauaguucugcucagucucugcuuccauaguuagucuauguuugaaagcauggcauacucaguaguagacuguuuaccuaguauacuggaggcaguauuuuauuuuuaaaaagacuuaucuuuguguauguuuguguguaggugcccauggaggccagagaccauauagaauccucugaacuuggaauuauuaagugguugagucuugacaaugaugcuagggauagaaauuaggucuucugcaaaagcaacaggcacucuaacugccgaaacuuuucuccagccccucacccuguguguguguauauacauaugggcaugggguaagacaacuuucaucaguuccuucucuccuuccaccaugcagguucuauccaacucaaauuaacaggcuuuguagugaguaccuuuacuugcuggcccuacuuuuuuguuuuguuuuguuugagacaggauuucucuguauaucccuacuuuuuuuuuuuuuuugauaaauggggucauauagugagccuugaaauuacuauguagccaaagauggccucuaaccucacuuuacuuuauaacugcugggauuauagacuuacaccacugagggguauauauuugaacaaaugaaaucguaucuuagaauauaaauuuaaaacuuuugaagaaugggcuggagagaugaauuagcgguucagagcacuggcuacacuucuagagguccugaguucaauucccagcaaccacaugguggcucacaaccaucuguaaugggaucagauguccuuuucuggugugucuaaagacagcaacagcauacucacauauauaaaauaaauaaaucuuuaaaaaauucucuugaagaaauguagcuggcauuucucaaaugaauacaaaaauagauacaugaaaaagggauguuacccuugaaucuaaguuguauucuggcuuuuacauguauucuauccccacaaagugauguuuucuucuucuaaaaaaaaaaaguguuuuaaaaggccagguguugugccaggcgugguggugcacgccuuuaaucccagcacucgggaagcagaggcaggaggauuucugaguuagaggccagccuggucuacaaagugaaugccaggaggccaggcguguagugcacaucuuuaaucccagcaccugggaggcagaggcaggcaaaucucugcauucaaggccagccuggucuacagagugaguucuagggcagcaaaggccacacagaagaaucagguuuugaaaauccaaaaaaaaaaaaaaguuuaaagcugggcgugguggcgcacacuuuuaaucucagcacuugggaggcagagguaggcggauuucugaguucaaggccagccuggucuacaaagugaauuccaggacagccaaggcuauaaagagaaacccugucucaaaaacaaacaaaacaaaacaaaaaaaaguuuaaauuuuuuccuucuuuuuuuccaccaagacagucuuaccauguagcucuggcuggggugaaacuuacuauguaaacugggcuggccucaaauacugagaccccaaggacuucaucacuauguacaccuaauuuuccuccagacagguucucacuauguaguucuagcuggccuagaucuggcuggcccugaacucauagagaucugccuaccuuugccucccacacuuaacacaaggcaauguuccugcuucagccugccuagugcuaagauaacuaagaucagguguguaccaucaugucugacuucacuugagguuuugaaguuaguuuauuacucuuguuuuaucaccuuuuuuuuggggggggggguucgagacaggguuucucuuuauaguccuggcuguccuggaacucacuuuuguagaccaggcuggcauggaacucagaaauccgccugccucugccucccaagugcugggaucaaaggugugugccaccaccgcccagcuuuguuuuaucaccuuuaugaauuccaccacauugccauuuggcuuacaggugauagcaaaagacuugaguggccagugcacagugagauuccaauguccaacuacuaaaauaauuucacuguauccaggcacaugguccuguuucuuguucagcaaggugcuucccaucugcauuccuacacagaagacagagguaugguggcacaacacaaauguuuuauuacucuaaaaacauuaaaacccagaucccaggauauagaggaugacaaggcaaaaaagauuagagaagcagguaggcccugacacuggggguuaauggucaggucuuggggguccuucuucugcuauauacaagaaacaucuaguuaaguuuagcugugcuugaauccuggccaauaccuucucuucuugucuacaggccacccaaggacaaaccuuguagcaguagcucagguagaaugaccuggcugacagcuaucccugaugagguuugugagcagugggcaaguaguagcccauccaagggaccaauugagucuucuuucuguaccuaugaccaagaaaccuguucuccuacccaacuauuugcuugacuaccugcucuguucccucccugagaggugagaagggggccccugccuaagagugucccuuccuucuccaccaaguauaagggacagccaaggcucuucuuuuagcucaagacccagaggagucagauguucaagaauaaaaaaggguauccagcaggaauugggagccaaucuaucugaauuaaaagcaucaguccauuucccagccucaguuuuguacagggaagaaucucaaaagcaguaaagagccaagcaagcuuggucagguuccuguaccaccacuucccaaauccugaaggacccaguguuccuuuggcuaagaacugcagggcacagacugggcaggcaaagccuaucuuccaggcuggaaaugauuguggagcuguucugccugcaucuucagccgcuggaauuccucuugaaugaagucugugagggcuuuccgcaucuccaccuaagagcaaggaugguucuggccugcauuccucaaggaccaugucugggguacccugggagucugagggacugagaaggccaaggacagcuaggggacccugggaggaaacucacagcugacuuguucucugcccggagccgcucaagcacagggaguguacugaagggcuucccaaucagcacggugauuuucuguaagaaggcaggccaucaagggugacaaggaaccuauaguuccagcccaaacaaugcggggauucagagcuaugcucuguaccugaugggcuugacguuccugaaagccacucucccucuucaaaacaggcaauugggcuugaugguauccaagggccagucuagucaauauccuaucaauaauuugucccacucuaccuugucccucacccccgccugauuucaauucuuuuucuaaaggucuugcuuccagaaaagccccacuuagcuccccuacuacaugcucaugcucagcaaaucuucaaccaauccuguauaguauggacaaggaaacacagggcaguuagcagggaaauagauagacaagagucagcagugccuacccaccuguccaaagcgggggaaguagggugggcuguuagggaggacaucauucauuccuguaccacaguggauagaaagccagccauugggagaagcaggguaccagagagaaucccagguacuucucucagcuacccaacaaccugaaaucccccuuaacgacaucuaagacaguccccucccuacccccaauccaugacucaccaacaugccacaguggcaggaugaugggauucagaugacacucagcaaucagccguccaauuccuacuucggagaaaugccaaagcauuggcacaagcugggccaaacuucccugccaacgucuggccaaugucacuucuacagucucucaauggaacuuaguccuugacucaccgccugucccuuuucuacugcuccugacacacccaccugagagaggaacgaagccaaggacccaaggggccaucuuuggauggggaaguuagcugugucaggcuggccagcaauacuuaccccauuugaagcgcaggaacucagaacucauguuuacuuucccuaaugagagaacacagagaaaaagcuugggccuagaaccaugaaugcuggagggcccugaucaagcacccaacugaccuucugggaagaugugcacccaguccccaugguuaagcuucuccaaaaugaaguccaucccuuucugguagacaccaucuccuguagagaaaggucuguucuccuuaauccauucucuggagaagaaaucaaacucuccaaacccuagugaaguagauucuggcucacuccuggucuauccacuuuaggauggaggcagcaguucauuucccauagcaccauccauagacacaucaacaucuauuucuagagccuguuucucuuugcuacccuggcccuucacauuuuugguuugaccauaucuuccucuuaagauggaaaugguggcucaugucuguaaucucagcauuugggaagcugagguaggaagauugcucugagcuugaggucaggaugggcaacacaguaagauccuguaucaaaacaaaacaauauucccucaacuucuuagugccugucaaaugcaaauagcacauucuuuuuuugugacagauauuacuauauagcccagguuggccucaaaguuauaguaauucucuuguuucagcuuuaauggugcuggauaacaggcauguaucaagacacuuagcuagacaguaucucucacugaaaugauaaucauggcaacucaaccucccucugcccuacggccugccuugcuggaaccugccccccuaacacacacccauuugcugacuacaaaucagcuccagagcuuccaccuucccucagguuucugggcuaagggagaacacuucaggaaguagaaaacacagaaaagauuggaaaacuugggaaaacugauuaauauuucaagaagugugaccuaacaccucuugugggcuagcaacuuggagucaccuggacauacaauaguggaagaauaaccacaggguggacagaaucagaaaguggaagggaagaggcuggaggacaaagagcaacacuggggcuaucucaggucagugcauugagaauugccuuucaaggguuaaagagauggcucaguggucaagaacacugacugcucuuccacagguccugaguucaauucccagcaaccacaugguggcucacaaccaucuguaauaggaucugaugcccucuucuggugugucugaagaaagcuauaguguacaaacauauacaaaauaaaauuuuuauuuuuuauuuuacugaagacagguuuauugggaagcuguucucaggugagcuaguucacuagacccaaggaccaaagccagguaagucaccaugugggaaggggauguaggggagggaaagagaaagagagaaaugaugugcuucaagaaagaaaagaaggaaagagcauaaaauaaaaucuuaaaaaggccgggcaauagugauacaugccuuuaaucccagcacuugggaggcagaggcagguggauuucugaguuugaggccagccuggucuacagagugaguuccaggacagccaggacuacacagagaaacccugucucauaaaaccaaagaaaaaaaaagucucagcccacccucaacagggaccugaucuggcagcucacuuaggggccagaaguugggaugaucucaggaaacagagagagccacaggugcccuacuugggaugguaguacacagcagggguguucaucacagguguuugcuccucuaguaaaccccacuguuggaaaaauaaccuuugagcuugaaacugugaaguaaaagaguguguguguuuugagacaggguuucucugaguagcccuggcugcccuggaacucacucuguagaccaggcuggccuccaacucagaaaucugccugccuuugccucccaagugcuaggauuaaaggcguguaccaccacucccagcaaggauagcguaucuuuggcauacuuuuuagcuacugcaagcacuuguacaaaaucacuucagugcuuaaaggugaaccuacaaaguccuaggcuuagagaaaaaugguuuguuuaaaaacagaaacaaaguaucccaaacucuguuuguuucagucacauguaauuagaucuuugcuuuccuugaaaauaauguuccaucuucuaguuuuuguucuauauuuuuacaaugcuggggauaguacucagggcucugugccaguuaaguaaaaacuauaccacugugucacacuuccagcucucaguuucucuguauguaugugcacacacacaacuuuaauuuuuuuuuuuugagacagggucuugguuucuaguuggccucaaacucaugguaauucaccuaccccaaccuaacaaaccaaauacugggacuacaggcauaauaacuagcuucuuucucucuuucuuuuuuucuuucuuucuuuucuaagacaggauuuuucuuuguagucuuggcaaucuuguaacuagcucuguagaccauacuagccucaaacucaagagauucaccugccucugcccaagugcugggauuaaggugugugcgaccaugaccagcuucuauauuauuauuuuuuuuugauaagauaggguaucaugcuaggcuuaaucccagcacucggaaggaagagacuggaggaugaguugccucaucuggucuauagagcuaguuccaggauagccaagacuacacagacaaacugucuuuaaaacaacaacaacaauaacaaagagagaaagauuaccauguaguccuauaguucuggucagucuggaacuugcuguauagaccaggcuggccucaauccuuaugccccugcuuacugagugaugggaugggauuagaggcauauaucaccauguucaucucagauccuuuuuucuuuuuaauuuuuauguuuugcccgcauguaugucuauguaaggguguaggauccccuggaaccgaauuacaggcaugagcugccaugugacugaugggaauugaacucugguccuuuggaagagcaggcagugcucuuaaccacugagauaguucuccaaccacucagaucggcuuuuaacugcaagaaagucuagaaucaguucaagaagaacagaacuaucuguauaggccauagguacaguauaugccuaaaauauacaagccucuguguucuaucccucaaacugaaaacgaaagaaaaaagaaaaaaaugaaagggcuggagagauggcucaggaguucagagcacugaacaaaggcucuuccaaagagucugaguccaauuuccagcaaccacaugguggcucacagccaucuguaaugggaucugauggccucuucuggugugucugaaaacagggugcucacacauaaaauuaaucuuuuuuuuuuuaaagaaugaaaacagaugcauacacacaagacuuuugaguuugcagaguaaaggagcuuagagucagggacagguguaaauuaucagaaugcugacauaucagagcaggaucugagaggaaauggcacugagacuauaucauucaacaaaauaauauagucucuucuggaaugcuuagaaagguggaaauacaaucuucuacccuucugacauucucuaaccuucucuucucuuauuuuuagaccacccuuucuuucauucuuugcuugaaaaggaaucuacauacccagaugaaagggcaauguggaucugaaucuuaaguuugccacaugguagucuaugaccuuggacuucuaagcuuugucuagagaaucugagcccuaucuagagaauggggucaagauggccccuacacuaagggguuugugaaagguacugaguggucaaucugagccuccucaucuuaccacuguuuguucucccaaaaacaaaacccuuagccuucuauacauguaccccacugccauuauaaagugguaacaccacacuguucucccugacaggagugguagauucagaagggacugcaaauacagcuuccuugaauucucacaccagaguuuuggacugcagagauucuaagugaucaucccucuuccuauucucugccaacuauacugccauaucauggcuccccuaaguccuucuaagacagacgcauugaccaccagcuuccuuguccccaagggaggccuggacaugccucccagaggagcagcucaccucgacacacaggcacacauuugcccaagcugaagaaaugggagugcagcuccuuggugaagcagaugucugcagcugcugggguccuagagcagcaauagacccaaucaucccugccuccaagacuucccauugcuuguccccaacucuccccacccaauauaaugccugccaucacugccauacagaaugaagcuccaagagaaggcccuaaggagccccacccaugcccuuccuggaaggcuggaugccaacuccugagcagagaaaggcaaaucugggcagaaauggaugggucacuucaaggggcccauuccuccucaccaacgcaucaacuucagguuccagauguggcggaguuuuaggaucccugugaaaaaguaaaguccuugaugugacauggcuacuuccacacuccuuuuaaauuucugauauccugucuaaaucacauucccuggaggaauccuaagggggacacacaaaacuuccagcaguuaggcaguauaucccccaaacaagguaaaguuuuucaaaagagccuggugggaagucaaucugucuuuggugggggccuguucuuguuuugccucccugaacccagcacacuggcaccauaccccagagaugagggucauccaugcaagacuggugguuggagacggugauaagggggguggcagggccucgguucucaaugagcucauacagcacuuccuuguugugcacggugaggugguucauguacucugggaagagaagucagucccaagcucuaggucauuuccaccugcccgaggcuucuuacugugccagaaaagccccugccauauucccaguccgaaaacccccagccaggccagaggccugugaacagacucugccuuggccuuuugccacucacugguccagaagcagcuguaggugccaacuaggcccaugacgacgcugcuggcuagaguccaggugagccggggcaccgcggggaauggccacuucacauggaggggcaucuccuccggcuccggccccgcccccggagcccagaguuccucuugccccaggccagccgauguccucuaccacucaggagaaggaucuccaacagacuggcagaggacuagacuaaggucaccugguggaacagcucagcaccucccuagcacuguucucuggauagagaagagccgcugcucaggcgacgagacgggacugcuguacaaagcaaugcgcacuagaaaccaagucuugacggccucacucgacgaaucagccggaaagcaacucgaggaagcguccuugccuguugucgcaaaacaugccuagguugcuugacggcugccagggcgggucuacgccagccucgcuccggccccucccccgucaagguuuuggcuccaaaccgccuuaagcagugcugcgucucuuugauuccauaauucuagugucuacaggcgacauuagcuacacagcaccauuaccugaagcuacgcaagucguaggcugguggaaacuuuuuacuuguucucuuucccugucccacccgauguguauccgguuaugcaugcuucugaaggcucacacagagaccggaaaagggcaucggguguccgcgucuauuauucucugccuuuuauuguacuauuucucccagugaucuggggguuggggcauuugguuaucuccacgauagagcauuugccuaguauucaugugguaccagaacuaacaaauuucugccaugaggcauuuuucuaaacugccacuccaguggggaccugaacaggucagucgcgcuacccauccugugcauaagguccuuugcuuuggguuuucugagcagucgucacacaggcaaacuuaauuugggagugcgcaccaacauugugguucagggccugaggacccugagagaagacugccucugcucugcucuuugcugcaggggaacuggccaaagaaugagcaagccuaccucaccuuuuucccuagguccagguaacuguucaaugauagacugcugcuucuuggcacgggugauaguaggcauguuugcgacaacaagcaaggacgcuuccucgacuugcuuucaggcggauucgucgagcagaggccgccagcuccccaaguugcuauucgcuuggcaaaagaaacacccaucaugggcggggugggccagcagguagccaguucucaggcacagccuacuggacagggauguggagcucagccuugcuuauggcccgccccuuugggugggucuggaaaccagcuccugggcugaaggguggcgcucagccuugcuacuugggacgggaaaguuguggagccggccccuuugggugugucuggaaacccgcgccucuucuucccauuucccccccacacacacccaacugcgcguccuuacccgccuuggcuggagcugcgauucuguggaguggaauguuuuauucgguucaacgcugaggcaggcguggggccgacuugggcuguggagguaugagaauccugcggguagggaaagggaggagguugucucuacuggggaggaacuucagaaggaaagggaauuucaagcuaaagcugucuuuggaagacuaggaagcauuaugcugaggccaggaacaguuauucuuucugguucauccucagaguccuaguggucucagucuccaaauauagcuuggccagugcagaacugccccagugcucacauguauuccaaaacagacaccccagugcaaggagaccaaaauaaguaugagugacagaacaggugaccagagagaaacaaauaucaaggccagcuaggaagauacuguggcagaaacacuaagaugugcagagucaggaagacagaacaaaccagccagauaggaagaaacuaacagagaggagaaagggacagcaugacuaagaaaaacaagcagacagaagcagagggccccaggcuucaagaaugugacauguacagagaacaugguaaagcgcugagcucaaaagauaugguaaggcagaggugagucugagacaaagauaaaccugagacagaugcucugaggggcuccagggcacucaggaaaguugaagccagccugggacuacauagugaguuccaggccagccuugguuauaaacugagacacacccacguuuuauuaauauuaauauauauaaagauauaaagauggcugguguaauggcuuaacagauaaggauauuuacugccaaacaugaucgcuugaguuugaucccuuuugguagaaggaaaaaacaugcuugacuuagacccaugcauaugugcauacauacacaaacacacacaaauagauguggaaaaauaaaacaauuaagaaaaauaaaagaaauuccugaagagguucaugcuuuaguuucuaauauggauaggacaaacuggaccuuccugaaucugggacugucuaugcccuagcuagcaauaggugcuauauagaaaauaguauguagcaguuucuuuguuuguuugagacaggguuucuccauguaucccugacuauccuagaacucacucuguagaccagcuagccuggaacucagagauccaccugccucugccuucaaagcacugggacuaaaggugugcgccaccacccagcaguacucaauuaacuuaaaagaauaaggguugaccucauccccauuguuagugaaaauguaaaauggcacaaaagcuauggaaaaauuugguguaccuuaaaaaauuaaaaauaaaauuuucaugaauuagcugaucugcuucaggaaacuaaggugcucaaaauuuucaaaauugcuaaacuggagugugauucaguugguacagugcuuacccaauuaugaggcuuacaucguauagcccucccuacauagucaauauaugaggcccuggauuucaucuccagcacugcauaaaccaggcuuggugguauacaucugucauuccaguuugggugagguagaggcaggaggaucagaaguuuaaggucaguuugacacacacacacacacacacacacacacacaaaucacuacaggguuacaguuauagcuuagugguagagcacaucuuuagcauauauaaggccccaucuucaaucccuaguaccacacauuaaaaauaaaguaauuaaauaaauaaauacaagaauucaaguaguggguguaccccaaugcugauggacaaaguguuucugaguauacacuggaauauuaaucauccuuaagaaggaagaagacagccgggcaugauggugcacgccuuuuaucccagcacuugggagacagaggcacaugggucucugaguucaaggccagaauggucuauagagugaguuccaggacagcugggggauacacagagaaacccugucuuggagaaaaaaaagaagaagaagaagaagagaggcuggagaggucacucagcaguguuuaccacucuuguagaggaucugaguuugguuccuagugccugcauuggguugcucacaacuucuaacugcagcuuaagagggaucucauaugucugguccuugaggguaccuucacucauaugaacauacccacuuacagacauauacauaacugaaugugaaauacaucuuuuuaaauaauggaaaagaauuucugaacugacaagauaugucagugggccugcguggccuccuugggcaucugcaugugcauauaccuccacauacauacacauaauuaaaaauaaaaccauccguaaugagaucugacucucucuucuggagugucugaggacagcuacaguguacuuacauauaauaaauaaauaaauaaauaaauaaauaaauaaauaucuuuaaaaaaaaccuaagagagauuaaggcuuuuuaaaaaagaagauaauuuugacauguuauacaacaagaauaaaccaugaggacaugguauuaaauaauaagacagucucacaaagacaacuauguuguucuacuuuagugaugccauuaguguugacaaauguagaagcagagguacaauggugcuuguaggguuuuuuuccugaguaucacaaaaguuuacuuagcaagaaguuucauauaacaauguguaugaccuggcucuuucugaacucuucuacugaagaacuaugguuuugaugcuuuacaaggcuucuaacaugaugaugcuauuuccuguuauccauccaauauuauucugcugcccacuaauugccaucuucacauauuugucagucacaagauucauaaagggaucaaagcccugcaauauuccuuguauauaucugccuccauuuaacuucaaugauaacuuauuuuccauaaaugucuucaguucuagcgagugggccuugcacauggucacugugcuuguuguguuuugaagcaggguaucacgauauaacugaagaauaccucaaacuuaugaucucauugccuucaccucccagaugcuggaauuacagaaguaugccuccacaccuagacuuguuuuugguuuuugaaagacagucucaggacuggggaguagcuaguggcagagugcuucucuaccauaccuagaaagauaaagacuguaaguucaagccucagcagugaaaaggagaaagggagggagggagggacggagggagggagggagggagauagauugauauuggcucuguggguuugguggcauauaccuauaaucccaguacuuggaugguggaaggaaucucaaggguuccugaggucauccuaagcuacauagacaaguuugagaccagacugggauacaucaguccuugucucaaaaggggaaguauaaguaaaaaacacaguaaagaaugagucauccaggcuuggugauuaugaacucgugauccuauuacucaggaggcugacaggaggauugcuccaaguuugggaccugugcuuuacuacagagcaagacugucuuucaaaaacucacgcagagguccuggggggaagucaguaaaaaacgugcacauaaaaaaacaggcgccggggugguggcgcaugccuuuaaucccagcacucgggaggcagaggcaggcggauuucugaguuugaggccagccuggucuacagagugaguuccaggacagccagggcuauaaagagaaacccugucucaaaaaaccaaaaaaaaaaaaaaaaaaacaaaaacaaaaaaaaacaaaaaacaaaaaacaaaaacaaaaaaaaaaaccaggcaugguaaaauguucuuguaauuacagcacuagggaggcagagacaauuggaccccuacggcucaauagcuagccaaauuucaugaguuccaauccagugacaccaaccaggguggauggcuccugggguugaccucugaccuccaaaugugcacacacauaaaugcauauacacucacaagcacccauaugcuuauacaaugcauacauauauacauugaaaaaauaggcugaaagguaaaaaaacauagacagauuuuguugcuggagcugaccccaugugaacuccuggccauaaucuuggcaaagaagguauacucacugaguacacaauuucaccuggggaagaugaaaaagcucugccgaucuaggaugguaacauuugugcuucuggcuauugaguucuuaaaagucugagaugguuuuaugccacaccacauguauuuuauuagguggucaagcucuguguacagaaguugaaauacguuccaggaagagauucaagaaauguucagggccaacagcagggagaauacuaauuagcugagaucagcugcagugccaaugcccuuuggacaaccuggauuccuuuggaggguuccugaugcacacauagcaaugcguggccuuguuauggcuccccugcucauucuccugguuggugggacugaagccuuucguaucugugccuucaaugcccacagacugacacuggccaagcuaaccaaggagucagugauggauaccuuaguucagguaaguucauuguugcagaaauuuguguccauaggaccuugacuaaaaacuccccauccugccugaccauaaaggaggggacaucuggaaaagugaauguacagaugugaagagucuuucaaccaucauuuaauuaccaacuuccuccucuaaaaauggguaagguauaauggaaugauguuguuuguuuccugaguuucuccuugucucacugcugucugcagccacucugguaccaaucuuuacauaaagcuccuccauguugacagcucugaauugagcugguaucccucauucccugcagauccuagcccgaugugauaucauggugcuucaggagguaguagauucuucccagaauacuguccccuuucugcuucaaaaacuuaaaagguaaagaaggacccuuucaaucuaaucugcauuccaccuagagccuuaagagcccuaacucugguuuuguuuccugguauauuugacaguuccaggaguuacagcuuccuaaacagcucauugcuggggcgcagcacauacaaggaaaaguauguguauaucuacaggugagcacaggggucaagaauccucaucaugacaauucuagguaggggucugaagacccagcuauucuauucuauucaagaagauaaaucagguagaugaauugcuggagcccaugaguucaagaccaguuggguuauaaugaaaauggaucucaaaaaaaacaaaacaacaacaacaaaaaaaaaccaaccucauaaaaguucucuggagagauggcucaguaguuaagagaacuuguuguucuuccagaggacuaagguuuuauucccagaacccacacaagagcacacaaccaucacuaauuccaguuccaggagaucuggcauccucuucuggccucuauagacccaugacgcucagaaauacauguaggcaaaacacucauaaaaauaaaauaaaaauaaaucucuaaaccaggaggaagugguggcacacaccuuuaaucccagcacucaagaggcaugggcaggcagaucuuuggccagacuagucuacaaaucaaguuccaggacagccaggauucucuuaugcagagaaacccugcuuaaaaaauagaacaaacagccgggcaugguggcgcacgccuuugaucccagcacuugggaggcagaggcaggcagauuuuuuuuaaaagauuuauuuauuuauuuauuuauuuauuuauuuauuuauuuauuuauuaaauguaaguacauuguagcugucuucagacacuccagaagagggggucagaucuuguuauggaugguugugagccaccaugugguugcugggauuugaacucuggaccuucggaagagcagucgggugcccuuacccacugagccaucucuccagccuggcagguagauuucugaguucgaggccagccuggucuacagagugaguuccaggacuacacagagaaacucugucuugaaaaaccaaauauaaauauaaauaaauaaauaaauaaauaaauaaauaaaacaaagccaggcaaucauggcacacgccuuuaauuccagcacuugggaggcagaggcaaguggauuucugaguuucaaaccagcauggucuauagagugaguuccaggacagccagggcuacacagaaaaacccugucucaaaauaaccaaaauuaauuaauuaauuaauuaauuaauaaaaaauaaagcaaaacacaagacacagccacagaaucaacuaagcagggcucauagagaaucacagagacugaagugauaaucacagaccguguaugggucugagcuauguucaugguugugcagcuuugggacuccuaauuccuuuugccccuuuccuacaacuggguugccuagucaaccuugauaugaggguuugugccuaguuguaaauuguuauaccguguuugguugauauuccugggaggccuguucuuuuuguuuuugaagggaaauggaggaggaguggaugggggcaggcgagaaacugaggucgguauguaauguaugagagaauaaaacaaagaucuuaaauuaaaaaacaacaaccaaaacaguuccagggagcuggaggcauaacucagugucaaagugcaaauuuauccccagugauaaaugaaaaacuccaagccaggagugguaucccaugccuuuaaucccagcacucagaggcagagacagauggaucucugugaguuugaagucagcauaguuuacagagcaaguuccaggacagccagggguacacaaaaagaaacccuaucagagaugagagagagagagagagaaagagagagagagagagagagagagagagagagagagagagagauccaagacagacagacagggcuacauaauagaacuuuucuuuuaaaaaaaaauagaaggaauaagaaaaaacccuaaguucuagaaaaaaauggcuguacccccaugagaguggcagaacaaggagccaggcaucuuccucuuugagcacuaacucuacucuuuuuauauaagauguggggccacuacuuccuaccucuuggucuucccaggucugacaagacacagguccuaaauuucuaccaauacaacgacacagaugauauuuuugcccgagaaccauuuguggcccauuucacucucccuagcaaaaguaagagggguaaaaaaaucugggccugguacaaggaaauaggagggggauguggcugguuuuccuguggguugguuucugggggaagcagaggugguuauguagaaggccuggcagcuguggcagccucagcuuccuggaccuugcagcucuuccaaguguggugcugguuccucuccacaccacucccaaggauguugagaaggagcugaaugcccucuaugauguguuucuggaugucuaccagcgcuggcagaaugagguaggggugauagauuccauggcagaggggauggugcaaaugccuuuuagcaagacgcaguggcuucugucgucucuagaaugugauucugcuuggagacuucaaugcagacugugcaucgcugacaaaaaaacgucugaaaagccugcuacuccggacuaaggcaggcuuccacugggugauuccugauggggaggauacuacagugcgggccaguacuaacuguaccuaugaccgaauuguggugcauggacagggcugccaaaugcugcugaaggcugcagcuaccuuugacuuucccaagagguuucagcugacugaggaagagguagagaagcugggugggcaaaauggcugagggcagaauuguggaggugagccagauacugacacuucauuuuguucucuccucaggcucuccgcaucagugaccauuauccuguagaaguggaacugagccaggccacuccacugaguaucccaccccacuacuuagccgcucuacugcugucacuccugccaucucagcuggacuagauagccauugacuugaccagggcacugguagucucagaugugaaagucaaugacagcuuuuuuaaauagcugcuugcuauucugagaaagcuagggcugggaguauaacucagcaacaagugccuugggcuugaauccuguuggguagacaggacuucaccugagguaguuaggaacaaagcuccaguagaaaugggcucagaucauaccuaagauuucugcaacugauacaaaugagcucauacuggaaaaaccuuaggucuaaguaaucuugcuucuccaugcacuauacuacauggcucugccaguguugucagguuuaaaauauucaauaaaaucauuuuaaccuuuug

SEQ ID NO: 9568 - RNA, 8242 nt, Mus musculus
cugcucgacgaauccgccugaaagcaagucgaggaagcguccuugcuuguugucgcaaacaugccuacuaucacccgugccaagaagcagcagucuaucauugaacaguuaccuggaccuagggaaaaaggugagguaggcuugcucauucuuuggccaguuccccugcagcaaagagcagagcagaggcagucuucucucaggguccucaggcccugaaccacaauguuggugcgcacucccaaauuaaguuugccugugugacgacugcucagaaaacccaaagcaaaggaccuuaugcacaggauggguagcgcgacugaccuguucagguccccacuggaguggcaguuuagaaaaaugccucauggcagaaauuuguuaguucugguaccacaugaauacuaggcaaaugcucuaucguggagauaaccaaaugccccaacccccagaucacugggagaaauaguacaauaaaaggcagagaauaauagacgcggacacccgaugcccuuuuccggucucugugugagccuucagaagcaugcauaaccggauacacaucgggugggacagggaaagagaacaaguaaaaaguuuccaccagccuacgacuugcguagcuucagguaauggugcuguguagcuaaugucgccuguagacacuagaauuauggaaucaaagagacgcagcacugcuuaaggcgguuuggagccaaaaccuugacgggggaggggccggagcgaggcuggcguagacccgcccuggcagccgucaagcaaccuaggcauguuuugcgacaacaggcaaggacgcuuccucgaguugcuuuccggcugauucgucgagugaggccgucaagacuugguuucuagugcgcauugcuuuguacagcagucccgucucgucgccugagcagcggcucuucucuauccagagaacagugcuagggaggugcugagcuguuccaccaggugaccuuagucuaguccucugccagucuguuggagauccuucuccugagugguagaggacaucggcuggccuggggcaagaggaacucugggcuccgggggcggggccggagccggaggagaugccccuccaugugaaguggccauuccccgcggugccccggcucaccuggacucuagccagcagcgucgucaugggccuaguuggcaccuacagcugcuucuggaccagugaguggcaaaaggccaaggcagagucuguucacaggccucuggccuggcuggggguuuucggacugggaauauggcaggggcuuuucuggcacaguaagaagccucgggcagguggaaaugaccuagagcuugggacugacuucucuucccagaguacaugaaccaccucaccgugcacaacaaggaagugcuguaugagcucauugagaaccgaggcccugccaccccccuuaucaccgucuccaaccaccagucuugcauggaugacccucaucucugggguauggugccagugugcuggguucagggaggcaaaacaagaacaggcccccaccaaagacagauugacuucccaccaggcucuuuugaaaaacuuuaccuuguuugggggauauacugccuaacugcuggaaguuuugugugucccccuuaggauuccuccagggaaugugauuuagacaggauaucagaaauuuaaaaggaguguggaaguagccaugucacaucaaggacuuuacuuuuucacagggauccuaaaacuccgccacaucuggaaccugaaguugaugcguuggugaggaggaaugggccccuugaagugacccauccauuucugcccagauuugccuuucucugcucaggaguuggcauccagccuuccaggaagggcauggguggggcuccuuagggccuucucuuggagcuucauucuguauggcagugauggcaggcauuauauuggguggggagaguuggggacaagcaaugggaagucuuggaggcagggaugauugggucuauugcugcucuaggaccccagcagcugcagacaucugcuucaccaaggagcugcacucccauuucuucagcuugggcaaaugugugccugugugucgaggugagcugcuccucugggaggcauguccaggccucccuuggggacaaggaagcugguggucaaugcgucugucuuagaaggacuuaggggagccaugauauggcaguauaguuggcagagaauaggaagagggaugaucacuuagaaucucugcaguccaaaacucuggugugagaauucaaggaagcuguauuugcagucccuucugaaucuaccacuccugucagggagaacagugugguguuaccacuuuauaauggcagugggguacauguauagaaggcuaaggguuuuguuuuugggagaacaaacagugguaagaugaggaggcucagauugaccacucaguaccuuucacaaaccccuuaguguaggggccaucuugaccccauucucuagauagggcucagauucucuagacaaagcuuagaaguccaaggucauagacuaccauguggcaaacuuaagauucagauccacauugcccuuucaucuggguauguagauuccuuuucaagcaaagaaugaaagaaaggguggucuaaaaauaagagaagagaagguuagagaaugucagaaggguagaagauuguauuuccaccuuucuaagcauuccagaagagacuauauuauuuuguugaaugauauagucucagugccauuuccucucagauccugcucugauaugucagcauucugauaauuuacaccugucccugacucuaagcuccuuuacucugcaaacucaaaagucuuguguguaugcaucuguuuucauucuuuaaaaaaaaaaagauuaauuuuaugugugagcacccuguuuucagacacaccagaagaggccaucagaucccauuacagauggcugugagccaccaugugguugcuggaaauuggacucagacucuuuggaagagccuuuguucagugcucugaacuccugagccaucucuccagcccuuucauuuuuuucuuuuuucuuucguuuucaguuugagggauagaacacagaggcuuguauauuuuaggcauauacuguaccuauggccuauacagauaguucuguucuucuugaacugauucuagacuuucuugcaguuaaaagccgaucugagugguuggagaacuaucucagugguuaagagcacugccugcucuuccaaaggaccagaguucaauucccaucagucacauggcagcucaugccuguaauucgguuccaggggauccuacacccuuacauagacauacaugcgggcaaaacauaaaaauuaaaaagaaaaaaggaucugagaugaacauggugauauaugccucuaaucccaucccaucacucaguaagcaggggcauaaggauugaggccagccuggucuauacagcaaguuccagacugaccagaacuauaggacuacaugguaaucuuucucucuuuguuauuguuguuguuguuuuaaagacaguuugucuguguagucuuggcuauccuggaacuagcucuauagaccagaugaggcaacucauccuccagucucuuccuuccgagugcugggauuaagccuagcaugauacccuaucuuaucaaaaaaaaauaauaauauagaagcuggucauggucgcacacaccuuaaucccagcacuugggcagaggcaggugaaucucuugaguuugaggcuaguauggucuacagagcuaguuacaagauugccaagacuacaaagaaaaauccugucuuagaaaagaaagaaagaaaaaaagaaagagagaaagaagcuaguuauuaugccuguagucccaguauuugguuuguuagguugggguaggugaauuaccaugaguuugaggccaacuagaaaccaagacccugucucaaaaaaaaaaaauuaaaguugugugugugcacauacauacagagaaacugagagcuggaagugugacacagugguauaguuuuuacuuaacuggcacagagcccugaguacuauccccagcauuguaaaaauauagaacaaaaacuagaagauggaacauuauuuucaaggaaagcaaagaucuaauuacaugugacugaaacaaacagaguuugggauacuuuguuucuguuuuuaaacaaaccauuuuucucuaagccuaggacuuuguagguucaccuuuaagcacugaagugauuuuguacaagugcuugcaguagcuaaaaaguaugccaaagauacgcuauccuugcugggaguggugguacacgccuuuaauccuagcacuugggaggcaaaggcaggcagauuucugaguuggaggccagccuggucuacagagugaguuccagggcagccagggcuacucagagaaacccugucucaaaacacacacacucuuuuacuucacaguuucaagcucaaagguuauuuuuccaacagugggguuuacuagaggagcaaacaccugugaugaacaccccugcuguguacuaccaucccaaguagggcaccuguggcucucucuguuuccugagaucaucccaacuucuggccccuaagugagcugccagaucaggucccuguugagggugggcugagacuuuuuuuuucuuugguuuuaugagacaggguuucucuguguaguccuggcuguccuggaacucacucuguagaccaggcuggccucaaacucagaaauccaccugccucugccucccaagugcugggauuaaaggcauguaucacuauugcccggccuuuuuaagauuuuauuuuaugcucuuuccuucuuuucuuucuugaagcacaucauuucucucuuucucuuucccuccccuacauccccuucccacauggugacuuaccuggcuuugguccuugggucuagugaacuagcucaccugagaacagcuucccaauaaaccugucuucaguaaaauaaaaaauaaaaauuuuauuuuguauauguuuguacacuauagcuuucuucagacacaccagaagagggcaucagauccuauuacagaugguugugagccaccaugugguugcugggaauugaacucaggaccuguggaagagcagucaguguucuugaccacugagccaucucuuuaacccuugaaaggcaauucucaaugcacugaccugagauagccccaguguugcucuuuguccuccagccucuucccuuccacuuucugauucuguccacccugugguuauucuuccacuauuguauguccaggugacuccaaguugcuagcccacaagagguguuaggucacacuucuugaaauauuaaucaguuuucccaaguuuuccaaucuuuucuguguuuucuacuuccugaaguguucucccuuagcccagaaaccugagggaagguggaagcucuggagcugauuuguagucagcaaauggguguguguuaggggggcagguuccagcaaggcaggccguagggcagagggagguugaguugccaugauuaucauuucagugagagauacugucuagcuaagugucuugauacaugccuguuauccagcaccauuaaagcugaaacaagagaauuacuauaacuuugaggccaaccugggcuauauaguaauaucugucacaaaaaaagaaugugcuauuugcauuugacaggcacuaagaaguugagggaauauuguuuuguuuugauacaggaucuuacuguguugcccauccugaccucaagcucagagcaaucuuccuaccucagcuucccaaaugcugagauuacagacaugagccaccauuuccaucuuaagaggaagauauggucaaaccaaaaaugugaagggccaggguagcaaagagaaacaggcucuagaaauagauguugaugugucuauggauggugcuaugggaaaugaacugcugccuccauccuaaaguggauagaccaggagugagccagaaucuacuucacuaggguuuggagaguuugauuucuucuccagagaauggauuaaggagaacagaccuuucucuacaggagauggugucuaccagaaagggauggacuucauuuuggagaagcuuaaccauggggacugggugcacaucuucccagaaggucaguugggugcuugaucagggcccuccagcauucaugguucuaggcccaagcuuuuucucuguguucucucauuagggaaaguaaacaugaguucugaguuccugcgcuucaaaugggguaaguauugcuggccagccugacacagcuaacuuccccauccaaagauggccccuuggguccuuggcuucguuccucucucaggugggugugucaggagcaguagaaaagggacaggcggugagucaaggacuaaguuccauugagagacuguagaagugacauuggccagacguuggcagggaaguuuggcccagcuugugccaaugcuuuggcauuucuccgaaguaggaauuggacggcugauugcugagugucaucugaaucccaucauccugccacuguggcauguuggugagucauggauuggggguagggaggggacugucuuagaugucguuaagggggauuucagguuguuggguagcugagagaaguaccugggauucucucugguacccugcuucucccaauggcuggcuuucuauccacugugguacaggaaugaaugauguccucccuaacagcccacccuacuucccccgcuuuggacagguggguaggcacugcugacucuugucuaucuauuucccugcuaacugcccuguguuuccuuguccauacuauacaggauugguugaagauuugcugagcaugagcauguaguaggggagcuaaguggggcuuuucuggaagcaagaccuuuagaaaaagaauugaaaucaggcgggggugagggacaagguagagugggacaaauuauugauaggauauugacuagacuggcccuuggauaccaucaagcccaauugccuguuuugaagagggagaguggcuuucaggaacgucaagcccaucagguacagagcauagcucugaauccccgcauuguuugggcuggaacuauagguuccuugucacccuugauggccugccuucuuacagaaaaucaccgugcugauugggaagcccuucaguacacucccugugcuugagcggcuccgggcagagaacaagucagcugugaguuuccucccaggguccccuagcuguccuuggccuucucagucccucagacucccaggguaccccagacaugguccuugaggaaugcaggccagaaccauccuugcucuuagguggagaugcggaaagcccucacagacuucauucaagaggaauuccagcggcugaagaugcaggcagaacagcuccacaaucauuuccagccuggaagauaggcuuugccugcccagucugugcccugcaguucuuagccaaaggaacacuggguccuucaggauuugggaaguggugguacaggaaccugaccaagcuugcuuggcucuuuacugcuuuugagauucuucccuguacaaaacugaggcugggaaauggacugaugcuuuuaauucagauagauuggcucccaauuccugcuggauacccuuuuuuauucuugaacaucugacuccucugggucuugagcuaaaagaagagccuuggcugucccuuauacuugguggagaaggaagggacacucuuaggcaggggcccccuucucaccucucagggagggaacagagcagguagucaagcaaauaguuggguaggagaacagguuucuuggucauagguacagaaagaagacucaauuggucccuuggaugggcuacuacuugcccacugcucacaaaccucaucagggauagcugucagccaggucauucuaccugagcuacugcuacaagguuuguccuuggguggccuguagacaagaagagaagguauuggccaggauucaagcacagcuaaacuuaacuagauguuucuuguauauagcagaagaaggacccccaagaccugaccauuaacccccagugucagggccuaccugcuucucuaaucuuuuuugccuugucauccucuauauccugggaucuggguuuuaauguuuuuagaguaauaaaacauuuguguugugccaccauac

SEQ ID NO: 9569 - RNA, 7627 nt, Mus musculus
ugagggcggggcuugggcggaggugccggucaucugaucugcaguggcuucagaggcccaggcacucacugaaagcugaggcuaugauggcggcaacagugguaucucggauacggacggggacagggcgggcuccagucauguggcugucucugucguugguggcaguggcagcagcaguggccacggagcagcaggugccacugguacuguggucgagugaccggugagcgggcagggacaggccugguugggcuggccggcuuggcugaguugaaucgggccagguuggguuugggagugccaugcggugcgccgcgguggaugagucgccuuugcugaacuccagggcuguccuuggccagaggcuucgaggcccagauggagauugucuuuuauucagggacucgcuucaugacggcgagcguucagaucucagggccuugcaugugaagccaggagccgauaggguuaggaucucaagcaacgaaaucaggucugacagucccuauucuguccacuuccaggaaucugugggcuccuguggccgacacacaugagggucauaucaccagcgauaugcagcuuucuaccuacuuagacccugcccuggagcuggguccccguaauguacugcuguuccuacaggacaaggugagucuguucuagcuugcuaugucuuuguccaaggaaagcugaccccaccccaccccuacugcccguuccauaggugaagcuguagugaccuccuuccaccuguaggcagguguggcuagauuuuuggaaagauauguaggagaagcuucagugggaacaguagacccacagaaacagcagggacuugauuuaaggaagcaagggauuaacugggcagugguggcacacucuuucaaucccagcacuugggaggcagaggcaggcggauuucugaguuugaugccagccuggucuacagagugaguuccaggacagccagggcuacacagagaaacccugucucgaaaaaccaaaaagaaaaaaaaaaggaagcaauggauuaaagaccagauaccuaccuaguacuaagcauuacuuucugauguccuauacugugguggaaauuacuacucaguuucacagaugagaagacucauuuugggauaagaucagugacuugcccaagguuucauuucauucauucauauauauauauauauauauauauauauauauauauauauauguaguauauauauauauauaauagcuaaugguuggcaguaauaggaauaacuggaaaaugaccuuuuauuuagucugguaugugcauucuauucaacugauaucauuaucuuguuuuaacugcuaaggaaaguaauguugaagagguaaaaugaauugcugaauugugauuugcacaauacacuacuuccagccugaggguaucagaccuguccuucaguuuugugcugagccagcauucuauuuuccuuucacuccagaggucugcaccuagagcaggaguaugaacuaugagaagguucuaauguagcauaagauuauuguucaagaggaugucaagucucugcuugucccuuccuccauaguagccugacuagcucuuucuguucuugcuuuccuucaguuccugugucggugguaguaauugugcugguugauaguccuuucagaagaugguaaauaacaggucagaccagaacucaguccuaucauuuuucagccuuugagcgcaugaaauaaucuuuguuaaccauacuuuucuguaagugcaaaaugaagauauccaccuauaucaggagucugcgagaaguauucuacauaagucaucuagccacagucucucaaucuuaggacauuuccuuuugacaaugguggcgugcuugcuauguguuuggaaguauaaacauucuugugaaggcaaguggcuaagagcuaaguugguacauguuuaugauaccagucuuuuuagucuagagaagggagcaggcuaagacaacacaguaaggacacuguuuuagguaacagugagaucaggcagggucucuggagauaacaucuuauuggcaggaaggagucaugugacuuuugaggcaggccauuacuggcaggagaacugcagguguaagggcccugggcaagggaguguucuuaaucaguucuaggggcugcuugugagacuggagccuaguaugugauugaaagguuaggagaugauccgcuaggucaccuagagauggaggaaaugccacaaggggaaagguugguaggaagauagcaagccuugcauagguagcacagaauauaggagaggaacauaggaaaggagacugggcuuauguauaguaaacauaaugaguuuagggaagcugguuaagauugccucugggccuaacugggagaagccagaggaagcuagcuggggguugagggaaggaggagugaaaacacuuuuagguuguagagagaagggcaugagauuggcauugccaggguccugagagcuccgaaaucuguuucccccauuuuguuccaauaucuuccucuccccucacucuuuuuuuguuguuguuguuuuguuguugcuguuguuguuguuucaagacaggguuuccucuguguagcucuggcuguccuggaacucacucuguagaccaggcuggccucaaacucagaaauccgccugccucugccucccgaguacugggauuaaaggcgugucuccccucauucuuaacaacaaugguggggcauggacuuccuccuuugaaaaggauccugcccaaacuguauagagguucauuugcucugacuucuacuucccucuuuagaggcauauaguaauuguucuuugcuguccucuuccuguucucuaacuucccucuuccuccccaguucuucuugcugccugacccuuguuuuguagguuaucacaaaccagcuguacauaaaucucucaacccuaugaucaccuucuauaucuugucaucaugcccucagagugcugggagaaaagaguaagccuuccacucaccuccaccacaaguccugaugguucacucuuuuguuagccuggagaaucuccccuccauguccuggcccuuggucuuuguuccuugcccagccuccuaggacaucucuucugcuuuccuuuuagcuaagcauugaggauuucacagcauacggugguguguuuggaaauaagcaggacagugccuuuucuaaccuggagguaagggucugcucacagccaaaaggaaagacaauacauucuguguucucucccagagagaggaccagaggcuuugaggguagagggcuugggaugugacugucaaggcuuggagauaugggacauuuacuuucugacucauucugggauccagucccuaugggguguggcuuuccaggugagguuuuagugguuauuauaagauccacugaucccuggcucacuuugccuuccacaucuucucuaccaucagaaugcccuggacuuggcccccuccucacuggugcuuccugcuguggacugguaugcaaucagcacucugaccaccuaccuacaggagaagcuuggggcuagccccuugcauguggaucuagcuaccuuaaaggagcugaagcucaaugccagccuuccugcccugcugcucauccgucugcccuacacagccagguacagccuagguggcauggcuuccagccucuaaccuugcaccucagauagggguaagauccugggaucuguugguggcagaguucaaucaaagaugacaguauucuccuguucacuaccuugggacucuuacagaaaguucauuuuaugccaagaagugacagaaaggaccuccugucagguugugacuuacaaguauucaccacugaguuaggccuauugggccuccagaaaugagaaaacuuuguuaccacuaaugcccacuuuauaggacuguagacauaguugcaaauaggggaaaggggaauaggauuccagacagggguacugaagcaaauagagguguggaagugggaauagcuguugcugagcuaagugucugcaugacagagcagcagaugaaguccacagacuuaguaaguggggcuaguaggaagggaaauguuagaagggcugagagaaagguagugaguuucagagaacugauccaggcaagcuauuuggauuugagagcagagcaaccugugggccucucacuuuuuuuauccauagcuccggucugauggcgcccagggagguccucacagguaacggugaguguguuacuggaaaauuuauguccccauuuugcccuugggccaggaaaauagaacugguuucuccuuaccacaagguuguccccguuucucagaguggcugacagcugagcaaguacaucguggcuggcugcuuggccauguucuucuguagucagccccaccugacagagauauccaagugccuuaugacccccugugcaagagcuccaaaaucuaguuuuuguacaaguacaaugaaucucuguauuuaauagaccaguaacauuaugcaaaguacuucuuugugguaaaggacagucccaucugcuguguagauuuugaguucucuguaucacuauauguucuguuuacuuagguuuagcuugccaucagagagcuacaauuguccccagagagacuggcagaguauguagaaggagaaauaccuguuuuuuagagguccucaguggaaacuaacagcacugaauucucauagucuagaaggucucugaaucagacaauggguaguauuucucuaagcaagcuaccuagugacuuggcucucuguucucuugucacucuucagaugaggucaucggacagguacugagcacacucaagucugaagaugucccuuacaccgcagcucuuacugcaguccgcccuucuagaguauguacucuucuagcaggggcccuggggaaugagggugugaggcaauguggugagugugacuagagaugaagggguaugucacaggcaggaucucucaggaggcuucaguuugggggauuaauggacagaggauugcuuccuccauccauggugccuuuuuucauuuugcuuaugagccacuuugggcagugugauuguuaguuuagggagauggaauaucaggucuagggacuuucagaugguauacaggguaaccaguggggaaggaauaccaguccaguggauuagguuuuguuuuuagggcuguugagagaaggcuuguuggauguuucuacagguggcccgugauauaaccaugguggcugggggucuaggucgccagcugcuucagacucagguggcaucuccugcgauccauccuccugugaguuacaaugacacugccccaaggauccuguuuugggcacaaaacuucucuguggcauacaaagacgaguggaaagacuugaccucccucaccuuugguguggagaaucuuaacuugaccggcuccuucuggaaugacuccuuugccauguaaggguuauaggaagagaaggaagggcuauccuaucacacauggucuuccugucacugugagcucaguacaggacaaggaugugggauuauguuugugugguauguucaccaaggacauagaugucacaguaucgcagggugauauugcugggagguuacuggugagggagccucuuaagaguuuggccuucucauguuuuuuuagguauugguuguuggguccugagcuuuuauuaccacauagucccuugggauccuggaccguuuuugaacccaaccccugggacugcauguaggcaaauaucaaaccaacuguuaaaaccaguccuagguuuccuacccuugaaaccucagcaggcagcugaauaaccccaagaaggaggccuaggaaccagaggaaggaauccuaaguuggagaugugaaaccuaauuguuucacaacugcuccugauuugcuuaugacuggaacuuuacuuuucccauaugguaaauggggacacuguauuggcaggugacuauaaggauggaucuagggcagcuuagguuggagccaaccugaugaggaccuucuuaagauccuucuagagccugacaguacuccucugccuuguuccauaggcuuucacugaccuaugagccacucuuuggugcaacagugacauucaaguaaguucuguuggcugaaguuugucagggcuggcgugucuucacucuguucuguucaucugacaucucugcauccccugccucccagguucauucuggcuagucgcuucuauccagugucugcccgauauugguuugccauggaacgacuugaaauccacagcaauggcucuguugcccauuucaauguuucccaagucacaggaccuagcaucuauucuuuccacugugaguacgucagcagugugagcaagaaaggcaaucuccuugugaccaacgugcccucagucuggcagaugacucuucauaacuuccagguauugaaagggugaugggccccaagcugguggcaguaaggggagggaagaagggcccagagaaucucaguaugguuugagcauguagcugagaguuccagccuugugcagucucugaagguauagauuauucauugauuccagaaucccagcucuuacuguguguggaaccuuguggaaccaucugauccaugucaaugugucuccuagauccaggccuucaaugugacuggugaacaguucuccuaugcuagcgacugugcugguuucuucucuccgggcaucuggaugggucugcucaccacccucuucaugcuuuucauauucaccuauggucugcacaugauacucagccuaaagaccauggaucgcuuugaugaccacaagggccccaccaucacuuugacccagauugugugacauacaccugagaggaauugagggaguauuggugucuagguugucauguuucuguuuugugacacaguggauggaaagguuuguccucuuccuacuauagcaugaacccuacauacgccacccucagucucucuugcuuccucuuuaacccggagagggacuccccuguggcuaucccccaucucuaccaacaaaguguauucuucauagauauuagauaaaucuuccaggcuucaucaucaagaggggaagggaccuuaauucuagggucuccccuuuacccucucuccuuauuuauucuugccccucugcuauuauuccuugcuguuuauagugcuuuuguguaguaaaugcucacuccccaagcuuuauggagcuuccagcaacagccaugaacuugagguuccuugaauuugcgagguguggaaagacuacuugacugucuguccagcuuagcuguuauguuuuuugggggggaggggugauguguuaagagugagugguacacugggguuuauuucuguggccugggaaggaagaaaccaucacgaggauuggugaacaaagugugcucacuggguuucuggauuauucccauaaagacugccugucaagaggccggaggugugugugggggguugcucuguuguuuccuuccuaauaaaauaaagacguguugccuuguguugggcuucgugucacucauuucugcacug

SEQ ID NO: 9570 - RNA, 7627 nt, Mus musculus
cagugcagaaaugagugacacgaagcccaacacaaggcaacacgucuuuauuuuauuaggaaggaaacaacagagcaaccccccacacacaccuccggccucuugacaggcagucuuuaugggaauaauccagaaacccagugagcacacuuuguucaccaauccucgugaugguuucuuccuucccaggccacagaaauaaaccccaguguaccacucacucuuaacacaucaccccucccccccaaaaaacauaacagcuaagcuggacagacagucaaguagucuuuccacaccucgcaaauucaaggaaccucaaguucauggcuguugcuggaagcuccauaaagcuuggggagugagcauuuacuacacaaaagcacuauaaacagcaaggaauaauagcagaggggcaagaauaaauaaggagagaggguaaaggggagacccuagaauuaaggucccuuccccucuugaugaugaagccuggaagauuuaucuaauaucuaugaagaauacacuuuguugguagagaugggggauagccacaggggagucccucuccggguuaaagaggaagcaagagagacugaggguggcguauguaggguucaugcuauaguaggaagaggacaaaccuuuccauccacugugucacaaaacagaaacaugacaaccuagacaccaauacucccucaauuccucucagguguaugucacacaaucugggucaaagugaugguggggcccuuguggucaucaaagcgauccauggucuuuaggcugaguaucaugugcagaccauaggugaauaugaaaagcaugaagaggguggugagcagacccauccagaugcccggagagaagaaaccagcacagucgcuagcauaggagaacuguucaccagucacauugaaggccuggaucuaggagacacauugacauggaucagaugguuccacaagguuccacacacaguaagagcugggauucuggaaucaaugaauaaucuauaccuucagagacugcacaaggcuggaacucucagcuacaugcucaaaccauacugagauucucugggcccuucuucccuccccuuacugccaccagcuuggggcccaucacccuuucaauaccuggaaguuaugaagagucaucugccagacugagggcacguuggucacaaggagauugccuuucuugcucacacugcugacguacucacaguggaaagaauagaugcuagguccugugacuugggaaacauugaaaugggcaacagagccauugcuguggauuucaagucguuccauggcaaaccaauaucgggcagacacuggauagaagcgacuagccagaaugaaccugggaggcaggggaugcagagaugucagaugaacagaacagagugaagacacgccagcccugacaaacuucagccaacagaacuuacuugaaugucacuguugcaccaaagaguggcucauaggucagugaaagccuauggaacaaggcagaggaguacugucaggcucuagaaggaucuuaagaagguccucaucagguuggcuccaaccuaagcugcccuagauccauccuuauagucaccugccaauacaguguccccauuuaccauaugggaaaaguaaaguuccagucauaagcaaaucaggagcaguugugaaacaauuagguuucacaucuccaacuuaggauuccuuccucugguuccuaggccuccuucuugggguuauucagcugccugcugagguuucaaggguaggaaaccuaggacugguuuuaacaguugguuugauauuugccuacaugcagucccagggguuggguucaaaaacgguccaggaucccaagggacuaugugguaauaaaagcucaggacccaacaaccaauaccuaaaaaaacaugagaaggccaaacucuuaagaggcucccucaccaguaaccucccagcaauaucacccugcgauacugugacaucuauguccuuggugaacauaccacacaaacauaaucccacauccuuguccuguacugagcucacagugacaggaagaccaugugugauaggauagcccuuccuucucuuccuauaacccuuacauggcaaaggagucauuccagaaggagccggucaaguuaagauucuccacaccaaaggugagggaggucaagucuuuccacucgucuuuguaugccacagagaaguuuugugcccaaaacaggauccuuggggcagugucauuguaacucacaggaggauggaucgcaggagaugccaccugagucugaagcagcuggcgaccuagacccccagccaccaugguuauaucacgggccaccuguagaaacauccaacaagccuucucucaacagcccuaaaaacaaaaccuaauccacuggacugguauuccuuccccacugguuacccuguauaccaucugaaagucccuagaccugauauuccaucucccuaaacuaacaaucacacugcccaaaguggcucauaagcaaaaugaaaaaaggcaccauggauggaggaagcaauccucuguccauuaaucccccaaacugaagccuccugagagauccugccugugacauaccccuucaucucuagucacacucaccacauugccucacacccucauuccccagggccccugcuagaagaguacauacucuagaagggcggacugcaguaagagcugcgguguaagggacaucuucagacuugagugugcucaguaccuguccgaugaccucaucugaagagugacaagagaacagagagccaagucacuagguagcuugcuuagagaaauacuacccauugucugauucagagaccuucuagacuaugagaauucagugcuguuaguuuccacugaggaccucuaaaaaacagguauuucuccuucuacauacucugccagucucucuggggacaauuguagcucucugauggcaagcuaaaccuaaguaaacagaacauauagugauacagagaacucaaaaucuacacagcagaugggacuguccuuuaccacaaagaaguacuuugcauaauguuacuggucuauuaaauacagagauucauuguacuuguacaaaaacuagauuuuggagcucuugcacagggggucauaaggcacuuggauaucucugucagguggggcugacuacagaagaacauggccaagcagccagccacgauguacuugcucagcugucagccacucugagaaacggggacaaccuugugguaaggagaaaccaguucuauuuuccuggcccaagggcaaaauggggacauaaauuuuccaguaacacacucaccguuaccugugaggaccucccugggcgccaucagaccggagcuauggauaaaaaaagugagaggcccacagguugcucugcucucaaauccaaauagcuugccuggaucaguucucugaaacucacuaccuuucucucagcccuucuaacauuucccuuccuacuagccccacuuacuaagucuguggacuucaucugcugcucugucaugcagacacuuagcucagcaacagcuauucccacuuccacaccucuauuugcuucaguaccccugucuggaauccuauuccccuuuccccuauuugcaacuaugucuacaguccuauaaagugggcauuagugguaacaaaguuuucucauuucuggaggcccaauaggccuaacucaguggugaauacuuguaagucacaaccugacaggagguccuuucugucacuucuuggcauaaaaugaacuuucuguaagagucccaagguagugaacaggagaauacugucaucuuugauugaacucugccaccaacagaucccaggaucuuaccccuaucugaggugcaagguuagaggcuggaagccaugccaccuaggcuguaccuggcuguguagggcagacggaugagcagcagggcaggaaggcuggcauugagcuucagcuccuuuaagguagcuagauccacaugcaaggggcuagccccaagcuucuccuguagguagguggucagagugcugauugcauaccaguccacagcaggaagcaccagugaggagggggccaaguccagggcauucugaugguagagaagauguggaaggcaaagugagccagggaucaguggaucuuauaauaaccacuaaaaccucaccuggaaagccacaccccauagggacuggaucccagaaugagucagaaaguaaaugucccauaucuccaagccuugacagucacaucccaagcccucuacccucaaagccucugguccucucucugggagagaacacagaauguauugucuuuccuuuuggcugugagcagacccuuaccuccagguuagaaaaggcacuguccugcuuauuuccaaacacaccaccguaugcugugaaauccucaaugcuuagcuaaaaggaaagcagaagagauguccuaggaggcugggcaaggaacaaagaccaagggccaggacauggaggggagauucuccaggcuaacaaaagagugaaccaucaggacuugugguggaggugaguggaaggcuuacucuuuucucccagcacucugagggcaugaugacaagauauagaaggugaucauaggguugagagauuuauguacagcugguuugugauaaccuacaaaacaagggucaggcagcaagaagaacuggggaggaagagggaaguuagagaacaggaagaggacagcaaagaacaauuacuauaugccucuaaagagggaaguagaagucagagcaaaugaaccucuauacaguuugggcaggauccuuuucaaaggaggaaguccaugccccaccauuguuguuaagaaugaggggagacacgccuuuaaucccaguacucgggaggcagaggcaggcggauuucugaguuugaggccagccuggucuacagagugaguuccaggacagccagagcuacacagaggaaacccugucuugaaacaacaacaacagcaacaacaaaacaacaacaacaaaaaaagagugaggggagaggaagauauuggaacaaaaugggggaaacagauuucggagcucucaggacccuggcaaugccaaucucaugcccuucucucuacaaccuaaaaguguuuucacuccuccuucccucaacccccagcuagcuuccucuggcuucucccaguuaggcccagaggcaaucuuaaccagcuucccuaaacucauuauguuuacuauacauaagcccagucuccuuuccuauguuccucuccuauauucugugcuaccuaugcaaggcuugcuaucuuccuaccaaccuuuccccuuguggcauuuccuccaucucuaggugaccuagcggaucaucuccuaaccuuucaaucacauacuaggcuccagucucacaagcagccccuagaacugauuaagaacacucccuugcccagggcccuuacaccugcaguucuccugccaguaauggccugccucaaaagucacaugacuccuuccugccaauaagauguuaucuccagagacccugccugaucucacuguuaccuaaaacaguguccuuacuguguugucuuagccugcucccuucucuagacuaaaaagacugguaucauaaacauguaccaacuuagcucuuagccacuugccuucacaagaauguuuauacuuccaaacacauagcaagcacgccaccauugucaaaaggaaauguccuaagauugagagacuguggcuagaugacuuauguagaauacuucucgcagacuccugauauagguggauaucuucauuuugcacuuacagaaaaguaugguuaacaaagauuauuucaugcgcucaaaggcugaaaaaugauaggacugaguucuggucugaccuguuauuuaccaucuucugaaaggacuaucaaccagcacaauuacuaccaccgacacaggaacugaaggaaagcaagaacagaaagagcuagucaggcuacuauggaggaagggacaagcagagacuugacauccucuugaacaauaaucuuaugcuacauuagaaccuucucauaguucauacuccugcucuaggugcagaccucuggagugaaaggaaaauagaaugcuggcucagcacaaaacugaaggacaggucugauacccucaggcuggaaguaguguauugugcaaaucacaauucagcaauucauuuuaccucuucaacauuacuuuccuuagcaguuaaaacaagauaaugauaucaguugaauagaaugcacauaccagacuaaauaaaaggucauuuuccaguuauuccuauuacugccaaccauuagcuauuauauauauauauauacuacauauauauauauauauauauauauauauauauauauauauaugaaugaaugaaaugaaaccuugggcaagucacugaucuuaucccaaaaugagucuucucaucugugaaacugaguaguaauuuccaccacaguauaggacaucagaaaguaaugcuuaguacuagguagguaucuggucuuuaauccauugcuuccuuuuuuuuuucuuuuugguuuuucgagacaggguuucucuguguagcccuggcuguccuggaacucacucuguagaccaggcuggcaucaaacucagaaauccgccugccucugccucccaagugcugggauugaaagagugugccaccacugcccaguuaaucccuugcuuccuuaaaucaagucccugcuguuucugugggucuacuguucccacugaagcuucuccuacauaucuuuccaaaaaucuagccacaccugccuacagguggaaggaggucacuacagcuucaccuauggaacgggcaguaggggugggguggggucagcuuuccuuggacaaagacauagcaagcuagaacagacucaccuuguccuguaggaacagcaguacauuacggggacccagcuccagggcagggucuaaguagguagaaagcugcauaucgcuggugauaugacccucaugugugucggccacaggagcccacagauuccuggaaguggacagaauagggacugucagaccugauuucguugcuugagauccuaacccuaucggcuccuggcuucacaugcaaggcccugagaucugaacgcucgccgucaugaagcgagucccugaauaaaagacaaucuccaucugggccucgaagccucuggccaaggacagcccuggaguucagcaaaggcgacucauccaccgcggcgcaccgcauggcacucccaaacccaaccuggcccgauucaacucagccaagccggccagcccaaccaggccugucccugcccgcucaccggucacucgaccacaguaccaguggcaccugcugcuccguggccacugcugcugccacugccaccaacgacagagacagccacaugacuggagcccgcccuguccccguccguauccgagauaccacuguugccgccaucauagccucagcuuucagugagugccugggccucugaagccacugcagaucagaugaccggcaccuccgcccaagccccgcccuca

SEQ ID NO: 9571 - RNA, 6872 nt, Mus musculus
ccaggcuuaaguuucaauaguuuuauugggagguuuuuguuuucugugaaauauacuagagcuuggggaaggggacacauucacuuugcaagguaaggguuucccaccacuaaaggaaaaggcauggggcaggguacacugggguuuggauccacuuuccuaccuccuucugcuuugcucacauuacuuuuucucagugaacacaacacaaaagaaauucaaaacagaucaaccuccagagggggucacaccuaaaucuucucccaucccaggcuuugccagcacugggagaggccagggcagcucacucuacagcccuaggcugcacagaaaggcugagggcucagacaauuacuccaaaguuaauaaauuagaauaaauuauaaggaggaggaggaggaggaggaaugcaauuuugugcugggagggucccuucucuccaacaccuaagaguugggggaggagauggguaucuccaaaggccacuacauuugggacuaagagcagugggggugggggucagcuuuuccuccacuccuucccaaacagcaaaauugggggugcacgaugcacacacacaugcacacacauguacacacgcacacacacguacguacacacacguacacacacgcacgcgcgcgcgcacacacacacacacacacacacacacacacacaaaguucucuuucccuagaacaaggacagaccaagaaagaggauacuauccaacucccaucucccaaaccaucccuaagguuaaggauauggucagugaauaaaaucaauaaggugggugauuggaaugugguaggggaagcagaagaugcuggaaacaaggaugccuagccauaccaucuccccugcccuagagaaggacauacaaguuggggagaggggaacaggggcuggaggaggggagucagcaaucacugaucagcuucuccaaagacaucauucuguuugcgcuucauguucucaaaaucaaaggcagaaccagccaugcguuuguagauaucuuugaugucauugcagguugucucaaagugugugguagcaucauaggagcaggaacagaacaccuguaaauagacagaaccccagggcucacggaagucaggcagaggaucuuggauagacugcaagaaccaaggcugacugggacagcauuuuuaccugacucucugaaccaucaucaaugggcucauauaaaucacugauagccacaaaccuaaggggcaaauaaaagaaaagaaagaagagaaaagucucauaaugggccuugcccauuccuaauccccaaccuccccauaaaguuugguucagccucucacuucuggucaauggguuccaacagcuccaaugcaggcucaacuuccuuuucugguucugcagucucuacaguggugcuggcaauggcgauguauuugcccugugcggccacguugugcgcauaggagaucaugcacacauagaugucugaccaugggaagccaauugguuaacauguaccagaggaaaauggccacacacaaaaaguaguuccuagaggcuagacaggaaucuggcccacaugcuccugcucccaacccaacauguaaacagcauucaaacugucauuuucaugaacaagguaagagcucaagccauccaagccgcagggauucuguaacaaaaugucacaagaagcccuaagauuucuugugagaagagaugcauaacagccuggccuaccugacuuccuguugaccugguucugagggaugauaauuuggcaggaauuggcaucauugguauucuugaugggguggcugaggauacagaugaugcgaauaaccuggccagccuuuugcacacggucugggauguaacugggaucacagaucagcugcuugcagcgggccaccugugaagguaccagaaggguuuguaccuguuggaaaggcaagccaggcagcucugagcugucaucacugucccuuucuuugaagcucagagagaucagcccucauauacagggcuaggugacccuacugcuaaaacacaaugaucacaaaaaugggcuuuuuuuuuucugcugcuggaguuuuuauuugagacuguuugacccaaacuaaucucaaccucaggaucuucuucacuagcagccucaauucucaugccccaccacagcaggcugaaggaugguuggggggaggcauguuaucucaguugguagagugcuugccuguuaugcauaaagccccagguuagauucccgcaaugcauaaagcaggucucuugacacacaccuguaauccagcaucaagaagguggaagcacaaggauuaaaaguucauccucagcuacauucaacaucugacgccagcccgggguacagggcacccuuuccaaaagaauacuuucaggaauacaaaauaugugacuucugaaggauacuucuugauugauuuauauucaucugccuuggcucccaaguacuggaaaacagcugugugccauuacaccuggcauuuugaaggguauuucuugccaacaggaauaacuauguagaguuucccugaccacccagucccuagcuguaagcuucucaggguuaagcagcagcaaacucaccaguaauaaggcucccuaagaacauagcccugaaaaagaccaaaccacgguaauacaaauguauauggcaggcuuaccucucccucagauuugacacccaccaccuugccauuuuccaugaugaugucauccacugguuuguucagcauguauguucccccauagauggcacucaaucuauaguaaggaaaaugacaagggagucuucucaggagaauggugaccgauccuacucuacucuccccaccccaccagugggguaaagaaacuacacagguagacagaguucaauuccaacuguuucaggugucucccccauaaauuugggcccauuuuuggcauauuccuucuucucugcuguuuccauccauaauacucuguucugcaaaugggucaauggaaggcagcaugaaggaguagcuccacacagaaauggcccaggagucaagaauaaagaacugucaguaaaagagccagcucccagggaagcccagacucaagguucugggguccuagacuuagaccugguacuaccaagagcuaagggaagcuauguucauggugaccuaguccuuuacuuuguauuucaucuauuuuuuaaauaaauuuuuauauuuauuuauucauauguguguuuuauuuacauguaugucuguacaccacauguaugccugaugcuuguggaggccagaugaagguuuuggauucccuaaaacuggaguuaugggugguugugaacuaccauguauguucacauuggaacugaaccuggauccucgguauaaacaagugcucuuaucugcugagccauuucuccagccucuacucugcuuuuuaaugcacuagcgcagugcccccauuacccagggauggaauaauauacaugaaaauuagaugggaaaguaggagaugccucaaaaauauucaagguaauuuucauucuuggccuuagucuuacuaguaauacuauccgaaaaagacagauccucaccuggcaaagcccuggggcagcucacccaggccauacaguggguauaaauaggggcucuugccauaccgggccagggacucgcuguacaacuugaugcgguuaauagucucaagacagggcugauccagguagcuggggaacaagagccaaggaagaugcuuuggcagcggcauccuugcucaccuacaaagacaccagccaaccuucccaccacccuuugugaccuggcaaagaugugggucaaauggagagggacugaaauggaacaggugagucuggagcugagcacaagagacaugcagggugggcaguagguacaauaggcagguguggggagggcaaggugugagccagagaaggggcucccaucaccagccagcuuuccccucacucaucagugcgguagagcgccaaggcauggccagugaaaucuaugacaucuugacccaggucaaacuuccgguagacaucacgcaugcugguguucuggggaucaacacccucaaagguuuuggggucauucucaucaaaguuugccacaaacaccaaaaauuuucggaagcgucguuuuucaaacaugcccaucagaucugaaagaaagguauugagaagacccuuagcauuacugggacauagaacuccucuuuccaccagagcaggccaagaaagcugguuguauguaauguagaguauuggcucccaccaauacucuaucauguaacacuaccccacccuucuugaucucaauuuucuuuuuguaggaagaaacccuucuaguuccacguagggaugcuacagggcaaguaggcccucugacaaaaaggaauccuguucugugaacuuucuggcaacuugccaggauggguagcacuguccaaucaauacacuauaaaguaaggguccucuaggacuacacagagcuaagauuaguuucaggcaaagaugagccuuuugccuaacuguccugaaaauagucugucucauccagccccauuauucucugguuaaggagacucauacucacuagaagccaaggccucagucucgguggauggcacuuuguagaucuugccccccuuauauacaaagcugcccucuaccaccuugaaguccagauaucgagucacuucuguauauaguagcaucuuuaccagcugaccuguguccagaggaaauaagggacauuguuguguuuuccuucaaaaacucucaguagucugacugaccauauucuugagauugaccaaucucuccccacuccgucuucccacucaccacccccaaaaccauauacagcaucuuuuuaaucucucucaccauuggccaugaggaauuuggggaucaagucaacauuccagucucggccccggcccauugauucagggggcccuuccaguaucugaaagcgcuuauauagcuguaagcaggacaggaaagaaagaaaaaugucaaggaccugucgcccuuucccacucuccugcccaguaccugagaauuacuucgcccccuuauaccuauguggaagacuaacaaggaucugggucuaagcccaggucuaagaauaagaaaucuuaccuccuccaggggugugauggaagagcucucacccccauaguagggguuucgguccaugugcagcaccuucuuuccauucacagacaugaugccagacaggaugcauuccuggggaaggagugacauuugcagcuauaccccauaacccuccaacuugcuucaugcccaccaccaauuuuauaaugcagcucuuuucagugccuaaaacuggggaggagaagauggcuucauaugauguuuccuuuacaacccugcugaguaaacuacuggagcauuaaaggagguuuggggggcagagcuuucagcuuccaagucuuccagcaucaacaagccaagagaaguaucuacuucucugagcccacaaaaagacaaugagucuacaagaagaaccaauucaaaggaccuuugaaagagaaggccaaguccuugaaaucccaggccccacccugcuccuccuucaaagggcaggagccccugacucucuucuggcccuauccacuggucuagacucaggguucaaacuaaaaagauuuaggccggggguggggguuggggggggcgggggcagggaagagacaaacacccucaccagucagucacuaacccaaggacaaaggcugaggauauauauucagucugagaucuccaugggaaaccaaguuggggcagagguaaaguggucacuaccccccccccacaccccccacacacacacuccugcugucucuggaacauuccauggguuuccuaucccaucccaaaaagcagaaaagcaugaugagggcccacccuuguaauguccccauacccaucuucauauuccauccccuaguuugaucacaagaugguaagggaugcuaaucaaggccuuggagcaggugaugaguucaggcaaagggugggggcugggugcaaugguuccacugugugugugggggggugaguuuuccaccucggugauagagauagggaagaauaggggucugagguuaaguacuagagugcaggaacacaggacaaaguggggcccucuacagagaauugggaacuggaaucgacauccuagggugagguaguggguugggcaugggguugguuuucccagggcuggagcuaggaugaugggaggauggaucggauaccggacucugcaucaaugcgggauggagugggguggggagggauggcgugggguggggagggauggcaugaugcagggcuaugagagccugaaguggcacuuacgguaagaccuguccccagcacaaucacaucguauuccucauccaugaucaggccuugguaccagcguccgcucugcuccuccuccuucaccacagcagccgcuaccacuaccucuacuauugcuacugcugcuacugccgcugcugcugcugccccugccgcugcuucugucacugccgccgcacugaaccaaagauggcgucugucgguugucuccugaucccuacgcagcguuaaugagucccucucucucuccgcuggccccgccccgcccaaccagucaucauuuccuugcuuguuuucugggagggcuucugucaccugggucccagcaccagaaugacugcagggguuaucggggcucuucgugagcccagaaaaauacggggcggggcaggccggcagcaggugcugaguccuccgaaagauccuugcgcgggagccg

SEQ ID NO: 9572 - RNA, 7119 nt, Mus musculus
caucagcugacuaaauugccgccgccacugccgucgccgucgccuccacgacuucuccaagcaaaagucacuguugccgcugucgucgcugccaacgccgccgcugccgcugccgcugccgcugccgcugccgcugccuccgcugaaaccgccacugccuucgcugaaaccgcugcugccaccauggcccaguacaagggcgcugcaagcgaggcgggacgcgccaugcaccuaaugaagaagagggagaagcagcgugagcaaauggagcagaugaagcagaggauugcagaggugugggccaggccggggcaccucagagcuugcgcuccgcgcggacccccuggcggucuccugccacucgucucugggagaccucaacagugggcuaugagugcccggagggcgggccccgcguugguggcgagacuugcugugcaucucuaguaacagaagucagccgagacagucuaaucuauaaaaugggcucaguguugguccaugucagagauggggagcacacugauguugggugagacuccuuggcacuccuccugaguacagagcucccagccuuccaaugcuuauugggaagaccccacuuccuguggagaggcacagggguaugccacugagucucacucauuacagaguacuagaguuucucccaggguuuguuuagugaguggucgcugcauucagaagcgcgauaccaagcugaccacagcuugauccuuugggcaagacuccugagaggagcagggggccuuagcucuccaggugagagcaggcccuaucuggggaagugagaagacaaacgcccaaaccagucuucaguuggaaguuuuuuuguuuuguuuuguuuuuuguuguuguuguuguuuugguuuuuugagacaggguuucucuguguagcccuggcuguccuggaacucacucuguagaccaggcuggccuccaacucagaaauccaccugccucugccucccaagugcugggauuaaaggcaugugccaccaugcccggccagauggaaguauuguccacccucaacuaugcuuguauagacaccuaguccuacaguuccggccucauugccucauuggcagcuggaaguuugccucuacuggcuacucauuuggaggucccuucagaguaccuacagggcacuuauuaauauggggucaggcugaagaacaguggccuuccagagagcugcugacagcauccugggccaaaaaggagaauuccagggucuggacauuuugaucccucuuuuuuuuuuccauuuaucucuuccugaaaucccguggcuugggucucaggagcuucagcuuaaaggcugaaggugaguggugguggcuacagauuacugagugggugcugggccccagcaggagaccugaagagggggccagagcaguucagggaugccaagagaaggaccuccuuugguuccuuuagccuucccaauuucguggacccuuccagacagaaaaggaagggagggugucuuucuuuucuaagaucaugucauagcauguuaaggcacaaauuucgaacuagggucuagaacccacagccacucugucacuuccauagugaagugguagauggccuucacugauaugucccuccucugcaggagaacauaaugaaaucuaacauugacaagaaauucucugcacacuaugaugcuguggaagcagagcucaaguccaguacugugggugagcaggacacauguaccaccuuuuuuuuuaguccuaggugucacucuuuugcuggcccuggcugacuagccuuucuucccaugucuucuugccucacaggucuugugacucugaaugacaugaaggccaaacaggaggcacuggugaaggagcgagagaaacagcuggcaaaaaaggagcagucaaaggagcuacagcugugggucccccauccucagcagcucuccccucacagugcagcuuagcgcuugggaacuccugggggugggucaggcuguuccauucccauuccauagggagaacccauuuccugcuuugggagcaguugugguaucuauugagcuccacacugguucucacuuuccagguuuaucuuucuuucuguuccucuguaaagguggugaguccuuucugagcccuuucuuuuuccugggugccugaacagccugcauuguccccauuccuuucugccccaugcuugaugugucacagaguccugcccuugagcuugaagugacuagggcaaauagaaucccucuggggugcuggggagauccagccugugcugaguggaccccaugcuaggcacacaguggcucugggucagggaaggggccucagggcaggaacauggggcaugauggccacccaugccuugguaggaaacuagagaagcuucgagagaaggagcgcaagaaggaggccaagcggaagaucuccagccuguccuucaccuuggaggaagaggaggagggaguugaagaggaggaagagauggcuauguacgaggaggaacuggagagggaaggugaggguacagcccaccagagcucucuucuggcauuugugcugacauuugggccagcaaagaagaagcacacucuuuuuuuuuuuuuuuuuuuuuuuuuuaaauuuuagccucagucaccaugagacagaacuaggccaauagccccuuuauaggagccacuagugugagaaguuaucagaguacuucuagugccuggucuaaaaggauccagaagcuguucuuugcagcacauaggauaaacuaagaaggggagaauauaaucuggacuagccuugccugcuaaaacuuucugaaguaaugggaauguuugugaacacacugucaaguauggugacugcucaccacgagcagccacuggacaaugauuaauugugauuggugaauuggaucuacacuugcugaaauccugugccuccaaaguacaacccuauguaugcacaucuguucugugccuugccaggccacagggucaguaugggcucaggacacucagaauugcugcuuucccuaagcacgggggaauuacuauacugcucccuuccacaguaauuuuagcacuacauuuaacccaacaguaucugaaauaauaccauuacuccuuauuuagcuagcuacauauucaguaguacucagggguauauguauaaaguaguguuguguuuuguuuuguuuacuucauuuauuuugagacagggucuuauccugcuuccaccuuaggagcuguucuauagugcacagacuaguggaaagguuaucaaucucacuguguaucgcugggguuuuguuuuguuuuuuucagauagucguuuuguuuugguuguuuauuuguuuuucgagacaggguuucucuguguagcccuggcuguccuggaacucacucuguagacuaggcuggccucgaacucagaaaucugccugccucugccucccaagugcugggauuaaaggcaccaccaugccaggucagauagucuuauuauauauccuaggcuagccuccaaauuguacugcucuugccucagccuucugagugugcuaggauuacagguauuugccacaucaucuaguucacuggagcuuuugaaaagcacagccugguguaucuuccccuuccaacuggagauuucauuuuguggucuuagcaaggaccuggauacccagcgcccugacauuuuugcuguuguuguuuuaguucauguuuauuauuuaucuagguuguuaguuuuguuuuuuguuuguuuucuuucuaagaaaggguuucucuguaguuuuggcaugucuggcacucauuguguguaccaagcugggcuuaaacuuagauccaccuggcuuuauucuucaaagugcuaguucuaaugguaugugccaccauggcuguacaggucaguaguucuuuuuuuuuuuuuuuuuaaagauucauuuauuuauuauauguaaguacacuguagcugucuucagacaauccagaagagggagucagaucuuguuacggaugguugugagccaccaugugguugcugggauuugaacuccgaaccuucggaagagcagucgggugcucuuacccacugagccaucucaccagcccaggucaguaguucuuaaagcaagcuccaagagccugagagacuucauaaauguucguuaaaucaaaaucauuuucaggccaggcauguugguacacugauuuuaggacuugagaggcagaggcaggcagaucucucugaguuugagcccacccugcucuacauagagaauuacauccagggcuacauaaacgugauuaugucuaaaggcaaacucacagaaucauuuucugaaaaaauaaaauguucuuuguuuuguuugccuuagagaucaccacaaagaaaaagaaauuggggaagaacccugauguggacacaagcuucuugccugaccgggaccgggagguaaaaacugcuuggcccugguacugacuuugguguugaucaugaacuugguggagacucuggcccaggguuagguuaauacugcaccuagagcagcccugaaucucaucauuuguccauuuugucuuaggaggaggagaaucggcuucgggaagagcugcgccaggagugggaagccaagcaggaaaaaaucaagagugagugcuauagcuacauaugguggcuuggucugucugucacccagcacuuaggagacugaggcaagagggucugaaguucaaggucaucuuuaacuacauggcuaguuugaagccagccuuggcuacaugagacccaaugugugguccaguguuggggcagugagagaacagggcuaaggcccaaacaguuuucuugcaaauaccuaaagguauguaccuauauaccccaaggaaacuguaaccucaggucuggagaccaagaggcaacucguuuuguuuuuugagacaggguuucucuauguagcuauggcuguccuauaacucacuuuguagacuagauuggccuuuaauuuagagauccgccucucucugccucuggaaugcugagauuaaaggcuugcaccaucaccuggauaaggcaacucuucuuuguaggugaagagauugaaaucaccuuuaguuacugggauggcucugggcaccggcgcacaguuaagguaggcaguagaaggccucccuuggcuuaaauucaauggaaaguaacugacagucuugacuugggaaaccucuguggguagcagggugggucucugcuuucuuggaaguauuucuuugggcuguuguuuuuucuuuucaacuugaaguauaccuacuucugcagaugaagaaaggcaacacgaugcagcaguuccuacagaaagcacuagagaucuugcggaaagacuucagugaacucaggugagcagaggaugcacuaugugugccugugcugugcaucugugaggaggcugacuucccagccagggcaucagacaacccugcugacugcuccacagcugggaaggcggaaugcugggcacugaaauccucaaaaaggagagcugugcucuuuuuucuuaccuuccugcuguagaaagcauaggugagagagcccugccuuggugguaugguccagaaguggaggacacuggaacucccgucccagauucauuaaacuacacagcuucccuuaaacuuuaaggcuuaaagcacuguggccagcacuuccuggccccuuguggccacucugaugacuucuaguuguuguccucuccucuuuuuccuguaggucagcagggguggaacagcucauguacaucaaggaggauuuaaucaucccccaugugaguuccuucaacccugggucaugcacucugugcuuucauaggagagucaccauacugcugugcacucuuccagggcugcugaacgcagugauaccugcagguagagguauggggaauagugggugauaggaccccagaaggauuaucaagcuggucuuucucauccucugcuccuagcaucacagcuucuaugacuucaucguuaccaaggcacgaggaaaaaguggugaguaauucuaucuuaguucacccuguaacuugcuccaacauauugaaggagaauagcauggccuugagcuuacugcuucucuccuacagggccacucuucaacuucgacguucaugaugauguacgacugcucagugaugccacuguggagaaggaugagguaugauggugccauggcacugggcaggcaaaggugcccugaaccugucagggagguuaaccuuggggagaagucaacagaaaggcaaggucagguaagaugguccugaaucacaacuuucauuccucagucacaugcaggcaaaguagugcuaaggagcugguaugagaagaacaagcacauuuuuccugccagucgcugggagcccuaugacccagaaaagaaaugggacaaguacacgguaaggaggcagggaagacaggcaggaaggauagguccugggaagacucuucuuagugguucuggugcuggacuaggcaacucagucagagaguaggacucauccuggcucucaguggcccugcagucaucuugcuaggaaacuagagauagcuaguaugacaugguagcacauaccuguaaucccaccacuaggaaggcuaaggcaagacgagcacaaguuccagccacccaggcuacauagcaagacuccugucacacacacacacacacacacacacacacacacacacacacacggagagggggagggggagggagggagggagggagggagggagaaggagaggaaugaagggacagggaguagagaauagggugguaugcuagccuauccugcuuauuuuauuucuuggcuuucauuccuuguccuauguguccccuuuuccucacaccagauccggugagcauccaaaaguggacaugaccuuggcucuccccagcgugccuccaugucuccagggcucaggugaccaugccagagcccucugugaggaugguaguugcuauuccuugaccugauguuaucauuacugauuuucccuuuuacaauaaaaaaguccacauguuggagcuggagugccugcau

SEQ ID NO: 9573 - RNA, 8573 nt, Mus musculus
uccacugaggacaucugaauacacuuuauuccacugcaagaaauuaguuuauuaacaaacaggucauuuagaaggugagcccucugacagacaccuugugaggaacucugauuggacuccagcuacuugggcacuuaaggccagauugcuccauucaggcuugcagaagucauccaaucaguucugauuuggcuuaaaggaucacugaaaacaggguuggauaccagugcagugccucugggagggagaguuucuugaagaugucccaaccuacccaauaccugcuccagugacaggggcaagcauugaagacccuugccucuggggggcacucaagaaauagaagaugaaaaaaaaagagaaauagaagaugacacaugaggggcagaggaaggggcugggugggaacugacugugggaucagcuuuaggaaaacaaggacacagguaccuaagcucccugacaaaaugaaaugggccagcccugcagcccccaucaccuugaggccacuuucaagcccuaauguguuagggagggggagccucaugccugggcauggggcacagucuccaccugacacuggugccaugcugccuccuucagucuggucccagagcucugcugugcuagcccgcuaugcuccuucgagggauacagccuuccaucuccagggccucuggccagcccucauacuuguuggugugcuuacuguucuucauaugcuguagagguuaauaggaagucaugaucuggcucucaggggccaaacaucagaauauucuucagucuguugcccuucccuucauucacacagggaaaauuggggauggcugagguggucuauucuuuuauaagugaacuagggaugggccacuguggacaggagggagucuauauggcccuggcuucagggaaaugcuggaaacugcuacccuauuuggggugaagggucuugggaggcaugagcuugaguuguuuuugucagccaaagcaauggagaaaucuguauuuguugaaagcagugcuuggaggccuaccuaagacuuuuugcugagagccuccuuagguaaggaugaugccaggggcccuccucucucuagcauccgcuagcauaaacccugacugauguacccuaagagagaacccaggguaggugagaaaggaguguguagcauaaacuggaaaacuggguuaugacaagguuaggaugguagugagcaucuuuuuuucuuuuuaaaaucugaaacaguauuucauguaguccaggcuagccucaaauuugauauguguccaaggauaaguugauccucuugccuuuacuuccacaguguugauauuacaggugucuccccugcucaguuuuauguaaugcuaaugauugaacacagggccucauguaugcuagacaaacacucaccauaagugagcuauaucccuggacugagcauccugaaggugcuuguaaagauuucuuagguauacucuggucaaugugcaauuugacauuuaaagacuccuuagguugaaauauauacaggacaggagagaucaaaguuacugucucuccccauggugauaacaaggggccaggcaucacuagggcauaggucagggacagagaccagaacccagcuggguagaauucagggaagcuuugagaagagguugccagggacaggaggcagaggugccagguucucugcuguaccugcucaaaggggcucuuguucugcacaccuuuggcucccacaaacacccagcugucacggaaggcuagauccuuggcauuccugcugcccagcucagaaaaaagcuuccuggucucuucauucauccugucacacaguagaaaggaaugugaacuggagauuauuacuguauuggaacaagauugaagcuggacuuggcagucacuuacuugguagcuggaucaucauaggaagccacaaacaccaggguaccuucaugcaguggccggaugaacuucaagagaucauugacaucugguggagaugggcccacagaauauggagcuucagauuccaccaagcagcccuuccccaccaaacaauauucuucuaaugaggaaaacaaaguagggacugggccagggauguuccacaccaaagaccaucaguaugaacacagacuaacugguaaagaagcuagggucauccagucacaaaacagaauccagacagauuuccccaucccuuguauuuuguaaauccaaggcaauacuugaacagcuaagugcaaagacagagggcaggauuucagggagaaaauauacaguagguugcuguggugggccacucaccuccagcccacaugucaaaggcucuggcuucuaggagcucaccacugaccccuguaucaagagaaagaacugcugagcaagccaggacauaccauuuuacuaccugagccuccagcccaggcucaaauacgguggguggcagcccuuucuagaagccucaaacauguccugucauccugucaaucacagagcuacaucccauagagccacuggcaucugagguccuaagcaucuaccauuauugucacuacuuucagcggguauagaauucuucucaagccuccuggggagugcccagaagccaccugcaucugcauagggaguaaugaaguagaggggacaggccauaccaugguaucugcuucuauaaucugaauucugacccuauaacaugguggacucaccauucaccagggcgauguucaggccacggcccacauugucuuugacgcugcucaugagccuggggaggggggagggaagaggaucucuugugggcauaucagcuuugcucuuccucacauaaccaucagcccuuggccuuuauagaccuggccucagguuccccucccacuucccagcccauaugcucacaucuuguccucgaggcagaucuugggcccgaugacauuggcagccccgcugacuauucgaaagcucaggugcucuucaggacaaggcuggggcaggccgcauuuguacuuccuggcccuugguucugaguaaugauagcagaugugacccauaugccuggcccuggugucaccugagaucugaggguaaaggucaggaccagccacagggcugaaggaauagcuacagagcauugaaaugggggaggagguggguggggcucacaccaaagaugaggaugcuuccaagugguguguuggcaaggaccuagggacuccaagaauuagauuuuucugcuauugguaggaaaagggaaaggagguugacagcuggauuagaacccuuguacaacuagaacaaagcagaggguccagaaagucaggaugggagcuacaugaaugaggaacacagaccaaaguggaugggcagagcacagggcucuacuagccucuguauuucuucagaguaaggguggagaugaccucuguaauggcuugaauuaugacccuauaaacuauacuggaguuggaacucucaguuccucagaauguggcugggaaacagggucuuuacagauagauaaguuaugaugaagucauaauggagcauguugagcccuuaacuuagugugacugguguccuuaugagacaaaagcauacaggagauguugugagacaguacaggcaaaagacaguacaggcaaaaggugcaguuauaagauaaggcacauagaaggcuucuagaaucugcagaggcacagaaagacccugaccuggagcuuucagagugaacacagcccugcugacacuuccauucacacucucaguuccaaacagugugagaaaguaaauuuugguuguuuaaggcaccugcuuuauucugcuuuucuuaguguagcuucaggaagcuaauauagguuuuggugccaggaauuggggguuuauauaaacaaauaccacaaauaccuaaggaugugaaaauggauuuagaacuggguagaguggacaaaagcuacagaguuuugagguguacaguagaaagagucugcacugcuuaaaacaaaaacaaaaacaaaaacaaaaacaaagaaaacccgaaacccuguugguaggaauacagagugaagccagguacaguacugcauaucuguaauuccagaacuuugaaggaugaugcagaaggaucaugauuucaagucuauucuggccuguauaguaagccucuauauuaaaacaaaucuagcaauauggauaguaaacauauuucuggugcaagcucagaaagaaacagcaaugaaaauucuucuguugaaucuuucacuuacaucccuaaacaagguguuguuaggaagaugaauauuauagaucuuucggugagaccuuagaaggaagucgaagaggccauuauugggugugggaggaaagcucagccuuguuauaaagugucaauuguucugguguuuuguaggagagaaagcuuguaaaauauuuagcaaaggaaauugucaagcacaguguuaaagguacggucugguuuuuccuugcugcugcuuaugguaaaaugagaaugagaacaguuggggaaaaauauuaaucaugaaggaaauaggacauaaauauauagaaaaaucucagccuagccagacauaugcuuguaauccuagcacuugggagauggaggcaggaagaucaggaauuuaagguuacccuugguuuuaaagugauuuuaaugauagccuugcauuuauuaagcccugucacaaagggaagggaaagaaagaaaauguuagucuaauuauauugaaaaauugagaaugcaugucaaacccguaauuccagaauuugauaggguaacacaggaggaauauagagcuugagagcuacauaguaaguucaaggucaguuuguauuauagaguaaaacucugucaaaaaaccggaaacauuuuaugggcuagaaaaauagcucuguauagaguauuugcucgguauguguaagguccuggguuuaauucccagcacuauaaaacguuuaaaaaagcauccuuuagagagaacacagagaugauggcucgcuaagaacuugcuaaggaaaugaagcacaugauugugugugugcuccuaccucucagaagccuggacuugagauaggauuauacagaauggaucuguggaggauugucuugucuuauaaccuaggccuucaggaacugcaugagaggccagcaaaauuugcuagagauuuauaccaacagaaauauugucagccuaugagaagaacugagaugagaauacaaggauggaagaaacaaaggaaugaaagacaaaaggaaggaaagaaagaaggaagugagggaagagagaaaggagggagaaaggaaggaagggugggagguagguagguugauuuugaauacagagcuaggaaugaagaggccaaagagggaacagaggaugcagucacuucagugggccuagagaaugauauagagauuucuucuuaggccuugacaucuagaacuugcccugcuaugauugggacuugcuuaggaccaugagccccugcuucaucccaaugucucuuguuuggaaugggaauguuuuuuuccuaugccugccccuuucaucuucugaugguggcuaacucauuuauuagguuuacagcccagaagccuaugauaguuaguugggagaggccagacagagaauggagauccuaguggggcuggcugacagcaugcaggggugucacaaaaggcagucugaaguacagguacggggggaauagggaagggacaggaggcuuaccugcagucacugaguucucugggccuguaaguagagaguuuuuucuguuagcagggaggccuccaggagccuccagcagaacaaccaggcucagggacucagggccaagucaggcuauacuuggcauguuccccgcucaaguuucaaugaugcccugauauaaaacugccugcuucaggaaaaggaugaauuggaauuguaaauagugcuuaggugacuuggcaccagugacaaagugcaagaucccuugugugucucagagcucaacggaaagucgaagaugauuaauaaucaauggaggccuuuccacuccuuacucuuacucuaucaacuuccacucuauugguuacaauuaggaguguuguucucuaggaugguucguggaaacaaggaugcauuuguguuagaagauagaccuagggcaaaaggaagccugccaugaagguaaugggaaacccaaccaccauaacccauauugggcgccucuauagugaaucaagaggauucccacacucacuggugaagaacugcugaauucgaggaaggccaacaccaggaccaccuaggaggauggugacuaggauccaggugagacccauaaugaugauuagggccacgaugcgcagggggccugcaggcaggauagacacagagcaggacuaucuuagacaucagugaacaaaaucugcaauaacccacuaccucacaugaccagaucuccccuucuacuugggaacaagugaugguacgauugggaggugggggaccaaucgauaucuaccagacccaaaagagaggcuugaacuuccuccuaguagacggaagaacgugaguucaaaccuugaggcugcucuguuugggucuccccagcagguuuggaggugccuuuuagaacucaugcucugggaagguuucauagcaccaaccucagcaucuugccucugaaauuaucagaauauuuacaguucacccaucugcuuugccuuuccucuuguucuguuggaagcucuauacuccuuguaaagaccaguccuucuaccugcuucaggauccaucaagauaucuccugucucagauacauugugcuaagacuucuuucuaucucacuuucucucauauuaucaacagguccuaacuuaguaagauaaagaugaaacagagcuccugaaagaaaaaucucauucuuugauucuucaucuuccucuucuccaccaaacucuuuaaaaauuuauauucuggcuugggauauagcucugugguagagcauuugcucagcaugcauaagacccugguuuccaucccccagcauacacauaaaagucaucuacauugugauuucuauuaccucacuccccaacucucucccaaaauucuuccaaucuagucgugcucccauaacaccaacuaaauaaccuuccaaacaagaccaccuaugacuuuuaugaugucacauuucugauugucugacugcucuuucuugacacuucacuacuagauuccaggacaguacugucuccugaccccauucucugggacucccuuuguugguuagauuguguuccauuacucucuccucaaaagguguucuuuuccaggcugccuucucccaucuucauacuguaugggagauuucaccaugcagcaaugacaccuuacaccuccagcccagaucugucuugaacucauauccucccagccaguuccuuaauguccaauuuggacuuauccacaaagcugcuacuuuaccaguuuucaaauucuacucucaccccaaacagucccuccaaggcacauucauguuuguaguccagcugacagcagagcuaccacuuagaucauacccaaccucaaaggcaccuaagucaguucucuucuggcuacaucucucuaucucuacuauccacuccucuccauccauucaaucucuggagauuuuauauauauauauauauauauauauccuuaacuuauauauauugauuauauauauuaucaacaucuaucuauaucuaucucucuauauaaaaucaauccuuauaguuugggaagcugaaguccucagaggugaauuugcucauaaaaugagugcuugugcacagucauccauuaauaaauaaacaaaccagugaccacccaggccucuccuaacacaggcacuaggacaccuggccucucuucaguucgcuguggaagccacccaccugccaaccucauguccacuucuccagcuggguugagaucucccgcaggugcacuguuugggaacuguggguucuggggggaaugaaacaggagagaguagguuugggggugggggcaguggcaagucugugcugggagcgaucgguguuaugacuuguuccuccaaacaccaguccaggcucaguuccucgugagugcugggagaaguccugccuggccaggagagccuuaggaauccguugcgccucacagucuggcuaacagacuccaggacuggagcguagcaaugauucuucuccacccggaucccuccggugcuaggcccggggcucaggucgauccgcucgaggcugguggcagagauugggcgggccaaggauguugucuggguguagggagaagcagaccggaucagggaguuacccaguugucucgcucugccggcuaggugaagcaagugagucacguagaaaagcuuaucaggcacgacaauggccgcccgcagaaggccacagcccacaggcgucgcuccgccauaggcccauaggcugugcuguagguccgcagguccucacggaggcuccaccuccagaccggccuccucccucucc

SEQ ID NO: 9574 - RNA, 8573 nt, Mus musculus
ggagagggaggaggccggucuggagguggagccuccgugaggaccugcggaccuacagcacagccuaugggccuauggcggagcgacgccugugggcuguggccuucugcgggcggccauugucgugccugauaagcuuuucuacgugacucacuugcuucaccuagccggcagagcgagacaacuggguaacucccugauccggucugcuucucccuacacccagacaacauccuuggcccgcccaaucucugccaccagccucgagcggaucgaccugagccccgggccuagcaccggagggauccggguggagaagaaucauugcuacgcuccaguccuggagucuguuagccagacugugaggcgcaacggauuccuaaggcucuccuggccaggcaggacuucucccagcacucacgaggaacugagccuggacugguguuuggaggaacaagucauaacaccgaucgcucccagcacagacuugccacugcccccacccccaaaccuacucucuccuguuucauuccccccagaacccacaguucccaaacagugcaccugcgggagaucucaacccagcuggagaaguggacaugagguuggcagguggguggcuuccacagcgaacugaagagaggccagguguccuagugccuguguuaggagaggccuggguggucacugguuuguuuauuuauuaauggaugacugugcacaagcacucauuuuaugagcaaauucaccucugaggacuucagcuucccaaacuauaaggauugauuuuauauagagagauagauauagauagauguugauaauauauauaaucaauauauauaaguuaaggauauauauauauauauauauauauaaaaucuccagagauugaauggauggagaggaguggauaguagagauagagagauguagccagaagagaacugacuuaggugccuuugagguuggguaugaucuaagugguagcucugcugucagcuggacuacaaacaugaaugugccuuggagggacuguuuggggugagaguagaauuugaaaacugguaaaguagcagcuuuguggauaaguccaaauuggacauuaaggaacuggcugggaggauaugaguucaagacagaucugggcuggagguguaaggugucauugcugcauggugaaaucucccauacaguaugaagaugggagaaggcagccuggaaaagaacaccuuuugaggagagaguaauggaacacaaucuaaccaacaaagggagucccagagaauggggucaggagacaguacuguccuggaaucuaguagugaagugucaagaaagagcagucagacaaucagaaaugugacaucauaaaagucauagguggucuuguuuggaagguuauuuaguugguguuaugggagcacgacuagauuggaagaauuuugggagagaguuggggagugagguaauagaaaucacaauguagaugacuuuuauguguaugcugggggauggaaaccagggucuuaugcaugcugagcaaaugcucuaccacagagcuauaucccaagccagaauauaaauuuuuaaagaguuugguggagaagaggaagaugaagaaucaaagaaugagauuuuucuuucaggagcucuguuucaucuuuaucuuacuaaguuaggaccuguugauaauaugagagaaagugagauagaaagaagucuuagcacaauguaucugagacaggagauaucuugauggauccugaagcagguagaaggacuggucuuuacaaggaguauagagcuuccaacagaacaagaggaaaggcaaagcagaugggugaacuguaaauauucugauaauuucagaggcaagaugcugagguuggugcuaugaaaccuucccagagcaugaguucuaaaaggcaccuccaaaccugcuggggagacccaaacagagcagccucaagguuugaacucacguucuuccgucuacuaggaggaaguucaagccucucuuuugggucugguagauaucgauuggucccccaccucccaaucguaccaucacuuguucccaaguagaaggggagaucuggucaugugagguaguggguuauugcagauuuuguucacugaugucuaagauaguccugcucugugucuauccugccugcaggcccccugcgcaucguggcccuaaucaucauuaugggucucaccuggauccuagucaccauccuccuaggugguccugguguuggccuuccucgaauucagcaguucuucaccagugagugugggaauccucuugauucacuauagaggcgcccaauauggguuauggugguuggguuucccauuaccuucauggcaggcuuccuuuugcccuaggucuaucuucuaacacaaaugcauccuuguuuccacgaaccauccuagagaacaacacuccuaauuguaaccaauagaguggaaguugauagaguaagaguaaggaguggaaaggccuccauugauuauuaaucaucuucgacuuuccguugagcucugagacacacaagggaucuugcacuuugucacuggugccaagucaccuaagcacuauuuacaauuccaauucauccuuuuccugaagcaggcaguuuuauaucagggcaucauugaaacuugagcggggaacaugccaaguauagccugacuuggcccugagucccugagccugguuguucugcuggaggcuccuggaggccucccugcuaacagaaaaaacucucuacuuacaggcccagagaacucagugacugcagguaagccuccugucccuucccuauuccccccguaccuguacuucagacugccuuuugugacaccccugcaugcugucagccagccccacuaggaucuccauucucugucuggccucucccaacuaacuaucauaggcuucugggcuguaaaccuaauaaaugaguuagccaccaucagaagaugaaaggggcaggcauaggaaaaaaacauucccauuccaaacaagagacauugggaugaagcaggggcucaugguccuaagcaagucccaaucauagcagggcaaguucuagaugucaaggccuaagaagaaaucucuauaucauucucuaggcccacugaagugacugcauccucuguucccucuuuggccucuucauuccuagcucuguauucaaaaucaaccuaccuaccucccacccuuccuuccuuucucccuccuuucucucuucccucacuuccuucuuucuuuccuuccuuuugucuuucauuccuuuguuucuuccauccuuguauucucaucucaguucuucucauaggcugacaauauuucuguugguauaaaucucuagcaaauuuugcuggccucucaugcaguuccugaaggccuagguuauaagacaagacaauccuccacagauccauucuguauaauccuaucucaaguccaggcuucugagagguaggagcacacacacaaucaugugcuucauuuccuuagcaaguucuuagcgagccaucaucucuguguucucucuaaaggaugcuuuuuuaaacguuuuauagugcugggaauuaaacccaggaccuuacacauaccgagcaaauacucuauacagagcuauuuuucuagcccauaaaauguuuccgguuuuuugacagaguuuuacucuauaauacaaacugaccuugaacuuacuauguagcucucaagcucuauauuccuccuguguuacccuaucaaauucuggaauuacggguuugacaugcauucucaauuuuucaauauaauuagacuaacauuuucuuucuuucccuucccuuugugacagggcuuaauaaaugcaaggcuaucauuaaaaucacuuuaaaaccaaggguaaccuuaaauuccugaucuuccugccuccaucucccaagugcuaggauuacaagcauaugucuggcuaggcugagauuuuucuauauauuuauguccuauuuccuucaugauuaauauuuuuccccaacuguucucauucucauuuuaccauaagcagcagcaaggaaaaaccagaccguaccuuuaacacugugcuugacaauuuccuuugcuaaauauuuuacaagcuuucucuccuacaaaacaccagaacaauugacacuuuauaacaaggcugagcuuuccucccacacccaauaauggccucuucgacuuccuucuaaggucucaccgaaagaucuauaauauucaucuuccuaacaacaccuuguuuagggauguaagugaaagauucaacagaagaauuuucauugcuguuucuuucugagcuugcaccagaaauauguuuacuauccauauugcuagauuuguuuuaauauagaggcuuacuauacaggccagaauagacuugaaaucaugauccuucugcaucauccuucaaaguucuggaauuacagauaugcaguacuguaccuggcuucacucuguauuccuaccaacaggguuucggguuuucuuuguuuuuguuuuuguuuuuguuuuuguuuuaagcagugcagacucuuucuacuguacaccucaaaacucuguagcuuuuguccacucuacccaguucuaaauccauuuucacauccuuagguauuugugguauuuguuuauauaaacccccaauuccuggcaccaaaaccuauauuagcuuccugaagcuacacuaagaaaagcagaauaaagcaggugccuuaaacaaccaaaauuuacuuucucacacuguuuggaacugagagugugaauggaagugucagcagggcuguguucacucugaaagcuccaggucagggucuuucugugccucugcagauucuagaagccuucuaugugccuuaucuuauaacugcaccuuuugccuguacugucuuuugccuguacugucucacaacaucuccuguaugcuuuugucucauaaggacaccagucacacuaaguuaagggcucaacaugcuccauuaugacuucaucauaacuuaucuaucuguaaagacccuguuucccagccacauucugaggaacugagaguuccaacuccaguauaguuuauagggucauaauucaagccauuacagaggucaucuccacccuuacucugaagaaauacagaggcuaguagagcccugugcucugcccauccacuuuggucuguguuccucauucauguagcucccauccugacuuucuggacccucugcuuuguucuaguuguacaaggguucuaauccagcugucaaccuccuuucccuuuuccuaccaauagcagaaaaaucuaauucuuggagucccuagguccuugccaacacaccacuuggaagcauccucaucuuuggugugagccccacccaccuccucccccauuucaaugcucuguagcuauuccuucagcccuguggcugguccugaccuuuacccucagaucucaggugacaccagggccaggcauaugggucacaucugcuaucauuacucagaaccaagggccaggaaguacaaaugcggccugccccagccuuguccugaagagcaccugagcuuucgaauagucagcggggcugccaaugucaucgggcccaagaucugccucgaggacaagaugugagcauaugggcugggaagugggaggggaaccugaggccaggucuauaaaggccaagggcugaugguuaugugaggaagagcaaagcugauaugcccacaagagauccucuucccuccccccuccccaggcucaugagcagcgucaaagacaaugugggccguggccugaacaucgcccuggugaauggugaguccaccauguuauagggucagaauucagauuauagaagcagauaccaugguauggccuguccccucuacuucauuacucccuaugcagaugcagguggcuucugggcacuccccaggaggcuugagaagaauucuauacccgcugaaaguagugacaauaaugguagaugcuuaggaccucagaugccaguggcucuaugggauguagcucugugauugacaggaugacaggacauguuugaggcuucuagaaagggcugccacccaccguauuugagccugggcuggaggcucagguaguaaaaugguauguccuggcuugcucagcaguucuuucucuugauacaggggucaguggugagcuccuagaagccagagccuuugacaugugggcuggaggugaguggcccaccacagcaaccuacuguauauuuucucccugaaauccugcccucugucuuugcacuuagcuguucaaguauugccuuggauuuacaaaauacaagggauggggaaaucugucuggauucuguuuugugacuggaugacccuagcuucuuuaccaguuagucuguguucauacugauggucuuugguguggaacaucccuggcccagucccuacuuuguuuuccucauuagaagaauauuguuugguggggaagggcugcuugguggaaucugaagcuccauauucugugggcccaucuccaccagaugucaaugaucucuugaaguucauccggccacugcaugaagguacccugguguuuguggcuuccuaugaugauccagcuaccaaguaagugacugccaaguccagcuucaaucuuguuccaauacaguaauaaucuccaguucacauuccuuucuacugugugacaggaugaaugaagagaccaggaagcuuuuuucugagcugggcagcaggaaugccaaggaucuagccuuccgugacagcuggguguuugugggagccaaaggugugcagaacaagagccccuuugagcagguacagcagagaaccuggcaccucugccuccugucccuggcaaccucuucucaaagcuucccugaauucuacccagcuggguucuggucucugucccugaccuaugcccuagugaugccuggccccuuguuaucaccauggggagagacaguaacuuugaucucuccuguccuguauauauuucaaccuaaggagucuuuaaaugucaaauugcacauugaccagaguauaccuaagaaaucuuuacaagcaccuucaggaugcucaguccagggauauagcucacuuauggugaguguuugucuagcauacaugaggcccuguguucaaucauuagcauuacauaaaacugagcaggggagacaccuguaauaucaacacuguggaaguaaaggcaagaggaucaacuuauccuuggacacauaucaaauuugaggcuagccuggacuacaugaaauacuguuucagauuuuaaaaagaaaaaaagaugcucacuaccauccuaaccuugucauaacccaguuuuccaguuuaugcuacacacuccuuucucaccuacccuggguucucucuuaggguacaucagucaggguuuaugcuagcggaugcuagagagaggagggccccuggcaucauccuuaccuaaggaggcucucagcaaaaagucuuagguaggccuccaagcacugcuuucaacaaauacagauuucuccauugcuuuggcugacaaaaacaacucaagcucaugccucccaagacccuucaccccaaauaggguagcaguuuccagcauuucccugaagccagggccauauagacucccuccuguccacaguggcccaucccuaguucacuuauaaaagaauagaccaccucagccauccccaauuuucccugugugaaugaagggaagggcaacagacugaagaauauucugauguuuggccccugagagccagaucaugacuuccuauuaaccucuacagcauaugaagaacaguaagcacaccaacaaguaugagggcuggccagaggcccuggagauggaaggcuguaucccucgaaggagcauagcgggcuagcacagcagagcucugggaccagacugaaggaggcagcauggcaccagugucagguggagacugugccccaugcccaggcaugaggcucccccucccuaacacauuagggcuugaaaguggccucaaggugaugggggcugcagggcuggcccauuucauuuugucagggagcuuagguaccuguguccuuguuuuccuaaagcugaucccacagucaguucccacccagccccuuccucugccccucaugugucaucuucuauuucucuuuuuuuuucaucuucuauuucuugagugccccccagaggcaagggucuucaaugcuugccccugucacuggagcagguauuggguagguugggacaucuucaagaaacucucccucccagaggcacugcacugguauccaacccuguuuucagugauccuuuaagccaaaucagaacugauuggaugacuucugcaagccugaauggagcaaucuggccuuaagugcccaaguagcuggaguccaaucagaguuccucacaaggugucugucagagggcucaccuucuaaaugaccuguuuguuaauaaacuaauuucuugcaguggaauaaaguguauucagauguccucagugga

SEQ ID NO: 9575 - RNA, 63251 nt, Mus musculus
agaggcugggugggaggugccgaguguggcugugcacuccucuugugcuaaagcugagccgccuagcuuccuacagugucacugcuucaagaugaaaucuccuucuagacuuugagguacuauacacuuuacaguucauguuugcuuaacucuauguaacccaggcuguucucaaacuuggagcgauucaccugcuucaggcucucaaauguuggaauuacgggcauaaaacaccagagcccccauucccacuuccuccacacguccucuuaggugagcgaucuauuucuauauuugaugagcugaagcuccgauugugacuugauaucagagcuuucauggcucauaagaggauggaugcggggacacagauaaugacuuaagguugauauguguucuuuaagagcauggacgguucagaagcacaugcggagguaaaccugagccuuugguugcuuucuuucugcuuaguguucuuucgugagagcguucuguuuuauguaucaaucagugaagggauguuuggaacauugcuccugacccucauguuugagccuuuuccccugaccgccuacagugccagggcagcugggccaguccuuuuaagcuggaucuaucugugucucaggcagcugcauuccuguccuuugacccaauggucuuacuuacaggaacuccaccccacuuccauaaugcuccaaaauacagaaaaguuuacagaagcacuguuuugguuagaugauagcguuuucaauuugguuacacuuguaaucucagcacuuggaaaguggagacgggagaggaggauaaaggguuuaaagcauccucggccacuuagcaacuuugaggucagccuuagcugcaugaaaccugucucagggaaucugaugucuuauucugaccaucucaggcgccaggcaugcaugugguacacguaccacaugugguacauguagggaaaccacuuauauaaaaaaaauaaaauuucaaaaauuguaggaagcuggagagaugacucagugguuaagggcacauacuguucuugcaggauacccgggcuggauuccuuacacucacauaaggcagcucacaaccgcuucaggggaucuggcaccucucugaucucuuccuccucuuccuccuccuccuccuccacacacacacacaaauaauaauuaauuuuuaaaauaaaacauuaaguaaagauaaaauaguaacagcaacaacaacaaaaugaauauuaaaaaaaaaagaauacaguaguuuccauauugacugaguacuuccucauaggcacucuccaaugcuuguggucaagggcaucuguagaccaggcuggccucaaauguacagaaugauggaauuaaaugccuucugaaugauggaauuaaaggcguaugcuaacacacccaguccugcuacauauuuuuugagaugggaauuucguauauucuuuaacucacuauguuuccaaggauguccuuggaccucuugcuuauaccuacuuaguucugggauuauagguggagauccaggucuuuuaugacucaugggacaaacuuucagucuauuuucuccaggacuuuguguguguguguucugaaaauuaaauuuauggcuuuugacauacauaugccuuauggcugacacaaaaccucagcccuuuaucauuuaaaauggacaauuaaagcuagggaugguggcacaugccuuuaaucccaguauucuggagacaggggcaggugaaucucugugaguuugaggcuagccuggucuacagagugaguucuaggacaaccagggcuacauagaaaaacccugucuuggaaaaaauacaauuaaaugguuaaauuauauucacauauauauauaugaaugagaugcauaagcuggggcauucaagucuuggcauuacaugauaggcaguaaaggaaugcuauccuucaaaacugauguuuguuugauacaucuggaaaaggaucuuuuugaccuggggagaaauaacucauucuguaaucagaggcuaguguauuuuuacaagcuggccauagcugucugggaacacucgguugccucuuucugauagcucaagaaugggagccuuaucacuucaagggcauuaauuuucugccuccuucaaagguaggggacaucugcaccaaggugggagugcuggcuguuuaacuuggcauggggacuagggagugagagacucagcgcacagagacaaggguggguuaccuugugucucuucacuaugacaccuguaucugcacacaugcacacuaacuuuaaauacauguaaugaaaucagagugaagugaacacaaaaaggcucacacuuacugugcaugcaaagauaaccuugaacuccauguucuccugucucuguuucuuuuuauuuauuuauuuauuuauuuauuuauuuauuguauacacuguagcugucuucagacacuccagaacagggcaccagaucucauuacggaugguugugagccaccaugugguugcugggauuugaacucagaaccuuuggaagagcagucggcgcucuuaaccgcugagccaucucuccagccccccugucucuguuucuuaaaugcugggauuauaggauaugacagcauaucuggcucuaguccacauuuucaacauuugacagauaaauuuuauuaauuuuuaaauuuuaaauuuauuuuauuuguuuuauuuuaugugcauggcuguuuugccugcguguaugucugugcaccacgucuauacuuggugcuuuuggaggccagaagaagguguugcauucccucgagcuggaguuacagauguuucugagcuguuaugugggugcugggaacugagccuggguccucugaaaaggcaauacauacucuuaucaaugagaaaucucuucagaccaaaccucuaaauauuucacuuuuguugauauuuugguugggcaaacaaaaauauaugugagauucuacauguagcuuuagaaagccacugugcucuguccagauugaacagggcagggaaguuagcuaaaugcugucguauuaaguauugguguuuuuaaaaccccaucuuuguuuuuaaagauuucauguuuguaucauuaaaagacaacuugaauaacauugugugugugcgcgcacgugcauucuucaaggaauauugaaaaccuguagcuaacuuucuuucuucuucauuccuaccucucucccuccccuccccuuugaacuucugauucuccugccuccaccucauacauguugagaucgcaguagugugccacuacauuuaguuuuauguaucgcuagaaaugggaccuauagggcuucaugaacuacacucuaucaacugaacuacaucccuaccccuaaaaguauuguauuuggaaccuagucaauauguucuauguaguguccuaaaagacuguaaugcauccuaguuugggagguuuuuaagcugauagaaaaaacuagguguuguuuauaugccuguaaucccaguacuugggaggcuaaggcaggaggaugacuacaaauuugaggcccuccuuggguauacaauaacauaaguccaaugccagcauucugagauccauaguaaaguccugucucaaaccaaaccaaaccaaaccaaaccaaaccaaaccaaaccaaaccagagggcuggagagauggcccagaggauaaaaucacuuacugcucuuucagaggacuggugaagugaaaacuuaagguuggaugguguuuuucuggggcaaauaugugaaggaacauuuagcugaaguggacauacgugaaaggcuaagggagacucgugaaggaauguuuagcugaagcagacacaggagagaggauguucacuaaagcaggcacaugaaaggacacaugaugagggauucuuugcaaaugauacauguauuggucugccuuauguuguguaguugagcuguauuugucaggacuccauagagagaaauuucugguggugugcuacaguuucuugccgcuucuucagauucaggcugauuggcagagugaugucagcugagacagaugcaugugcugaggcaagcccuggaggacacaugauguuuggaggguauaaauaggacccaauagacagugacagaggcugagcuaggugugcuuauagagcuggcuauguaaugcuuguuggucucacugaucuuugcuuugcugagagaggcacauccgagaacuucuuuugguguucuucugggguccgucccucuugcugacuugugcagaggcugaggccuggcugucucugcuagguugugucaccgcugcugauucauguuugcuaucccuacucuggacuguugguguauccaugaaguguuugcgaguggauugagcugucugcuaacacgugaacugaacugcugauuucuagacaacacagacgggaguugcuccaaagaaucuuucuaaacaggucuacuuuccccauauccuuucuuucccucuggugaguauugggcuaaaagggagguuaaagaguuuaagaaccaucauuaaaaauaagauuaaaaaaaaggucacagaccuguuugguuugguuccuaguauucacaugguagcucauauccacuuauaauucuaauuccaggaaacugauauccuuccucuucugauguccucaggcacuagacauacacaugguacgcauacaucuauguaggugcucacauauacacacaaaauaaaaaaagaaacccaacaaaacaacaguaacgacaauaccuuuauguuaaagccaugugugcaugcuuaugaucccagcacuugggaagccuaggcaggagagcuacccuccagggcagcuugagcuacauuuacugaccccggucucagaacaauaauaaaacagauuuuuuuuuuuugguuuuucgagacaggguuucucuguauagcccuggcuguccuggaacucacuuuguagaccaggcuggcuucgaacucagagauccgccugccucugccucccaagugcugggauuaaaggcgugugccaccacgcccggcucagauucuuaauauaguaacugaugcugaguaaaguaaaaaagaagauugagaagagaaaauccuuaauuuauuugaucacaguuuuaugugacauagguaaccuguuaugugacauagguaaacucuguuuaacccagagaacaagugccaucagggaaauagccuuucaucucaggaaggcagucuuuucugcuaguagacaaagugcuagccauucauacagacacuccauauuuugacuuuaguugugaaaacagagaaggguggaauaggauaaaacugguuucagccauagaggacucuauuuagaccuguuuauucuuuuccugaagaagucuuggauagucaucuuacuuguuacuuaauagcauuuccaguuuggccuucugcucagacaggaagcuggucugugaacacuuucuccugauuucuuauucucuggccaaaggggaaccuuuccaucacugcauaaucaguucacaguuuugucacuggggcuaugauucuggaaagaaaaugacccaguuucacucagaaacugguaacugagaggucuuggaugcauguugaagagagacacugggauagauauuuuuugguggggguaagaaacuuauuagaagaauuauuaauauucuggacaaagagacagcagcauggcaggggaucugaggagaguccaggccucagcaccagaaacagggcuuccaaagaggaguaagagcucuccaggcagugucaaaguccugucuuauagcucucugaggaagagggaugguuuauaguaccagcuugcagcaagguucuuugguuuuaagauagaacucaagauagaaggagguggggaccaggauguguggugcaccuggaagucuguaaggcacuaauagaaaaugccuucaguagggggccugucaguaucugugggaauggaagggcugcuucaggcuuugugggcaugagcaguaguuuggucugaguucuaacauuacauucuuacaguaacaucauggugaauuauuuuugguauuguuuguuuugagagauggucuuucauguuucccagcuguucuuaaaugugcuauauagcugacgcugcccuucaacucaugauuccuacggccaggacuugugaagugcugagcucagaggcaugugccauacauggcuuuuagagggaggauucuggagguucugucagaaaaggaaggaugauccguucugguugcuucucaaaguccaaaaagucucaaaggcucuccccagcuguaucucugucuuucugguccuccuaugcccucuggcuccucagcaggcaggccagaucaagcugggguuuugaccuuuucuaccuguaauugcuugguggcucaguuccagcagugagacacaucuggguugaggaagggugggagcaggaaagcauccgcuguacucuuuuguacugugaugguuuacuggagaugugacacauuguuagacauaugugaauauguggaugcaaguuguagagcugugugugccugagguuuagucugaagagugaggucagguuugauguuuuuuuugaaguggaaacuucugguuucguuggaaagucaguuaugucaaaugaugcuuugcuggggcacacaggucaaaggauguuuugccaagggagacaugugaaaauguuuucggaagcagacacaggugagaggauguuuugcuauaguaggcaugugaaaggacacgugauguuuagaaagaauauacauaugaccacacagacaaugggagcuagaacauugguuugccuugcucugccuugguagucuuugcugacgauacacauguauugguuugccauacauugcauugcugagcuuuauuuguggugacuucauagagaacuucucaugagguuccugcgguuucuucugcagacucgagcugauuggugagccuugcaguuucuucugaauugaacugcucuugcugacucaugaguggugauugccaagugaacuggacugcagcugcugauucauguugguguuaugguagaggacaaggcuacugacaaugaagauuggaaucuccccaaagaacuauuucuaaacaguucuacuuaccccauauccuccuaaacuuucuuuuucaccucuaguggauggugggcuagaggggagguugaacccuuacuaaaguagguuaaggaaaaguuauaccuauacuuuaguguccugcagggucauccaggacccugugcuuaggacuacauacuugaugugacaucuugucaucuuaaaauuacuagcugggugugcugugugcuggcucacgccuuuaaucccaguccuugggaggcagaggcaggcggauuucuguguucgagguuagccuggucuacaaagugaguuccaggacagccaaggcuacacagagaaacccugucucaaaaaaccaaaaaaaaaaaaaaaauacugaugaguaugcauuugugaucuuagguauauaaaguuggaugggacaaauuauuagcaauguaguaagcaagggggugcugacucugcauauccucuguucuaggggcuccuucugaaugcaagcugauaggugucagugacccaugaauucagaaugcuauaccucuaggaugugcaaguuaccucuauagaagaauaugugggcacugauagaaccccagaggacauacuuucauuugagauuuccccuuuauuuauuuuccagucuuccuucuuuccuuucucuuccaucccucccuuucccucucuccaggguuuuacuagguaucccugguuggccuggaacucacuauguagaccaggcuauccucauucacaaaaaagaggcauaccucuaucuuccaaauacuaggauuaaagguguaugucaucaugccuggcauccuuuuaaaaauuguauguguauggguguuuugccugaguguaugucugugugccacacggguaccaugccuacaguggccagaaaaggguaucagguccucugggacuggcauuauagacaguugugagccaccuugaggaugcuggggauugaacuccaacucuuuggaagauccacaaauguucuuaauugacuaagccauuucuccagccccaaacuuucauuuuugaggggcagaaaucuagccuuuuccuuuguaaauaacagcuuuauuagauguuucauuaauaugucaugacauuuaccauuuuaaaguauagaauuuaugguauuuagaacauuuauuuucuccgacucuauuaaaauccaguucuggcaaccccuugauuugcuuucuguaucuaugacauuaaauaaacaaaacuuccauuccaagugaagagggauggcuauguaguuaagaaggaugguuaugaacucccaaucuucuugcuuccaccuccgaaguuucccuuccuccucuccucccaaugcccaccacuucucaucugacccccuuccuauccacuccuccagaaaaggguagggcucccauggauaucaaacagccauggcauaucauguuccaguaagacuagacacuuugccuuguagaaaggugugaugaggccacccaguaggaggaaaaugaucccaaaaagacaugcccuugcuuuuuaaagaaaauuauuuuauuauauguuaucuauuaucuggaaguaugucuaucuugugauuuuguaugcuuauaugcacuggaguggcauaauaauacucuuguggaggucugcgggcauuuuguaggagucaguuuuuucuuucaaacguggggccuaugaauugaauucaggccaucagacuuggcaguaggcaucuuuaucagcuggcuccucucauuggcucuguuuuuuugcuuuuguaacggguuuucauuauagcccuggcuggccuagaacucucuauguagaguaggcauuaauuccaaacuugcauuaauucuauugcuuuuggccuccagagcgauaagacuagagauuaacaucaucaugccugguauucuuuuuguuuuagaaacuauguuuucuagauaagccugaugcaggccuauaacuccagcuacauagguggcugaggugggagaaucacaaguucagugccagccuggacaauuuagugagaccauguaucaaaauaaaguuuagaaggagccugggugguaccugccuuuauuuucagcacuugagaggcaaaggcuggguggaucucugaguuccaggauacccagagcuauauagugccugucuuaaaaacacaaaacaaaacaaaaauguaaaaagggcuuaggauguuauauaaucaauagacaguacaacaaacaacaaaaaccaaaacaauuaucuuucuauuuuuaaugauauuuucccucuuauuuaaauuuuuuugagggugacaaggucucacuaugucuuuauuggccuggagcuugcuauauagaccagacuggccuugaacucagagaucuguguaccuuugcuuccagagugggggaauuaaaggcaugugcuacaaagcccagcucucuuucucucugauguguguguguguguugguuuuucgagacaggguuucucuguacagccccugcuguccuggaacucacuuuguagaucaggcuggccuugaacucagaaauccgcuugccucugcuucccaagugcugggauuaaaggcgugcgccaccacugcccggcuucucucugauuuuuuuaaccagaggguuaccugccucuccauuuuuucagugucagagaucugaucuaggucaagggcaugcuagguaaauucuagguaaguuuugagcuauccuuaguuuuuauucuuuuugaauuuuauguauguauuuauauauauauauccuuaguuuuuauucuuuuugaauuuuauguaugcauuuauauauauauauauguguguguguggaggggcaugugcaggcauguacaugccacagugugcaguguauaugcagagaucaaaggacaaguugaagguguuuuuuuuuuucuccuuccaucauguggguuucagagaucaaagugaggucauugagcugggcaacaggugccuauagccacugaaccaucucucuggucuaguucucaguuuuuugugacaagguccuauugaucugauccucuuguaucugccuccagaguaccagggauacugguauaaaauacuucacucagccagacauuuuguuuucagauagcuuguuucuuuauuguaugccagguuagguuaaaacucaccauguguccaggcuggacuagaacuuuggcagucuucaggaaccagucuucuuagugaugagauuacaggcaugagucaucagggcugacucuucagcugggcacuuaacauuuuuauuauguaugcauauauaauauguguauauguggguauguguacaugguaugauauacaugugaaggaagaauacaacuuuugggucauugugcuuguguuguucugucagacuugcauuugaugcaacugauuuuaccugcugagcauuucagcaucccuuagccaggcaauuuuacuuugagauucugaaaacuuauacccugggaugaaugaauuguugcuuagccuauuuuagagguucuuggggcuauuugauaggauugagggccaagaaucacagaccccaccaauacaggcuccuuggcccccucuuaugggaucaggaccacacauccacauuuacacagaaugaaggaaccaagcuaccuacaagcccguguauucuuauuuauuucauuauaucuaagauagaaucucaugaaucccaaguccucccaaaaaaacaaacaaaaacccaaacccaaacccaccuccaaaaaacaaacaauaacaaaaaaccuguucucaacauuccuaaugcugccacccuuuaauauguuuccucauauugugcugaccauaaaauaauuguauugguaauucauaacuaauuuugccacuguuaugaaucauaauauaaauaucagauaugcaagauaucuaauaugugacccccaaagggggaaugacccacagguugagaaccaaugauuaagagcgagguaggagggucaggaguucagagucguccgcuaucacauagcaaguuugaggccagccuggcuuuaugaaacccuaucucaaaaacaacagcaacaaaacaaaguacacugaaaaaaugcaguuaaaugaaacaaacagaaucauuaaguaacaccuucuacuacucguuauuucuaauuuccaaucuuauuuagaugucgggagccagacuggccuggaauggcuugaaaugggacagagcauuggacauagauuuaaagacagauggucucuagccuagcucucuaacuauacuuacugaauauuuguugauggcuuuguagacuuaacagucucuuguuuauucugugguugaaaacugcuggcuucuuuucucuuuaacucucuguagcuuccuuuuucuuuauaaaucucuaugcuuuauuaaaugcuguaucuuuauuuuauaacucuguuuuuguucugugcuucauuaagugcuaaaaacuuaacuuuucuuuacuguucugugcuucuuuaagcucugggguaacaacuauuaguuuugugcuaaaaacuuaacucuuacuuacuugugcuuaaauaagcacuaauaucuggugauuaacacaugcuguuuagugucagggaauuaacuaaaaggauuuauugcuagugcuccuuucucuguccaggcagccagaagccuccauggcuaggcugcuuaacucuuugugaaccagagaggaaggaaaggaaagaaucaaaaugcuuuauacaggcaaauaugcacagacacauauauauucaucauccacacucuggccaggccugaccaucagucacaaucaucuccacaaguauuuaugcaugccuacacacauacauaguuaccuacacacuuacauauagacaaacagauauacacauuuggauggauggguggauggauagauggggcagagcuccccaaaccaaaccaucaaaccaacaauuuucuuuccuuucucuggccuuuuuauacuuucuuagacaaaauguucuuuagaaaauuacuucagagauaaaauguuagauaaaaugggaguuacagaaggauguugaaauuaagaucaaagcaguguuucauucuauaugcucauuauaaguucaaagccacaguuuucacauggccuugucuuaucauagugcacaccuguggcuccauccuugggcuuaaaugcauuuccuugaacacaaauuuaucccaagccuauuucucuuuuuaguguaauuaugaaagcucauuguauuucuuauuaugcacccuuuacuauuaugaggagugggcacauucuauucuugauucuuacuuuauugcaucuuuuuagcaaaaugacugaaaccaucuuuuaaaacucuuucuaagauuauuugaaucaaaucagauauucuguagaaucauuaauuaauuuaaauagcauuaauucaugaaaguucaucuuuacuucaauauguaggaaaucugaucaacagggugggcuaaugcugaggauuauuauauuaauuuaauaaugacaggaaagacauaucagcugcaagaagcaauccugagaugaagucucuuuggaaccuugccaucaagaucaccaauagcagaccaugcaaaaaacggugggccaccuccaggaaggccaccugcuagccuuagccuauccuagauggcuccuaacacuuuaguguuuaucaaagucuccagaucuauucucagagcuaaugcagugaauuaccuuuauaucaaugucuuaguuugagguuuacugcagugaacagacaccauaaucaaggcaacucuuauaaagaacaacauuuaauuggggcuggcuuauggguucagagauucaguccauuaucauggcagacacagugcugggggagagagaagagacugugcacuacacuaaguguagccugaacauauaugaaaccuggaagcccucccccacagugacauacuucuuccaacaaggccacaccuacuaauagagccacuauauggccaagcauucaaauacaugaauguaugguggccauuccuauucagauugccagucuucauuucaaauucugagaugggaugcuuauguuucucaggcuggcuuucaccuugcuauauagcuaaggauauccuugaacuuuuuaucuuucugccucuaccucucuagggcuggggugauaggugugacccucaaagcugagaugacaguggacugucuucaucuuuuguuuuuauucuaguauuaaauaagauccuagguguccccaccuguguuuuugugucccagaguugaaguggcagcugaaugacuucacuuccucccucauucugcucaguguagggaccaaaaucuuggauuucaguugaaugcuaucacuuggaccuucauuucugauuugugugauuacauggagcugagguggcuuuuacugucugcugaacuuuuugucacgccuccaaaguaauaagguagaaaagaccaaguauuagguccugguuuauugguuuauuuacugauuuacuuauaucacugcuguauuaccuauuugccaaccaugacuucaguugcucccuggaacagaaugaccuggagaaauagcucaaacaaugggucauugcucuuaacaacaugcugacugccaagcauacuuuuguaaagaccugcucacaaauuagacccagcauuaaagccuuucaggagcuguccuggcuucauccuauuggggacauuucucuuuuacucucauuggugucagagggcuuauuccagaaagauucccucaacagccucauuguugaaugauugugucaucauuccugaaaugcugcuggcuuauugugccuuugguccuugguagggacuuaaaucugagugaucagcugaauguccucaccucucuuugugcuuuauguuauccuaccuuacccuaguauuaaauaagauuuaggcaacaguuguguccccaccuguguuuuuguguccuagaguugaagugguagcugaaugacuuuacuuacuccuucauucuguccaauguggggaccaaaaucuuggauuucacuugaaugcuaucgcuuggaccuggagccaaggugaaaggcaacuucaccugggccuucauguacuacuauaguuuucucauccagaggcagcuaauguaacccagacuuaaaaugucucuacucuaguguagcuacaaauaccugcgguuacaguugacuguuccaccuacaaguuucugguuucauccaguguaggcauauagagauucuaugucaguugaucucugcagauuaggccaugaaucucagcacuaauguuugcaucagaacuaacguaauguacuggagaaauggcuuagugcuuaggugugccugcuggucuugcaaaggaccugaguuuaguaagggcacccuauacauauacauacacacacccagagguaaggugaaaguagaauguacucaauagagcuuugguguagggucagguugcucucuucaguccuucuucuuucuuacucaaauuacucccaugucccuucuguacuuuaggcucccugugcugccccuuuauaguagcuucugcuuuagggacacuaugccagcaaguucucuacucccaaagucuguaaaaguuggggugcaaccugaggguuucaacaguacucuaagcacaaagagccuccacauggucaguaccauuuucuggugccuuugucugcuuucccuugcccuaaagcuuuaaauaccacccucaggugaacaucugaggcuuugaaaauccacucuaaccauucaaagagguugaggauuuuaaaaggcucuuucccaaaaacaggcaugagucugguaccccuugguaauguguggaggaaggugugggggcagcuuuaggaaaagauggacaagauucugccauuugggcguugacaggcuuuacaucuucacuauccuuuuguaaaaccuugucuauucacuguaaccacaugacugcuguaccaggagucaagagaaaccguguggccuuuuaucuaaacaugaugggaagauuaaaauucaugagagucaguaggagaugacaguggaaguggcauugaggccucacaugggcuuugugccaagucccugagaagcuauucuacuuguuucuacaugcuuuuucaugggcugugguaaaaguggugaggcuaggcuagaaagccuccauagcucagcacacagcuuuuagccccagaguuguugcacacauuugcccugccagcucucaggcccaaucuaaguggcaccaucagcucacccaucugaggcauagacaccaggaggauggagaaugaagggccugucccuguguuaaagccuggccuccaaucuugucuauggaaccuugauggaugcucuggaggacacugaccagaaguguaacugucagcugggcaugguggcgcacaccuuuaaucccaccacccgggaggcagaggcaggcggauuucugaauucaaggcuagccuggucuacagagugaguuccaggacagccagggcuauacagagaaacccugucucaaaaaacaaaaaaaacaaaaaacaaaacaaaacaaaaacacaaaaaaaaaaaccccaaaaagaaguguaacugucaugccugaaaagaauaaaaauauucuauagugugugauacacacccuuaagccuggcacuugggagucagaagcagguggagcuuugugauuucaaagccagcaugagaugacugcaugguauaaagcaacaguuauaaaacuucucaguccuacugagcccucagaagauuucaaauuaagagacugcucuagcaucagcuucagguguuuccucaaaauauguagccauuguuggacuauuuggacuguagcuucuaagcaacucuaguauauguuuuaucaguucuguucuuuuauagaacccugaauaacaaaugugggaaguggggaaauaauaggucucuccuucaugauccuggaugcaaggagaaaagaacaaggagacagguaaaacuguuuugaggauuuaauggcaggguugggauaggaaaauucuagcugcugugcuugccuuccuuugguaaggaggcugcccauaggugggaugagguugaccauggaguauggaauuggucaggggacaucuagagcccccaaaauauugcuaggcagcaugaggucucuuccaucuggugaggaggaaugucuaguagcacugaggcuaguguggccaugggcagguccucucacauagguguccuugaccacuuccuucaaguuuugaggagcuugcccauagccucugggaagucugguuuggucauugucccuuugaggccuaaggcuccuccccauuguuccuaacuccuuaaggaguccaggggcagacugauaggcauucuuucugcagcggcuggaagggaggugauucaggucuuguggaaagauggguggcucagauagggccagugguggcccugaaacccuacaaugaguuuuaaaugccugguauuugaggaauguagcuggguuuacuggugguggcaguggcagcagcauaggacaaaauggcgguccaagcccaggaacuagaauguguaucuaaggccuauggucccaaaguccuuccaauauggggucaauaguccuaauauaggguuagauggugaaaagggaagaugcagaaaggguggccagaagaggcagaguauagaugguguaacuuccagggcucagagcuugugaggguucacccacuuguagguacccucguacuggaagcccacucucuucaucagcucaucugccucuguggggccgcggcugggagguaaaggagagacaugagugaccuuuauccuugguauucccacugcccugcuucauuuggcuuggcccucuuagcucccauccuucccuuaccugccauauacauaggggaugggcuggggcuuuucucgaucaaucuugugcagcaguggugugaagauacgccaggcuucccugaguucaucacugaagggauacaguguaggauggaguggaggcacacagggacagagggagaaaaccaucccucuugccuguguuaggcugggggucccucaccuccggacaaagugcaucuggcucccacagaagacauccaggaugaggcguucauaggcaucagggagcuucacauucugcagguuugggaaagggggauguugcugauacuacuguacucagccacccagggccucccuuagggcuuugcccagaugguccucccuguugaaccuuguaucuguugccauaaguuagauccagcuccgacuccucaggguuaaagaacaugccaggcuucuuggucaucaucuugguguauacugccucauugggcugcacacggaugaccagcucauuacgcuugcacuguugguggaagaugucaccugccacgucucggaacugcagucucacuucagcuuugcguucauucagggcuuugccacagcgcaggaugaaggguaccccuagagagcagggaugaccucagggacuggcuuuccuaucuugugcuguguguauaugagagagagcuccugugucuguguauaugugugaauguguacacguggaauaaguaaugacuagggucguuucccacuugugguagcccuccuucuccagcaucccuuacuacugaauaccauguauucauaccaugaucauaacaagaagugucucuuugugggcacauuuaacccugccuugcuggaaccuagaaauuucaccuaccgucccaccguucauucuccacauagaggacagcugcugcaaaaguggcagugguggacccaugggguacuguggggucaucuaaguauccauuggcagcuucuccuucuccauugggguuccccacauauuggccaaggaccacguugucaguuuccaccucugagauacacuucaacacuuugaccugggagagaaccaaugcagguaacagggaggauguaggacaagagcccagugccuugucauagaauuacuuguuauggggcauggcugcuggggaccugguggacaugccuccaccuaccuucucaucacggacaucaucugaaccuguaguggcaggcuuuuccauggccaccagacacaacaucugcaggaggugguucugcauaacaucccuaguagcagaagaggcagaugcucuagucaagugccauuuccagggugaggccaaggggauaacuaaguucuaguugcccuaggauuaccaaacaaggcuuccuagugacaaacuggaaaaccuugguuccuuaccccuagugucuucccaguauccuaagacaaguuaguagauacuaauccuaacccuuugggguuuggcuagaugggaguuauacccuucauggcuacccccaacaggucacuugaacacuagcccucauagugugaagaugagcugaguugggguaggauauggguucuuaccugaugaucccaaauucaucaaaauagcccccacgacccucaguaccaaagggcucuuuaaaugugaggaucacacaagcaauguugucucgauuccagauggggccaaagauccuguuggcaaaccugugggagguucguuuagaggcuagcaugagagacauuuuggaaggguucaugaauggaugcuacauuugggauuccacaguauaguggcuguaucugagcuaaguaccaagcuuaguacccuggccagcaucuaggaggaauuugacuuuggggcagcagggcaggugggguuccuuauguugccacccuugcccugguucccuuccaccccauccccuaugcaccucagcaccaugagauucuggaccaucucuuugcccagguaguggucaaugcgguagaucugguccucacggaaaagagaggagaugugguucgacaguugauuggagcucuguaggucucucccgaagggcuucuccacgaugaugcgguuccagccucugcuuggagcccccaaucauguuauuucccaaaccuuucccaggaauaggccuauggccaugucauucugacccucacaccagggagcagggcuuucaucuauuguauucucaggugacucagggaagcucugcuggcuacuauugauccuuauccugaauagacagcaucuuagaagcuucccugacaacaugguagggacuggaacaauuccagggauuuuuccaccuuggugcuaggguagcaugaccuuggguggccuuguuccccaccucccaaugccagacccuuagagggucagaaguggcccagcagccaacaggaaagaaggacacagcuuccuuacuaguuuuacuuuaauuagucucauguauccaagguuggccaagaacuuguuauguaguuaagaaugaccuuaaauugcugcuucuccuguuuccagcucccaagagcugagaucacagguacugugccaucaugucuggcuccccucauugguuuuauguucuugaagucuuauuguguuucucagguuguucuggaauuccuggguuaaaggguacuccucccucaucccuucaguagcagggacuaucgucaucgcccaacgcaacugacuuuaauugaguuuacuuauuuuuuaaacuagcuuuuauuuguuuuuuugagacauauucuuacuaugaagacuagaaugacuucaaauucaguacguauguagcccaggcuggccuugacaacauaauaauccuccugccuccugaguacuggaaucacaacugugugucacuacacccagcuaaauuuuuuuuuuuuuugguuugagacagucucacucuguauuacagguuagccuugaacuccaagcaauccucuugcuucaaucuccaucauacugaaauuauuuaugugucaccuugcccagauuuccauagauuuuaaaagaccagguuucuuucuuugacacucagagugcuaaacuuguuuucuaaauucaggaggaagagaaagaugguuugcagucagcagugcucucuuaugaaacaacacugccaccuuguggaucugcugaggauugggggugggggaaggaauucucacaaugagcaucuguucuguggagcaacacugucaucuuaugguccuggugggaaauguugcaaggggccacuauuuuguagugagagccuuggaagguagaagcugcccaguguguguguauagccuguuccuuuuuuuuuggggggggggguaugcuauuccauauggacaacacacuaggggcauucaucuuuucaacuugcauagacuggcuugaccugggggcuauuuagaguagcagaaacaggaacaaacagacaggagugaagaaagacaggucuuacgucugacucaugcaggucucuugaauguucuuggugacugcuucauagacuguggggggcaaggccagguagaauagacgguuggccugcauccccuggugcagggcauucauguggcuguugaggugcuuauaggaggcugcaucaucauacuggccagcuacauaggaauuacgggcaaagaacuccuccagcuuaggucuuucuucuggaguggccuggggauacacagaugaaugucaacuucuacuuuucucaagagucuacaguuguucugcccuaaaggaauagaagaucucuuucucucucugugccuaccccccucacucucucaacaauuucuuguuccacagguaaggcggguuuuccuugagucccugucauugcucuacaagcacaggaguuuacuuuaucaugguaacuuuguguacccacaggcagagggcuaaggcacauagcaggaauauaugcagguggggcaaaucacuggcacauuuuuauguauccuuggggcccucauaccuagaguagaaacuggauuucaggaaagucuaaccugagaaaaaagaaugauggagaagguugucucuucaaaauuacuacaguaaacuauagguggugagaaaaugucaacauagugcaauuacuguagaaaagagguacuuggaaggguccuuucauccagcuacuggcaugauccagugugguaccagagcauagcaggaugaagccagaguggagcuaggagacagauaugagguugaagggaccuucuuccugucuuuguucaaaggucaggaagaauguggcacaauuaaguagacacaacuuuugugugguuggcaagggaaagcaaggaugugaggugucagagauugaguguucuggguggcccugccuguuaauaagucaaaugagaaaggagggaacuauugcuuaugauggaaauggggacaugucuucucaagggaugccuggagcuagucuugcuguggaguagaagaaagggcagcacaaggcuccaggauccaaugucacacucacuuuaaagaagggcucacucugcuuucggaugucguccacugugagucgugagcgggcauagcccacaaugaagguaucuucagguagaaggccaucccggaacagccaccugaggguacaauacagcuguuuucagacuggcuagggaaggccaaggccuguaccugguagagaguauuuugggggguaguguagaaauauuaccuaccagaugguaggauagaucuucuucuuggccaggucacccugcagaagaagaaacaugucagaaagagcugacacgaccuagaucauuccccaccaguggugaucuuaguccucauuugggguuaccacucagcuagaaauauaucuacuaugcccuccccauauauaucagaggaucucugagacuuaagccucuaccagccuuguaccaauacagaugaguagaugacacugcuggguucaagaugaaacccuagacaucgaauucauuagagcuuaaggaugauaaaggcagcacauaaaagaaagacaaaaccugugagguaaggccucagaugucaccggagcuagaaggcaaugagauggucauucaauuuggaaaguuagaaaaauaauggcaggaaaaguuugaugaugcagaaugaagucuugucucuguaacaaaggccagauuuggugguaauauauucucccaauauugagggagauacuguuucaaaaucaccucuucuaaaucagaauuaaaaaaaaaauaagguagcagugaaaaaauucaauggaaaaauugggcuggagaagaugcucagugauuuuggaguaggcaaggguucugauuuccacccccacccuacaaaaacaaacagaguagaaaacuaacaaaagagcgcuagaggagagcugugaauugcuauuuucuugauaugacagggcugugguacacaugaagccacaguagcuguaguugccugcaugagaucaaguuggccagcaugcugaguguguguaguucacaagcugcuaccccuagcuaaggaucuguuggaagauccacuucccaucaguggcugcuagggaauauaauuuuucuucauggccccuugguaauugcucaaggaguggaugaugguuccaugcucaugagaauguaggaagcaauuauuguacuuaauggguuauaacaaaaauaaaaauugggugggggaucggggagguuguccagagggguugagagagagagaauggaggguagauaugcuuuaaaugcauuguauacauguaugaaauucucaaagaauaaauuaagagcuauuaaaaaaaacaagccaaaauaaaaccaacuuccccaaacaucaaaccaaacuaaacaaccaaaacaagaaagaaaagcugggcuucguggcacaggucuauaaucccaguacuuggguaguuggagcaggaggaucuggacuucaaagucagccuuagguauacaccauaagacccuuucccuaucucaaacacuaccaccaccaccaaaauccaaaacaaaacccaacccagccuaacaaaacccuaacaaguuagaaugagacagagaauuuuguuuauuuuuuucaagauagaguuucucuguauaguccuggcugucuucaaauucauccuguagacaagguugagcuuaaacucacagauauccaccugccucugcuuccggagugcugggauuaaaugugugugccacuacagccuagcugagacacagaauuaaaaauuuuuuuaauuuuauuuuuuuaagacagggccuugccauguaaccaauguugguaccguccacccuccauccccaagucugguuuucuuuguguagcucugguuauccuggaaguucuguagaccaggcuagccucaaacucaagagagcucuaccugccucugucuuccagugcugggaauaaaggcccagguuggucuuaaauucaguauguaguccuggcuggccucaaacuacagacaacccucuuguuucuuuguagugggauuacaaaugugugccaccauauucagcaagauggaaaaaugucuuuaaaaaaaaaaaaagauccaaccuaggauauaauggaggaauggaccuaagggguggcaauguacaaagacaacuccuggccugaaaagcauugcuaauggcuucuaccagagucaaggaagagugaauuccacucugaaguaaauuuccccugaagacagaauaaagaggaauacuucuaagggcacuuugagaacuuuaguucuacaacuugaugacaaaggcugauguaaaacucgauugauugauugauuguuuauugagucagaguuuuucuauauaguccuguaacucauuugucagcuggccuggcuguacagaugaacugcagguucaaugaggguuccugucucaaagaauaaagguagcgagagcaaugacaaaaucaaucacugaaaaucacauuaaaagauuuaaaaaugggcugaagagaugcucaguauuaagagacuugcugguuuuguacagcgucccaaguuugguuuucagcauccauaucaggcagcucacaacugcuuguaacuucaguuccagggaauuuaaugacaucuucuggccuuuguggguauccauacacauguggcugacuggcuggcagacagacacauaaauaaaaaaccauaaaucuuaaaaaaaaauuagccagguaguggugguacaugccuuuaaucucaguacuuggaaggcagaugcaggcggaucucuaaguuuauagccagccuaguccacagaaugaguuccaggucagcuaaggcuauacaaagaaaccaagucuacaaacaaaaacaaaaaccaauaccccucaaaagaaauuaaaugaaaaauucugaaaaaaccauuguguguguauggcgcuggugacugaacucaggaaaucaagcauguuaggcaagugcucaacuacuggacuauagucccguccuggcuaguuuuauguuaacuugauacaagcuagagucaccagaaaggaggcggccucaauugagaaaauacucucauaagaucagccuguaggcaagccugugggacauuuuuaagugauugaugugggagggcccagcccauugugggugguaccaaccuugacugaugguccuggguucuauaagaaaacaggcugaacaagccaguaagaaauaucccucgacgggcgugguggcgcacgccuuuaaucccagcacucgggaggcagaggcagguggauuucugaguucgaggccagccuggucuacaaagugagcuccaggacagccagagcuauaaagagaaacccugucucgaaaaaccaaaaaaaaaaaaaaaaaaaaaaaaaaaaaaaccaaaaaaaaaaaaaccaaaaaaaaaaaaacaaaaaaagaaaaaagaaauaucccucuaugccucuauguaucagcuccugcauccagguucauuuccuuucuucagugauggucuaugauguggaaguguaagccaaauaaacuguuucuuccucaacuugcuuuuggucauagcaauagaaacccuaacuaggacagucacagaucuuaucccuggcugaccuggaacuugcugagaagaacaggauggccucaaauucacagaaaucuaccugucucuacuuccugggauuaaaaaggcauguaccaccauguuugccuaucuuuugagacagagucucaaaaaguuacucagguuggccuggaaguuacuuuguagucaacauuagcuuugaaugccugccccagacuccugagaagcugugauuacaauaggccucugagaaaucuucaugucuguguacugauuuuuaaaauauagcaacuuuguuaaguucaacaaauacagauaaaggguuucagaaaaaaauucuauuuauuuuuuuuuaaucaaagagggaauaaaaucucuuuaauuugauuuaggacaucuaccaaacacccuaaaaacaccauucaaaaugggguucugagccgggcgugguggcgcacgccuuuaaucccagcacuagggaggcagaggcaggaggauuucugaguucgaggccagccuggucuacaaagugaguuccaggacagccaggacuacacagagaaacccugucucgaaaaacaaaaacaaaacaaacaaaaugggguauuguuuaccuuucuuguugcuaugaaaaaaaaauaccuggcagaaagaaauuucggggaugaggguuuauucagguuuacaguuugaggguacaguuugccaugucagggaaggcguggugauggggggugaaguuuguguugucaacaaggaagccgagagaugaauauggacacuuaguuuacucucuccaauuuccuuuuguucacucagggacaccaaucaauaguguguucuaugaaauucaugguaggucucucuucuucaguuaaauuucucuuuaaacacaaucacagacacgcaucuaggugucuaugagaaaauucuaaaugcuugcuauuguuucuuuagucagucuuaaacuaaaagcccuugauagugucaucagacaagaaaaugaaaaguggccgggcgguggugguacacgccuuuaaucccagcacuugggagguagaggcagguggauuucugaguucaagaccagccuggucuacagagugaguuccaggacagccagggcuacacagagaaacccugucucaaaaaaacaaaaccaaaaaaaaaaaaagaaaaaagaaagaaagugguauaagguuuggaauagaggacaaaaaccugucauuauuagaugauagcuuguuuauuuaaaaaaguaccucaaaucaaccuacagacuaauuauuagaauuaaugaggguuuuccaaguugcuagauuaaaaaagugauaggaguagguagagauuucuuaggauauaaaguaauaaucauaagccagcauuguacugcagccuguaaucauagcauuccagaaguagaggcaggaggauaagaacuucaggauuauccuuggauacauaaagggcucaaggucugcacuggggguagggaauauaggagaggaaagagagauaugaaaaaaaugaagggcaugcauaugacugguucaauauccaguauuaugaaacaaaagaaacgaaggaaaauaggcaagccuggcauuaugaccuuagugguaggguaugugcuuugcaugggcagggcccagaguauaaucccuagcaccaaaaagacaaguuucaaccuuagagauaguauucacuaaacuuaccuguauucagaauaucuaaguagcuccuaugacacacugaaaaacaaucuaacugaaauggguaaaagguuuggccagauguuucaccagaauggaaacgaauggccauaaaauacaugggaaauguucaagaucaucagguaucagaaaaugcaacuuuaacaagacacuacuucagacucauuagaaugacuguaauacaaaugaugauaguugguacauacuuauagaacucccuucccgcaaaaagccaaagcaaaaggaagaccuaguauugguauggaacucauagacuguguguagaaaccugcaaugauuaaaucuaaaacagcauggcagccucuuaucaggugaaguagcuauaauaucuagguguuacuccagagaaauaaaagcaggcaaccagcugcccaaagaucugugcaugaauguucauggcagcuuuaauuuaaaauagcccagaaauggucaaauaaaccagcaugcagauggacaaauuguauaucuguauucagcuacucaggaaugagcuacuauuucaguguuggcaaaucuuaaaaauauauuaugaugaacuauagaagcuagacauaagagacuauauacuaaugaauucacuuaaaagccccagaaugggcaacuuuagacuauuaugacaggacucagaugaguaguugccuagagaggcgguagacuggcuggccagggguauccaagaauugugugggaagacagaaauguccuagauuaggucaucaacaauauagcuaccauuuaugcauuacaauauguaccaagaaaagagggugaaaauaauugagcaggggguggagaggaaguuugacauuacuccuagggaaacaauagcuacaaaguggggguucuuuggguacauaccuuuuuuuuugcuguagcuuugagacagggucuugcuauguaauccuaacuaguuuugaacuugcuauguugcucagacuguccuuacacucaagguaauccuuuugccucagccuccuaagugcugugauuacaacuguauaccaguacaccuggcuuuaguuacuuaaaaacauuuuuuuuuuugagacuggguuuccuguauccuagacuagcaucaagcucacuauguagcuaaggcuagcucugaacuccuaauccuccuucuuccaccuuucuagaauuacaggagaaguauaccaccauauauuuuacauuguuuuuuuuuauauuuauuuauuuauuuauuuauuauauguaaguacacuguagcugucuucagacacaccagaagagggagucagaucuuguuacagaugguugugagccaccaugugguugcugggauuugaacucuggaccuucggaagagcagucgggugcucuuacccacugagccaucucaccagcccuauuuuacauuguuuuaauucagggucuuguuauguugcuuaggcaggcuaguuuugaaugucuuucuugaagugaaucuccugcuucagccucugcagugcuaagauuuuaggugauaauacucuguuucuucuuuuuauuuaaguaauuauuuuguuuuuaauuauguguauggguauguugggggguguauauguacauuaguacagguaccuauagaaggcagaaaagggcacuggauccccuggauugggaguuauaaggaguuauuagcugccuguuguggguacuaggaacuaaacuuggauuugagcaaaaguagcaaauacucuuaaccaaugagucaucuuucaagcccccuuucuuaauggggagagaaauuuacaagggugugccaaguuugugaaaaguugcccagcugcgcccuuaaggucuguguuauuuuugaugaaauauuccaauaagaauuauaaauauuuggggcuaaggauauagcucaguggucaaguguuaggcaacggguuugaucuguaacacugcaaagcuaaugaauaaaccaaacagcacccccaagaacccacuguaaauauuaguagauacaagcuagcaacuuuuauuuacuaacaguaaauaaaacucauuuaccagugaguuggaaaaauuagcaauuuaaaacaauaccauuuacaaaaguaaauauuauaaagaaccuagccauaaguucaccauccucauuuccaagcuaaugugcacacucaguucaguaucccaguaaucaguaacagcccaacaugcuuucauuuuguacccugccaaaccagguacaagaagaaggggcagacaugacuaccaaucucuuggaauagaguagggcauuugcccuuucaucucaaacccuauaauuaggaacgugggagaagugugaacccaugcuacacacacaggauaguacuacuucauggggagaggugagcaagugcaacuggagucaggcacuggucccaucuauauucuaauucacucucuacacaaaaagcaacucugguuuuaagaaccugaauauuuauacaaaaguaauuugcugaaacuuuuacuacagguauaucuaauuaaaacucaaaacaccacuuucuaacaaggcauuuuggcacuaauuucucagguguuugggaugagguuuuagaugcagugggucuggguggcaugaaccuugcaaaauuuaaauaagcuaugcagaauacagcucgaacaauccuccuuuaccuggcugggaucaccaucaccuggaaagaugcugggcuccaugaaucagggacccccagagagugaacugcuguucucucucucuuuuuaaagguuuauuuauuuauuuuaugcauaugaguacaccagaagagggcaccagaccccauuacagaugguugugagccaccaugugguugcugggaauugaacucaggaccucuggaagagcagucagugcucuuaaccacugagccaucucuccagcccugcuguucucuuuaguacaauauuuaauaggcaacuuucuguuaucacagguagaacuaauauacagcauagcccaagcugauuacauagccuaagcugacuaacucuuuaaaaugaagagguggggcugggaagguugcuuggugguuaacagcacuaagcuauucuuucagaggacauuaguuugauuuccagcauccauauggugguucacaaccuucuguaauuccaguuuuagggaucugaccucugagagcaccagacaugcaagugguacagacauacacgcaggcaaaauaccuauguacauaaaaugaaucaaaucaaaucaaaacauuguagugguaauaccauuuugauccaaacuucaaaaaugacuuagccagauguacuaguauauaccuguaaucucaguacuugggaggcugagacaggagaauaacaaguucaaggucagcccaggaaacguagugagacccugucucaaaaaaaaaaaaaaaaaaaaaaaggggagcagaggcucagggaaggcugaggcugaguagacuugguuagcauauuaacaaacaaaagagaguuaaccauguagcugcacugaugagcccauuucuaugggaaauggcaguucuggauaaggauaguuaugggcacucagggauucccauggcuugaauguuuguucucagggguuugcugagugaccgguccauggaaucaauugugugcaugucauuucuagguucuggguucccaaaacuuucauagaggacuguugccaaacccuaacacccuguguuggcaugagcgagcaauucagugcccaugucugucaacugcucagaauuaaaguccugagcauuggcgaguggguuccuaugauaacuaccaccuuccauaugaacuucugggagccugagcccaauggccaguaaguaacuucaaugcuaugacuaucuuuaggaaaaugucuaagacuugcugccagcugggcuucuauugcucuggagccuccucaucugucacuuccucaugugauaccaagcauggccaccugaguggccuaauuacugucccccaagucacucugcugggcaaagcuuuuacucuguugugcaagaugguugcccuuauaggucccacaaagcccagcauagacaaguccaauucugggccaggauuuccccccaggaugguucuuaguuccucagaaugcucucaaugccugccucuaugaucuuccaucagugggauguggguuacugcucauguucagaggguuuuauccuguccucacacacucuggaaaggacuggcuugcugggaacuagaaacuaaaagaaacaaugagaacccuggcuuguagacuuuucuaagcagacaguguuugcuuaugaucaaauuccaacuaacugggaggaaucaguacagacuccagccaauguguugguggcaggggacuggucugcugagucacaguugccccacacccagagcuguuuguucuuguucucuuugggauuaacaagacauagaaccugcucuccuuguuuuggcucagccugcaacugacagucugccuggcuucaagucacccaagggaggugagguaggacuaaggacagugggggugggagguagccauucuucucagggaugggaucacccugucuuuccuguuggcuucaugacucucacuaaacuccucugaaguaaggaacaugagaagaacuaaaaucuaaacuuaacaugugugggaguaggggcaauuagagagacggcuggaagucucucaucuuugcuacccccucauauugcccaaguaccauggcgggggaaggaucuaccuaaggauauguggugaauuaggagaauuaagacaugauuaagaucucuagccacagauaucuggccagauaaaggcaaagagacccugaguaccacuuggucuauaguuagcugagguuuggguucuuguuuuuugaagucaaaucauacccagccuuuuguuugggagaaauucgagugaaggccuugcaggagugaggcacucaguucccaagaguuguuggggaugagggacccaccuagcuuuccaagacacaguucuagacugugaagacugcgacugagggucggcuauuuuccaggcacugaaugagauauagggagauacgagguaggucucggcuaaaaaucuaacaaaaggccuccuucuuacacccuggcacucugugagucaccaggcuuuugggagaaugccaaggucaucaugacacagcaagaaucuuaccagcucaagggagaagucagcucagaaaugacccaaguagagggaugggcugggacugccaggucacuccucacacaguccugucagcaggauggaccuugagugcucacugaaucuaugggugucacauaggcuagguaaggaaucagaugucuagagagaugggcccauagugagcuuaucugcccauguggacucccagaccuacuccauuucuucugcauaggagaaagacucacucacucucuaguuucaccaagguccuauuggcugggggagaugcccuucuaggcucaguuccuucccugcacugguccauaaggagugggacaguaaggauuucuguucacuuucuuguuggggugggaguucugagaagaggaauggcuacagugaggcacauugagaauguccccaccaaggaagcuggguacauguguaaggacuggguaaggaccuggggaggaagaaggggcagaggauggcuacuuaggaucaacuugcccuaguuuguuccaguuuccuaggcuugaggccugccagccacuagcuuccuuuuaguuucuaggucacauugagcuuguuccaaacuuagagggcaguugcccuuauccucaacuugccuugcucuuuagguccucuugggaccuguguguugcaggggccuuaguacacaagaauccauuugugacuucuguuacaugcagcuccccaaaguacacuguccccacaaggaggauaggaacugagacuauuauguaaugggagacacuugauugcuacguuuaaugaauggagaacuugcagguguccuagaucagauagcaccugcauuuagugaaguaucaggcaggagcuacucuaggggcuaagcauagggucugucugucucucucucucaggaccucugagaggaacagaaagaaacaaugaugcuuuuuagaaaaucucuuucuuccccacucccuuuugcuggaacuaauaguuccuauuucuacucuggaagcccggguucuuacucccagagcagaggagagcaaaggggaaccaaacugauugcagugaaaggaaguugcucaacuugaggcuagaauucacauaauuagccuaggauaaagccagaaaagcugccugguuuuuguuuguuagaugaaaaacaccaggguucagagaaauguagacauuuguuccaggucacauaauaagcuaucaacaagguaucuaagaguucauguccuacaguuaaaaaugaucuucgaugacuggguuauuguugcugcaugcuuaugaaagcauggguggggcaggggaaauaaucuucaguuacuuucucuuccauuuggcccuuuagacugaaagcagagucccacaugcuaagguuuguggcagauacaugcauagcuccuuuaaggggacuaggcuagagacagggcugaggguagggcugcuguauuguguguuccgacuaaguaccucccuuaggucuuagagcuacaaggagccaggggacagugcuuugguuugucugucccuuccccuuucaguggcagggcccuucuccucagcuuguuucugcauuccuuuucgaaguucugccacucccauuuuugcucagaaauauaaggcagacaacaaacaagucuggcaaaggggguggcauguucugauguccauuuuuuggauaguacugcgauugaaccuagggccucaugcauaugagguuagggcuuuaccacugaccuacagcuguagcccuuggugcauggcaaugcucugugugaacaaaaaaccacagagcuccuccagcauugagggguccaggguggaaggugcugagccaguggcuacccuuucaagaacacacuaguucugaugaaguucuuguccaagauuacacaauaaguuaauagugaagauggucacacgagggugagcugauuccaggauuaaaagcaagcaauugaguuuaccuuugccaucgaacacuggccacugaacgugcccugcugccacauagcacauaagggggugauuuggucuaagccaugacuuuacuaagcccccaccugcuccagucucacuguguacugucaauacaacaccccucugacugcuucuguucuucaguuuuuccuaacagagcugggacuaggugggaugaacagaaauuugcaguaggcuuuggaagauauggcaaagaggagguguuuaucccuagggaacuucaugccguagaaagaaaagagggagaggcaggaccucagauucuuccacugaaauuaacaguaauauuuuucaaauuacagauucauuaaaaucagaauuuucccugauugcacaucaguuuuuuuuuuucauccaggaggaagaagugcuacuggguggugcuuuagcaccugugaugguccaagucuggucuccacucaauggcucagcacagaguucugagaugugacacaaguacauguauaucagguacugcugugaugaucaggacacacagguggaguauaugccauagaguucaaccuaguagaacuuguggguaccucagcaguuccgucaauugggaaaguugagauagagagagagaagugccuugcacaaggcuauauuucaucuuuuagacucggggccugaagggagacucaccgaugcacccaugaugauaaauauguguguaucagcuugguggaaggcaucacccugguacaacucuucccucaggaucccacacaccuggguccggcucagggccaccugcucugccaugauguuuucugguggaagaaaagacucauugauaugguaggagaacgaaagagcauugacaacuuaaccuuauccaagggucuuuuggguucucaccaggcuggugacgauuacuaaaaccacuggccgggaaugcucuguguguguguguguguguacgcgcgcgcgcgcgcgcgcgcgcgagcauacaugcauucggagauucagaaacugcugccucugagcuccagccauaaccuccaaaguugccuucgcuaggggcuguacauuacgaaaguacuaaagcuuuaauauaauucaccuaggacauccacugugggcagcuagauaaaaucugguuacggcaucacacucuguauaugggaccaucguaucguacucgggugucugccagaaacuccacaaugaacugagcacguuugauugugcagaugauggaguucagcuccggcucucuucuggcccaguugggugauccccgaaagucccuucucuucuaaaggucuaguccucaugggcccaaugcggggaaagugcgggauacaaagggauggguuaaaaacuuguagauuagcgcgcaucaaagggacucgcggcguacaagcgugaagcaugucccuccaccgacaugccaucagaccaccccuuuaccugaguuuaguugccgcugccaaacacguucacagaucuguagcgcacagccaguuuccgggggcuaagcuucgcuggcccauuuaacgcaagagggcgugugcuuugacugagcugacccgccucaggagaggcaggaggggaggagcuucgggcuagucuaucauugcaggaggagaugcgcgcgcaucccuggccagccccgcccuuuggccuuccccgaugccgcugccccuacaauuucgagaucgcaaagucuugucauaagugcagcuccacacaguucuccuggguccccgucuccugugucacccagccauuauguauggccuagcuuuccgcuggaccuucgaggcccugcaccuucccggaugaccccacuuccguuagcagcauagccacgccuucccuagcugcuaguuuggcuucggagcuggacuuucgcagcuuccucuaggcuuuuuccuuggugggggcccagcggcagagagcccaguagcaggaccagacugaaacuuggguguuuuagugcggaugcggugccuugaaaaugggguaggggcgagugugggcguggugacgcacuacuuuaauccuagcagacgggaaaaaagaggcagguagaucucugaguucgagacccuggucuuaugggacccugucucaaaaaaaaaguguguguauaagugugugauguuuaucagugaggagagcucugguguucugcuggccgacgcaggcuggcgaucuaagacuuuucuuuggaacagaguauggcacuuugggguuuugauucacugguuaaucuccaagccuuugagucuguguuuuacuuccggaucccgcacuuacgacaccggaagccggaaguggaguuuuccacugcagagaagggaagggugaccgccugacuaggacuuucuaggagcuccgguucugucggagcggucggaucccucugcuccugcccucuucacuucuggccgacucugcugacaggugugguccucuucuccaaagacagggcuccaucgguggcuguuucguagcuuccgagacuccagagguccacacccuuccccccaccuuaggcccaguuuguucugccgcaagcuucuaauuauucgcuacccagauuauuuaggcuagucggauugaaucugcccuucccuucacugcagcugucgccuaagggcuuggccccuagugcuagaacucuuuagguagcagacauuuucuguugaucaaacuguuucugaaacacguuuugcacuguaggccagguagaccucgaacucaaaguucugccucagccuuucgagugcuagagcaacagguguucgccaucaggcuaggcuguuuaucaaacuugagugcauuugaagucuuuaaaaaguuuucacguguaccuucacaacuaaaggucuuaccuucugcaccucaguuuacuuugcaaaugauucauaguaaucuguuugccuguccucauaacauuuaucugaccugagaaggaauguguugucuuggcauuuccuaggaaaaaggaaggaccagagagggcaagggagaauaguugguggagaggaaggaagggaguauaggugguauaggaucuuguaggcuguuguauggacuuugcuuuuuaacacuaggagaaauggaaacucugaaagaguucaugguagagaagagaaguaguuugaguuauuuuugagguaauuggccccaguggggccaauuaacugcaaagggccauugaaaaggcaaagcauggugacccguaaagagauuauugcaguaaugcaggugaaagaugauagcgcugucagccuugaauuacugaaaaaauuuaaaauguacaaaaguagaaauaauaauauaguaaauuccauguacacauuucuuagcugugacuaucagcucauaguuaacuuuaauccacaccccauuacaauccuuuaccaugauuauuuucuuuucuacagaagauguuauuuuauguguauaggugcuuugcuaugcuuuccuagugcccaagggagucagaagaagguuucagauccccuuggauuggaguuacagauguuugugagccacaucugcaacaacaagugcucuuaaucccugaaccauuaucucucuugcuccacccauugcgauuuucaauaacagcuuucuugagacauaauuggcaugcuacaaaaauuacuauuugugugugugccccccacaugcaugcaugauguaugauuuguacagggagcacaggugccauggcuagaauguguagagcucagaggacaacauugagucagcuaucuucuuuccaccuuuauauguucucaugucuccaggcuugcauagcaagggccuuuauccacugagcugucucccuugcccauacuucaauauuuuuuuaaacagucucuucuagaucccuucccuuugaguuucuaauccccuggagcuggaguuacaaaagguugugaguugcccaacaugggugcugggaacugaacuugggcucucuggaagagcacugagugcuccuaauagcugagacaucucuccaacuucuuuuaagacuucuagacauccaaguaguuuuauaaauaucuggaauuuaggaaugagaacuguuugggauauuaucaacauuaagauuuggguuaaaagccaugagaccggauggaauuacugcaggggugaaugcaguuaagaaagaagucccaaaguuccucaacgugaagaaguggggacucaggaaaagggccugagcagcaucagccuuugagggagugagucaccagcagagaaggcuuuucuggaaccugaaggaagaaaguaggugaaaaaguggggagggucaguugugugggcucaggcagauggaccuauggguagcaacaccuuuaguauaaauagccaauauuccccaguguuacaggaggucucccuuauugaaagcccacuucuggaaacuugcauugagaucauucucuuccugguugucaguaugaggcaggauuuacaaggucuccagguuaguauuguccugcauauucucugguuuaaaagccagcauaagcagaucaggggucaugugucucggacaccccaguucacacuuucacacuucuuagagcaaagaagucacaagaggucucuauccccagugaacacuuuucagguacaauguggucuccugaagucucuuuuaucauguguuuguguuuucuugacuccuguaagaagugaccacaggccaaguggcuuaaaagaacagaaaauugauaucucacaggucuggaggccaggagaauaaaaccagaaggugaacaagguuaugcuucaucugcaagcuguacaagaguauccuucaugugucuuauaguuguggguagcucaguuguuucuuggccugugguuauaucaaucuaguugaguaauaagguacuuguuacugggcucauggcccaccuauauaacuugcagugaucucaauuugagagccuugauuuuugugagacagguucuuacuauguagagcaagcuggccuugaauucgcagagauugugccuucuaagugcugggauuaaagacaugcaccacuaugccuggcuugaaauccuuaguuuaacuacaucuguaaagaccauuuuuuccaaguaaaaaaaaaucacauuuauagguugagggauuaggacauggauauaucaaucauuccacuauacugggugagggaccaggacccuuugcuucaacuuaaagguguguggaggagguaggauucccaguuuacuuccccucuccuccacaauucucucucuuugcaaugguaauauuugcuaugucuuagcccaaacuucacuuuuguaucuuguuccaccagacaaaauguccauccuuuugcugugaauggaagucuaguugaacgaacucuguucuuugucaugcacuccuacuacccuuuucuucuagacacuguccuguuggaugaacaagcaccccuggaagaaccagcugagugagauggugcagcccagugguggcccagcagaggaccaggacaugcugggugaagaaucuucucuggggaagccugcaaugcuacaucugccuucagagcaggguacuccugagacccuccagcgcugccuggaagagaaucaagagcuccgagguaaagauugaugugugagggagguaugaaguuaaaagucaggaggagccugggauacuuauauaaggacaaagcuuauugucaccugcaucuuguaauuggcaggauaugaggucaugaugugcccaagaaccauccagaguuucaaacuuagcuaccuugcuuuguuuuaaguaggguucucugugaagagucacaugcagaagauaaugugguucaaagccagcaccagggaagggagaagggauggggaaggaggauaagcuaaaaagccaugguagguaggggaagagugggcuauaggaagcaaugagaauagguuuauucuuucuugggacauagcaagcuuuuaggugggaggggauaugguuuuccuucagagagagagagggguuuuuucuaagaugaaauguguccuauucuuggaaggguauggccagcucuggugagaggagaucuuugaguaugucuucugcacuggcacugccuucuuucucaugccacccucauuuguaagguggauguuuacuguucuucaauaugcagccgaagagaaugaaacucagaacuacuagcuuguucugucugcaccuucugggcaaaaagaaaguugauuuugguguauuccuuuaagugaagaaucucuguuuaguaacgcauucuagacacuugggggcauaucaucaguggaacuggcuaggaauugguuugacuucuuagagaaaggccacuuaguauuauaggagugccuggcuguuaggacuccuaucuccuuugcugucuucccugucccuagacgcuauccggcagagcaaucagaugcugagggaacgcugugaggagcugcugcauuuccaggucagccagcgggaggagaaggaguuccuuaugugcaaauuccaggaagcccggaagcugguggagagacugagcuuggagaagcuugaucuucggagucagagggaacaggccuuaaaggaguuggagcaacugaagaaaugccaacagguagcuagcuaguggacgggcaggcccuucugccccaccuguguuugaagaccauagcagcacucauauuccuguaggaaguauguuguuggaguuuccucaggaccuuuucaggcuugauugcugggagcacucuuagaaccaagagaagccaucacacuaacuguuaguuuauuacaguaaaaggcucuacaucagaaucuuccaagguacaaggcauauaugguaggagccaggagaggccagaugugagcgucucagggagcagugcuuuugcugugaacgguggugcacuguauauagagcauugucaaccaggaagcaguccugagcucugggagccaggcuuuguccugggcucaggcuuuguccugggcucacuuuugaaggcauggagugcuuggguaccugagcuagcuugcucagguucuagccacccugaggucuagcaggugcuauaccauguaguccaaggcccucacauacccuggcaucagcccagacagccugguugaguccuaggccccugaaaaaacaaggcagucacaucagguaggauuucccagggggcucagagaugauccuuaggagccuuuggaggaauuaugagacccuaggccugugaauuggcccuguauuacacaagcaccaaaggaugguaugccuaguguggaaugaaaggguauuacagggccuuuuugggcuggcugguuucaggacccuggugacaauaguugagcagggauuguaccaucugagaggaccagucugggggaaaggguagagaagaccugccauaaucaaguuuuauauugugggacuaaguucauaaugaugcagagagugccuugucaaagcauuucauucuuaucuggggagacagcagcaagguaccacacagcaggggcuuagauaacagaggauugucucuaguugagaucagaggucuaagauaaagguaugggcaggcagguucuucagagagcucuuucagguacuucuccaaguauauuguuaguguuggcaagccuuggugcucccuaacucucuugucacauggccuuuucucuucagaaaguuuuguuauauuuuauuuuggguagugugugugucugugcuugcacucacacauguggauguguguauugccaugggguucacauguaggugacaggacaacuugcaggagucgguucucuccuucuaccaugugagucccaggcacugaacacaggauguuagccuuuauggcaggcaccuuucccacguggaccugcuaaauugucucacaguccuuucuuuuuauuuuuuuauuuuauuuuuaggcauuuuuauuagauauuuucuucauuuacauuucaaaugcuauccccagagcccccuauacccucccccugccuugcuccccaacccacccacuaguccuuucuuuuuauaaggauaacgaugugaugugaaacauaaagguagacaguuauuagagcuacgagaauagaauuuguucaguaacugaugacaaugagagagaaagagcuaacugagcucuggugauuugcagaggugauuguguauuuuaccuuuuucuuuuuuuuuucaagacaggguuucucuguguagcucuggcuguccuggaacucacucuguagaccaggcuggccucaaacucagaaaucugccugccucugccucccaagugcugggauuaaaggcgugcaccaccacugccuggcuuaccuuuuuuuaagauuuauuuuuaccuauguguuugggugucugugucuguguauaaguguccuugaaggccagaagagagucucagaucuucucaaacuggaauuccugguaacuauagacaguugugguggaaggaacuaaacucucuggucuucuaaagaguagcaaguacucuuaacuacugagcaaugucucuacgcaaugacugggaauuucaaaaugagaauaggggccagaguguggcucaguaauaaaguguaugcuuugcuugugugaggccuagaguuuaguuuccaggacuucaaaaaauaagauaaagacagagguacagauagaaggaaaugaaagauuuggauaggggaaggagcucaagugaaugccaaaggguauuagugucaauaugauaagaccaguguguuuacaagcuuauacaaaucaaauguagguuuuuguacuugaagaccgggagucuggguucuuucugauaauuccauuuaagagaaguagcacucagguuuuugagacaggguuagggucaaaggaaauacaugggcuuugaggugauagagaaaggaaucauggcaaagguuaggccuaugucaagugucaguuucuuuaacagcucugagcauuugcaaguaggaacuaggaaggggcuugguacauuacacaaaugugaucuuaagcuguuagaaggcaugcuagagcuagagagaugacucagagguucagagcacugacuguucuucuagagguccugaguucaauucccagcaacgacaugguggcucacaaccaucuguaaugggauccgaugcccucuucugguauguuugaggagagcugcauauacauaaaauaaauaaaucuuuaaaaagaaggcaugcuaaaguuugguuaaccuuaaaguuugucugagcugagcaugguuuguacucaggacagcuugugauaguugguuucuuuucuuccaucauauggguuuugaaacucaaacucuggucaucagccuugguggugaguaccuuuuaucugaugagccuucuugaugguucagcucucaguauuuaaaaaauuccagucuccucucuuauucugaaacuucucaccuguuguauaauguggacuagguguuaauuuuuguugcugucuuugagucuagccuccuuuuacagagucucaaaagagacugagaaagguucacuaccacuugagagucaagguuggugacuggaggaaggcaaauagccauugggcuaaugaggcuucaaaguaccaagguuuauaggucuugagaggcaggagaagcccuccauauaucagcugcuugaaggcugccuuaggucuuagaagugccaaaagugggaagcuugggagaaagcaguacugauagggaaugaccuuuuuucuuguagcagauggcugaggacaaggccucugugaaagcucaggugacaucauugcucggagaacuccaggagagccagagccguuuggaggcugccaccaaggaucggcaagcuuuagagggaaggugaguggggaggggaagcuaacccaggaggccccuuccaggguuuuuaaugagacaaauguaggaguucuaggaauuccucucucugaaaggaaggaccgagucuuuuuagauuccccagagcccucagggcuuccuugugagaagccuggucugguauucagggauuuaguucuagcuguugcuggaaagacucugagucuguacugggugcuuaguuagggcuuccguugcuguggaaagauagcacgacaaugacaacuuuuauaaggaaaacauucuaucuggcuuacauucagagguuuaguccauuauugucaugguagcaagcaugaugguaagcagacagacaugaugcuggacaggugucugaaaguucuucaucgggauuggcaggcagcaggaagagagaguaaaccagugagccuagcuugagcaucugaaaccucaaaguccauccccagugauccgcuucuuuuaacaaggccacaccuacucuuaacaaggccacuuauccuaauccuuuuaaauaauuccacucucuagaauccuacgggggccauuuucacucaaaacaucauacugggaucuagcuuauucuuuaggaagcacugcagggccccugagaccacacucaagagcucacuauccagacugauaugcagugggauucuaccaaggcagaaaguccuaggugaacaagacuggauacauuccacagcaacccugugaauagcacagagcccucaugaacuacuucucauuaaagacuauggauuccauguuucuguugggaguuguucacguugguauccucugccaggcauguaccaguauuucugaauucuggcagaaaagugaguuugacugacuuugucaacuaauggucuugggacugucacucacucucuuuugccaaggggguuagguugccacaugagaucauuuaguuacaggcauggguacuguugugccucucauacugccuugcugcuguccuccauauaguuagugaagcuaacaggccuucucagugcaauagguaguuauuguguuuguggaguaguggguuggggcuccuguccugugggagggaggagaguuugacuugggcucagagagcacuggugguggguugguggggggagggcagugugagaaaaagccaaaggggagcaggcccaguaguccagaucugccuugucaaaguugggaugaucugcugucaguggcuuccucaaagacacauggaaauguccaucauugucuuuguaaugagcacacagggagguaccaggguguugaggcuaacaccggaacuagaguuuaagggaaacugugggguacuguaggccaggaucagaagauaugggugauagagguaagacaccaugagcuuuuacagugaggguauagaggcagagaugaauucucugcugagacuauugaugcuauaucuugucccauggggcuguacaaccuagguauggaaccugagccucuagugagggugccugggacuagagcuaaacugugaguugcacaguaguuccugccuauccuugaguccagugcuaaugagcucacagccuucucaggguguucuuuuuuuguugcaugucaggauucgagcaguuagugagcaggucagacagcuggagagugagcgggaggugcuacagcagcagcacagcguccagguggaccagcugcguaugcagaaccagagcguggaggcugccuugcgaauggagcggcaggcugcuucagaggagaaguaagugccugggaggguugguaccaagagaucucagaguguggaggcugccuugcgaauggagcgacaggcugcuucagagaaguaagugccugggaggcuugguaccaagagaucucacagcacccguggugcuuucugccuuuuagggagcccugauagggacugauuguguauaaaagggcugauuuuucuccuuuugccuugcuaaugacagagucaacuauuauauguaaacaggaauauuuucuacccauauucauguucacuacauguccuacauagguucuuuucaucacaguuaaaauauacucuugguguaaggaaagcaaagagccauggugccuucaagcugguccuaaacacuccuuaucugggcucacaaugccuguacaggcucucaaccugcuauugguaucugguucagcauccuuuugaguuuucuuuaauuuagaacagucucccugccucuacauuuauuuucuuuuuggugcuagagauggaggguagggccucaaacacacuaggcaacaguucuauuccugaguuguacccuagcccuuguuagaaacauuccaagauguuggcuuuaaggaaaacaugaacuauguagcagccaaauuauuugcagugaauccuugcagucaacaaagcuugccuuagagcugauagccucaggagcccagauguaauccaggaagcccaaauuucaggucucuuaugggacaagaaggaagaagguaaaguugucuuaggcaaguuguggcucuacugggacaaagcaguuucuccagugacagcuccuuuuugcacaggcggaagcuggcucaguugcaggcagccuaucaccagcucuuccaagacuacgacagccacauuaagagcagcaaggugagugcaaaacauaagcuaggaaguaugucuucccuggguuguucagggagagguuuuuccuucuuccccaguguaccugagggggagcagugugaccuuugagaaauagcauaucugacuuuuggaagggacucucaaguuaccugacaccuucaguggggcuguaacuaugacaguuuuuggaugaccacaaagaaaugggacauagccacaggacaucucuaggguaucugggucuaggaacuucacauauggucuguggcagagauguuguucugcauggccauuccuucaugcucagaguugggaagucuacaacauuucuuuuuuuucuaaaaacauuuuuauauuuauuuauauauauguaaaaaguuuuugccuacauauauguauguguacuaugugugugcuugauacacuggaagauagaaaagagugauggaucugcuggaacuggaguuaugaaugguugugagcugccugugacugaauuuggguccucuccaagaacaaguguucuuaacugcugagccauccuuccagcuucucuuuaccucccccagaaacaguucugaggugacucugaucucucuuugaguuuauccucauuaggucuagugauuacuuuguaugugugucuacucacaaacauauguggaagucagaggacaucauugguguuacuccuuaggagcuauacaugaccagcucuuuuucuuucauagauucugaggcuugaauucagguccucacaagugcuuuacugacugaacuaccucccuagccuauucuuuuucaguagagcccaggccagccuugaacccuuagguggcugagacuagccuugaacuccugauccuuuugccuccaucuuccaugugcugagauuacagguguugugcuaccaugaccagcauucuaguggucacauuuuucucacaauaaaguuuauuagcuguucucuuucucauaaauagaaucgauuuucaauaauuuuuuacaaccuauuacucauauaaagaaacucuaacaagguugccaaaagcccacauauuggugguguugggcaugguaguguauaucuuuaauccuagcacucuggagucagaggcaggccaaucuuggugaguucauccuagucuacagagugaguucuaggauagccagcuuuacauagucucaaagacaaaacccaaaaccccccagaccaaaccaaaccaacaacaaaaaaccaaccccccaaaacaaaaauacuccacuaucgaauaaacaacuccagagaguaaugggaagccaacugauauuaacagacuagacgaaaugauuucuaaaggcauuucugccucucacuaaaauuuuaaaaaauuguuuacaauaaagaacucuagaacagugcaguuacucaagaugaaguauccaaagauggauucacaaaaaugggaauuuaucuguuuuucaauuaauaaaauaaauagaacuagaagaaauggcagagaagcaaaaucaaaucccaugauauguguguuuguauauguauguguauaaaacugcaagaaguaauucucaaaguugcagaguuuaaacaaaauauauuuauuuauuuuuugggguggggguugggcuuuuugagacagaauuucucuguguaguccuggcuguccuggaacucacucuguagaccagguuggccuugaacucagaaaucugccugccucugccucccaagugcuaggauuaaaggugugugccaccacugccuggcuaaaauuuuuuuuuaauuuuuuuauuagguauuuucuucauuuacauuuucaaugcuaucccaaaagucccccuauaccuuccccccuggcuaaaauuuuauauuuuauguauuuauuuuauuauagcgaaauaggcaguuaauuugggguaagauagucauuaaaauuugaucucucccuaaauguacauuuaaaauuuuaggcuaagaacuggauguuuccaugcaauagugauuacuacauuuccauauaaacaucaucugcaguuacgacuaugaauuuuuuuccuucuguguaaagaugagcugcucuagcaccuaaauauggccuuaauuuagaaaguguaugaacaacuuuugaaagacuauagugugguacaaauagauuaaaaauacuugaacacuauuauuucuagcaaauacauuaagggagggcucaaacaaucaaaacaugaagaccucuaugcacauaaaaaucccucaugaaaugaguuaacucauauuaauuuaaaaauaaaaccuauguuuucuuauuugucuaaaauuuaaauaauaauggaagucaauuaaaaaaaaaacacuugaaagcuaacacagauuaugcaguuacucaaaguuagugguuacauuuuaaggaggacauugucaagcauaaugcacccauaggugcaugauacuagaucacaugacaaagaauugguuauaaaaugcugcuuaaggaacaggaaagauuuuucagugacuaagaccacuugcuauuuuuuuccccccagaggaccucauuuuuuuuuuguuguuguuuuuuuuguuuuuugagacaggguuucucuguguagcccuggcuguccuggaacucacuguauagaccagguuggccuugaacucagagauccgccugccucugccucccaagugcugggauuaaaggcacgcgccaccacccggcuaggaccuaaguuuuguuuucaguacucacauuggguggcuaacagcuaccugcaacuccagcuuuggcagauaugacaguaucucugacuucuguggguacccacacacauaugguguacauguguauacacacacacacacacacacauacguauguaaauuaagaaaaucuuuuaaaaaauggcuguuuaaucuuuuggaaggaauucuuggcugagagcaugugugcauguguauaagauguguuugaccaaguggcagagucgaaggacacauagaaugcagcuuugccuccagucuauggagaggcagugcauaguacuggcuugccucaggagggaugguggcucuuguccuugaagagucaaguggauggcuggcuagcuaggaauucucugaagggaaugaugcagaguacgaggcaguaccuuauauauccucagaguuccuaucaguccuaagaucuuugugcauccuaagggccuuagcauuucuucuguacuguagggcuaccacaggaugcaguauucucccugcacacauggucauuggcuccaaaauccaaaggacugacuuuguuccagcuuuuccuacuuagucucaaacaauggccagccagggagguagcuuggccccacugugggccaaaagacucugacagcacccuuuguccuucucuagggcaugcagcuggaagaucugaggcaacagcuccagcaagcugaggaggcccugguagccaaacaggaauugauugauaagcugaaagaggaggcugagcagcacaagauugugauggagacugugccagucuugaaggcccaggugagggcucuguuccagccugccuaccacaugaaugaccugcccauccaggcagugggguucuguguaccuuuuuacagcauuuuguaguggcuucucuauucuugagcccuuugcauucuuccuugacuucuuggugcucuugggaucauaggcuuucauaucuguuucugauguacuauuauaggguccuaggccagggcucuguuccuuugggcauggcauagaaugcuugaugggaagcugauggaugguggguguucaccucuguucuauuugccaggcggauaucuacaaggcugacuuccaagcugagaggcaugcccgggagaagcugguggagaagaaggaguauuugcaggagcagcuggagcagcugcagcgcgaguucaacaagcugaaaguuggcugccaugagucagccaggugggccuguaagagugcagccaggagcacagccauagacagagaagguguauacuaggcagcaaccaguaguaacuucaggagauugauggcucuuagcauugguguuaaguucucugugccuccuacugcucccuuguguuuggccuuccaacaaagaccuuucccauugguccagcuagaaacugaacagaaaugcauguauugagauguaucuaaggccggagguuucauagcuuucauaguguuuuuuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuucgagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggaucccuggauaugcuagugucuacaugguccauccuuuuaucucagcuccaaacuuugucucuguaacuccuuccaaggguguuuuguucccacuucuaaggaggggcauaguguucacacuucagucuucauuuuucuugaguuucauguguuuaggaaauuguaucuuauaucuuggguaucuuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuauauccaguuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucagguuuguuuugauuugcauuucccugaugauuaaggauguugagcauuuuuucaggugcuucucugccauuugguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagagcaagccauugcuguucuguucaggaauuuuuccccuguacccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcccuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuuugauggggauugcauugaaucuguagauugcucauaguguuuuaguuugguuucuguugcugugauagagaccaugacuuauagcaacuggggaggaaagggauuauuuuagcuuauaauuuauaauccaugacagaggcagagcaggcaccuggaggcagaacgugaaguauagucaaaaggggaaugcugcuuucuggcuuguccagcuugcuugcuugcuuauacaaccuaggcccaccugcccagggguggcaccaccuaccauagguugggccaucccacagcaauuauuaauugaagauaugccuuacaaacuugccacagcuucugcucuccauggugguugucccauguuacuggcauccaauaugcuaggguuuccacugcagcugagggugcaccuucuccugaccucugaaauagugccaagcccuuucuuuagcugcuuuccaugaugccuucauauuacuugguccccucuccugugugcugauccugaggagauacucucuagauuuuaaaagauuucaccucagugauacuguuuucuucuuaaucacagcuaauuucucagcuucaguuaaccagcauuaguuguccucccucguaaagcaaagguuuuacuugaguucugcugaucucuuguucaucgcaccugauucuucagccucagcugacuucaacugcagauucuuaauucaaaauaccacacaaaugacgcugauagaaucuuugcuucccucugaaacuucauuugcuuuggugucagcauucuuaucuuccuuggcucccacagagcagcccguuaagcucuaaccacuugauggauaggaacuugagauaggaacugaagucaaaaccuuggaagaacgacuuuuuggcuugcuugcuuuugcaaccuaagugauugcuugagguguggcacugucucuagggaacuaggucuucucuuaucaaugaagaaaaugccccaaaggcuugccuauaggccagucuaauauacucaguugaguaaauaucagaugacuuugaucagaugaauccagcuuuugucaaaaugacaaacaacaacaacaaaaaccuaaccagugcaaauguaucuaucuaaaaacucaaaauaugacuuuauuugguuuaguaucuuuauauauguaacuaguuaauauaaggucacauuagguuaauuaguugacugugguacuuacagaagcaccaaauuaagauaauagaaggcugccacaagaaggcuaaggcagacucugagauucagcuacaagccaagaaaugccaaacacuuuguaaaccacuggcagcuagggggugggcaugguaauucugcccaguccucugacacguuuauuuggggcacuuagucaucuguaucaugcacguuuuuguuauucuaaguuacuaaguaugugguaguuuguaacaagguucugaggaaacuaauauaggggaacccaaggaauaauuccuaauaaguacaaaguuuccuuugggggaugauaaaauauucuaaaauuaggcugaugauuggauaugcugaauagaguaaaacccucuaacaauacgguuuaaauuggggacuuauauaguacaugaauuauaucuaaaugaauguauuuauucauaaaaaacccuauaagcauugauugaaugcuuucuguuuucaaaaggauugaggauaugaggaagcggcauguagagacuccccagccuccuuuacucccugcuccagguaagugaacaagugguagaugaugggaggagaugcuuagggaggggaaacauguguugguuucucugcugcucugcuuuggggaguucuugcugaccucuccugucaguagcccacaucacucugaggucaaaggaaaaaugugcugguggagguggcucccagcaauguagucaaauauggugguaucaguaagucucagcaccuuguuagccccccuuuccauuugaggccuaccuaggcugugcaugaaguacuuacauaguucaucacacuccuguguucuuuuuucucagcucaccacuccuuucauuuggccuuguccaaccagcggaggagcccuccugaagaaccuccugacuucuguuguccgaagugccaguaucaggcuccugauauggacacucuacagauacaugucauggagugcauagaguaggagcagcagaugcaaggccacuugcaguacuauguccugaucugugugacuugugcuuuccuguuuuaccugcauaguccacacuuaagggcuugcuuuagcccuuuggucccccauuuaggguagacagccccauucagggcuuuuuuuuuucugugugccugauccaguuugccucugguggcuucuucccucuucucccauaguccuagggagucuagaauggaggccaggggcucuuagggagcaucccuucuccaagcaggucuggguacagcuuuucuucucuccaacugguaccuuucuugccggugaacugcaggcucuccucccagggcauguggcacuugggucuauaacauguguuaccucugguagacauguggaaaguauucuguccuuuuguuacuguaauuaaugguguagugaaaguacuuguacacugaucuguguguaccuuuaggacagaugcuuagaugugacauuggauccuugcccuggaggaggugggcagaccuuuggauuuuugccaucucuaagauauaccauucuuuacuaaagaauuugcuuaagugucuuuuucuggggcaugugggcccuuuuuaauuccucugauguaacuuggauuuucauaauuccuacccauuuuucuguugggacauugccauuuguucuugggcuuuguagagcuuuuugauuaucagucagguugguuuugacuauuacagaagugcaccccuuguuccacauugauuguuaguguuuuggggccuagaagcuguuuuauacuccuacuuacccauucuuuacuccuaguuuuuugacuuuggaauuaugacugcuuugucaacagaaagguauuucacauguaugcuuuccuuuuucuagccccagugugcucuuguuuuugccaagcacauuguuaccuucugugaauggugguggccauaguucaucacacuccuggaguuugugaucacauguucuucaccagccaaaauguccuagggaaccauuuagcagugacugacugaucacagaaaagggaacacuucacuuguuuugcaagguucuagacauuuugugggaccuuaccgucauugguauuagaccugcaguucuaguaaaggaaaggaaguuguaguugagaaagcaauaaauaugccuugcucauuccuuaggucuaaauccuuccugcccuccuguaagcuuucaugguucugagugguaucugugaauccaucccgggggcuuuuauuuacaugguuucuuucccauuaagagugagaaggcuaaguagaauucagauuauaaaaaaggauuuaaaaaguaauccugagcugggggcuuucucggaauuuucaggggaugcagaguaaguuuuccauuuccuaauucccagguaucuaucagaaagaucuuuaggaaaauguuaaaggaacaaacaaguucuuugcuuauguguuuucauuuaaauaccuaaucuauaauuuuccuuuaggaauacuauugguuuagguugaguccaguuuuguggugguauauaucacuuuucuauagcugcuuuaaaauuuuuccuaaacuuggaagagcaagaacaacaacaacaacaacaacaacaacaaaucacucuuuccugucuggaagccacauauuaaguuuuuucuggaggcugugagaaucaauuccaggcauucucuuaacuuucagugguuugugguaguccuugguguugcuuggcucauagacccaucacuccaguuucugguucuagggccuugugguuucuuccucucuucugucucauaaggaaaccauguugugcauguggggucuauuugauuagauuaaggaggaucuccaguucaagacccuuaacucauuccaccuaccaagauccuuuccccaaauaaagucuuguucucacauuauggggguuugggcuuauauaacccggaguauggauaucaucagaaccugaguaaaugcagcccaaaggcagggccuuuaaagccuuguaauucugcuagagagaccuggucucuagggugaugaccaguagucuucagaguuugaaggcagacccuugucagugcuugaugcuguuaguagggucagugggaaugauugggaaaggcagguuggcuauaguaggagagagcuguugggcugccugcaguggcugcaugagcuucacgcuucuuggauaaacagagaugcauaggugcauuucugaccaguacuuuauccugaaagggucccagaaagcaggugugacccagguuacacaguaggaagcuugaaaacaugggcuucaugcacuggucaagacaaaucugaggguggcacaagguaaugguugggaccuaguacccuucuagaaggugggagcccuugccaccgacuuacccugcaguaugguguaugauuaaccguacaucaaagauuugagauucuaccaucuuuuugacaugagacaugcucuuuucuuuugcagaauuacuuaagcuagaacuggaaaaaguggucguuccauuccccucaggaauuagucuacuugcuuuugcacaaauuuuauguggccucuggcagacaacuuuuagauccauacagcuagaagcaugcccuuuccagaagaccuguucuggaauagauagugcuucuuauguaugcucucuuccuguuggcccaugcccaagagaaaaccagagagccaguaagacaguacagagugcuucaccuacugaaguaauaaacgauaaggcagauuguagguaggaaugauaucuaaaaaggaacaauugcagcccugugugugacacccucaggcaagguaaggccuaccuuuuaguguuuccccuuucaaggugggaguuuggagagaugaacaagcacuuuggaagcauccccagcccucuuuaccugacaacaguuugguccucacagugacugcuucauuggagugccucuccaguguuauggcaccaucaucuguuaccacccaaggcugugaugaaauaagauacaacauauccgaugacacaggccugcauggcuagcaucuugaacauuuuauuacaugaacauucucuguacgaugguauaaaaaggcccgaggauuaaauuauguauaaaauaugaaauaaagaaguaagacuuucaagcaugcacucuguccucccuuguuggauguagggguaggauugccaguaacaaagguuuucuuugcuauuucuaucucuuuaauuccccuguauuacauaggaaguagcuguuacacacagcucugagguuucuucugccuauggcugaggaaagcucauuauugacacaacagaguggugaaaggggccaagucaacuaauuuggggcuugaauuuccugugguugcagcaacaaaguaccacacguuagggagcuuaggcaacagauuuccucucccuguuaaggauggcaggcaucugagaaguggguuccucauaagggauaacccauuccagugccccucuccaguguguggcaggucccagaaauucuuaguuuucucuaguuguaccugcaucucugccucugccacuuuugucacauggccaucuuguguuuccuuuuuauaagcacaccaguguuguauacagguggguauuuggaaacauggaagcauuuuguucaguaucuagugacagugauggaaagagaugauuugcagagaaggucagagcagcaugagggucuuagguauggagcugcagccaacauuauggacauggaagagagggauugcuggacuuuugguuuccugccuggguaccuggacaaucuaucuaccauugggaggacuagguaacaguggaaguuaguuaugagagaaguuguuugauguucaauucugaucuagccaggcucagugugagauguccugggucccuucaucuugccuugacuguuaggugcaguuucauauugaaacugcaggcucuuuuuuauccauugcuacuggcaaccagugugaucugguaaaucuguuuccacuuugcuuagugcucuccacugauuuucuguuacuugagaccuaaacuccaucuucagccuuguguugaucuaaugucaugucaacuucucuaaaagcucagccaauucuacacuggccuucuauuccuuuccucaaaccacuuagcacuuuuuuuuuuuaaauuuuuuuagauuuauuuauuuauuuauuauauguaaguacacuguaguugucuucagacacuccagaaaaggagucagaucuuguuacggaugguugugagccaccaugugguugcugggauuugaacuccagaccuuuggaagagcaguagggugcucuuacccacugagccaucucaccagcccagcacuucuguuucuuaaggcuguugcuccuguugucuccuuugcugagaaaguucuguucccuaauuuguacuguugacuacuuuuugucauccauauaaguguaaacaaaaguucuuucaucugaucucuucauccuaaaucauacuacccuguuuuaacucacauuacuaccacugaccuuuucuaguguuuuuuucuuuucuaccacuagagggagacagaagccguaucaauuuagucguauacucaacacagggaaacugcauuuacugauggcugagcuugucugagacgauaucaggauuccccugccaauaucuucauggacgucacuugucaccauaauuggugacuuauagaaguuauuaauguacuagaaauuauaguacagaaaucuuauuuuaggacuauaguaccaauagccuuuuuuuguggugcuggggauagaacccagggucuuucacauguaagcauucauaccaucacugagcuacaaucccugguuaucagcuucucacuuuauuuaccuuccccugacuuugacagcccugucuaguuuggaacuuauuauguaauccacgauggccuugaauuuacagccauccucagccucuccagugcuaggauuauaaauauaucugacuagcuuauuuuuuucauuuuguucagguuuuuaaugagugucuugguuucagauaugaaaaacagaauuuggaagaaagccaguugggccagucugugguagagcaugcacucaaaguugaagcaagauguuaaugaguucuaggcuggcuuaggcuucauagcaagauccuaucucauaaaacaaaaaguuaacuggugauucccuggaggugagaggggugaggagagagugauaguuaaugaauacaaaguucuuugagggaaaaugagaauauucugaaauuggcuauggcgauacucauacauuugugaaugugcaaggaacacuucagaugaaugacuuuuguuguauauggauuagguugcaauaaaacuggcauuuaaaauguuaucuaagcccugcaguuuuccagaacuuuuugugacaacgaagaugauauaaaaagaguugaauauuugcuuuuguuaaauuuaauuuuauuaauuuuuacuuauucacuuuauaucucgcucacugucccauuccuggucacccccucccacaacccuucuccccaaauauuugcuuuugaagcuguuugacaggugaacuauugaugagcucuuggcauuguuccacuaaguagaagggcagagcuggaggugagacaugugugacugacuuugucucacaaaauagaaugaucacaccauagccuuucuucugaguuccacaauuggaacuaacugaagacuagcaguugccucuaaaucagcauggacuggacaacacaugggcccuaccuacuacaccaauagaggaacaaaauuaagugggcaaguaugauagguaguggccagugggaaagaagagaccaccuaggcacagcagcuuuuuugauuucacuggugccaaguauccuaggaucagggcugggauggaauuugauuugucagucuggcaggcccauccaugcucuuauggauuuaaagauuggcuccauaguuaaguauauuaauggaaaagggacacagaugugaaaaggguaaggauauuugcucuaaauauuuugugugacugaaagaagaguuuaggauggguuacaaugucacaaugggcugaguucuaugaccacugucuagugguucuugaccuguggguugcaacccuuuuggggucacauaucagauauccugcgugucagauauuuacauuaugaugcauaacaguagcaaaauuacaguuguggaguagcaauaugaaaauuaaugggugggggcuuacuacggcaugacgaacuguauuaaagguugcagcauuaggaacguugagaaccacuauguggggcccauuuuggcuauaauaggcagagucacagaaaguguaaggaacuuacaucuguguuagaaugaaagggaaucacacuauguaggaaucagugcauuaauggggagacuucacacuugaagauacaaaagagggacuccaagcuguagaggaucagguuuuguguuuacuagagaauugacagguuccaggguuaggacagagaaagcacaaggagccaaauaauauugucccagaaauauaaggaugcucuuaaagaaaaacugagacacauuuagcugcauuaggcauaaaaaucaaaaugacugcaggcugaaauaaaagugggcacauaacaauagcaacuguuauugcuauugugccagaauuaccuugauaauucugaagguaucuugaagggaagcagcaagaauuuaauauauuuagcaaaugauagaacauugcugauaguuaucagggugagauauuggauuuuucauuuaaaaauacuuauuugcaaauuuuuuucucuuuuuuucuuuuuauuuuguuugcaaauuauuuuuaguuauguauauguauacauguauggaguaugcacauagguacagguguuuguagaugcuagaggaucugacugccugcagcuggaguuacagagaguuguggucugccugacauggaugauagaaaacaaacuuggguuccccgaaagugcaaaugcucuuaaccaauaagccaucucucuagccucauaggauuuauuauuuuuauuuuuauuauuucuaaauuugagauaauacaauuacaucauuucugucuuuccuuuccuccauccaaaccuuuucauauacuucuccuuguucuuuuucaaauuuauggucucauauuucauuauuguuuuacauacauacauguauauguauauacauaugcauguauauauauacacauauacauguguguaugucuauguuucuaaauauauaaguaugaucuguucauucuguauauuacaugacuuuuuaaaaauuauguauuuauuguaugugcuauagcagauauacagagugcagaggacaacuggcaugaaugagucuguuuucuuauucagccauauaguuccuaaggcuggaacucagguucucuggcuugguggcaguugguuuuuuuuuuuccccacugagacaucuaacuagcuuuggauuuguuauuuuuuguaaggugucuuaguggauauuuauaaaacaacuaggauauucauaagguacaucaugguggguuagaucuuuaagguauuuucccucauguuccuuuuuaaaagcccacaaaguguggguaucaucuguuccugauauaacaggaagaaccuaaguagcucugaggauguuuaucuacuccugaaaccauccuccuaccucaaccuguuagcugcuggauuacauguguguaucccuuggcucagcuugaaacacacacacacacacacacacacacacacacacacacacacacacacacccuacacacagcuuucucccuguagcacugggugucuuagaacuugcucuguagaauagcuuguccuugaacucagagaucugcuugccuuugccuccugagugcugggauuaaaguccugcaccaccacugguuggcaaacuuaucuucuuuuaaaacaauauuauacaagaauuauuuuauuguaaaaaguaaguaaaucaaaagcaucacacugcuacauuaauguagccacucaaacuguaaaaguccccagacuuuagcacaacugguuacaugauggaaauaccauuuaggcugugaauguacuuagauagcaccaccugcca

SEQ ID NO: 9576 - RNA, 19714 nt, Mus musculus
auccgggaaggugcagggccucgaagguccagcggaaagcuaggccauacauaauggcugggugacacaggagacggggacccaggagaacuguguggagcugcacuuaugacaagacuuugcgaucucgaaauuguaggggcagcggcaucggggaaggccaaagggcggggcuggccagggaugcgcgcgcaucuccuccugcaaugauagacuagcccgaagcuccuccccuccugccucuccugaggcgggucagcucagucaaagcacacgcccucuugcguuaaaugggccagcgaagcuuagcccccggaaacuggcugugcgcuacagaucugugaacguguuuggcagcggcaacuaaacucagguaaagggguggucugauggcaugucgguggagggacaugcuucacgcuuguacgccgcgagucccuuugaugcgcgcuaaucuacaaguuuuuaacccaucccuuuguaucccgcacuuuccccgcauugggcccaugaggacuagaccuuuagaagagaagggacuuucggggaucacccaacugggccagaagagagccggagcugaacuccaucaucugcacaaucaaacgugcucaguucauuguggaguuucuggcagacacccgaguacgauacgauggucccauauacagagugugaugccguaaccagauuuuaucuagcugcccacaguggauguccuaggugaauuauauuaaagcuuuaguacuuucguaauguacagccccuagcgaaggcaacuuuggagguuauggcuggagcucagaggcagcaguuucugaaucuccgaaugcauguaugcucgcgcgcgcgcgcgcgcgcgcgcguacacacacacacacacacagagcauucccggccagugguuuuaguaaucgucaccagccuggugagaacccaaaagacccuuggauaagguuaaguugucaaugcucuuucguucuccuaccauaucaaugagucuuuucuuccaccagaaaacaucauggcagagcagguggcccugagccggacccaggugugugggauccugagggaagaguuguaccagggugaugccuuccaccaagcugauacacacauauuuaucaucaugggugcaucggugagucucccuucaggccccgagucuaaaagaugaaauauagccuugugcaaggcacuucucucucucuaucucaacuuucccaauugacggaacugcugagguacccacaaguucuacuagguugaacucuauggcauauacuccaccuguguguccugaucaucacagcaguaccugauauacauguacuugugucacaucucagaacucugugcugagccauugaguggagaccagacuuggaccaucacaggugcuaaagcaccacccaguagcacuucuuccuccuggaugaaaaaaaaaaacugaugugcaaucagggaaaauucugauuuuaaugaaucuguaauuugaaaaauauuacuguuaauuucaguggaagaaucugagguccugccucucccucuuuucuuucuacggcaugaaguucccuagggauaaacaccuccucuuugccauaucuuccaaagccuacugcaaauuucuguucaucccaccuagucccagcucuguuaggaaaaacugaagaacagaagcagucagagggguguuguauugacaguacacagugagacuggagcaggugggggcuuaguaaagucauggcuuagaccaaaucacccccuuaugugcuauguggcagcagggcacguucaguggccaguguucgauggcaaagguaaacucaauugcuugcuuuuaauccuggaaucagcucacccucgugugaccaucuucacuauuaacuuauuguguaaucuuggacaagaacuucaucagaacuaguguguucuugaaaggguagccacuggcucagcaccuuccacccuggaccccucaaugcuggaggagcucugugguuuuuuguucacacagagcauugccaugcaccaagggcuacagcuguaggucagugguaaagcccuaaccucauaugcaugaggcccuagguucaaucgcaguacuauccaaaaaauggacaucagaacaugccacccccuuugccagacuuguuuguugucugccuuauauuucugagcaaaaaugggaguggcagaacuucgaaaaggaaugcagaaacaagcugaggagaagggcccugccacugaaaggggaagggacagacaaaccaaagcacuguccccuggcuccuuguagcucuaagaccuaagggagguacuuagucggaacacacaauacagcagcccuacccucagcccugucucuagccuaguccccuuaaaggagcuaugcauguaucugccacaaaccuuagcaugugggacucugcuuucagucuaaagggccaaauggaagagaaaguaacugaagauuauuuccccugccccacccaugcuuucauaagcaugcagcaacaauaacccagucaucgaagaucauuuuuaacuguaggacaugaacucuuagauaccuuguugauagcuuauuaugugaccuggaacaaaugucuacauuucucugaacccugguguuuuucaucuaacaaacaaaaaccaggcagcuuuucuggcuuuauccuaggcuaauuaugugaauucuagccucaaguugagcaacuuccuuucacugcaaucaguuugguuccccuuugcucuccucugcucugggaguaagaacccgggcuuccagaguagaaauaggaacuauuaguuccagcaaaagggaguggggaagaaagagauuuucuaaaaagcaucauuguuucuuucuguuccucucagagguccugagagagagagacagacagacccuaugcuuagccccuagaguagcuccugccugauacuucacuaaaugcaggugcuaucugaucuaggacaccugcaaguucuccauucauuaaacguagcaaucaagugucucccauuacauaauagucucaguuccuauccuccuuguggggacaguguacuuuggggagcugcauguaacagaagucacaaauggauucuuguguacuaaggccccugcaacacacaggucccaagaggaccuaaagagcaaggcaaguugaggauaagggcaacugcccucuaaguuuggaacaagcucaaugugaccuagaaacuaaaaggaagcuaguggcuggcaggccucaagccuaggaaacuggaacaaacuagggcaaguugauccuaaguagccauccucugccccuucuuccuccccagguccuuacccaguccuuacacauguacccagcuuccuugguggggacauucucaaugugccucacuguagccauuccucuucucagaacucccaccccaacaagaaagugaacagaaauccuuacugucccacuccuuauggaccagugcagggaaggaacugagccuagaagggcaucucccccagccaauaggaccuuggugaaacuagagagugagugagucuuucuccuaugcagaagaaauggaguaggucugggaguccacaugggcagauaagcucacuaugggcccaucucucuagacaucugauuccuuaccuagccuaugugacacccauagauucagugagcacucaagguccauccugcugacaggacugugugaggagugaccuggcagucccagcccaucccucuacuugggucauuucugagcugacuucucccuugagcugguaagauucuugcugugucaugaugaccuuggcauucucccaaaagccuggugacucacagagugccaggguguaagaaggaggccuuuuguuagauuuuuagccgagaccuaccucguaucucccuauaucucauucagugccuggaaaauagccgacccucagucgcagucuucacagucuagaacugugucuuggaaagcuaggugggucccucauccccaacaacucuugggaacugagugccucacuccugcaaggccuucacucgaauuucucccaaacaaaaggcuggguaugauuugacuucaaaaaacaagaacccaaaccucagcuaacuauagaccaagugguacucagggucucuuugccuuuaucuggccagauaucuguggcuagagaucuuaaucaugucuuaauucuccuaauucaccacauauccuuagguagauccuucccccgccaugguacuugggcaauaugaggggguagcaaagaugagagacuuccagccgucucucuaauugccccuacucccacacauguuaaguuuagauuuuaguucuucucauguuccuuacuucagaggaguuuagugagagucaugaagccaacaggaaagacagggugaucccaucccugagaagaauggcuaccucccacccccacuguccuuaguccuaccucaccucccuugggugacuugaagccaggcagacugucaguugcaggcugagccaaaacaaggagagcagguucuaugucuuguuaaucccaaagagaacaagaacaaacagcucuggguguggggcaacugugacucagcagaccaguccccugccaccaacacauuggcuggagucuguacugauuccucccaguuaguuggaauuugaucauaagcaaacacugucugcuuagaaaagucuacaagccaggguucucauuguuucuuuuaguuucuaguucccagcaagccaguccuuuccagagugugugaggacaggauaaaacccucugaacaugagcaguaacccacaucccacugauggaagaucauagaggcaggcauugagagcauucugaggaacuaagaaccauccuggggggaaauccuggcccagaauuggacuugucuaugcugggcuuugugggaccuauaagggcaaccaucuugcacaacagaguaaaagcuuugcccagcagagugacuugggggacaguaauuaggccacucagguggccaugcuugguaucacaugaggaagugacagaugaggaggcuccagagcaauagaagcccagcuggcagcaagucuuagacauuuuccuaaagauagucauagcauugaaguuacuuacuggccauugggcucaggcucccagaaguucauauggaaggugguaguuaucauaggaacccacucgccaaugcucaggacuuuaauucugagcaguugacagacaugggcacugaauugcucgcucaugccaacacaggguguuaggguuuggcaacaguccucuaugaaaguuuugggaacccagaaccuagaaaugacaugcacacaauugauuccauggaccggucacucagcaaaccccugagaacaaacauucaagccaugggaaucccugagugcccauaacuauccuuauccagaacugccauuucccauagaaaugggcucaucagugcagcuacaugguuaacucucuuuuguuuguuaauaugcuaaccaagucuacucagccucagccuucccugagccucugcuccccuuuuuuuuuuuuuuuuuuuuuuugagacagggucucacuacguuuccugggcugaccuugaacuuguuauucuccugucucagccucccaaguacugagauuacagguauauacuaguacaucuggcuaagucauuuuugaaguuuggaucaaaaugguauuaccacuacaauguuuugauuugauuugauucauuuuauguacauagguauuuugccugcguguaugucuguaccacuugcaugucuggugcucucagaggucagaucccuaaaacuggaauuacagaagguugugaaccaccauauggaugcuggaaaucaaacuaauguccucugaaagaauagcuuagugcuguuaaccaccaagcaaccuucccagccccaccucuucauuuuaaagaguuagucagcuuaggcuauguaaucagcuugggcuaugcuguauauuaguucuaccugugauaacagaaaguugccuauuaaauauuguacuaaagagaacagcagggcuggagagauggcucagugguuaagagcacugacugcucuuccagagguccugaguucaauucccagcaaccacaugguggcucacaaccaucuguaauggggucuggugcccucuucugguguacucauaugcauaaaauaaauaaauaaaccuuuaaaaagagagagagaacagcaguucacucucugggggucccugauucauggagcccagcaucuuuccaggugauggugaucccagccagguaaaggaggauuguucgagcuguauucugcauagcuuauuuaaauuuugcaagguucaugccacccagacccacugcaucuaaaaccucaucccaaacaccugagaaauuagugccaaaaugccuuguuagaaagugguguuuugaguuuuaauuagauauaccuguaguaaaaguuucagcaaauuacuuuuguauaaauauucagguucuuaaaaccagaguugcuuuuuguguagagagugaauuagaauauagaugggaccagugccugacuccaguugcacuugcucaccucuccccaugaaguaguacuauccuguguguguagcauggguucacacuucucccacguuccuaauuauaggguuugagaugaaagggcaaaugcccuacucuauuccaagagauugguagucaugucugccccuucuucuuguaccugguuuggcaggguacaaaaugaaagcauguugggcuguuacugauuacugggauacugaacugagugugcacauuagcuuggaaaugaggauggugaacuuauggcuagguucuuuauaauauuuacuuuuguaaaugguauuguuuuaaauugcuaauuuuuccaacucacugguaaaugaguuuuauuuacuguuaguaaauaaaaguugcuagcuuguaucuacuaauauuuacaguggguucuugggggugcuguuugguuuauucauuagcuuugcaguguuacagaucaaacccguugccuaacacuugaccacugagcuauauccuuagccccaaauauuuauaauucuuauuggaauauuucaucaaaaauaacacagaccuuaagggcgcagcugggcaacuuuucacaaacuuggcacacccuuguaaauuucucuccccauuaagaaagggggcuugaaagaugacucauugguuaagaguauuugcuacuuuugcucaaauccaaguuuaguuccuaguacccacaacaggcagcuaauaacuccuuauaacucccaauccaggggauccagugcccuuuucugccuucuauagguaccuguacuaauguacauauacaccccccaacauacccauacacauaauuaaaaacaaaauaauuacuuaaauaaaaagaagaaacagaguauuaucaccuaaaaucuuagcacugcagaggcugaagcaggagauucacuucaagaaagacauucaaaacuagccugccuaagcaacauaacaagacccugaauuaaaacaauguaaaauagggcuggugagauggcucaguggguaagagcacccgacugcucuuccgaagguccagaguucaaaucccagcaaccacaugguggcucacaaccaucuguaacaagaucugacucccucuucuggugugucugaagacagcuacaguguacuuacauauaauaaauaaauaaauaaauaaauauaaaaaaaaacaauguaaaauauauggugguauacuucuccuguaauucuagaaagguggaagaaggaggauuaggaguucagagcuagccuuagcuacauagugagcuugaugcuagucuaggauacaggaaacccagucucaaaaaaaaaaauguuuuuaaguaacuaaagccagguguacugguauacaguuguaaucacagcacuuaggaggcugaggcaaaaggauuaccuugaguguaaggacagucugagcaacauagcaaguucaaaacuaguuaggauuacauagcaagacccugucucaaagcuacagcaaaaaaaaagguauguacccaaagaacccccacuuuguagcuauuguuucccuaggaguaaugucaaacuuccucuccacccccugcucaauuauuuucacccucuuuucuugguacauauuguaaugcauaaaugguagcuauauuguugaugaccuaaucuaggacauuucugucuucccacacaauucuuggauaccccuggccagccagucuaccgccucucuaggcaacuacucaucugaguccugucauaauagucuaaaguugcccauucuggggcuuuuaagugaauucauuaguauauagucucuuaugucuagcuucuauaguucaucauaauauauuuuuaagauuugccaacacugaaauaguagcucauuccugaguagcugaauacagauauacaauuuguccaucugcaugcugguuuauuugaccauuucugggcuauuuuaaauuaaagcugccaugaacauucaugcacagaucuuugggcagcugguugccugcuuuuauuucucuggaguaacaccuagauauuauagcuacuucaccugauaagaggcugccaugcuguuuuagauuuaaucauugcagguuucuacacacagucuaugaguuccauaccaauacuaggucuuccuuuugcuuuggcuuuuugcgggaagggaguucuauaaguauguaccaacuaucaucauuuguauuacagucauucuaaugagucugaaguagugucuuguuaaaguugcauuuucugauaccugaugaucuugaacauuucccauguauuuuauggccauucguuuccauucuggugaaacaucuggccaaaccuuuuacccauuucaguuagauuguuuuucagugugucauaggagcuacuuagauauucugaauacagguaaguuuagugaauacuaucucuaagguugaaacuugucuuuuuggugcuagggauuauacucugggcccugcccaugcaaagcacauacccuaccacuaaggucauaaugccaggcuugccuauuuuccuucguuucuuuuguuucauaauacuggauauugaaccagucauaugcaugcccuucauuuuuuucauaucucucuuuccucuccuauauucccuacccccagugcagaccuugagcccuuuauguauccaaggauaauccugaaguucuuauccuccugccucuacuucuggaaugcuaugauuacaggcugcaguacaaugcuggcuuaugauuauuacuuuauauccuaagaaaucucuaccuacuccuaucacuuuuuuaaucuagcaacuuggaaaacccucauuaauucuaauaauuagucuguagguugauuugagguacuuuuuuaaauaaacaagcuaucaucuaauaaugacagguuuuuguccucuauuccaaaccuuauaccacuuucuuucuuuuuucuuuuuuuuuuuuugguuuuguuuuuuugagacaggguuucucuguguagcccuggcuguccuggaacucacucuguagaccaggcuggucuugaacucagaaauccaccugccucuaccucccaagugcugggauuaaaggcguguaccaccaccgcccggccacuuuucauuuucuugucugaugacacuaucaagggcuuuuaguuuaagacugacuaaagaaacaauagcaagcauuuagaauuuucucauagacaccuagaugcgugucugugauuguguuuaaagagaaauuuaacugaagaagagagaccuaccaugaauuucauagaacacacuauugauuggugucccugagugaacaaaaggaaauuggagagaguaaacuaaguguccauauucaucucucggcuuccuuguugacaacacaaacuucaccccccaucaccacgccuucccugacauggcaaacuguacccucaaacuguaaaccugaauaaacccucauccccgaaauuucuuucugccagguauuuuuuuuucauagcaacaagaaagguaaacaauaccccauuuuguuuguuuuguuuuuguuuuucgagacaggguuucucuguguaguccuggcuguccuggaacucacuuuguagaccaggcuggccucgaacucagaaauccuccugccucugccucccuagugcugggauuaaaggcgugcgccaccacgcccggcucagaaccccauuuugaaugguguuuuuaggguguuugguagauguccuaaaucaaauuaaagagauuuuauucccucuuugauuaaaaaaaaauaaauagaauuuuuuucugaaacccuuuaucuguauuuguugaacuuaacaaaguugcuauauuuuaaaaaucaguacacagacaugaagauuucucagaggccuauuguaaucacagcuucucaggagucuggggcaggcauucaaagcuaauguugacuacaaaguaacuuccaggccaaccugaguaacuuuuugagacucugucucaaaagauaggcaaacauggugguacaugccuuuuuaaucccaggaaguagagacagguagauuucugugaauuugaggccauccuguucuucucagcaaguuccaggucagccagggauaagaucugugacuguccuaguuaggguuucuauugcuaugaccaaaagcaaguugaggaagaaacaguuuauuuggcuuacacuuccacaucauagaccaucacugaagaaaggaaaugaaccuggaugcaggagcugauacauagaggcauagagggauauuucuuuuuucuuuuuuuguuuuuuuuuuuuugguuuuuuuuuuuuugguuuuuuuuuuuuuuuuuuuuuuuuuuuuuuugguuuuucgagacaggguuucucuuuauagcucuggcuguccuggagcucacuuuguagaccaggcuggccucgaacucagaaauccaccugccucugccucccgagugcugggauuaaaggcgugcgccaccacgcccgucgagggauauuucuuacuggcuuguucagccuguuuucuuauagaacccaggaccaucagucaagguugguaccacccacaaugggcugggcccucccacaucaaucacuuaaaaaugucccacaggcuugccuacaggcugaucuuaugagaguauuuucucaauugaggccgccuccuuucuggugacucuagcuuguaucaaguuaacauaaaacuagccaggacgggacuauaguccaguaguugagcacuugccuaacaugcuugauuuccugaguucagucaccagcgccauacacacacaaugguuuuuucagaauuuuucauuuaauuucuuuugagggguauugguuuuuguuuuuguuuguagacuugguuucuuuguauagccuuagcugaccuggaacucauucuguggacuaggcuggcuauaaacuuagagauccgccugcaucugccuuccaaguacugagauuaaaggcauguaccaccacuaccuggcuaauuuuuuuuuaagauuuaugguuuuuuauuuaugugucugucugccagccagucagccacauguguauggauacccacaaaggccagaagaugucauuaaauucccuggaacugaaguuacaagcaguugugagcugccugauauggaugcugaaaaccaaacuugggacgcuguacaaaaccagcaagucucuuaauacugagcaucucuucagcccauuuuuaaaucuuuuaaugugauuuucagugauugauuuugucauugcucucgcuaccuuuauucuuugagacaggaacccucauugaaccugcaguucaucuguacagccaggccagcugacaaaugaguuacaggacuauauagaaaaacucugacucaauaaacaaucaaucaaucaaucgaguuuuacaucagccuuugucaucaaguuguagaacuaaaguucucaaagugcccuuagaaguauuccucuuuauucugucuucaggggaaauuuacuucagaguggaauucacucuuccuugacucugguagaagccauuagcaaugcuuuucaggccaggaguugucuuuguacauugccaccccuuagguccauuccuccauuauauccuagguuggaucuuuuuuuuuuuuuaaagacauuuuuccaucuugcugaauaugguggcacacauuuguaaucccacuacaaagaaacaagaggguugucuguaguuugaggccagccaggacuacauacugaauuuaagaccaaccugggccuuuauucccagcacuggaagacagaggcagguagagcucucuugaguuugaggcuagccuggucuacagaacuuccaggauaaccagagcuacacaaagaaaaccagacuuggggauggaggguggacgguaccaacauugguuacauggcaaggcccugucuuaaaaaaauaaaauuaaaaaaauuuuuaauucugugucucagcuaggcuguaguggcacacacauuuaaucccagcacuccggaagcagaggcagguggauaucugugaguuuaagcucaaccuugucuacaggaugaauuugaagacagccaggacuauacagagaaacucuaucuugaaaaaaauaaacaaaauucucugucucauucuaacuuguuaggguuuuguuaggcuggguuggguuuuguuuuggauuuuggugguggugguaguguuugagauagggaaagggucuuaugguguauaccuaaggcugacuuugaaguccagauccuccugcuccaacuacccaaguacugggauuauagaccugugccacgaagcccagcuuuucuuucuuguuuugguuguuuaguuugguuugauguuuggggaaguugguuuuauuuuggcuuguuuuuuuuaauagcucuuaauuuauucuuugagaauuucauacauguauacaaugcauuuaaagcauaucuacccuccauucucucucucucaaccccucuggacaaccuccccgaucccccacccaauuuuuauuuuuguuauaacccauuaaguacaauaauugcuuccuacauucucaugagcauggaaccaucauccacuccuugagcaauuaccaaggggccaugaagaaaaauuauauucccuagcagccacugaugggaaguggaucuuccaacagauccuuagcuagggguagcagcuugugaacuacacacacucagcaugcuggccaacuugaucucaugcaggcaacuacagcuacuguggcuucauguguaccacagcccugucauaucaagaaaauagcaauucacagcucuccucuagcgcucuuuuguuaguuuucuacucuguuuguuuuuguaggguggggguggaaaucagaacccuugccuacuccaaaaucacugagcaucuucuccagcccaauuuuuccauugaauuuuuucacugcuaccuuauuuuuuuuuuaauucugauuuagaagaggugauuuugaaacaguaucucccucaauauugggagaauauauuaccaccaaaucuggccuuuguuacagagacaagacuucauucugcaucaucaaacuuuuccugccauuauuuuucuaacuuuccaaauugaaugaccaucucauugccuucuagcuccggugacaucugaggccuuaccucacagguuuugucuuucuuuuaugugcugccuuuaucauccuuaagcucuaaugaauucgaugucuaggguuucaucuugaacccagcagugucaucuacucaucuguauugguacaaggcugguagaggcuuaagucucagagauccucugauauauauggggagggcauaguagauauauuucuagcugagugguaaccccaaaugaggacuaagaucaccacugguggggaaugaucuaggucgugucagcucuuucugacauguuucuucuucugcagggugaccuggccaagaagaagaucuauccuaccaucugguagguaauauuucuacacuaccccccaaaauacucucuaccagguacaggccuuggccuucccuagccagucugaaaacagcuguauuguacccucagguggcuguuccgggauggccuucuaccugaagauaccuucauugugggcuaugcccgcucacgacucacaguggacgacauccgaaagcagagugagcccuucuuuaaagugagugugacauuggauccuggagccuugugcugcccuuucuucuacuccacagcaagacuagcuccaggcaucccuugagaagacauguccccauuuccaucauaagcaauaguucccuccuuucucauuugacuuauuaacaggcagggccacccagaacacucaaucucugacaccucacauccuugcuuucccuugccaaccacacaaaaguugugucuacuuaauugugccacauucuuccugaccuuugaacaaagacaggaagaaggucccuucaaccucauaucugucuccuagcuccacucuggcuucauccugcuaugcucugguaccacacuggaucaugccaguagcuggaugaaaggacccuuccaaguaccucuuuucuacaguaauugcacuauguugacauuuucucaccaccuauaguuuacuguaguaauuuugaagagacaaccuucuccaucauucuuuuuucucagguuagacuuuccugaaauccaguuucuacucuagguaugagggccccaaggauacauaaaaaugugccagugauuugccccaccugcauauauuccugcuaugugccuuagcccucugccuguggguacacaaaguuaccaugauaaaguaaacuccugugcuuguagagcaaugacagggacucaaggaaaacccgccuuaccuguggaacaagaaauuguugagagagugagggggguaggcacagagagagaaagagaucuucuauuccuuuagggcagaacaacuguagacucuugagaaaaguagaaguugacauucaucuguguauccccaggccacuccagaagaaagaccuaagcuggaggaguucuuugcccguaauuccuauguagcuggccaguaugaugaugcagccuccuauaagcaccucaacagccacaugaaugcccugcaccaggggaugcaggccaaccgucuauucuaccuggccuugccccccacagucuaugaagcagucaccaagaacauucaagagaccugcaugagucagacguaagaccugucuuucuucacuccugucuguuuguuccuguuucugcuacucuaaauagcccccaggucaagccagucuaugcaaguugaaaagaugaaugccccuaguguguuguccauauggaauagcauacccccccccccaaaaaaaaaggaacaggcuauacacacacacugggcagcuucuaccuuccaaggcucucacuacaaaauaguggccccuugcaacauuucccaccaggaccauaagaugacaguguugcuccacagaacagaugcucauugugagaauuccuucccccacccccaauccucagcagauccacaagguggcaguguuguuucauaagagagcacugcugacugcaaaccaucuuucucuuccuccugaauuuagaaaacaaguuuagcacucugagugucaaagaaagaaaccuggucuuuuaaaaucuauggaaaucugggcaaggugacacauaaauaauuucaguaugauggagauugaagcaagaggauugcuuggaguucaaggcuaaccuguaauacagagugagacugucucaaaccaaaaaaaaaaaaaauuuagcuggguguagugacacacaguugugauuccaguacucaggaggcaggaggauuauuauguugucaaggccagccugggcuacauacguacugaauuugaagucauucuagucuucauaguaagaauaugucucaaaaaaacaaauaaaagcuaguuuaaaaaauaaguaaacucaauuaaagucaguugcguugggcgaugacgauagucccugcuacugaagggaugagggaggaguacccuuuaacccaggaauuccagaacaaccugagaaacacaauaagacuucaagaacauaaaaccaaugaggggagccagacaugauggcacaguaccugugaucucagcucuugggagcuggaaacaggagaagcagcaauuuaaggucauucuuaacuacauaacaaguucuuggccaaccuuggauacaugagacuaauuaaaguaaaacuaguaaggaagcuguguccuucuuuccuguuggcugcugggccacuucugacccucuaagggucuggcauugggagguggggaacaaggccacccaaggucaugcuacccuagcaccaagguggaaaaaucccuggaauuguuccagucccuaccauguugucagggaagcuucuaagaugcugucuauucaggauaaggaucaauaguagccagcagagcuucccugagucaccugagaauacaauagaugaaagcccugcucccuggugugagggucagaaugacauggccauaggccuauuccugggaaagguuugggaaauaacaugauugggggcuccaagcagaggcuggaaccgcaucaucguggagaagcccuucgggagagaccuacagagcuccaaucaacugucgaaccacaucuccucucuuuuccgugaggaccagaucuaccgcauugaccacuaccugggcaaagagaugguccagaaucucauggugcugaggugcauaggggaugggguggaagggaaccagggcaaggguggcaacauaaggaaccccaccugcccugcugccccaaagucaaauuccuccuagaugcuggccaggguacuaagcuugguacuuagcucagauacagccacuauacuguggaaucccaaauguagcauccauucaugaacccuuccaaaaugucucucaugcuagccucuaaacgaaccucccacagguuugccaacaggaucuuuggccccaucuggaaucgagacaacauugcuugugugauccucacauuuaaagagcccuuugguacugagggucgugggggcuauuuugaugaauuugggaucaucagguaagaacccauauccuaccccaacucagcucaucuucacacuaugagggcuaguguucaagugaccuguuggggguagccaugaaggguauaacucccaucuagccaaaccccaaaggguuaggauuaguaucuacuaacuugucuuaggauacugggaagacacuagggguaaggaaccaagguuuuccaguuugucacuaggaagccuuguuugguaauccuagggcaacuagaacuuaguuauccccuuggccucacccuggaaauggcacuugacuagagcaucugccucuucugcuacuagggauguuaugcagaaccaccuccugcagauguugugucugguggccauggaaaagccugccacuacagguucagaugauguccgugaugagaagguagguggaggcauguccaccagguccccagcagccaugccccauaacaaguaauucuaugacaaggcacugggcucuuguccuacauccucccuguuaccugcauugguucucucccaggucaaaguguugaaguguaucucagagguggaaacugacaacgugguccuuggccaauauguggggaaccccaauggagaaggagaagcugccaauggauacuuagaugaccccacaguaccccauggguccaccacugccacuuuugcagcagcuguccucuauguggagaaugaacggugggacgguaggugaaauuucuagguuccagcaaggcaggguuaaaugugcccacaaagagacacuucuuguuaugaucaugguaugaauacaugguauucaguaguaagggaugcuggagaaggagggcuaccacaagugggaaacgacccuagucauuacuuauuccacguguacacauucacacauauacacagacacaggagcucucucucauauacacacagcacaagauaggaaagccagucccugaggucaucccugcucucuagggguacccuucauccugcgcuguggcaaagcccugaaugaacgcaaagcugaagugagacugcaguuccgagacguggcaggugacaucuuccaccaacagugcaagcguaaugagcuggucauccgugugcagcccaaugaggcaguauacaccaagaugaugaccaagaagccuggcauguucuuuaacccugaggagucggagcuggaucuaacuuauggcaacagauacaagguucaacagggaggaccaucugggcaaagcccuaagggaggcccuggguggcugaguacaguaguaucagcaacaucccccuuucccaaaccugcagaaugugaagcucccugaugccuaugaacgccucauccuggaugucuucugugggagccagaugcacuuuguccggaggugagggacccccagccuaacacaggcaagagggaugguuuucucccucugucccugugugccuccacuccauccuacacuguaucccuucagugaugaacucagggaagccuggcguaucuucacaccacugcugcacaagauugaucgagaaaagccccagcccauccccuauguauauggcagguaagggaaggaugggagcuaagagggccaagccaaaugaagcagggcagugggaauaccaaggauaaaggucacucaugucucuccuuuaccucccagccgcggccccacagaggcagaugagcugaugaagagagugggcuuccaguacgaggguaccuacaagugggugaacccucacaagcucugagcccuggaaguuacaccaucuauacucugccucuucuggccacccuuucugcaucuucccuuuucaccaucuaacccuauauuaggacuauugaccccauauuggaaggacuuugggaccauaggccuuagauacacauucuaguuccugggcuuggaccgccauuuuguccuaugcugcugccacugccaccaccaguaaacccagcuacauuccucaaauaccaggcauuuaaaacucauuguaggguuucagggccaccacuggcccuaucugagccacccaucuuuccacaagaccugaaucaccucccuuccagccgcugcagaaagaaugccuaucagucugccccuggacuccuuaaggaguuaggaacaauggggaggagccuuaggccucaaagggacaaugaccaaaccagacuucccagaggcuaugggcaagcuccucaaaacuugaaggaaguggucaaggacaccuaugugagaggaccugcccauggccacacuagccucagugcuacuagacauuccuccucaccagauggaagagaccucaugcugccuagcaauauuuugggggcucuagauguccccugaccaauuccauacuccauggucaaccucaucccaccuaugggcagccuccuuaccaaaggaaggcaagcacagcagcuagaauuuuccuaucccaacccugccauuaaauccucaaaacaguuuuac

SEQ ID NO: 9577 - RNA, 751 nt, Mus musculus
uaauuaaaaaaaaagaugaggucuuauaggggagcggcuggauaaggaaaccaaaaaaggaacaguaauuuaaaguuuauuccaguuauaaugcagguuauucugacuguaagguagcaucauacgguauacuucugagcccauucccaagaucuucuguuguacuuaucucugucuguauuauagauccaugcaaucucuggcacuagggggucaucuggguuuggaucacauagcagugaacgaauggauaaaagaacuuuggaaauaguuaaagcaggagaccacugugaucuuagaauaucaagacaaaugcugccauuacuguuaauauuuggaugauaaauucuuguuguaaaugcaaccuuaggugguuugaagggguagucuguaggaaaaugaauugucaaaaagauuacaccacuuuuauaugggcugucauuaggucccauaauuguggcuugccaaugaaacaugucaucuccaacuggaccugcggagcauugugcuggagggucacgggccaaaucacuaaguuccuuauuaauccguuucagcgccauagucugugcuuuucgccgggcuccucacuaucccgagguguacucaaagguccggccaaaacucuugauuaucccggaggcggggaaggguugccucuuuuucucacaccggcucugccagacacaggcgcuugggauggagguggcggaucucacgagaaccucguggcaggcucgccggagcucca

SEQ ID NO: 9578 - RNA, 751 nt, Mus musculus
uggagcuccggcgagccugccacgagguucucgugagauccgccaccuccaucccaagcgccugugucuggcagagccggugugagaaaaagaggcaacccuuccccgccuccgggauaaucaagaguuuuggccggaccuuugaguacaccucgggauagugaggagcccggcgaaaagcacagacuauggcgcugaaacggauuaauaaggaacuuagugauuuggcccgugacccuccagcacaaugcuccgcagguccaguuggagaugacauguuucauuggcaagccacaauuaugggaccuaaugacagcccauauaaaagugguguaaucuuuuugacaauucauuuuccuacagacuaccccuucaaaccaccuaagguugcauuuacaacaagaauuuaucauccaaauauuaacaguaauggcagcauuugucuugauauucuaagaucacaguggucuccugcuuuaacuauuuccaaaguucuuuuauccauucguucacugcuaugugauccaaacccagaugacccccuagugccagagauugcauggaucuauaauacagacagagauaaguacaacagaagaucuugggaaugggcucagaaguauaccguaugaugcuaccuuacagucagaauaaccugcauuauaacuggaauaaacuuuaaauuacuguuccuuuuuugguuuccuuauccagccgcuccccuauaagaccucaucuuuuuuuuuaauua

SEQ ID NO: 9579 - RNA, 1264 nt, Mus musculus
caugcaggacccuguugagggcuuagaugggagagcagggcuggcagaaggugaggauagccaacugaggccucaagcuccggaugcccaggcuagcucucaaaauucggcaacugaaggugaccauggcaacgucccucggaguugcccacaagauucugggagaccagcugcuccugggacccuggcuacuccuggaagucaggcugcuccaggcagccccagcccagggaacacuguagggucuggagcagcagcugaagaggcagcugucauuccucacagugagcaggcgacacuugucccugggcgcaacggugauacugcaucaacuagaaaucgacaccuggaguuguaucuuuuccuaggagaccguggcagggccuaccggaagauaaggaggcuaaaacuuccaugaaaggcuuucggggcacagcugacuagggauaggacagacaggugcagugugggcagucgugacaggacagggagacuccuugccugagagggcugaagaguguagaacaagaggagaaccacuggggagguaggagaugacugggcuuugguugcaggaggguucuuugccaggcaggccuaguaggucuauccacguaaagguauccuaugcaguggauggugccuuaacauuaucuccucccagcucuguaacagugccuuucaggacugcaauggaggcaggcauggcccgcagaucccuggucgccaaugcccguccccagcaagugaugguucagcaggaguucacagcgaaugacaguauccuggcugugucaguauuccaaaaaucugaagggguggcaucaagguugggaggcagugugcacucuaguggugcccuaaggagacacuggagggauuuuaaguaagcaggaagacauugggguggaggaccugaacagaucccucaucauuuccccgacggugucucuucucucucaauuuuaguagauggacuacugaugacccuguccucuuccgaauuuccaucaacacuuuccuugaccagcucucccuggugaugagaaacauucagcgccuggaguuuguggcuguugucaaacgaggacgaggaagaagucgugaauccuaacauguuaccagauacaagaaaagucagagcguuuccuguuuugaguaguuguuauuuugaauuuaaacuucagcacuucaaugcuguaugcuccauaucagucaguaucuuucaguuacugaaggaacagguguuuaaauguuacugaac

SEQ ID NO: 9580 - RNA, 2307 nt, Mus musculus
agcggguuguaacccccaccucaccuccauagcugagccugagugguacagcugcuugagcuggggucgcugaguggaaagucauaauugccaugcaggauccuggugaggacgacgcaaguggcaguauagggguugaugaaggcagcaaggaugggcagcauaggccucaagccgcagaugcccaggcuagcucucagaguuuggcgacugaggaugaccacgacaacuccccuccugagaguggccuacaggaugccugcagugaggcugcuccaggcaacuccugcucagggagcccuguaguaucaggaaugucagcugaagaggcagcuguccuuccucaggaagagcaggugccacuucucccugggcccagcggagaugcugcugcgacaacugcaagucgacuccuggaguuguauccuuucccggaagacacuuagcagggccuaugggaagauaggaaggauaaaacgagaaacgggguggggggcgggggcuuuugagugagugagcgggaagacugacagcaggguggggaagagacagagugguacacucugggcucuccauccaagaaguaaugucgugcuggcaggacagggagaccucuaaagcagggaagauuucaggguguaggugaaaaucugaacuacuggggaggugggaggugggugaggcuuguuucacauagucagaaacaugguuuagggguaguccuggucuugggugacagaagaugguagugccaggcagaucuuagaaguguaccaggccacauagcaauaggaaacccaaagguggaugguaccuuaaccauaaccuccuuccagcucugugagagugccuuucucuucugcuguggaggcagacauggcccgcaggucccuggucgccaacacccagcaucagcucuuaaugguuccacaggaguacacugugaaugacaguaucuuagcugugucaguuuuccaaaacucuggaguggggguggccucaggguugggaggcaguguacacuguaggggcuugcuaguggagaugugggugaguuagguguaagugggaaggcauggugugaugggccugagcagacuccuucaucguuucccucaugguaucucucucucacauuuaguagguggacuacagaagaccccguucucuuccgaauuuccaucaauaacuuccuugaucaacucucccuggucaugagaaacauucaacaccuucaguuuguggcuuuuaaacgaagaagagaaagaagucguaauaacugaucuguuaccuguuacaggacaagacagaagcauuucaugcuuuugguaauugucaccuugcuuucaaaguucaauguuuuugucgcucauaugcccucuauaagucucuugauaggcuuguuucacuauugcuaaaggaacagguacuuaaacauucauugcugagcaaaauacaacugaccuacuacgcuuuuuuuguuuguuuguaugacuuaacuuuuguuugucuauggcagaaaucucuacucuuuuuuuuuuccccacaugugugcuucugugaagaaguucuggcauucagaacuucuugcagucuaaacuaauuuaauucuaaagauuucuugcgaucuaaaguaauuuaagacaguuuaggaaauggaagaaaaaggaauuuaguuaaggccauuuauuaagcacuaaauacaguaauguuugaaauaagaagaguuuaaugugaaaaacagugcuuaccuugugaucaggagauaaugcagaguaccauucaacaaagaaaaaaaauugugugacuucauuguuuucuuugacauaucuuuguccuguuuguuguugcuguuguuguuguuguugcuguuguuguugcugcugucuugguuuuggugguggugguguuuguuuuagaaaccucuucugguuuggagagauagaggacucaucaguuaagagcacaggcuacacuacauaaggauauagguccuauuccuagcuugcacauuuugacuaacaacccuuuguaacuccauuccaggggaauccagagauauccucugcacacaaguggugcacaaaugcucauacaaagacccacaugcgaaaucuaaaauuuuuaauuuggaaauguauuaacccuacaguuauauuaauauucuaauuauauaaaauuggcuuaugagguuuuaauauuauaucaauuuuuucagaauauauaaaaaguccuucauuuucugaaaaucuuuuguuguuguucuuucauauauuuuguaaauuaaaucauugggguuuauuuucu

SEQ ID NO: 9581 - RNA, 12577 nt, Mus musculus
aggcuguuuugcagagacgagggaacaagguaggugacgaguuuugcagggaacgucccacggcgggacuccagggucggggggguuaggaggcacccuuguuguucucgucgucauuguagugggacaguggggucacagaacaugagggucccgggaagccugugaggugacuuccggagcuuucuuuuacuguaagaggcgccagagcccaaaaugagaaaccgagaaugagaaaaacucccaguuugggguaguuuuuuguuguucuuugguuuuguuugguucuugugguggugguggguuuuuuguuuuuuguuuuuugguuguuguugcuggguuuucuuguuguuguuuguuuguuuugguuggauuuuuguuaguuuguuugguuccugacugcacaccuggauccuccugugacacuucuguugggagccgcacucacauuugccauuacaagauggcgcugacagcuguguucuaagugguaaacauaaucugcacacgugcaggggcaguuuucccgccauguguucugccuuucucaugaugacaacugggccaaugggcugcagccaaucagggaguaauacguccuaggcggaggauaauucuccuuaaaagggacgggguuuugccauuuuuucucucucucuuguucuuguucuuuuucucucucuugcuuucuuuuucucucucuugcuuucuuguucuuguucuuuuucucgcucucucgcucucuugcucucuuguucuuguucuuuuucuuguucuuuuucucucucuugcacucuugcuccugaagauguaagcaauaaagcuuuugccgcagaagauuccgcuuugcugcguucuuccuggccggucacgagaacgcguguaagaguuggugccgaaauccgggacgagaaaauccgggaagaaaaaacccgggacaagaaaaccugggacgguuaccaucaccggcgcaaggaagauuccucauuccggaaccagaacugcgggucacggucauaaagguucccguaaaacagacuguugagaaggauucaacugcgugaauucagaacucuucagcuggggaacaggguacccguaaguauagcuuuacaagguaagucuggucuugaacuuucuaacgaaauucaagacagucuaucagaaguaaagugggaaauagcuuuacaagguaagucuggucuugaacuuucuaacgaaauucaagacagucuaucagaaguaaagugggaaauagcuuuacaagguauguuuggccuugaacuuuuucuaguguuaggagcccuuuuguuccuuuucacauguuaucaagcgguuaaggcagggcugaaaauucuggaugaaauucagugcaaucuaucagaaguaaagcggggagagagaguaggagcaaagaggaaauaugguacacaaaauaaguauacaggccuuuccaagggucuugaacccaaggaaaaguuuaggucagguaagaauaccuggggagagauuagaaggaaggaaaagaaaaaagaaaagaaaaaaagaucaaucagcgaagguuucuaggagaaggagccuauacucaucacuagaugagcucaaggagccaguucuuaauaguucugaaucagaugaaaaggcuauuagggccuggaaggcgcucuccggagcaggugaagccacuggacaacuaacaaagaucguccagagaccucaggagucauucucagauuuuguggccagaaugacagaggcagcagagcguauuuuugcagauuuggagcaagccgcaccucugguagaauagcuuauuuaugagcaagccacgcaguaaugcagagcggccauagccccaagaaagaacaaagguuuacaagacuggcucaggguuugucgggagcuugggggaccucucauuaugcguuacuuccauucaguaugagaaauuuacuagggcagcuaauuugucaaaaagucuuucucaguauauguuacagaauuggacggcugaauuugaacagacccuucgggaauugagaauugccaucauucaggucaacuccacgcgcuuggaccugucccugaucaaaggauuacccaauuggaucuccucagcauuuuccuucguuaaagaaugggugggaucgauauuauuuggagauacacuuugcuguggauuaguguugcuucucugguuggucuguaagcuuaaggcccaaacuaggagagacaaggugguuauugcccaggcacuugcaguacuagaacauggugcuuccccugauauaugguuaucuaugcuuaagcaauaggucgcuggccauucagcucuugcaccccacgaggcuagucucauugcacgggauagagugagugugcuucagcagcccgagagaguugcaugacuaagcacugcaguagaagggcucugcggcauauaugagccuauucuagggagacaugucauuuuucaaaaagguucaguguccuaguucccuucccccaggaaaaacgacacgggagcaggucaggguugcucuggguaaaagccugugagccuaagagcuaauccuguacauggcuccuuuaccugcacacuggggauuugaccucuaucuccacucucauuaauauggguggccuauugcucuuauuaaaagaaaagggggagauguugggagccgcccucacauuugccauuacaagauggcgcugacagcuguguucuaagugguaaacauaaucugcacacgugcaggggcaguuuucccgccauguguucugccuuucucaugaugacaacugggccaaugggcugcagccaaucagggaguaauacguccuaggcggaggauaauucuccuuaaaagggacgggguuuugccauuuuuucucucucucuuguucuuguucuuuuucucucucuugcuuucuuuuucucucucuuucuuucuuguucuuguucuguuucucgcucucucgcucucuugcucucuuguucuuguucuuuuucuuguucuuuuucucucucuugcacucuugcuccugaagauguaagcaauaaagcuuuugccgcagaagauuccgcuuugcugcguucuuccuggccgguagcgagaacgcguguaagacacuuccauaagcaguaucugagcaggauaguuauucugaaguggaagggggaaacccugggcacuuugcacaaacacaugggcaacgacagggcccaagcugggaauggguaccugauuggcaggccucacaccuuugggaguaccuguaggcagccucaggcaugucugcacaguaguguuuccacuaaucagagaccuacuccagaauguggggccucuaucugaggggcgggggaaggagccucucagaggaauguauugaaguguggucaccugggugagugacagggaauuagcagagucagucuugagccucugauggugagaaagcucagucagccugguguaucgggccuuuuggggagcaaagugggguuuugaggcagaagagaccagguuuagcugugaugagauguuuggaagacuuugcaccugguagugaaauagaccagugagaccaauggaugaaaaggguuccaggaggguugcagguuuaaagaguguuggcugggacagugacguggagaaaaauaaguagugacucuccccuguccucuguggguccucaguggacacaucuggguccugcuucuuugcagccaugggacuugccucccucaacacaaaugccuguguuuuuguauguuuuucucagugucaagauuuggucaagaucuagaauauuggugggccauaggagguacuccuaaaaucuguguugaauguugaaggggaugggccaggacugguccccuucaccaaaggacugcaucuccauccaaaucccacaaguacuauacuagcugaaaccacuuaacccuggguauacacaccuucccagccagucagagagaugugcacugagaggugguuccuacauagguaugaccaaccacccucuaaaaaggaggaggcuccagggguagacgaguacccuggguggaugauuggcuauuggggaacucuguuuaggggcucuccaguugauacaggguucagaaaggugccuuagcuugucugguagggcauugggaucacaaagaggcagguccaaaccaaaccggugggaccauccuaggaccuucacuuuccaaaggaggccuggcaaggccacagagggcgaggcuagggagcagucauggggcugcauggauugggagggcuaaaugggacagcaagugggcugugagacauggccucccugacugaugaguaggaccuuagugaguuggaauucccaaccagacaucagcauuagguccuuguauuauacgaggugaggguauagggauaggaaagcagcagaggguacugaucuugagagguagugugucugggagcuccaaguccagauagagaaauggggcaggucaggacauugguggcaugcucuuguccucauuuugcuccagcacaagugccaggacacccagccacacccaugguguccuguucccuguuccuauuuccuucuuccaauucuucccuguaucucuacuuccaggacuccuauguaacacaagaagauucuagcuaugucaagcagggaaaggauggccacugacacugcuggcaggcacucaaggauggauccaaaucucuccucagaugacagccagaacccaggugcagucgaugcagguaaaaaauagaagacaacaacaaaaccaaaacuacaucaugaaaaaaacccacaaacaaacaaaccagaggggcugccagagggcuguguccacccccagcagacauccuaaaaucccuuggcauguggcacacugaguggauguggugguguguggacauuuccuucuugaacuaguggggggagguucagaugcaauuaacugcuacucaagcuuguuuguggcuuuugcuuuccccaccugaaauuccuaccacacaagaauccugcaagucucauaagacaguucucugcaggcaauaugcagugugccucucugggaacacaugggucacauguggaaggacagugcagaugccuccaacaucugguccaagaaucacucaagccuaaugaauuuugugugugucugugcuugugucuguacuucugugugauauucucucucucucucucucucucucucucucucucucucccucucccucucccucucccucucccucucccucucccucucccucucccucucccucucccucucccucucccucucccucucccucccucccucucugucugugcaugcuuuuugugacucucugucucaugcaugcauaagaaugggagugcaugugcaugacuucuuuuaaaaguguaaguuacuguagguggcuauuggcucuagaaaccccacagugacucaguuuucaaugggagaugaugggaguagcucccuuuguccaaaacauuuuuccucuuuuucuuuaaauacagcuaacagagaaguccuugaugcugguagggaggacauuacuuccucaggaacagagaggcaacaggccaggugaucacguuuguuugguugguucuuucuuucucucuuucucucuauuucuuucucucuuuucuuccuucucucucucucuuucucuuucuuucuuucucuuccuuccuuccuuccuuccuuccuuccuuucuuucuuucuuucuuucuuucuuucuuucuuucuuucuuucuuucugcccagucguaaacuauguuuagaaaagucaggcuggaaagauggcucagugaaagggugcuguauguauaaacacgagaaucugaggucauauucagccccaaaagaaaaggccacacguggccacuuaacaccuuugaagcccagaacugagggcugagguguggcagagagcuucuuucugcaugccaaccuacuaaaaauaaacugagauauaaacaaacaaacaaacaaauaaacgcagucuucgguaaggugugugaaucacaggaauguccuggaugcauugaguauaaaggccacaacacauuuguccugcaguccaucagauguucaguguguuacaaaaugaaaaucucaugcuaccagcaaacuacaaguucugucacagaacuugucugacaggaauaagguggaaauugguagaggaggacccccuccauacauacacacauauacauuacuaccucugguggcugcacacuuauacacaugcauuucuguugcauucagagaaaucuagaagaaucagugucugcucuugaacugugaacuguauugaggcuguguggggcacacucuacuucccugcucaugcaacaaaguuggccuuuuguauacauugaauuaaagaguuuauguaauuucuuugcaggaaggaaaaacaggauuugguccaagaauucgaagguauguuccaggagacaauucgaauuugagaaaauuguuugagccaaagaagugcaaggcaagggaguugucacuuggcagagaagagaagugggcuuacugccuaguucucaaacacacaguguggaaauaguguuuauuacucaccaagucucuacuucaccuuaauuguccaugugaagaucauggcaccugcagugggacgguccaugccuacucucugugagauauuuacaaauuggaugaaaguauccgucucccaguuuuugauucacacaagugaugcaucuguuuuugauaccacauuuuacuucucucauuuguauucuaguccuguucuucuauauuuugugggggggggggcgauacuugaagagggccaauccugguuaaauagcugcccacaauuuacaaugcaaagagauagcacaugaaguggaaagcugaagucagugcuguuagccuguggcucuaguaugaucaguugaguccugcauuaaauugcugucagagguuagucacaugaacuguuaaacaaacuuaucaacccgagaaacagcugggaggucuguaggcuuuucugauguugaguuacaucuagaaacuauccugaaccucaggauagggcuguagucauguggaggccauugccucauauuguucaggccucuggguuccauccccaauaccacagaguuuuccaugagucaaguuuucccuuuaaauuauucaggauguagcugggcgugguggcccaagccuuuaaucauagcauucaggagggagagacagguggauuuccgaguucaacaccagcacggucuacagaguaaguuccaggacagccaaggcuacacagagaaacccugucucaaaccccccccccaaaaauuucaggaugucuacuuuaccaaauuugucaaauagccucaagugcuacaaugguuacuguauuuuucaucucacuguccagugaucucugagcuguuggagauuguuguaaguggacauuuguguuuugcaucaagcagcccaacaauuccuccuagcauguucuaggacuggaacacucuuaguacauugauuacauucauacuuuauaaaagacaucuaguaaagaaauuacacagugacuugauacccuuuuuguaagucuuguuaaguccccucuguuauguuuuguauguaauaucuagacacugaaguccaacuguccaauuucauggucaggucagagccacugaaauucuugacggaaaaaaaaaauaaccuuugcaucgucagaucaucuccaccuauugauaacaagugucuuuccaguacccuugagggaccuucacaguaaugccuacaagauuauguccccuuacagagucaccuaacaaaguucuucaggaaaacagagaaagauucucaaggaucaugaccucaucuuucagugccauagaggucaaaauuaaggauguucugaaaacccagugugaacagagguaggguuguugcuucuugucacuuugaucccagagcuguugacaguugguuugugagcacaaugaagggggaauagccaguggccccacuggcuagaagcuuuguuggcaagucaacuugccuuguuuuuucuguaggacagacuuuguuuugucuuauacccucccguuguaacugaagucaaucaacugcauuuccuaaggaugaauuaagauguuuugacacagggcaguugaaucaguguaacaguaaguaaggugugugcauuguguaaaaguucugggugcauucaguuugaaauccucaaaucauccauccuggaguccuucaucucuucagugugaaaugagaugaaaaucucuagccuccaauguggaacagguuuccggaggagcccgguucaccauacaggugugcugaaauccucacggguacagugauaaagaguggguagacguccacagaauucucugauggucgugggugugcauccucauuggaccuaucuucauaaugggaaaauaaagcaggggcugugcucgucagagagacuaauacuuguggaaugcuaguaagacaauccugaguuuucuagcacuaaaagcugugaagugacuccugucucggccaaggagggacacgugcuauuagggugguaggaacuaauccaccucauuuuccauuucccugucagaauauuuuagaucuccuuucccagccuugcauuuagugaaggaaagacagucgugcuguguuugaaugggcuuucuucaugucaagaaggaauaucacaguguucaccguugucuuuuacaggcagaaacuuuguaaggaauauucucuucagguuacaaauuugaguaggaaguuaacuucggaugcauacaaacucaagaaacaggcuuagcuuuaaaggaguccauuucgucagcaucagggguagcaacagaggcuuccugcagcaggucuggagggaaggggcaggacaugagcucugggagacaaggagggugguugauguggaggggagagacuggccaucaucccugacuugguuuuuugucccccuucugugggaagaugacaaggguaaugauggguuaggagcccgcaugguacagguguggccggaugagcagguacugucugcagagugcaggaagagguaugggauuguauuuugagaggggacccuucaggaucgacccaguacagaggccaaagaguaggagggccccacgaagccuucugacacagugaucagggaugcggagugagagcaguucauggggcuguggaggagcagguggagacuuagcugccagugugguuggaguucagaccagcccuguccaagaggagaagagggaaagguucccaugcagugauggauggaccugggauggugacagggucaccuuuugccuggagaugagaaugggcuuugggggacugguaacuggacucagugcugucucugggggcucuuucuuccugguggaggauggagcugcucccuggggauucugacuuccaaagguggggaagcagaaggggaacuacugagggguauggagaugcuguccagcccagcucaggucaggagccuggacucuggaaucccaccaaguggauugcagucacuguccaguuucuugcuaguuaugcuaacucagaaaaaauaauuuacaucugugccuuaguuucuugggaguggaaggagagaagaaguccauacguaucugaaagaauuuugucaaagauuuguuuuagauguguauccuuauauugguacacagcaguaucugaagucagucguaaagaauauaacccuguuaguguggcacugugugcucuacucuuacuggaaaggccaaaguggagugggucccuauguggaggagugacaaaugauggggauaacucaagguagguucuaaaaauacagagaguccagcagauuugaaggccucuaguagguagguuaucaagacuucaggaacuacuagcaguguuuugaguacuguuaaauaggaacccuucccauuaaaugagugagcuucacauaaugaagguuauuuuucuacuauuagguuaguccuguaaauguggucacuguuuuaguugaaaacaauuguaaauguuuuucacuccaucuguuuugcauaaauaaaauaaaaaauugccuuuuaugagcuuccugucccccccucacuuguucuuacaucuuacacugccuuuguuuguagaauauguuuauggagcaacagaaguuuauucaugaaacucucacucuccagaagaacagaauggaggaauuuaaaucacugugugaagaauacuuggagguguguugaacaaccucuacaggggacacugaauauccugguauucuuucugugcuuuggauaacagcuuaugaaaguuaccugcaaacaccuuccaccauuuccucaugcuccauguaauccuaaguacaaagucaguuuaauuuuagcauucacucaugguuaggagaaucauucaaagcaggacuugcugucuugguaauuucaucuggagcuguucauauuguaaagggcacuaaugcucuucagcucaucccaucuugacucacaguacauuuuuucauuggguauguaugugcacacaugcacacaugcguacuugucugugcauggguguguagaugucggaagacaacucuuacagacacacuucaucauauccuuuuuuucuuaucucuagguuuuugauuguuugguuuuaauuuugaaaaagggucucacuguguagcucuggcuguccugaacucacuaugucgaccacucuggacucaaacucacagagaucuaccugccugccucugcuuccugagugcugggauuacaggugugcaccacugugcgggacucccaugauacccuuuugaaacaggaugacucccuggaccuggaacuauggcuaggcuggcuggcugcucagcaguuccuuugcugccacaggucgaugugucaccaugccugacuuuuaguauuuaugcugaagagcuuacguuggccuuuuaugcuuauggagcaagcuccuccacuacugcugcauucuuaccccccaagaauuacuuuuacacacugcaguugucgucccagacccucucguuccaucuuuaagcagacuagugacaagaauauuuguacuuacuucccuugcucaguccauuuacauuuccuaucauuguaggacugaaacauggcuucauauggccaauuagaaccauaagacagcugccagguauagcccucaguaagaaaguaaguggaagacagagagauugugaauugagaguuguccuccauaauagucucucuaaguucuugcuaggcacguugaauguccuaugccgucuucagguuuguagcucucuacaagacaauuaaauacuggacgcucuacuuuuguuucagacucaaugugaauuggcuuguucaaguugcaguuaaaauuuuauucauccagaguaauucagaugacccaaaacaaccaaguugacagaauucauccuugcuuucuuaaugccugucuccuacaaaaaaaaaaaaaccuaccccaacacacacacacacacacacacacacacacacggggcggggauuaguggccaguguguguuccugcugaaauaucauucuuuaaguacucaguggcccagaaacuugcucagccauuccaauguuaagaucucuguguuguuccaguuucuguggucacugaacaagauuauggaagagguccugccaaguuuuauaaugccuccacaguauuuagcaagacuguagauguaguaugugcuguuucacucagugcuaaagggaauguggagguggaaaccuugaguuuuaaguuccuggugcacaguggucauaguacgggacaaguuauuccauccugcuaagaagugggcgaguggcaaugaacgggcucaugcuucaugcucuguuugcauuuggcuucauuggcuuucauuugugcugugcauggagaguuaucccagacucucagacaugguaggcaagcacccuuccccugggccaccccuauagcuaaucccucacaauuugaccauucagcaguggguugagaaguggcaaagucggugucacuuugguguauguuuugaucuucuucuuguacagggugcgugcucgcugcuucuggaguaauuuuuggaguaauuaaaccauguuuuuuuuuuuuuuuaccacacuugcucccuuugaaauguugauguucccauuugaaagacaaaaugauccgagcugauuuccucacauguuuuuugcuucagaaacuggagguacugagggauucucggggaaauuccaucgcugaagagcugagacgucucauagccaccuuggaaauuaaacuucugaugcugcauguaaguaccuagccuuuccauagaaaauggggauaaggccaaccuugagugcuauuuauuuuacgcccauuuaauauuuucaauacuuaacagaaccagcaaaagacugcugcuccuccacagucucuccuggaugugugauucucauaau

SEQ ID NO: 9582 - RNA, 13924 nt, Mus musculus
cggucacaccuccguggccgaaucagccaaugggauugaguagacaguccgcggguucguagagauuccugcccccguaccccguccuguccuccuccuccuccuccucuucucuacgucccuuuuuuauaucagcaagcuaggggcggugcaacggugggcggguccuaaugacgugcccggacgggucucacaccauaggagucuacaguucuuaguuuguggcggcuugggcgggacgcacgcggugcaguucaagauggcggaugcagaagguaagagguucugguggcagugccaugagaccuguggggccuccuacacgacccggagcuaguuauagugagauugcaucgugacccgcgguuccccguguucccgcucgcaguuuggcugucucaccacucggcucuggcucuaccugugaaugcacgcauucgugaccagugacuaggcuucauuagauccuggcuucgugcaaaagauucuaccaggguccccucccaaaggcaucagccguggaggcgacugugucgugauaaggagacgcgguagcauuucugcuggcacuaggcaggacauuauggaaaugaggguagcaaaggugcagagcaaggguuaggaaggaaaggaacagaggaguuggaagcaaguguaacucagaccuacaagaaaaacuuuaagagaucacaagccccuauggacagugcaguguucguuugugaaacuuuccagccuguggacaagugcuucccuaaguaauauuuggccuugccacagccacguggagaacccgaagggaagccaacacgugcuagagucauuuaccagccaagccauccuaguguuuggccucacaaacguaaguucucuccaguaaugucagacuuuaaaauguuuucuuugucccgauuuuagaguuaauuuuaaacuuugguuuuaguuuucaaaaucuucaaauauugaguuuguuucuuguaguaauuacauucccaaagaagcauaagaagaaaaaagaccggaagccauuacaagaagaugauguugccgugaguagaaauuuacuuugcuucgacugauugagauaauuuaguaaacagcacauuaaagggggaaagugcuuuuaaauauucucaaucaauaugcuaguacuuaguggucauuauguagaacgggcaaaaaccugaaaucauacaacucccagagaaauuuucuaacaugcauggcaugcuaaauggugagcuauugacccugaauuucucugccuuacuccaucagcagacccaugguuuuguuaaaauauuuggauucaacuugaucuuccuaaaguugagugaccuggguuucagaaaucacaccccuccuuuccucuuguuuaaaaggcaugcacuuccaaaauuaagcugagaaauguuucugcucuauugaaggaaauacaacaugcugaagaauuucuuaucaaaccagaaucuaaaguggcucaauuagacacuucucaguggcccuuguuacuaaagguauguuuucuguguaucagauggaugcuugaauuccauauuauuucuaguuaaugcuuacugcugggguguuguguugcaugcucuuuauuccagugggccaggcaagccuaguuuacauaaagagacccugucucaaaaaaggaaugcucacugccagcauaguuuacauuuagaaaacuuuaaaugauguagcauggaauauaguaugucaccaaaaugucaauugcuguuagguuuuagacaauugcacuuuugaaaucaacuccuguagacuguuucagugccuaagaacaugggguuuugaagccagacgccuuugaaauaagaguauaugugauccuaggccacuuuuuuuuuuaacaauuauuucuuuuaugugaguauauuguaacugucuucagacacaccagaagaggagggcauuggaucccauuacagaugguugugagccaccaugugguugcugggaauugaacucgggaccucuggaagaacagucaguacucuuaacuguugagccaucuccccagccaugggccagucuuuuaaccucacugaaucuauuaauugcucaugauuauuuucucuuaggaugaugugcagggaguuauaggagguauucuaugaagcaugcuuaguuuacgguugcaugucauagaaauuauagguuauuauuuagggauuuaauuagugauauugaguaacccauugaacuaaaauuuauaauuuucacaaaguggauaccagcuauaaaguuaagacaucuagcaaagaagauuuuaaaauauaaauuuaauauaaauuuuuauuucaucgauuacagugugugggugggauguugggggugcaugcuccacauggcauacguguagaagucaaaagauaacuugcaaaguuuguucucaagugucgugaguuacuaguauugcaguuuucccuaguauguaggaaggcuuaguagugugucauuaauaaugggaacaacauacauuuaugggcuugaagggcuacagugguuggugguguuauuuacugacucuuguuuuacuucuauugauauguuauuaaacuuauguuauugcuuucuagaauuuugauaagcuaaauguaaggacagcacacuauacaccucuuccuugugguucaaauccucugaagagggagauuggggacuauaucagguaggcaugcucuguccaaacuuaaagucuuuugaaacugaugcucucacugaauuuauuuguuauucaagggaguaguaguggcagcuuagaacagcuuuguccugaauauauaaccuaaauaugugauuugcuuuucuuuuuaugucuucaugcuauuuuuuuuagacaagaacaggaggugauuaccuuuuuuucuucuauuuuaggaccgguuucauuaaucuugacaagcccucuaaccccucuucccaugaggugguagccuggauccgacgaauacuucggguagagaagacuggccacaguggcacacuagaucccaaagugacugguuguuuaauugugugcauugaacgagccacucguuuggugaaaucacaacagagugcagguuuguaaaagagagaguagggggcuauacuuguuucuguucuuguuucacuucuacauuuuggcucuuagaaacuauuucuuuagaaaaaaucuuaaagcacgagugugaauugguuucuguuguucucugccaaaaucuggugguucuuuaagaguuugagacacuaagcauguggauauugaaucaacuguccuguuccuagcgcugcggcaggucacuuguaugcuugcugguucugcucuuuauuguguucuugguuuugcagacaggguuucucuguguagcccuggcugucuuggaacucacucuguagaccagguuagccucgaggauucaccugccucugcuucccaagcgcugggauuaaaggcgugcgcuaccaccaccugccauguuuacugcuucuuaacucaggucauguuucuaauguuucuaucucaagucuccuuuccccauuuucacccaagaaaauucugcuuaaaguacaagguauuuuccuguuagacucuacaguagguauucccucugugucugccaucacauugagcauuaaaaugugugugugaacgugagcgagcuuuuuccauccuuuccuuccuuccuuucuuuuauuuuuuuuccuugggcggggggguuugagacaggguuucucuguguagcccugacuguccuggaacucacucuguagaccaggcuggccucgaacucagaaauccaccugccucuaccucccaagugcugggauuaaaggcgugcgccaccacugucugaccauucuuucauuuuugagacaaggcuuuucuguguagcucauguugcuguggaaaucucaauuaucccaucucagccucuaaacuucuggguuuagguuauagccauggcgugggcuauuccugacccaagaaaauuugucuuuauuucuuuucucuaucuacaacauuaagucugucaguacagauuuuacugaaacagacguuggauucccuacugcuucugccacuucacguggcagugauagaacauuuguaaaacagaaaacucaguggccacaccugacuacucuuuugucauuuuuucaggcaaagaguauguuggaauuguccggcugcacaaugcuauugaaggggguacucagcuuucuaggguaagucuauaacuuguagggagcauaccuuugauuugggucucugaacuccaggaaaguucuccuggcuagugucucuugugcucuuugaaugggcuguccuagauuccugggugaugaaugacuggugcuagggaugccuucuagccaugcuuuuucugugaaggacauucugauuagugcugagcuaucccuucguaguugaaaaagaagaaacugaacuaauuuuaugaaagaaaacuuuguauuugaauuauguucuuaaacucccuaaauaugccccuuugucuuauuuuaaaaugagcccacauaauuuuuuguuugugcuuuguucuuaggcccuagaaacucugacaggugcccuguuucagcgacccccacuuauugcugcaguaaagaggcagcuucgagugaggacuaucuacgagagcaaaaugauagaauaugauccugagagaagauuaggugaguuguuagauauauaucaagcugaauugcuuuagauccacaagcaggugggggggggauaauauauuaucagggauucucuuguuaguaguagaaacuuuugaguacauuguguagucauacucuauucccuaugucuguucccuaugucuuucuguuaguuuguuuuagauuaggucucuccauuaaguagcucugguuguuauggaaauugcuguuugcaauucaagcuguccuugaacucaauagagauccaccugucuccgccucuugagauuaaaaucagccuccaucacgcccaagguuugaaaagaaaaucauguguuuacuucucucucucucucucucucucucucucucucucucucucucucucucucucugucucugucucugucucucucugugugugugguguuugucuuaggaaucuuuuggguaagcugugaagcuggcaccuacauucggacacuaugcguacaccuuggcuuguuacugggaguugguggucagaugcaggaacuucggagggugcguucuggagucaugagugaaaagguaugcaguugugggacuagaaguuugggauuuggguuuuguggggauuuuugauguuuuuucuuguguuguuuguuuguuuuauuguuugagacagaguuucuauguguagcccucucuguccuggaacucccucuauaaaccagacuggccuccaacucauagauuuacuugcuucuaucucccugguacuagcauuaaaggugugcgccacuaccgcuggacuuggggcuagagggcuuuagaaaucauacauagaacucugucugcuuuccaucuuaggaaagauuucauauuguuuaguucaguucagggcagcuuucauguucugugaauuaaacuucgggacauugaaauuggcaaagagggcgcuggggagauggcucagcaguuaagagcaccaaacugcucuucuagagguucugaguucaaauuccagcaaccacaugguggcuuacaaccaucuguaaugggaucagaugcccucuucugguuugucugaagacagcugcaguguauucauauacauaaaauagauaaagucuuuaaaaaaaauaaauaagaaauuggcaaagaaaugauuggguagccgggcagugguggcacacgccuuuaaucccagcacuugggaggcagaggcagguggaggccaccuggucuacagaguaaguuccuugauagccagggcuacacagagaaacccugucucaggaaaaaaauaaggaagagaaagggagggagggagggagggaaaggaaggaaggaaggaaggaaggaaggaaggaaggauggauggauggauggauuggguagagaguauuauucauacauuucuuuccuauucuaccuaugccagucuugcuuagaucuugagaguguuaaugcagcuuuagagcauuuggcaaccauuuguaaacaccuggguuccaucccaagcaguacaaaaaaaaaaaaaaaggauugacugcuuagaucuaauuugucaacauguacagauauuuuauggagauucuaaagacuuaugaugagccuggacuaaaagacaauuuauaguuauauucaguuguaaaaaguuuaggagucagcaaggcgugguggccuuuagucccagcacugggaggcagaggcaggcagauuucugaguucgaggccagccuggucuagagagugaguuucaggacagccagggcuauacagagaaacccugucugggggggaaaaaaaagcuuaggaggagucugauggacagaagaagauauacaguaugaagucucagaguuuaauaucuuacugccuuucaggaccacauggugacaaugcaugauguacucgaugcucaguggcuguaugauaaccauaaggaugagaguuacuugcggcguguuguuuacccuuuggaaaagcuguugacaucucauaaacgucugguuaugaaagauagugcaguaaguuaugggguaaaagucaauguuuucagagcacgugucuccaaagaugagaugcuagcauuguaaaaucauauuuaucguauuuuuauuuuccuugugguuauucuccucccccucuccucccccucuccucccccaagugauaucuagaauuugcccucuuuuaauuuguuucuucuggcugugccuaaaauaaucuugauuuauuuaaguuacuauaacaaauuguuucaauagguaaagguugggccuggagcauuucagagauguuauuuacucuguaaggauuucaaugaaaugcugcuuucuucuguugaagcacauuaucaggccugguauaauuuucuuagcaaguuguuuugagucuucaucucuaguaagugcacuauauuuuccugaaaaagauucaagagcaguucucuggaacacuuugauagaaaacucuugaggcagcuuuuggguuuuuguuuuuuuguuuucaauuuuuuauuagauauucucuucauuuacauuucgaaugcuauccuguauauaugugugcacacaugcauauggagguuagucaaggauaacuuguaggaguugauucucucaauucaccauguguguucaggaaucaaacucagguagucaggcauuaggcuaaguaccuuuaccugcugagucauuucucuggcccccaagaccagagaaauggguuuguuuuguuuuauguguauuuuguuugcguguaugucuauaccacaugcauaccuguuaucuagaaaggucagaaaaaaugguauugugcccccucgggcuagaguuacauauggaugauagccuagaaaugggugcucagaaacccaagugcucugcaagaguagcaagugcucuuaacuagugaaccauuucuccagcccccagguuuuauuccagaugacaaugcucaugggccacaugauaaaagucgaguuuaauaaccuauuuguauaaucagugaagaaagagggguaacauuuuuuauuuuuauuauguaucuguuaugauguaugcgcgugagcacaugcaugcugcaauguauguuuggggcucaguauaauuuuguggagucuguuuccuccuuccaucuuuuauugaauauggaugggccaccagacuugcugagucaccuguaaaguuuucuuuaguauuuuguagcauaugugaaauuuuuagaguaguguuagcacaugauagguuuuuguuauggucuauguucuuuuguacuucacuguagucaguggacuaucaguguuauuaguccuacuuugcggagagcugguacgugcugcgagcaaucgcgugagugccgccaguaaucucugaggagagccgugugugccgcgagcaaucgccauuauaagauggcgcgggccuccgcugugccuaacuaguaaacaagccuuguacgcaggugcgagagugaauucacuccuagucacucccauucuccggguguaauaguggggugaugggcaagcaacgaaccaggagcugucacgccauaucaggugcugaaacgucacgcugcggguuauaaaagcagcgccauuuucccgguucggaaucuuccugagaagcaagcaauaaagcucuugccggaagauucugguuuguugcgucuuucuugccggucgagccggacgcaauacuacuucccacuauaaagcuacuuccucuauucugguauggaaguggaaaggggauaauggauagcauuuggcccucaugugugguguucucuccauaggugaaugcaaucugcuauggggccaagaucaugcuuccuggucuucuucgauaugaagauggcauugaggucaaccaggagauuguggucauuacuacuaagggggaagcuaucugcauggguaaggaagggaguagcccucauuauuucuggaacugaaucucugcaucaucaaagcuagguucauugugggccagucccaugucagggucccuugauuuuauauaaucauggugucucuugggguuuguaugaauaauuuauaaagggaaugacuaguugaauacagauuaaagaggaauuauauauuuauaugcucuuggcugucuagugaaacuccacaaguaagaguagugacaguugucugugaugauuaaaggagagccuuuaguucauuccugguuugcugacugguaacuuguaguuaguaucagugacguuugguuuuugguguuucaagacgguuucucuguagcacuugcuguacuggaacucacucuguagagcaggcugccuugaacucaaaagaguuccgccugccucugccuccagagugcugggauuaaaggugugagcuacuacuauuaacaucagguguuaucagugacuuaauuuguaaacguuuaacuacuauugaauugguuaucccuugcaacuugcugugcucuguggccuucucaauaaguccaagcuguucauuuaauaauccuaauuuucaccagaaaaaaagucaugucaccagggucccuguaucaguucugugagaaggcaccugugaaagguccauucugauauauagcagaacagagauucuaaaaacuugaaauguuuguucuauaaaccugaggguggugugucauuccugcaccuguuuuuuuuuuuuuucuuguuagguguuucuucaguugcuuuuguuaaguguauuuuagagacuucucuuuuuuuguuguugguuuguuuuuguuuucugagacaggguuucucuguguagcccuggcuguccuggaacucacucuguagaccaggcuggccuugaacucagaaaucugccugccucugccucccaagugcugggauuaaaggcgugcgccaccaccaccuggcaaguguauuuuaguuuguuaaguuuaacaguauuuuaaguacuuuuaaguauuucuuucugugauggagacauuucuccauacauccggagcaaaggaaagcccaguuaagguaauagagcuuaggauuuaaagaguucuaaaaaggcauaaaccaguagaaaucauuuauuaccaaaauauucuuuuuuuuucuuucuaaucccugcagcaauugcauugaugacuacagcagugauuucuaccugugaccaugguauaguagccaaaauaaagagggugaucauggagagagacacuuauccucgcaagugggguuuagguccaaaggucagugguacuagguuauagcccuuccuggguuguauuugcauuaauaaguaccaacaaaugcaggucuuuguuggccauauuugaagcucuagauuauugucagugagcagaggcaugcccugucuuagacuucagagauucucccucuaguuaagagaaaccuuugggcauuacuuaaucucacugggguugugaacuaugacugucaaaaauguggaguggucucuugguuccuagaguauccacagugaaaguuuuaacuucaucauggaucugggcaagauuuuuccacuucagcuauugugaagaauagguuagagauugaugacaauaagagaagagggaacaaacgauucaggacauuuuguaaggggugugaagcugagaauauguaagaaaccuugcuugugauagucugugcagacugggucuaagcuguagucuauaaucauaauggcuacuuccuguauugacaguagucuaauguuuggaaugcuuccaggcaagucagaagaagaugaugaucaagcagggccuucuggacaagcauggcaaacccacagacaauaccccugccacauggaaacaggauuacauugacuauagguaaggauggaguuuguugguuuauuccauugucuuuauuuuauuucuuuaacuuuauucuuugugaauuucacaucauacacaccaagcgcacucaucuccccaugccuucauauccauccucugcccaaggcaacugccacccccauaaggaaaaaaguuuuggaagcuguaguguguuacaguguguuacaucuuuacuugcaaugaaucauuggacugguuugaggccucuggcuucugcuacacuaucaauguuggcuccucacugggacuccucucuguuggugccccaugucauggagauccugcagcuuuagauaugcaggaccagcccuuuuaugugcugcagcaguucauagaugggguagauguugaaauagaccaacucaaaguucuggaugugggccugggugguaaggaugggcuuugggggacugggguaauguaguacacuugaguacaggaaacugcacagccaaggggagauggacgguuuuauuugggauaagugcuaaaugcuuugccacaggcccuaaugcagcucacucuuucccuugcuuggcucuuugaaaccugggucaguaaguacuaguagucagggcauggacuguggagauaaucagucuguaaaaccaacuguugguucuuuugucuagcaucaguguuuuaauuggggguuuuaggguugcccaguaucauugaauaacaaggggcaugauaagauauaauaggaccaccauggaaaacucuucuaugaaucuaaccucauauuaccuuugucuuucagugauucuggcaagaacacacugguuaccgaagcaguacaagccccucaguuagcugcugaagcaguaaaugucauaaaagugaguggcaugaucuguuugaaaggugcuugcuucaaacuggguggggugguggcgaaugccuuuaaucccaguacuuccaagacagaaguaaagcagccuggucuacaggagugaguuccaggacagauggagaaacacugucucaaaaacaaacaacaaaggaaagaaagaagugugcuuaaagagauacaccaguguuuaagguagucuagccacaaguccuagcaaguaaggcaggcuuauccaugcagugcucuacacacacuaucuccuacuugaggauguuuguuugguucaguagcauuuguguugugucugugguagggggaguauggacuuaagaaucaauuaccuugguuccuaccuccacugugacacaguguggaguggaauaaccuuguguggaaugugucacacauauuuugacucuacccuggguuaaauagguagcauaaguguauugaaagcagaggccucaaugaaauucaggaggaacagaauugucagaaaccaaaaaaauauuucuaguccaugcuaacucacuguuuaaaggacaagagugaagcaugugguaguaaccaaggcugggggccacugucauuagagccccaaaugguauguuugcugucuugagugacuaguaaugagcuauauggguggaacuugcaaguugucaaagagcaccuuaagucuuggaguuggcucacugagacaauuucucagggucuuuuauacgcaacgcugcuuuggcacauucaucaugccccauggcuuacuauauuuuuuauuuagugagauacugucuucaaaucuuuagaaaaucagacacuauucaaguuuauagacacaaaaccauugaauauacguggaaucuuucuugguaacuuccuacauuucuaacuucaugugaauuuuuuuuacacagaggaagcgggauagugagagugaaagugaugagaccccaacaguuccccaguugaaggaaaagaagaagaagaaggauaagaagcccaaaacugugcuagaaagugggggcgaaacuggagaugggguaugugugaaccaugggugugccuuugugucagcugagucuuugacaggaauugugcgagagugggguuccuaccauugccuuuuuuggugcugcccuguguucuagauuugccuugucuaccuucuuggacacagaaguaggggcacccagccuuucagaacaguggaucaugguugaauuauguugcugcuggguagggaagguguauuaaguagaucucucuaagacuucaccgagaaggucacaggcaaaauuuguuuaaccccaaaugucuuagauuuuugaacagacuugacugugcaauuugucagauuucuuuugggaacaguagucauaaauguuuugucaguggguacauugaacuuacuuuuacuuucucuuucuuuaggacaacgacaccaccaaaaagaaaaagaagaagaaaguaaaagugguagaagagaugucugaauaguuuaagccacuucuggaagcauuauguccagcugggaagaaaaagaaaagccuuauuggaaaaacuuuuuguugagggagaacagaggucccagaguagaaaguucugguauacuuuuagcugccacuugugaccucagugguuagcugguguggccaucucaucccauccuguccuguuuuaaggauaugagagauaaaaucaggccuuugccaccaaccccucugcuugcuugaggaagccacaccuuuagacauggcauggccuaguaacuaucugcagcuauuuacuaaugagcauuuucaacaaugccauagauaguccucuccuacuuugcuuuuuaaaaaguugguaaaaauuaaaucugcuacauaaaaugguauagaaccuucugugagagaaaaaauguaauugaacuauguucacugggggacucuuaucuccaguguucuaugaggacugcucuauucagguauuaaccuugccuggugguaucuaugauauuuaggcuaguacucuguauuuuuguguacaacaggauuucucuauauggcuacuuguguuucuuauggaagccaaagcauuccuguaccuuccuauuuguuuucuuuuaaagaauggaauugccgggcgugguggcgcaugccuuuaaucccagcacuugggaggcagaggcagguggauuucugaguucaaagccagccuggucuacagagugaguuccaggacaguccaggcuauacagagaaacccugucucgaaaaaaaaaaaaccaaaaaaacaaaaaacaaaacaaaaaaaccaaaaaacaaaaaaaacaaaaaaaaaaacaaaaaaacaaaaaaagaaaaaaaaaagaauggaauuguucagaauggaauuguucauugcugaagaauguaauuuguaguuuuuuuuuuuuuaaaaaguauuccuguuagauuuacuaugauaaucuuggacuggcaacaaaagugagagaauauuuuuauuaaaagucugagguuuauguccu

SEQ ID NO: 9583 - RNA, 22324 nt, Mus musculus
aggacaacgacaccaccaaaaagaaaaagaagaagaaaguaaaagugguagaagagaugucugaauaguuuaagccacuucuggaagcauuauguccagcugggaagaaaaagaaaagccuuauuggaaaaacuuuuuguugagggagaacagaggucccagaguagaaaguucugguauacuuuuagcugccacuugugaccucagugguuagcugguguggccaucucaucccauccuguccuguuuuaaggauaugagagauaaaaucaggccuuugccaccaaccccucugcuugcuugaggaagccacaccuuuagacauggcauggccuaguaacuaucugcagcuauuuacuaaugagcauuuucaacaaugccauagauaguccucuccuacuuugcuuuuuaaaaaguugguaaaaauuaaaucugcuacauaaaaugguauagaaccuucugugagagaaaaaauguaauugaacuauguucacugggggacucuuaucuccaguguucuaugaggacugcucuauucagguauuaaccuugccuggugguaucuaugauauuuaggcuaguacucuguauuuuuguguacaacaggauuucucuauauggcuacuuguguuucuuauggaagccaaagcauuccuguaccuuccuauuuguuuucuuuuaaagaauggaauugccgggcgugguggcgcaugccuuuaaucccagcacuugggaggcagaggcagguggauuucugaguucaaagccagccuggucuacagagugaguuccaggacaguccaggcuauacagagaaacccugucucgaaaaaaaaaaaaccaaaaaaacaaaaaacaaaacaaaaaaaccaaaaaacaaaaaaaacaaaaaaaaaaacaaaaaaacaaaaaaagaaaaaaaaaagaauggaauuguucagaauggaauuguucauugcugaagaauguaauuuguaguuuuuuuuuuuuuaaaaaguauuccuguuagauuuacuaugauaaucuuggacuggcaacaaaagugagagaauauuuuuauuaaaagucugagguuuauguccuauuuugaauuugcuuuuccuuuggcuacuuuuaaauuuccuaauucugagucuuucuuacauuggcacuggggccuaucugcucucaagggagaucauuacuaauccaggguuaagaggaaagggguagaugcauuuauauuguacugggcuugugaagagguuggagguacuccagguaggaaacugccaguuuugguguugacugcagagggagcagggaacuuugcuuaaauaugugcccaaaaccaagaauauaaacacaaguuuuaggggaaauuguuaauagcauaggcagguauagaaugcccaaacagccccugcuuuuguaacauguuuuaaaccauucucuuacgacuuaacaaguccuagagaagacgccuuugugcauugugaauaccagaccuauagaggcagugacagguaauucccagagaucuuauguuaaugucauugcuuggaagguuaagauugggaauggaguuacagggucacggguacuuuaacacagcagcauuuuuauugcuuuggaagauuuucccuacagcagacauucuauugcacagcuguuugauuuuggcauuuuagaaaguuuucagaagauauuuauuccagaguaaaaagacauucuauaguugaaagcaaaggagcucaggcuucagggggacaguugguuuaucuauguagcauugcauuugguuauucuuauggcaauuuuccagagaucauuuugaaauguagauaguaggaaagcuucaccccuuuaggagccugaguaagaaaacagcagagcuaaaaguugaagcaacccuuuuggcuuaagcaagggagggggugcggggagguggcauuccaaaugcuggcugaaacauguuugccaauucuguaagcuuaguaaacccaggagacaggcacccacuguggagaacugcaagccuggucaaaggcuucuugcaauuucuuaagaguuucaucaacacuauuauucaccaaagagaggucaaaguaaugagcauacugacuacggauggccucagaguccuucugcagcugcugcagggcuucagucugcaaagaagaaagccauagaugaagcagcagucuuuaaucacagcagcaaagggaagauuuaaacaaguuuacauuaacugguuccccaucuguuuuuuugcaugguggugauccauccuguggccuaguaucugcuagguaaccaauuaagaauauaauguuugccaaagggguugagaaccacuuaacuauucuaaugaaugccaaacuaacccuaauuaccuagcacagccuucacuagcauucacuuaguuuuagcccuuuguuuauggaaaagccauuuuagcaacuacuacagcuauaauccaaggauaagggagaaaguuuauugacaagucucaagccucuggcuccaauggucaguuaacuacauaaaggcaaaaggauagagaaauaugugucauaguggugguggggauauuuguaacuuucauuacagggaaguaccauaauauagaauucuuagaugaagucacuaacucaauggaaacaugagcuaaggauauggccagauauacaagcaauacaaauaacuuuuaauaaguguguguggcagucuuauugacucgacugccuuugaacuccagacuggccuugagcuccugauccucuuccuuucaccucccaauugcagugauugacucucaauaguaagaaacaaucuuuuauaguaaaacaaagugaaaaugccauucuucuaaaauguuaaccaauucuuuuaaaaauguuaugaaugauguuaaagaggaaacagccacuuuuacaagcaggcuccuuucccacuguagccacacugcacccugugauggaucuaguaccaccuccauccuucacagcuccuucuguuugcuucacaucaguauauaucauauaagaaauaggauuuauuuaacuguccgucucagccauuagaacuguucauucaggacuaugacuagaauugaauuauuuaauaacuaaucucuugaauaacucuggaaugaauaaaauaugcaugcccuuugucuucuuggccuuggaaaaaacaguugacaaugaccuaaaagguguggaccuccacccaugugaccccuuucccaccugagugcccuggucaguaggugcgaugaacacaaugaaaggugaaagcucagcuguccgaacagucuuuagggucuaggaaaagggaagaaaaggagaaacaaacaacccaguugucugucagaauguauuccuucuaauaaguguuaaaucccaauaccaauuuguaucaugcugaccccacuaaaacuuuaggaagcaagauuuccaggagcucacgucccucauuacauggcugaaaccauuguuccugcccuuuuaugccuacauaccuggggcucaaugucaaggauggcaaucuuguccugcuuaugaaucuggugcacuguuucaaauuuggugccaaacauguugcccugauagcugccaaacuccaagaacucauuggcagagauguucuucgucaucuccucuguugagaugaaaugauacuccuucccaucuuccucacucuucuuugguggccguguuguaucuguguauaagaacucaaauccuugaugagcucuucuugguccuugcuaucuuuuaguguacugacucaaaaugucuauauggaaacucuacccaucuuuggggcagauaauauaauagagauguuuuucucaugaacugaaggauugguacuggaagguaguacagauacaauacccccaccuacccaucucuccagcacuguuuuguuuuuaugacauggaaagaacacaaugguuuuguuuaaacauuuuguuaaaaaguuaaaauguuggggcuggcaauuuuucagcauuugccacagaaggcucauaaccugagaaccugaaaccaugugguggaaggaaaggacugacuccuauaaauuguauucugacuuccauacacaugcuauaaaaugagugcacacacacacaugcuguggcaugaguacacacacugcauaauaauacuguauaauaauacugaguaauaaauaauucuuuaaaaaaguuaaaauguuaagaguaacacucuagugcagagauaaauuauauauucccagccucuuuuuauccuaugaugaaccaucuuuaccuuccacgccagacacuugucucuaaaaugacuucuuucccucaacuugcacauugaaaacccuggcaagggugugugugugugugugugugugugugugugugugugugggugugugccagugccaugaugugcauaugaaagucaggggucaaccagugggagucaguucuacuaccaugugguucugaggguuaaauucauauuguuaggguuagcagccaucuccucagcccuauaaguauauauuacauuuccaaauauuuuguguuuuaugugugauuuuuccuuccuucccccucucccuuucccuuuccuucucccuccuacucccucuuucucucccucccucccucccucccuuccucccucccucccuuccuuugcucuucaauguggauuccaaagacugaaaucaggacgucauacuuuccgagaacuuuacugacagaguuaucuccccaaccccccaaauuuucaguuuucaugauuaaauauaugaaauaaaauaacaagaacaaaaacaugugacauuucagaaaaacacugauucuaaauuuuguaacaggacauuucugccugacccuuaggcuccugagaaauacuuacauggggcaggguacgcaaacuucucuggauugugacugagcagaccauucuuaauauggcuacgacccaccccacuggcuccugugugaggauaaagaaaggcuuccaucacuuucacucagaaacacugcuggggauaagacaaggaaugggagguggauuucuauaucccagugcucaaacaguucgguguuguaacaaggcugcaacugagucauuacaauugucaagauuuggggucaccaaauagcuucaauuccguaguauccauuugagugggaagucauucuaaggccuaagaguuaagauauggaacauaauugcuauuucuucagaggaauuagcuacuggggaguuuucuuuuuauucccuaagccauccaaacagguagacaaagagcaaacuuaauauaaaagaauuaugugcuaaaaacaguagaaaaccguguaguaugaaguggauccagauagauuacuuguaggauccagaaguucuuuauaacugcuaugugagguaucuaagagaccacacuacauaucuuccuuacugccuuuccugaagaaggguagacauauaacaugggauuggaaauaaagacagaauugugcucuugaauuagcaaauuggugaggagcaguaaaaagauaccgaucaacaccaaggucuuccucuugaaugcagggagccgaacaacuuccucauaggaaacaacauccaacuggucaaaaacuagagacaaagaaaaucaaaucauuaauuuucagagguggggugauaaagcacuggcugggguuaaggaguugacacacuugauccagcaagaagggaagguuggguguggugguacaugccuauaauccaaggucugaggcccugucuacaaaaaaguaaauaaaaugcagggagagagaccauggacaugaaaucagagggggguugcugggagggauguuuagauauuucuaugugaugaagaaugauauauaagaaaguaaagcagaaaguacuucccauaaaaauuccgaggaaaggacugacaugaccccauuuuaauucugaaugaacuaucuagaacguuaggugagaaaaaaaaaaaaaacugcaggggcuagaguuuaagcagugagacuggacacaccaaacucuagcucaauuccaugacuaugccgugaaaaacaauuccaagcggaauccaaacuuacugaggaauaauguuuugcucauuaaauaugcuagcaaaauggcuguagcagcuggaggaggugcugauaaacugaagaacaggaugugagagcaggcucacucuguauuacauaugcaugugguucuuuuaggucuaugauuugguuuucucagcaucccccaucugaacuuuuuacauggcucuguaggcuaguccauaggauucugauuuuauaugcuuuuuuuuauaacucuauguucuuuucuguaucccuuugaccugaccuuuucagucucuuucagucucagcacuguaacaguucucuauccccaacacagauucaaucucucuagaacauuuaacuugggugucucacagccacuuagaggucaaucaauaucaucacuguaaacccucuaacaucccuuauuuuagagaacagaaccaauauugagccaaccauucaagauggaaaaggggcucuuagacaaacgguccucuacuccuucacagaugccuuugccaugguagcuuuggguucuuugauuuguucaugcaucugucacugucucugaaugcuccgaacaagauggaaacauuaaauaaauuauagauugguauucauuuauuaucagcaacccacuugaaauucagcccuccguauucaugagcccuguauccucagauucaaucaaccacaaauugaaauauuuugcaucuauauuaaacauauacagacuuucucuuucauuauucccuaaacaauauacugcaauuauuuauacagcauuuucauuguauuagaaaaaaaucaagauuuucuuuuucagucauggucucacugugcaguucugccuugcuuaaaauuuucaaaggaggauauacauaaguccuauauaaauucuacacccuuuuuugaggguguuggagcaucuguugauuuugauaaccacuggguggguacuggaaccauuccucuguagauacugaaucagcagaauaaagauaagaauggagaaaagucuggaagacuugaucaguuuguuacuugagaggugaggugaugaguagguguggacagaccacuagcuuucaugaauaugcacuggcauuaucucucugacagcaguaaguuuaugaauaaaaugaguaaaggaaagucaaaagaaauggcacauuuucuauacaucccacuauguacugcauccucaccucuuuccuucugguuaaagagguggagaaacacuaaugcuacuuggacucuucagagggacacagaaaacuuacuggaacugugcuuagccagguacuugucuuuacacuucuucuucuucccaaagggacugcaacuuggugcuucacuuggagcagagugagccacgcuugccacucuccugugaagaacagacgacuaaaacucaguagguccucaguguaaaggccugugaaguacugggcuaccuccuuucuuuucuguaguuaaguuuugagacugacccaguuccuugacucuaaaauucuucaggcagagaugcccucacacacuucccuuccuuucuucauaauuuuacauggucacccaggcacaaggcagugcaaauguuuucaggaggaaaaagugauauccuccccuuagugcagccugaccauucuuccaccuuugagguaaaaccuggaaaauugggcuaacacucaguucaucauaagaaauauauuaucuacaacaacuuaaucuauaaauaaagcacacagaaucauauauaugacugaaacaauagcuucaauaacaauaccaccuguuaguguguaaucuauacugauguuucuaugaaucagcuuuuguuuuuagccagggucuuaauauguagcucagguggcuuugaacuugccuuagucuucugagcauucugaauuacaggccucagcuacaauaucuaacucucauuaaaaaaaaaauguauguuguagucuacuaaauugauuucaugccucauuaguaagccucaguuucacuuugugcucuccugagucugucuuagcuaucugcauuuccugaucuuacuauguucuucaccaggcguuagcucuaaaaauggcccagaaguuauagacagcauacuccagguuuugaccaacaucuuccagguuuguacuguauuucuucuguuguucuaaugauaaacauuuauuuauacaaaacacauccugugguuaggugcuuuuuacaauuggaaaugagaccaagcagaacucuaacuucaaacuaaaggccucuauauguuugcaggggucaccauuuggcacucgauagacagcuaaguggguuguacuuacauauuuaggaauuuguauauuaagaauguauguauguauguauauauauucaacugcuaaugaaaaaacaggccaugaauucugaagagagcaaagaaauauauaugaaaaguuuagaaggaagaaagggggaaaaugauguaauuauauuauaaucucaaaaacauaauagaaagaaauaggucugguacaggaacuugcacucuuugagguucugaugucauuuucuacaaggaggucaacaaugaauauggauuuuuuuaccacucuauggucaugugugguagccuuucacuaagucagcaaccugacuagaggacaagaauauguauaaaagacacauacuuaaaaugugacuguuuucagaaguuuucuuagaaacaguacugagugauugaagagauaugggaaacaaggaauagggcucuguaacugguaagaguguuuaaggaaacaggccaauaaaaggcuccuuucccugaaacaaauguccuuucaaugaaccguuaucaacuccuguggacccuuccucaucuauuauguaaagaaaacuagaacauauggagauauggaaaauauacgcaagacagcagauuucugaagcuaagcaauuagcuacugcaggggcuuuccaccaguacaaacaugcucaccauuccuguagcucaggagaagggauuaauccugcagacucuuuggaggagcccuccacccgccccugccaccaauugcugucaucuuuguugauuaucuggauaaugucuccaguaacaaacuucaguccugccuccuugcaaggaauaagguuguccuuuuggggaucauagucaaacugugcucucaugaacaucuguaaaagaaggcaaauaagaccucaggaaaaacacuaacacuagagcauguacguaaaaagucccacuauaaggaaaugagcaagaaugaggcaaaaaugguaggcacaugugcagcugaauuguucaaguguucuuaaguacauacugcuguguuuguagaagaaucaaaacugaucuuuuuaacaagaagacauuucucaugaaaugccuuucugggucaccauguugucagcucuugaaucugaguuguccaucucagaggagagagcuguuaccauccgucugaaaauacucucaaaaauaugguaaaguugauauaucuuucucuagcagacagucuagcaauaugaauguguccaucaucuucaaauacugacauucuuugcccuaccuucuaucaaacuauguauuuaucuuauauaaaucaugcuuauguggauaaguauguuuaucucagcauuauuuauaagagcaaaguauugaaaaaaauuuuauuuccuaagacauuuuaauuuaucugugauaaaugguuaaguagcugcuaaguauauuaccauguaacaugaaaucccaauuuauagaauaucuaaugcccuuggcaauccugcuaacaugugaaauaagaacauuaauaaacagccgggcgaugguggcccacgccuuuaaucccagcacucgggaggcagagguaggcagauuucugaguucgagcccagccuggucuacaaagugaguuccaggacagccagggcuauacagagaaacccugucucgaaaaacaaaacaaaacaaacaaacaaaaaaacagggcaauucaucagaaggauaaggagucacaaucaagcagaaucuaguucagcaacacaaaaguugugacauuaacauaaacauaaaaaguagagaaaagccgggcagugguggcccacgccuuuaaucccagcacuugggaggcagaggcagguggauuucugaguucaaagccagccuggucucuagagugaguuccaggacaguccaggcuauacagagaaacccugucucgaaaaaacaaaaaaaaaagggggaaaaaaaguagagaaaaaaaaaaucacacgauuuugucacuagguacaaagaaaaaauuuaacauccaaacauuaaaauuuuaaugaacuuguaacagaagggaucuccuugagacuaauaaauaccuucaaaagccuuacagcuugggguuagagggaugguucaggugacaaggacugcucuuucagaggaccuguaugugacucccagcaccuauaucagguggcucauaacgagcuccaggggaaucuugauaccucugacgucugugagcaccugaacucauacgcacauauacacacagagacacagaauuaaaauaauacaaacaaauaaaaccccgcagccaacauacuuuacaauguaauacuaaaacuuugucuucaauauugagaaauagagaaggauccugcuguuauuacuucuuuggggauauugugaagaugucuuuuuuccacaaaaugauauggagauuuaacucaaggguaaauaaauagaccaacuacacagaauaugccuacauauaugacaugauaaaagugaugauacauauaguaugaacaggauguucauucauuuuuuguuuguuuguuuggcuuuuucgagaauaggguuucucuguauagcccuggcuguccuggaacucacuuuauagaccagccuggucuacagagugaguuccaggaggacagccaaggcuacacagagaaacccugccuugaaaaaccaaaaaacauacauccaaggaguucauggcacuuccuauaagcaaaaaaccaaaccaaacaaaaacaaaaaacuggccauaaucacagcacauuuauacgaugaaucagagaaacuucaccuauugcaauaaguaacauggaugacucauuuaaauauaguacugaaugcaaugaaaaagaaaaaggaauaaagggccgaggagacugcucaguugaguugguaaaauuccuacuauauaguucaauuuauauaaacuucaaaauggggcaaaacucuuuucucuugucagggugguggugagccuggaagaaaugagauaagaaguaauagaugcuggacauauucugccuuuugaauugggugcuguucaguucaugaauguaaccaguuuuauacguguggucuauucauuuuguuauauguaugaacacaaacagcaaaaacucaauuuaaaagguuaagacuagacuauuucacacuggagguaauaauagaaauuucagguuugauaugaguauuuauuuucauuucuuuuuuuacucacaugugcucaguugccuguggaggccagaagaaggcaacagauucccuagaucuaguguuauagaccacugugaaguaccugauguggguacugucaaucaaauucauguccucugaaagagcagcaaauucucuuaaccugaagcaucucuccagcccaagguuugguauuuuaaccuuuuuugcacauucauuugccaagguccugucccaucuauuccucugcuacugauaacuuguuccuaacacuuccaacauugucuucuuccucaaagaaaaaggaagaaagggcugaggagacucuucaauugaguuaguaaaauacuugccuuauauguacuuugcaauugaguuugacccucagaauucacauuaaaaagcugagucaagugguucagagcugggaaggagagagacagaaggauuccugaggcucauuagcuaaccaaacuaaccuaauggguaagauccaggcuagggugggugagguggaacuuugucuccaaaaaaaaaaaaauggggacugagagagguagcucaguugauaaaguaucuaccacacaaccaugagaaccugaguucagaccccaguuaaaucuaaaaaaaacugggcacaauguguugccugaaauuccaguacuggagaagagggucagggagaagaaauaggugaaucccugaagcucauuggccaaccauucuagcccaaucaaugaauuucagguuccuugagagacaccucucaaaaauaaauaaauaaauaaauaaauaaagguaaggugagguuaauauaaaccucuggccuccacacucauauacauacaugugcacaugcgcacacacauuuacacaagaacaccccaacaaacacauaaagauggaugacacccaagguuguccucugcccucuacacaaaugcacuugaacacacaugaacaagcacaacaagcacacacagacacaagaaaaauagagagaaaauaaaggagaugacagaguggacaauaggauaauaggaucccaagccaagcaacuaaacaccugugagagauucaaaauguauaguuauagaaucauguaauuuuaaauaaaaucucaaagaccaccaaacagcacaaaagagaaaauggcacucuauaccuguagcgcaggaaggcgacucugcugauuagcaaugacuuuuaaugagaucauuccuuugguuuccuucuauuaaaaaagaaaagaaaaaugaaacuguagcaaaaacuuacgggggguggaggaauaggguuuuauaaagucaggguuuucacgacagaaccauuuuuauaguuuaagauuuggucagauauuaccucuugaaccaugagauugucauguacuucccacaccagcauaacugaagacacaaaaauaauaaugcaauaaaacauugcaaauauuuacagucacauguuucuuuugguuuuugguuuuucuauauagcugaggcuggccuuaaccuaugaucauuucugccucaggcuuccaagucccaucgcaacuggaaguagauacaaguuuaacuuguuauuggccuccuaagagcuuuuauuauaggcaugagcuauauugcauucagcuuaacgauuuauuuuguaauuuaguuaccauaauuacagcugaucauccucucuuuuuuucuuacaauuuaaauaauaaaauaugcauaauaucacauacaaauguuuucaaauuauguauauaucauaugacuaacauaugcauuacuucacaacuuauuuuuguugugacaauacucaacauauauucgcuuaggacuuuucaagaauauaauccggaucacagggcucccaauggaggagcuagagaaaguacccaaggagcuaaagggaucugcaacccuauagguggaacaacauuaugaacuaaccaguaccccggagcucuugacucuagcugcauauguaucaaaagauggccuaguaggccaucacuggaaagagaggcccauuuauaggcaaacuuuauaugccccaguacaggguaacgccagggccaaaaagugggaguggguggguaggggggugggggggaagguaugggggacuuuugggauagcauuggaaauguaaaugaggaaaauaccuaauaaaaaauauuuaaaaaagacaaacugaaaaaaaaagaauauaauccggugccgggcgugguggcacacgccuuuaaucccagcacucgggaggcagaggcaggcggauuucugaguucgaggccagccuggucuacaaagugaguuccaggacagccagggcuacacagagaaacucugucucgaaaaaccaaaaauaaauaaauaaauaaauaaauaaauaaaugguuuguuguauuauuuauaguuccaugauccccacccauucccagccccugaucagcaccauuccacucucuacuucuacagguuugccuuucuugauucuacguauauaagaguuuacgugaugacuaucuuucuggguguggcuuauuuauauaauguccuccuggugcaccuauguuguaucaaauaaugggauuuccuuuuuguauaagacaggacagcauuucauaguguguauauaccacauauuuuuaguuuauuggacuccauagcuuggcuaugauggauugugcaguaguaauugagcagauuuuuaaaagguuggucaguaguuuuuuuguuucuuuugcccaguuuucuauuugguuuuguuuuuaaaaugaaauuuagauuuccccagaauuauuagcucuuuucugauguacuaucuuuuuagcuuaugcucauuugcaaguaguucaaugucagaggcccacuuuaagggccaaauuucugacaucacucccgguacuaugauauuacugggcagcccaguaauaauuagguagcacauucaaaaagggaguuugaaaaguuucaugaaggacauuauucacacagguauacauauccucaggaagaauucucucccuuguuggaucuuucgaggauguccacaccugugugaaauugguaccuacaggagcagauucgucagguaagagagcaagcacauaaauaccuuuaauaacugcuugcugaaucuacugaagcccaagugaucuagaaacuaaaaucaaccuacugacauguaagacaaaguuaagaaagauggcaaaguaucaggaggggcaaacagaaaggcagcauaaacaccaagcagaauccacauaguggauucugagacuacagacugagagaaacgaauccaccugcucaaagccauacagcaagaauaaaguaaagcaaggauucagaaauaccaauauacaccacaaucuccagauacccagggcaauagucuuguuuuuuuuuuaugagauugaugcucucaaguuacuagcccugcuuugcaguuuuaguaaaugaaagcagagaaauaauauuucuuagacagaauaucagaggaucagaagugauaaacacccucucaauaagauaaccaugcuuuugcagagaaaugagauacaguggcaccaguucccauauaccuuucaugaacauagaagauaguauuugucuggugcagagaauacccaccauugccuucugcaacugaucuacugagugauuagucacauuugugccauugauuucuaggaucucauccccaacaugaagggagccugucauuaaacaaacaaacaaaagacucaaugcauaaaauaauaaaaagucaaacaagagcuguuaguauagcucaagaauaccacauaaucaaaaauagaauuuaaggcauuuuauaaaauagauaaaauucaaauaguagaaguauucaaccaggagagauaaaaacaaauuugguucugaaucuaucuagcacaguucaauacugccucauccuuuuuuauuucagucauccaagagcugucugcguaaaagcaucucauccuugaauuccuggaauuagaauagcugccaaccccaggagacuuggacacacauauacacauuaaaaagaauaaccaagucagggaaaaagaucucaguacucccaauuauucagugagaucaauguuucuuuguuaaacacauguucuuagaugguuagucaauguuaaaauucuaugugaaggaugguuaccaaauucaugucaccuuggaugaauaaaaaacauaguuaaacauaaaaggguaggacauaaugaggaaggacacucacuggaguagccauagccaacauugggaauaguuucuaguuucuaauaccauuuagauuauuaccagcugcugaaaauguuaaauuuuaauuuauuauucuguucucucauugcucccuaaauuauauuuuaguaaaugauauaucugaaaauuguuagcacucugacauuagagaaauacaauaauuaauuauaccuacuuaaauuugguuuccucauucaagcuguuagcuucaggaggguagagauauggcuuucuuuacuguuacauaucaguauuauguaauggguacauguaauaaugauucacuuauuaaguaaaaaggaaaguuuauaugagaaggugcagaggagcugggcagugguggugcaugacuuuaauccuggcacuuaggaggcagagacaggcauaucucuuugaguuugaggccagccuagucucaacaaagaaauccuaucucaggggauuggggugggggugggggaguucagaauucauacuaaaaucuuaccaugcaauuuucuagagucaggugguuuuguuugguugguuuaguuuucgagacagaguuucuccguguagcccuggcuguccuggaacucacuuuguaggcuaagcuggccucgaacucagagaucugccugccucugguuccugaggguugggauuagggcaggcaccuccaugccugguuuaaagaguuaauuuuuaagccaaggaaucucuugucacucucaugaaaaugcuaucaguuuguaggacuauaagcuccuugucccaaacaacugaacagagaguaaauaauuaucccaggguaaaauuagacuuaggaccccuccucccugccagaguaccuugucuaugaaucaugccgccauggagaauucuggccacgguacacgacuguuuuucauucagcuucaaagugauccccuggaauaaaggcaaugaaaaggaaacuuuguuuuaagcccuugcugaggacaucuuuaaagcaucuuaaggaaauuuugcagggaaaaccauuuccaucuguaucaugggcaggucucaaguagaaaaagcaggaagcuugcucugaaaggugcuugaaauggggacaaagagacacagcaguaagucuguacaauuccaggaguggccuuuggcauauacucuuacggccuaaugacuuuaucaguagaguauaagugauaagggacaauaggacaagagauuaccaugggcucuucugugaucuucucaaauuguaugagacgaacucuccgagccuccugaccuuuggcaugggcagggcuaccuggagcaggggacccauugguguacauguccucaguaguaacauuugacugguucaaugaagucugucaaguuaaaacagauuaauggauaaaauacacaguaaaacuccauaguuaaucaacaaucuguaauuagaacccaaaaagcuucuagaauauaaaaaauagaauauaaaaaaauaguuauuuuauaagguugacaucuacucucauuagaauccaugugaagcuguuuguaaacauuccuuauucaauuuaauacacacauuuuacaaggucauugcagauaaaggaaugauuuucauuaaaaaauauucugaaggauuaagagauagcucauuaacaucauuggcuauucuuugagagaacuuggguucaauuuucagcacucacauggcagcucacaacugucuguaacuuaaaaguuuggagguuggagagauggcacagcgguuaagagcacugacugcucuucugaagguccugaguucaaaucccagcaaccacaugguggcucacaaccaucuguaaugagaucugacgcccucuucuggugugucugaagacagcuacaguguacuuacauauauaauaauaaauaaaucuugaguccacagagagcagagguucugaguucaauucucagcaacuacaugauggcucacaaccaucuguacagauaacaguguacucauauacauaaacuaaauaauaaaauaaaaacuuaaaguuuggauuauuugaggauaauaugaagacaucuugccuuuauuauucacaaauguuugugcauaaaauaauaaaucaaaaccuacacagcaagccagaggaggaaaaacuagugugagcuugguauuuggguauaaacugaaaauggagagcagcuuuuuuacuauccacacacagagacacuaggaagagcugugaaaaauauaucuugccaauucauuuuucuggaggaaagaagagucuugaguaggaaucaucaucccccccccccccgccccggcacagaagggugggaagaugacagacaaggagaucuggccuagaaaccuaaggagagaaguaugucuuauaacauaggugugcuuuccacaaaggucucuaaauuuacugcuuccuuucuaacugaaaaaacaaugaggacuggcauagugucacuuacuguguaacuuccacaugaggaaguguugagaaauugucuuguuuagcagcuaaaaugucccaaaacucauaugaccaucacaugaucuuuauguuguaacaaaaauguugaaaagggguuguaauuugaaaauuaacuuagaauaccuagcaacacagaacuucacacaacaaacaauucaaugacacuacagucacugcaugggaagacaccauguagccaugagaaggaagcucugagguaauuuugaaaccaucuguucauguggaaaauaaaacaacuugaagacaauuaugcuaguuucaccauaaauagugaaaaaaugaauauauucacguuuaccuacacacaaauaaugucuggaaggaacaguggugguuucuaggaagggggaaauugguuggcuacaagacagagugaaaaggaaauugccuucacgggcuaauuuuacucaccauaucuuccaaauugugcacuauguguuuaaauaccuuaagaaaauaauuuagcaaaaaaaauauuaaacagaacuuaaaaacuugggacacuuuuuugggggagggggugagacaggguuucucuguguagcccuggcuguccugaaacucacucuguagaccaagcuguccuugaacucagaaaccuaccugccucugccucccaagugcuaggauuaaaggcaugugccaccacugcccagugggacacacuucuuacgagaaaaacccagucuaggauagauuccuggcucuuuuacuaauggcugguaacuuuggauucuugaccuucuugcauuuguguuuuuucaauuguaaaaaugaggaugguaacuuaaggacuuuacuggguugugagcuuaacauaacuuagaagcacuggguaaaugugagcuaugguuacuauguugcuguacagcucucuauugggagugcugacauaccaacaauaccaaaagaagccacucaagaaaaugcucagcauucaaauccucauauaucccuucauuuuuaugucacaaugauuacuuucuauucagaaaaaaugaaaaauggagcugcuugaguuucaguuguuagaagccugugugugcauccagaguguacuauacagauaaagcacaucagccaaagaccuuuaaccauguggccuuuggauugagagauguauuuagugccuggcaaauaaagcucuaguuaauauaugauuuuaagacaauaccugccagaaaaauucugauucuugagcccuccugucucuccaguucuuaucauuuauaguuaaauaguucuaaucucuauacuucccuggggaauuguugguuuucucaugacuuuucuaacuuuuuuguuguacuuuuucccacucacaaagugaaacagaugugcaugugaagaguggguacuugugauucagucaggggcuacacaaggcuggcaggugauaguaaggaacucccagcucuucuguauuuagagucauucauuuccuuggacuaggcauucuaaguucaccauguggaagcaguuggcaaugagccuaacaguaggcugaacaaauguuuguucauuccugugcucaguaguucacugucauuuuguucugaagccaauugguuuaaaugagaaagucaacuauaguugccccugcucuauucacccccacuaccccugcccccaccccugccaauuuuuucaaucuauuuuuuuauuucaacuuccuuugagaaacugucucugcccuuugaacugugcugcagauguuuccucugaaggagguguagggggugaagcacuguggaguggccagcauugcugaagccugcacuuuguagaaucuaggaguuaaagggcaaacaggacagccugugcagagacaccaagguucaaugccauguacaauagcagaaaacaagucuugguugaaucaguagggagcauggucagugagucugcuccugauuaucauucuaccagagaaaaagacuccuucuuagguuuggcuguaucauuugaagaggauauuuccauucaaggucuguguuuucagagaauuuaaacuaaaaaaacaaaaaguacuauuuucaaauuauuuagucuuugccccaguuuucucaguaccuaguauagucuguuagucuucuucauauucuguccuucacuucuaggauaucuaugauuuuauuuuucaaaaccagaaagaccuagauaccuuacagauaggaauuugguuuuauuguggccacaguggcuuaaguagauuagaauuuuuaucacauuaaguuuuguucuuugcacuuuauuugcucaccuuaaauaagacacugaacuagaacaucaggaauagauguuuccuucagcagucaugacacuuuggagggaggucugauaauuucuugcuguaaaaaauaaauccaucuaguugugacacuaaaaauguccugaagucugacauguuagcccauauagugccuauaaacucaggaggcugaggcaggagaauugcaaggaauucaaggccaguuggggcaacugaguaagcuacaagguaaccugagcuagugugagacagcgucucaaagcaagaaacaaacagauaaacaaaaaaagcaaaauguccuccuacuugccagcaagagagauaaaauuugcugacauuuaauuggugcacaguuucuuccccuaagcagugaguugcucugucaguguuacuaaaagaggacuuuggguguggagcauagaaaggcaagauuaaauaaccauacuuccaaaacuagcuuggggaggggaaaugacaccagagauagggaaaaggaaacagagcuccagaauugaggaaccagaauacaacugucauaauauggauuuuuuucucguauuaauucuucacuuuuucuuuuuuucccuuuaucaaaaaaaaaaaagugaucaaaacacauaauagcuaccauuccuguaaagguuuuuggauuuauuuccucaguuucaucuaguaucaucuuugaacauuuuguguaaguaauguauguuguuuaauagcuguaccuuccuaucacaaagccaucuucgcuguaucacaagcagcaucauaaaucucccaggagaagggacuggggagcagagggagcaggguccguaggugaauggggagggggagacauguuacauagaaucuaaucacaaccaccucuggaggccugacauauuagauuaauaacuauuuacugucuaacacuggaauaugaaugcuaccuuaguuuacagcauagcacaaggagacccccugaaaugaaaugcagagggaaaugugugagcuuuuuagagcacgaaguugguuuucacaaccaugucugugaaacaacacaaacgcucaauaacagccaggcagaucuacuauuggauguguuccuuaaagucuuauuuuccuucuucaagucuguuaguagacuuccauccaugagcaaguuuucuuugaccuuaaguauucauuuaguccuggccugccucucgggauuuucaccuaggagggcugcuccaggcaacuauccaccacacccagaucucagcaggaaucgggcccagugcuaaggccuccacccugggggcaagacacccaagaucuggccauccggggacagagcgcuugggaacaaggccauggauaggaaaaauccagcagcagauggaaaggccuggauccuagacccaacccgaacccagaggaccccaggggucccgcuaaccucaggucgguuacgcuucuguaguaagugcuccagguagagguccgaaagugcggugcgcaugcuguucccucccucgccuucgcucgacuugagcgucaucucucaggagcagagacaaccagacgcaguagccgcagagcuuugagcccaggaaucgcaaaucggggaacugcggccuguucagagacgagcuagacuaaggcggcggaggaggcagggaucaagagcugcgcugagagccaggagggccaagcagagcaguacccacgcuccgccuacucuccacccug

SEQ ID NO: 9584 - RNA, 22324 nt, Mus musculus
caggguggagaguaggcggagcguggguacugcucugcuuggcccuccuggcucucagcgcagcucuugaucccugccuccuccgccgccuuagucuagcucgucucugaacaggccgcaguuccccgauuugcgauuccugggcucaaagcucugcggcuacugcgucugguugucucugcuccugagagaugacgcucaagucgagcgaaggcgagggagggaacagcaugcgcaccgcacuuucggaccucuaccuggagcacuuacuacagaagcguaaccgaccugagguuagcgggaccccugggguccucuggguucggguugggucuaggauccaggccuuuccaucugcugcuggauuuuuccuauccauggccuuguucccaagcgcucuguccccggauggccagaucuugggugucuugcccccaggguggaggccuuagcacugggcccgauuccugcugagaucugggugugguggauaguugccuggagcagcccuccuaggugaaaaucccgagaggcaggccaggacuaaaugaauacuuaaggucaaagaaaacuugcucauggauggaagucuacuaacagacuugaagaaggaaaauaagacuuuaaggaacacauccaauaguagaucugccuggcuguuauugagcguuuguguuguuucacagacaugguugugaaaaccaacuucgugcucuaaaaagcucacacauuucccucugcauuucauuucagggggucuccuugugcuaugcuguaaacuaagguagcauucauauuccaguguuagacaguaaauaguuauuaaucuaauaugucaggccuccagaggugguugugauuagauucuauguaacaugucucccccuccccauucaccuacggacccugcucccucugcuccccagucccuucuccugggagauuuaugaugcugcuugugauacagcgaagauggcuuugugauaggaagguacagcuauuaaacaacauacauuacuuacacaaaauguucaaagaugauacuagaugaaacugaggaaauaaauccaaaaaccuuuacaggaaugguagcuauuauguguuuugaucacuuuuuuuuuuuugauaaagggaaaaaaagaaaaagugaagaauuaauacgagaaaaaaauccauauuaugacaguuguauucugguuccucaauucuggagcucuguuuccuuuucccuaucucuggugucauuuccccuccccaagcuaguuuuggaaguaugguuauuuaaucuugccuuucuaugcuccacacccaaaguccucuuuuaguaacacugacagagcaacucacugcuuaggggaagaaacugugcaccaauuaaaugucagcaaauuuuaucucucuugcuggcaaguaggaggacauuuugcuuuuuuuguuuaucuguuuguuucuugcuuugagacgcugucucacacuagcucagguuaccuuguagcuuacucaguugccccaacuggccuugaauuccuugcaauucuccugccucagccuccugaguuuauaggcacuauaugggcuaacaugucagacuucaggacauuuuuagugucacaacuagauggauuuauuuuuuacagcaagaaauuaucagaccucccuccaaagugucaugacugcugaaggaaacaucuauuccugauguucuaguucagugucuuauuuaaggugagcaaauaaagugcaaagaacaaaacuuaaugugauaaaaauucuaaucuacuuaagccacuguggccacaauaaaaccaaauuccuaucuguaagguaucuaggucuuucugguuuugaaaaauaaaaucauagauauccuagaagugaaggacagaauaugaagaagacuaacagacuauacuagguacugagaaaacuggggcaaagacuaaauaauuugaaaauaguacuuuuuguuuuuuuaguuuaaauucucugaaaacacagaccuugaauggaaauauccucuucaaaugauacagccaaaccuaagaaggagucuuuuucucugguagaaugauaaucaggagcagacucacugaccaugcucccuacugauucaaccaagacuuguuuucugcuauuguacauggcauugaaccuuggugucucugcacaggcuguccuguuugcccuuuaacuccuagauucuacaaagugcaggcuucagcaaugcuggccacuccacagugcuucacccccuacaccuccuucagaggaaacaucugcagcacaguucaaagggcagagacaguuucucaaaggaaguugaaauaaaaaaauagauugaaaaaauuggcaggggugggggcagggguagugggggugaauagagcaggggcaacuauaguugacuuucucauuuaaaccaauuggcuucagaacaaaaugacagugaacuacugagcacaggaaugaacaaacauuuguucagccuacuguuaggcucauugccaacugcuuccacauggugaacuuagaaugccuaguccaaggaaaugaaugacucuaaauacagaagagcugggaguuccuuacuaucaccugccagccuuguguagccccugacugaaucacaaguacccacucuucacaugcacaucuguuucacuuugugagugggaaaaaguacaacaaaaaaguuagaaaagucaugagaaaaccaacaauuccccagggaaguauagagauuagaacuauuuaacuauaaaugauaagaacuggagagacaggagggcucaagaaucagaauuuuucuggcagguauugucuuaaaaucauauauuaacuagagcuuuauuugccaggcacuaaauacaucucucaauccaaaggccacaugguuaaaggucuuuggcugaugugcuuuaucuguauaguacacucuggaugcacacacaggcuucuaacaacugaaacucaagcagcuccauuuuucauuuuuucugaauagaaaguaaucauugugacauaaaaaugaagggauauaugaggauuugaaugcugagcauuuucuugaguggcuucuuuugguauuguugguaugucagcacucccaauagagagcuguacagcaacauaguaaccauagcucacauuuacccagugcuucuaaguuauguuaagcucacaacccaguaaaguccuuaaguuaccauccucauuuuuacaauugaaaaaacacaaaugcaagaaggucaagaauccaaaguuaccagccauuaguaaaagagccaggaaucuauccuagacuggguuuuucucguaagaagugugucccacugggcagugguggcacaugccuuuaauccuagcacuugggaggcagaggcagguagguuucugaguucaaggacagcuuggucuacagagugaguuucaggacagccagggcuacacagagaaacccugucucacccccucccccaaaaaagugucccaaguuuuuaaguucuguuuaauauuuuuuuugcuaaauuauuuucuuaagguauuuaaacacauagugcacaauuuggaagauauggugaguaaaauuagcccgugaaggcaauuuccuuuucacucugucuuguagccaaccaauuucccccuuccuagaaaccaccacuguuccuuccagacauuauuuguguguagguaaacgugaauauauucauuuuuucacuauuuauggugaaacuagcauaauugucuucaaguuguuuuauuuuccacaugaacagaugguuucaaaauuaccucagagcuuccuucucauggcuacauggugucuucccaugcagugacuguagugucauugaauuguuuguugugugaaguucuguguugcuagguauucuaaguuaauuuucaaauuacaaccccuuuucaacauuuuuguuacaacauaaagaucaugugauggucauaugaguuuugggacauuuuagcugcuaaacaagacaauuucucaacacuuccucauguggaaguuacacaguaagugacacuaugccaguccucauuguuuuuucaguuagaaaggaagcaguaaauuuagagaccuuuguggaaagcacaccuauguuauaagacauacuucucuccuuagguuucuaggccagaucuccuugucugucaucuucccacccuucugugccggggcgggggggggggggaugaugauuccuacucaagacucuucuuuccuccagaaaaaugaauuggcaagauauauuuuucacagcucuuccuagugucucuguguguggauaguaaaaaagcugcucuccauuuucaguuuauacccaaauaccaagcucacacuaguuuuuccuccucuggcuugcuguguagguuuugauuuauuauuuuaugcacaaacauuugugaauaauaaaggcaagaugucuucauauuauccucaaauaauccaaacuuuaaguuuuuauuuuauuauuuaguuuauguauaugaguacacuguuaucuguacagaugguugugagccaucauguaguugcugagaauugaacucagaaccucugcucucuguggacucaagauuuauuuauuauuauauauguaaguacacuguagcugucuucagacacaccagaagagggcgucagaucucauuacagaugguugugagccaccaugugguugcugggauuugaacucaggaccuucagaagagcagucagugcucuuaaccgcugugccaucucuccaaccuccaaacuuuuaaguuacagacaguugugagcugccaugugagugcugaaaauugaacccaaguucucucaaagaauagccaaugauguuaaugagcuaucucuuaauccuucagaauauuuuuuaaugaaaaucauuccuuuaucugcaaugaccuuguaaaauguguguauuaaauugaauaaggaauguuuacaaacagcuucacauggauucuaaugagaguagaugucaaccuuauaaaauaacuauuuuuuuauauucuauuuuuuauauucuagaagcuuuuuggguucuaauuacagauuguugauuaacuauggaguuuuacuguguauuuuauccauuaaucuguuuuaacuugacagacuucauugaaccagucaaauguuacuacugaggacauguacaccaauggguccccugcuccagguagcccugcccaugccaaaggucaggaggcucggagaguucgucucauacaauuugagaagaucacagaagagcccaugguaaucucuuguccuauugucccuuaucacuuauacucuacugauaaagucauuaggccguaagaguauaugccaaaggccacuccuggaauuguacagacuuacugcugugucucuuuguccccauuucaagcaccuuucagagcaagcuuccugcuuuuucuacuugagaccugcccaugauacagauggaaaugguuuucccugcaaaauuuccuuaagaugcuuuaaagauguccucagcaagggcuuaaaacaaaguuuccuuuucauugccuuuauuccaggggaucacuuugaagcugaaugaaaaacagucguguaccguggccagaauucuccauggcggcaugauucauagacaagguacucuggcagggaggagggguccuaagucuaauuuuacccugggauaauuauuuacucucuguucaguuguuugggacaaggagcuuauaguccuacaaacugauagcauuuucaugagagugacaagagauuccuuggcuuaaaaauuaacucuuuaaaccaggcauggaggugccugcccuaaucccaacccucaggaaccagaggcaggcagaucucugaguucgaggccagcuuagccuacaaagugaguuccaggacagccagggcuacacggagaaacucugucucgaaaacuaaaccaaccaaacaaaaccaccugacucuagaaaauugcaugguaagauuuuaguaugaauucugaacucccccacccccaccccaauccccugagauaggauuucuuuguugagacuaggcuggccucaaacucaaagagauaugccugucucugccuccuaagugccaggauuaaagucaugcaccaccacugcccagcuccucugcaccuucucauauaaacuuuccuuuuuacuuaauaagugaaucauuauuacauguacccauuacauaauacugauauguaacaguaaagaaagccauaucucuacccuccugaagcuaacagcuugaaugaggaaaccaaauuuaaguagguauaauuaauuauuguauuucucuaaugucagagugcuaacaauuuucagauauaucauuuacuaaaauauaauuuagggagcaaugagagaacagaauaauaaauuaaaauuuaacauuuucagcagcugguaauaaucuaaaugguauuagaaacuagaaacuauucccaauguuggcuauggcuacuccagugaguguccuuccucauuauguccuacccuuuuauguuuaacuauguuuuuuauucauccaaggugacaugaauuugguaaccauccuucacauagaauuuuaacauugacuaaccaucuaagaacauguguuuaacaaagaaacauugaucucacugaauaauugggaguacugagaucuuuuucccugacuugguuauucuuuuuaauguguauauguguguccaagucuccugggguuggcagcuauucuaauuccaggaauucaaggaugagaugcuuuuacgcagacagcucuuggaugacugaaauaaaaaaggaugaggcaguauugaacugugcuagauagauucagaaccaaauuuguuuuuaucucuccugguugaauacuucuacuauuugaauuuuaucuauuuuauaaaaugccuuaaauucuauuuuugauuaugugguauucuugagcuauacuaacagcucuuguuugacuuuuuauuauuuuaugcauugagucuuuuguuuguuuguuuaaugacaggcucccuucauguuggggaugagauccuagaaaucaauggcacaaaugugacuaaucacucaguagaucaguugcagaaggcaaugguggguauucucugcaccagacaaauacuaucuucuauguucaugaaagguauaugggaacuggugccacuguaucucauuucucugcaaaagcaugguuaucuuauugagaggguguuuaucacuucugauccucugauauucugucuaagaaauauuauuucucugcuuucauuuacuaaaacugcaaagcagggcuaguaacuugagagcaucaaucucauaaaaaaaaaacaagacuauugcccuggguaucuggagauugugguguauauugguauuucugaauccuugcuuuacuuuauucuugcuguauggcuuugagcagguggauucguuucucucagucuguagucucagaauccacuauguggauucugcuugguguuuaugcugccuuucuguuugccccuccugauacuuugccaucuuucuuaacuuugucuuacaugucaguagguugauuuuaguuucuagaucacuugggcuucaguagauucagcaagcaguuauuaaagguauuuaugugcuugcucucuuaccugacgaaucugcuccuguagguaccaauuucacacagguguggacauccucgaaagauccaacaagggagagaauucuuccugaggauauguauaccugugugaauaauguccuucaugaaacuuuucaaacucccuuuuugaaugugcuaccuaauuauuacugggcugcccaguaauaucauaguaccgggagugaugucagaaauuuggcccuuaaagugggccucugacauugaacuacuugcaaaugagcauaagcuaaaaagauaguacaucagaaaagagcuaauaauucuggggaaaucuaaauuucauuuuaaaaacaaaaccaaauagaaaacugggcaaaagaaacaaaaaaacuacugaccaaccuuuuaaaaaucugcucaauuacuacugcacaauccaucauagccaagcuauggaguccaauaaacuaaaaauaugugguauauacacacuaugaaaugcuguccugucuuauacaaaaaggaaaucccauuauuugauacaacauaggugcaccaggaggacauuauauaaauaagccacacccagaaagauagucaucacguaaacucuuauauacguagaaucaagaaaggcaaaccuguagaaguagagaguggaauggugcugaucaggggcugggaauggguggggaucauggaacuauaaauaauacaacaaaccauuuauuuauuuauuuauuuauuuauuuauuuuugguuuuucgagacagaguuucucuguguagcccuggcuguccuggaacucacuuuguagaccaggcuggccucgaacucagaaauccgccugccucugccucccgagugcugggauuaaaggcgugugccaccacgcccggcaccggauuauauucuuuuuuuuucaguuugucuuuuuuaaauauuuuuuauuagguauuuuccucauuuacauuuccaaugcuaucccaaaagucccccauaccuucccccccaccccccuacccacccacucccacuuuuuggcccuggcguuacccuguacuggggcauauaaaguuugccuauaaaugggccucucuuuccagugauggccuacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccggauuauauucuugaaaaguccuaagcgaauauauguugaguauugucacaacaaaaauaaguugugaaguaaugcauauguuagucauaugauauauacauaauuugaaaacauuuguaugugauauuaugcauauuuuauuauuuaaauuguaagaaaaaaagagaggaugaucagcuguaauuaugguaacuaaauuacaaaauaaaucguuaagcugaaugcaauauagcucaugccuauaauaaaagcucuuaggaggccaauaacaaguuaaacuuguaucuacuuccaguugcgaugggacuuggaagccugaggcagaaaugaucauagguuaaggccagccucagcuauauagaaaaaccaaaaaccaaaagaaacaugugacuguaaauauuugcaauguuuuauugcauuauuauuuuugugucuucaguuaugcuggugugggaaguacaugacaaucucaugguucaagagguaauaucugaccaaaucuuaaacuauaaaaaugguucugucgugaaaacccugacuuuauaaaacccuauuccuccaccccccguaaguuuuugcuacaguuucauuuuucuuuucuuuuuuaauagaaggaaaccaaaggaaugaucucauuaaaagucauugcuaaucagcagagucgccuuccugcgcuacagguauagagugccauuuucucuuuugugcuguuugguggucuuugagauuuuauuuaaaauuacaugauucuauaacuauacauuuugaaucucucacagguguuuaguugcuuggcuugggauccuauuauccuauuguccacucugucaucuccuuuauuuucucucuauuuuucuugugucugugugugcuuguugugcuuguucauguguguucaagugcauuuguguagagggcagaggacaaccuugggugucauccaucuuuauguguuuguugggguguucuuguguaaaugugugugcgcaugugcacauguauguauaugaguguggaggccagagguuuauauuaaccucaccuuaccuuuauuuauuuauuuauuuauuuauuuuugagaggugucucucaaggaaccugaaauucauugauugggcuagaaugguuggccaaugagcuucagggauucaccuauuucuucucccugacccucuucuccaguacuggaauuucaggcaacacauugugcccaguuuuuuuuagauuuaacuggggucugaacucagguucucaugguugugugguagauacuuuaucaacugagcuaccucucucaguccccauuuuuuuuuuuuuggagacaaaguuccaccucacccacccuagccuggaucuuacccauuagguuaguuugguuagcuaaugagccucaggaauccuucugucucucuccuucccagcucugaaccacuugacucagcuuuuuaaugugaauucugagggucaaacucaauugcaaaguacauauaaggcaaguauuuuacuaacucaauugaagagucuccucagcccuuucuuccuuuuucuuugaggaagaagacaauguuggaaguguuaggaacaaguuaucaguagcagaggaauagaugggacaggaccuuggcaaaugaaugugcaaaaaagguuaaaauaccaaaccuugggcuggagagaugcuucagguuaagagaauuugcugcucuuucagaggacaugaauuugauugacaguacccacaucagguacuucacaguggucuauaacacuagaucuagggaaucuguugccuucuucuggccuccacaggcaacugagcacaugugaguaaaaaaagaaaugaaaauaaauacucauaucaaaccugaaauuucuauuauuaccuccagugugaaauagucuagucuuaaccuuuuaaauugaguuuuugcuguuuguguucauacauauaacaaaaugaauagaccacacguauaaaacugguuacauucaugaacugaacagcacccaauucaaaaggcagaauauguccagcaucuauuacuucuuaucucauuucuuccaggcucaccaccacccugacaagagaaaagaguuuugccccauuuugaaguuuauauaaauugaacuauauaguaggaauuuuaccaacucaacugagcagucuccucggcccuuuauuccuuuuucuuuuucauugcauucaguacuauauuuaaaugagucauccauguuacuuauugcaauaggugaaguuucucugauucaucguauaaaugugcugugauuauggccaguuuuuuguuuuuguuugguuugguuuuuugcuuauaggaagugccaugaacuccuuggauguauguuuuuugguuuuucaaggcaggguuucucuguguagccuuggcuguccuccuggaacucacucuguagaccaggcuggucuauaaagugaguuccaggacagccagggcuauacagagaaacccuauucucgaaaaagccaaacaaacaaacaaaaaaugaaugaacauccuguucauacuauauguaucaucacuuuuaucaugucauauauguaggcauauucuguguaguuggucuauuuauuuacccuugaguuaaaucuccauaucauuuuguggaaaaaagacaucuucacaauauccccaaagaaguaauaacagcaggauccuucucuauuucucaauauugaagacaaaguuuuaguauuacauuguaaaguauguuggcugcgggguuuuauuuguuuguauuauuuuaauucugugucucuguguguauaugugcguaugaguucaggugcucacagacgucagagguaucaagauuccccuggagcucguuaugagccaccugauauaggugcugggagucacauacagguccucugaaagagcaguccuugucaccugaaccaucccucuaaccccaagcuguaaggcuuuugaagguauuuauuagucucaaggagaucccuucuguuacaaguucauuaaaauuuuaauguuuggauguuaaauuuuuucuuuguaccuagugacaaaaucgugugauuuuuuuuuucucuacuuuuuuucccccuuuuuuuuuuguuuuuucgagacaggguuucucuguauagccuggacuguccuggaacucacucuagagaccaggcuggcuuugaacucagaaauccaccugccucugccucccaagugcugggauuaaaggcgugggccaccacugcccggcuuuucucuacuuuuuauguuuauguuaaugucacaacuuuuguguugcugaacuagauucugcuugauugugacuccuuauccuucugaugaauugcccuguuuuuuuguuuguuuguuuuguuuuguuuuucgagacaggguuucucuguauagcccuggcuguccuggaacucacuuuguagaccaggcugggcucgaacucagaaaucugccuaccucugccucccgagugcugggauuaaaggcgugggccaccaucgcccggcuguuuauuaauguucuuauuucacauguuagcaggauugccaagggcauuagauauucuauaaauugggauuucauguuacaugguaauauacuuagcagcuacuuaaccauuuaucacagauaaauuaaaaugucuuaggaaauaaaauuuuuuucaauacuuugcucuuauaaauaaugcugagauaaacauacuuauccacauaagcaugauuuauauaagauaaauacauaguuugauagaagguagggcaaagaaugucaguauuugaagaugauggacacauucauauugcuagacugucugcuagagaaagauauaucaacuuuaccauauuuuugagaguauuuucagacggaugguaacagcucucuccucugagauggacaacucagauucaagagcugacaacauggugacccagaaaggcauuucaugagaaaugucuucuuguuaaaaagaucaguuuugauucuucuacaaacacagcaguauguacuuaagaacacuugaacaauucagcugcacaugugccuaccauuuuugccucauucuugcucauuuccuuauagugggacuuuuuacguacaugcucuaguguuaguguuuuuccugaggucuuauuugccuucuuuuacagauguucaugagagcacaguuugacuaugauccccaaaaggacaaccuuauuccuugcaaggaggcaggacugaaguuuguuacuggagacauuauccagauaaucaacaaagaugacagcaauugguggcaggggcggguggagggcuccuccaaagagucugcaggauuaaucccuucuccugagcuacaggaauggugagcauguuuguacugguggaaagccccugcaguagcuaauugcuuagcuucagaaaucugcugucuugcguauauuuuccauaucuccauauguucuaguuuucuuuacauaauagaugaggaaggguccacaggaguugauaacgguucauugaaaggacauuuguuucagggaaaggagccuuuuauuggccuguuuccuuaaacacucuuaccaguuacagagcccuauuccuuguuucccauaucucuucaaucacucaguacuguuucuaagaaaacuucugaaaacagucacauuuuaaguaugugucuuuuauacauauucuuguccucuagucagguugcugacuuagugaaaggcuaccacacaugaccauagagugguaaaaaaauccauauucauuguugaccuccuuguagaaaaugacaucagaaccucaaagagugcaaguuccuguaccagaccuauuucuuucuauuauguuuuugagauuauaauauaauuacaucauuuucccccuuucuuccuucuaaacuuuucauauauauuucuuugcucucuucagaauucauggccuguuuuuucauuagcaguugaauauauauacauacauacauacauucuuaauauacaaauuccuaaauauguaaguacaacccacuuagcugucuaucgagugccaaauggugaccccugcaaacauauagaggccuuuaguuugaaguuagaguucugcuuggucucauuuccaauuguaaaaagcaccuaaccacaggauguguuuuguauaaauaaauguuuaucauuagaacaacagaagaaauacaguacaaaccuggaagauguuggucaaaaccuggaguaugcugucuauaacuucugggccauuuuuagagcuaacgccuggugaagaacauaguaagaucaggaaaugcagauagcuaagacagacucaggagagcacaaagugaaacugaggcuuacuaaugaggcaugaaaucaauuuaguagacuacaacauacauuuuuuuuuuaaugagaguuagauauuguagcugaggccuguaauucagaaugcucagaagacuaaggcaaguucaaagccaccugagcuacauauuaagacccuggcuaaaaacaaaagcugauucauagaaacaucaguauagauuacacacuaacaggugguauuguuauugaagcuauuguuucagucauauauaugauucugugugcuuuauuuauagauuaaguuguuguagauaauauauuucuuaugaugaacugaguguuagcccaauuuuccagguuuuaccucaaagguggaagaauggucaggcugcacuaaggggaggauaucacuuuuuccuccugaaaacauuugcacugccuugugccugggugaccauguaaaauuaugaagaaaggaagggaagugugugagggcaucucugccugaagaauuuuagagucaaggaacugggucagucucaaaacuuaacuacagaaaagaaaggagguagcccaguacuucacaggccuuuacacugaggaccuacugaguuuuagucgucuguucuucacaggagaguggcaagcguggcucacucugcuccaagugaagcaccaaguugcagucccuuugggaagaagaagaaguguaaagacaaguaccuggcuaagcacaguuccaguaaguuuucugugucccucugaagaguccaaguagcauuaguguuucuccaccucuuuaaccagaaggaaagaggugaggaugcaguacauagugggauguauagaaaaugugccauuucuuuugacuuuccuuuacucauuuuauucauaaacuuacugcugucagagagauaaugccagugcauauucaugaaagcuaguggucuguccacaccuacucaucaccucaccucucaaguaacaaacugaucaagucuuccagacuuuucuccauucuuaucuuuauucugcugauucaguaucuacagaggaaugguuccaguacccacccagugguuaucaaaaucaacagaugcuccaacacccucaaaaaaggguguagaauuuauauaggacuuauguauauccuccuuugaaaauuuuaagcaaggcagaacugcacagugagaccaugacugaaaaagaaaaucuugauuuuuuucuaauacaaugaaaaugcuguauaaauaauugcaguauauuguuuagggaauaaugaaagagaaagucuguauauguuuaauauagaugcaaaauauuucaauuugugguugauugaaucugaggauacagggcucaugaauacggagggcugaauuucaaguggguugcugauaauaaaugaauaccaaucuauaauuuauuuaauguuuccaucuuguucggagcauucagagacagugacagaugcaugaacaaaucaaagaacccaaagcuaccauggcaaaggcaucugugaaggaguagaggaccguuugucuaagagccccuuuuccaucuugaaugguuggcucaauauugguucuguucucuaaaauaagggauguuagaggguuuacagugaugauauugauugaccucuaaguggcugugagacacccaaguuaaauguucuagagagauugaaucuguguuggggauagagaacuguuacagugcugagacugaaagagacugaaaaggucaggucaaagggauacagaaaagaacauagaguuauaaaaaaaagcauauaaaaucagaauccuauggacuagccuacagagccauguaaaaaguucagaugggggaugcugagaaaaccaaaucauagaccuaaaagaaccacaugcauauguaauacagagugagccugcucucacauccuguucuucaguuuaucagcaccuccuccagcugcuacagccauuuugcuagcauauuuaaugagcaaaacauuauuccucaguaaguuuggauuccgcuuggaauuguuuuucacggcauagucauggaauugagcuagaguuugguguguccagucucacugcuuaaacucuagccccugcaguuuuuuuuuuuuuucucaccuaacguucuagauaguucauucagaauuaaaauggggucaugucaguccuuuccucggaauuuuuaugggaaguacuuucugcuuuacuuucuuauauaucauucuucaucacauagaaauaucuaaacaucccucccagcaaccccccucugauuucauguccauggucucucucccugcauuuuauuuacuuuuuuguagacagggccucagaccuuggauuauaggcauguaccaccacacccaaccuucccuucuugcuggaucaagugugucaacuccuuaaccccagccagugcuuuaucaccccaccucugaaaauuaaugauuugauuuucuuugucucuaguuuuugaccaguuggauguuguuuccuaugaggaaguuguucggcucccugcauucaagaggaagaccuugguguugaucgguaucuuuuuacugcuccucaccaauuugcuaauucaagagcacaauucugucuuuauuuccaaucccauguuauaugucuacccuucuucaggaaaggcaguaaggaagauauguaguguggucucuuagauaccucacauagcaguuauaaagaacuucuggauccuacaaguaaucuaucuggauccacuucauacuacacgguuuucuacuguuuuuagcacauaauucuuuuauauuaaguuugcucuuugucuaccuguuuggauggcuuagggaauaaaaagaaaacuccccaguagcuaauuccucugaagaaauagcaauuauguuccauaucuuaacucuuaggccuuagaaugacuucccacucaaauggauacuacggaauugaagcuauuuggugaccccaaaucuugacaauuguaaugacucaguugcagccuuguuacaacaccgaacuguuugagcacugggauauagaaauccaccucccauuccuugucuuauccccagcaguguuucugagugaaagugauggaagccuuucuuuauccucacacaggagccaguggggugggucguagccauauuaagaauggucugcucagucacaauccagagaaguuugcguacccugccccauguaaguauuucucaggagccuaagggucaggcagaaauguccuguuacaaaauuuagaaucaguguuuuucugaaaugucacauguuuuuguucuuguuauuuuauuucauauauuuaaucaugaaaacugaaaauuugggggguuggggagauaacucugucaguaaaguucucggaaaguaugacguccugauuucagucuuuggaauccacauugaagagcaaaggaagggagggagggaggaagggagggagggagggagggagagaaagagggaguaggagggagaaggaaagggaaagggagagggggaaggaaggaaaaaucacacauaaaacacaaaauauuuggaaauguaauauauacuuauagggcugaggagauggcugcuaacccuaacaauaugaauuuaacccucagaaccacaugguaguagaacugacucccacugguugaccccugacuuucauaugcacaucauggcacuggcacacacccacacacacacacacacacacacacacacacacacacacccuugccaggguuuucaaugugcaaguugagggaaagaagucauuuuagagacaagugucuggcguggaagguaaagaugguucaucauaggauaaaaagaggcugggaauauauaauuuaucucugcacuagaguguuacucuuaacauuuuaacuuuuuuaaagaauuauuuauuacucaguauuauuauacaguauuauuaugcaguguguguacucaugccacagcaugugugugugugcacucauuuuauagcauguguauggaagucagaauacaauuuauaggagucaguccuuuccuuccaccacaugguuucagguucucagguuaugagccuucuguggcaaaugcugaaaaauugccagccccaacauuuuaacuuuuuaacaaaauguuuaaacaaaaccauuguguucuuuccaugucauaaaaacaaaacagugcuggagagauggguagguggggguauuguaucuguacuaccuuccaguaccaauccuucaguucaugagaaaaacaucucuauuauauuaucugccccaaagauggguagaguuuccauauagacauuuugagucaguacacuaaaagauagcaaggaccaagaagagcucaucaaggauuugaguucuuauacacagauacaacacggccaccaaagaagagugaggaagaugggaaggaguaucauuucaucucaacagaggagaugacgaagaacaucucugccaaugaguucuuggaguuuggcagcuaucagggcaacauguuuggcaccaaauuugaaacagugcaccagauucauaagcaggacaagauugccauccuugacauugagccccagguauguaggcauaaaagggcaggaacaaugguuucagccauguaaugagggacgugagcuccuggaaaucuugcuuccuaaaguuuuaguggggucagcaugauacaaauugguauugggauuuaacacuuauuagaaggaauacauucugacagacaacuggguuguuuguuucuccuuuucuucccuuuuccuagacccuaaagacuguucggacagcugagcuuucaccuuucauuguguucaucgcaccuacugaccagggcacucaggugggaaaggggucacauggguggagguccacaccuuuuaggucauugucaacuguuuuuuccaaggccaagaagacaaagggcaugcauauuuuauucauuccagaguuauucaagagauuaguuauuaaauaauucaauucuagucauaguccugaaugaacaguucuaauggcugagacggacaguuaaauaaauccuauuucuuauaugauauauacugaugugaagcaaacagaaggagcugugaaggauggaggugguacuagauccaucacagggugcaguguggcuacagugggaaaggagccugcuuguaaaaguggcuguuuccucuuuaacaucauucauaacauuuuuaaaagaauugguuaacauuuuagaagaauggcauuuucacuuuguuuuacuauaaaagauuguuucuuacuauugagagucaaucacugcaauugggaggugaaaggaagaggaucaggagcucaaggccagucuggaguucaaaggcagucgagucaauaagacugccacacacacuuauuaaaaguuauuuguauugcuuguauaucuggccauauccuuagcucauguuuccauugaguuagugacuucaucuaagaauucuauauuaugguacuucccuguaaugaaaguuacaaauauccccaccaccacuaugacacauauuucucuauccuuuugccuuuauguaguuaacugaccauuggagccagaggcuugagacuugucaauaaacuuucucccuuauccuuggauuauagcuguaguaguugcuaaaauggcuuuuccauaaacaaagggcuaaaacuaagugaaugcuagugaaggcugugcuagguaauuaggguuaguuuggcauucauuagaauaguuaagugguucucaaccccuuuggcaaacauuauauucuuaauugguuaccuagcagauacuaggccacaggauggaucaccaccaugcaaaaaaacagauggggaaccaguuaauguaaacuuguuuaaaucuucccuuugcugcugugauuaaagacugcugcuucaucuauggcuuucuucuuugcagacugaagcccugcagcagcugcagaaggacucugaggccauccguagucaguaugcucauuacuuugaccucucuuuggugaauaauaguguugaugaaacucuuaagaaauugcaagaagccuuugaccaggcuugcaguucuccacagugggugccugucuccuggguuuacuaagcuuacagaauuggcaaacauguuucagccagcauuuggaaugccaccuccccgcacccccucccuugcuuaagccaaaaggguugcuucaacuuuuagcucugcuguuuucuuacucaggcuccuaaaggggugaagcuuuccuacuaucuacauuucaaaaugaucucuggaaaauugccauaagaauaaccaaaugcaaugcuacauagauaaaccaacugucccccugaagccugagcuccuuugcuuucaacuauagaaugucuuuuuacucuggaauaaauaucuucugaaaacuuucuaaaaugccaaaaucaaacagcugugcaauagaaugucugcuguagggaaaaucuuccaaagcaauaaaaaugcugcuguguuaaaguacccgugacccuguaacuccauucccaaucuuaaccuuccaagcaaugacauuaacauaagaucucugggaauuaccugucacugccucuauaggucugguauucacaaugcacaaaggcgucuucucuaggacuuguuaagucguaagagaaugguuuaaaacauguuacaaaagcaggggcuguuugggcauucuauaccugccuaugcuauuaacaauuuccccuaaaacuuguguuuauauucuugguuuugggcacauauuuaagcaaaguucccugcucccucugcagucaacaccaaaacuggcaguuuccuaccuggaguaccuccaaccucuucacaagcccaguacaauauaaaugcaucuaccccuuuccucuuaacccuggauuaguaaugaucucccuugagagcagauaggccccagugccaauguaagaaagacucagaauuaggaaauuuaaaaguagccaaaggaaaagcaaauucaaaauaggacauaaaccucagacuuuuaauaaaaauauucucucacuuuuguugccaguccaagauuaucauaguaaaucuaacaggaauacuuuuuaaaaaaaaaaaaacuacaaauuacauucuucagcaaugaacaauuccauucugaacaauuccauucuuuuuuuuuucuuuuuuuguuuuuuuguuuuuuuuuuuguuuuuuuuguuuuuugguuuuuuuguuuuguuuuuuguuuuuuugguuuuuuuuuuuucgagacaggguuucucuguauagccuggacuguccuggaacucacucuguagaccaggcuggcuuugaacucagaaauccaccugccucugccucccaagugcugggauuaaaggcaugcgccaccacgcccggcaauuccauucuuuaaaagaaaacaaauaggaagguacaggaaugcuuuggcuuccauaagaaacacaaguagccauauagagaaauccuguuguacacaaaaauacagaguacuagccuaaauaucauagauaccaccaggcaagguuaauaccugaauagagcaguccucauagaacacuggagauaagagucccccagugaacauaguucaauuacauuuuuucucucacagaagguucuauaccauuuuauguagcagauuuaauuuuuaccaacuuuuuaaaaagcaaaguaggagaggacuaucuauggcauuguugaaaaugcucauuaguaaauagcugcagauaguuacuaggccaugccaugucuaaagguguggcuuccucaagcaagcagagggguugguggcaaaggccugauuuuaucucucauauccuuaaaacaggacaggaugggaugagauggccacaccagcuaaccacugaggucacaaguggcagcuaaaaguauaccagaacuuucuacucugggaccucuguucucccucaacaaaaaguuuuuccaauaaggcuuuucuuuuucuucccagcuggacauaaugcuuccagaaguggcuuaaacuauucagacaucucuucuaccacuuuuacuuucuucuucuuuuucuuuuugguggugucguuguccu

SEQ ID NO: 9585 - RNA, 2893 nt, Mus musculus
ucucggggagguucucgcucuguccgucucgcuccgucucucgcuuccccccgccccggcucccuucgggaccccccuccccggucgccggcguguggcggagugugugcgagggcggagggcgggggcgggcguccgggggggcgggggcgggcgccgcggcccccgggacggcggccgggacugcgcggcgccauggacgucgagaggcugcaggaggugcugaaagauuuugagaagagagggaaaaaggaauuuuguccuguacuggaucaguuucucugucauguagcuaaaacuggagaaacaaugauucaguggucccaauuuaaaggcuauuucauuuucaaacuggagaaagugauggaugauuucagaacuucagcuccugaaccaagagguccucccaauccuaauguugaauauauucccuuugaugaaaugaagggaagaauacugaaaauugucacuggauuuaaugguaucccuuuuacuauucagcggcuaugugaauugcuaaccgauccaagaagaaauuauacagggacaaguuucucagaggaguagagaagaaugugaugguuguuagcugcguuuguccauccucagagaagaacaauucuaauagcuuaaauagaaugaaugguguuauguuuccuggaaacucaccaaacuauacugacaggucuaauauaaacgggccuggaacaccuaggccacuuaaucgaccaaagcuuucuuugucagcccccuugacaacaaaugguuugccugagagcacagauagcaaagauucugagcugcagcuaagugaagagaaaggccacagugauucuucagccucugaaucagaaguuuccuuacugagcccuguuaaaaauaaacauccagaugaagaugcuguggagucugaggaacaugaggugaaaagacugaaguuugacaaagaaggugacgucagagagacagcuagccaaacggugucuggugaagucucuucaguuagagcagaggaaacggaaacagcaauucccccuccugacaaggacagagaaagucgaaccaggcagcacuguacagaagaggaggaggaggaggaagaagaagaggaagaggaggaggaagaaucguuuaugacaccaagagaaauggucccagaaagaaaaaaucaagaaaaggaaucugaugacaccuuaacugugaaugaagagacuucagaggagagccaucagauggaaggcucuggugugucuccagcucagacagacuccacuucagaaaggagugacagugcaggggccucaaggaguggcucugacugccuggagacacaggagucaggagggccuccuuccaguaagaccggagaaagugugucagugccgucguccauggagaaugaggaagccacagaagucacagaugacccaauggaacaagacuaacuacuuaaaaacacuuagaggcaguauuuuacauacaguucugguuuuacacuguauaagacuuuuaaguaauaaaguggaccuuuaguuuuacaagagaaacaggcuguaaaauaaagaaccuuaagaauaaacccugaagguuguauguggaagagcugugaguacggcuccucugggucccacuuagugcugauuuucuuguuugguuugguuuuuuguuugcuuuuuuccugguguacucaaaucagugguuuguguauagauuuuuuuuuaauuuagaauaaaaguuuuuaaacuggaagauaauuauaauuuugaaaacuuuaaagaugaucucacuugguuuauacauacacaaggaagauuuuugucuugucucuagcaguuuccauauuuuggucauaguuuaaacauguuaacgugaauuaauaggguuucaugugguuucagauuuuuauuguucgacuguacaauggaaccuuaagucauauauacauauauagauuauccugaggggggguguuauauuuuucuguuucuauaagagaugaauacagugaauacuuuuuuauugguaaugacugaguucacuucuuucagaagacaucuucucuucugaguaguugagacaaaaaucuggccccugugagauccugggaaucuuucagucuguugaaauaccagguuaaacacauuccaagagaucugugcaaacuaaauucuuuuguauacuucuaaggugccugagacaacaagacuucauuuauuuauggaaagugugcuuuaucuugggaguugugcucaagcauuagcuugcugucuguagaaugagugcuucggagccugacaugaaaccaucucaagagcccacaggucccauaacauucgguugcuuuucugaacacugucaacaucacaucugucuuucugaauaauccuauaugccgcauggcacuggugugaaacaucacuguacuggaagaauuaguagaggacuucaguaauguaccugagcuaaaaugaccgaggcguuaggggugcacagaaaccaccaugaucuguauaacauuuugaagugaauuaauauuuuugaacaugcuucuucaacagccaguguuauauuuuucagaucaacacaaagcacaaugguuacuacucuauaaacucaauauuuucaaauucacauauuuaaagucaugcaagcugcaacuucccugucagaauuacuggcugccaaauuuauaccuguuucuucagcuguacuuuuugauauuuagaauuuuuaaauuucuguaaaguagguuuuguagacuguaauguguucacugccuuugugaagcgguauauaauuguauaauuucguguguaacugaaugcuugggcuuucaauacaguauucauauaaagcaauaaauauuaauguuaugaaaaaaaaaagaauagac

SEQ ID NO: 9586 - RNA, 2581 nt, Mus musculus
aacaguugaagacaguucuuuauuucuauuaccaaauauggaacauugaauguaguauguacauuuugcccaaaagucacaaaaauaacuaauuucuccaauaauguaagucaaaagaguuuugauuaccuauuugcaagauuuaucuugacaaaaagaaaugccaaagaccauguuccuuauuacuuuuuuauuacuguuaaauuuguagcuggcaaaccauacuggauacaucaaaguugacuggcaaagaguagaaaaagacaugaagaaagccaaagagcaguugaaaauucguaagaauaagcaaauaccaacugaggucaagagcaaagcugaggagguaagacuuguuuuguucagauuuaauauaugaaaaguacaggcaguuuuguguagaaaacaggauauauaauuaucuuagcaguauaaaaagcuuuaugauaacaaagaacuuggagcagugagacaaaaacuauauucuaugucacucuuagaauaucauuacuguaaaaacaauuugcaugggacaaggucucauuauauaacccaggcuggccuaaaauuccugcuucaaccucuuaagugcuaggauaacauguaugugcuaccuaguguauuucaugaaggcacuuuaaaaauguauuuuauuuuauuuuuuaucuguauguauuuuugccuauauguauaucuguauacguacagauacaaguguguaccuguggugcuuguaggggcaauaagagggcaucagaucaggggcuggagagauggcucagcaguuaagagcacugacugcucuucuaggguucccaaguucaauucccagccaccacauaguggcucacaaccaucuguaaugggaugcaguacccucuuuuggugugucugaugggugcaacaguguacucacauaaauaaaauaaguaaaucuuuuaaaaaagggcaucagaucucauggaacaacaguuaccaauggcuaugagcugucaugugggugcugagaauugaaccugggucuucugucuuuccagccucuuguaaagcuuaguaauugaaauauuugaugaccuuugucaguaaaugagaauacaaaggaaaugaagauaguaguuguacuuaacuaguucuuauaagaguggggguaccacaguuguugggguguacugccaaugugaacauuuugaauuacauuuuaucucugugccugcucaucuuugaaauagccaaacuguuuguucugcacaugauuaguagaaaugcuuagauuauagauugguagccuuuuucugaagauaaccagaugguaaauauuuucaguuuuugaguuauggucucuaucacaacaaccugacuuccucauauagagugaaaauagccauaaaugauauauguccuccacacacaugaaugcgcauucauauauacauacuccucagauaaacauaugaaaauauaaguaauuuuuaaaagauuuuucuuuaguagaccucuguuugaggaaauauuaagggcugcaguggaagugaaacaaggagacauaauguccuagauucauuuuguuucuggaauaaaguauucugaccaaaagcaacuuaagggaggaaaggguugauccagcuuacaauucuaggcuucaggccaucauugaggggaagucaaggcaggaacuuggacagcuaaucacauuaauccuaaauugagagcagagagaaacaaguggaucuuugcugucugcuuucucucccacacagcauuuccucugaccaaguaaucaauucaucgccaaagaccaugcggcaagaauuacagagaauguucuuggcugguuggcagacaggcuucugcucaccuagcuuuuuuguacaguucaugucuagggaauggugcugcccacaguauuguaggccauccuauaguagccaacaaucaggacagucccuuacaacaugcccaggucaauaugaucuaggucagugguuuucauccuuccuaaugcuguaacccuuuaauauaauuccucauauugucgugaccccccaaucauaaaauuauuuucauugcuacuucauaacuguaauuuugcuauuguuaugaauuauaaugcaaauuaucuauguuuucaaaugcucuuaggcaacccaagaaccacagguugaaaaacacugaaauagaaauucucuucucagauaauaguugguugugucaaguugacaguuuaagcuaacuaggauaucuagauacagagguagugaagagacacuguguacuuugcauaauggugcaaggaggauggacggagagugaugggaauguaacagugcaaauggcuuacaucguuggaaagugcuuaacuucaagaacugauuuggccuggccuggggauauggcuuaguggguaaagugauugccaugcaagucugaagaccacaguuuuggauuccuagcacucaugugaggccaggugggugagguggucugcuuucagucccagggcuauggcaagaaucaccagagcaagcuggcuagccugcaucguaaucucuagguccagcaagagauccugccucaguauauaaug

SEQ ID NO: 9587 - RNA, 60986 nt, Mus musculus
gacgccaacgaucgaugccucagaagguaguuauuugcucuggugcuuucugaagauggcggcggcuaaggacggaugcggccuagaaacugcugcuggaaacgggcggcggcuccacuuagggauuccugaagcaguguuugugguaagaaacucuuucucagcgucuuaaucugauauuggagauugcuuuccagucacuucccaggucugggucguugggaggaacagagcuaaagggucccggaagggaaugucuggccuuuugccucuuccugcaucuuggcuuuuuaggccuggcgggcgauagcuuugaagaaagguaguccaaccccggcccagaagagggagcagggaggagaacuggguagcuggagacggaugcgaggcggauuggggcguggcgucccuugaaacugaccaguugcugccuguugucgccuaaagaaaaacaaaaaacagcagcaacgguuauugagcucaagaccgcagugaugccggagauguagauggguggacauuuagcacagagagcaggcagagcagcuguuuguaggguguggguacugaguggcacccagucagcuugagcacggccgugguccguuuccuugggaauggaagcagacugcugagaaaaguaaacguuagcacaaacguuaaguccauguguucuugcuuuuaagaauugaggcuuauguaaugggcaaccggcuguuauuagguuuuugaaaccauuuuauauuugcuuuuaguaauacuauuuaagcaguuuguagacaacaaauuuuaugcaguugugaagauugugggaaaugcaauuggaagguuucauguaacaggaccgacccaaguuaaauauuuguacugaagcauauaaaaucuuagucaaaauuuccuugauucuuuuuugguauguaccaaaaauuauauauauucugucuuauugcuaacauucuucaaaagacccuuuuuuucuuuuacuuaaaucacauuuuauauuguauauuuuaaugugcugguggaauaaauuuuuauguguauucucaauguucugugcuuuuaaaaauauuuuucaagugaucuuuacaugaaguaauauuuucugagguucagaaauuuucuuagaaaauuugcaaaacuuuaugagggaguuacuguuguucaaauuuuguagauguaguugaugaaacccagaaauagagguauccagaaguagcauuugagcagucaggagagcuuuagaaccucuuuggucaugcucugcuacuuagaggugaggaaauuuuguguuauuucuccugauccuauuauaaugccugauauauaaggauguaaauauauaaauuuccauucugucuuaaauauaacccgauagcaguaacuucagaaauggaauuaaugaauacaaacuuuaucugagggauuuaccguaaaauaaacuuuuauuuauuuauuuuauuuauuuauuuuuuugagacagcccagguuggcuuagaacucacuguuuggauuaggauggccucaaauucauagugccuguccugcuucugcuuuccaaguuuguagguuaaagacagacacugugacaacuggcuguaaaauuuuaugguuaaauuuuauaccaacacgauguaauaagcaguccaaacuuuauauaauuaucuugauguuccaaaacuaauggaaguggcaugauauuuuaacaacauaaaauucuaugucugagaguauuugaauccuacccaacuuccaucuugcugcuuagucuugaguuucuaugggugacaauauuuauggacuuauuuugaaaaauaaaauauguauucaauugaauuaaaucaguaagaaaaaugauaacuuuggcacacaauuugcucaauucuuuagugacuagggcacaugaguaggcagugugcuucauugcuagcaauuuucauauuuauuacuagagccacaugagaaauguauaaagcaggcaaguucaugugucuuacauuaaaaacagaaaaauaaagaauaaauuaccuacauaauguauguaaacuguccgaaauggucuuucuugaacuuuuuuuuucuuuuuuugagacaaaguauguuguccaggcugacaacuuuggauccuuucgcuucuacuuccuaaguucugggauaacagaccuguagcaucaugucuaacuucucuuuaacuuuucuucugccagugcuggggauaaccuagggccaccugucuuguaggcaagugguauaccacugagcuccagggcagccaucuuuaacucuuuauaguuagguuuuuaauuaaaaacaagcuuucagaaaagaaaaauuaguucucuccaguggagucucacuagguauauuagccauacuaacggguggauuccaugcagggcaguaaauagacggccaccacaaaauuaauucaaucguauuguuguagacuuuuuguguaguauuguuugaguauuuuucucccuccuggccuuuugccuggaugcuuucauuucagauuuuguguuuuuauggauuuuuuuuguuuuuaaaauuauggcuuuuuguuuguuugccuauuuucuaaagaaagagaaauuggggaguuggagaggugggaggaucuuggaggaguugggagaggggaaguugaucagauuauuuuaugaaauuuuuucuucaaaaaaaauuaaaugaaacaaaccuuugaggaaaacaaaacuuguucuuuuacauuuuauaaacaaaguaguaaaaaucagguuuguaauaugaauuuaaaacuucguaugauuuuucauauuaaaggaagauguagauucuuucaugaagcagccugggaaugagacugcagauacaguguuaaagaagcuggaugaacaauaccagaaguauaaguuuauggaacucaaccuugcucagaaaaaaaggagguaaucaaaauuucuacauuuaaaaaucuuuacuauaauuauuaaugaauauaaguuguauacacuaaugaauuuuacucugauauauuuauacaugcaaauauugugcuuagaucauauucauuuucccugaugccaaccauccuuuccuuuuacuuuagucugguauauuuuauuuaacaugauaaccuaaaguucugcuaaugguguuguaagugacauauuuucauucuuacuaaauuauugcauaauguucuauuucuacauauaugcauagaccuugcauauauaccuguuuauccaaucaucugauguucuugauuauugugaauaaugccacaauauuaguaugcacagaacuucauuacuuuauuuucuuuggauaugcacucaggaauaauaaagcugaaucaaauaguguuuccauuuuuaguuuuucaauuaugugugugugugugcucauauguaugcagguucaugcaugccaugccacaagcauaugcucaaaugugcuauagugcgcacauguggaggucagagaacaacuuucuagaaucauuuuccuucugcuaccuuguggaggcagggucucucuugcuauuauuuuugccacuuuguguacucacacuagcugaccugugagccucugggcaguucuccugucucucgggcaguucucauuuugccaugcugagauuacagaugcuagccauugaauccuguuuuuuuguuuuguuuuguuuuguuuuguuuuguuuugugagauucagagguugaacuaagguugcucaucaguaaggauuuugauccauuucucuggccucauuuuuauguuucugaggagcauucauacuguuuuuuuuauaaaagguauuauaaguuauauuauguaagguaacauugcauuuauauuauauaacaguauauaaaguacccuuuuccuguauauccuugccaauacugcuaauuaguuauuuuugagauagggucucauguaguguagucuggucuugaauuugcuauguagcaaaggaugaccuugagguccugacccuucugccucuaccucccaaauguuggaguuacagguguguaccguacugguucauugaaccuagggccucauguguacaaggcaaguguucuacuuuugaguuauacugcuaguccuuuuuuuuuuuuauuuugaaauagguucuuaaauuguccagguaguucuugaacuuucaaucuuucugucucugccucccaaguauuugggaugauacuguuuugacucuagugagauggaaucuuuguaguuuuaauuugcauuuuuugaggccuaaagguguugaacauuuucuuuauacauuuauuagccauuugguacgucaaaucauuaucuacuuaguuauuggauuauuuuuucuuuugguuaaguuuuuuuuaauucuuuacauauucuagauaucaaugcacuauuagguaaauaguuggcaauauuuucuauccgcucuaaacuuguuagucuacugauugguucauuugcugugcagagcuuuuuaauuugguauaauuucauuuuacaauucuguauuuugagcuacuggaauccuauugaaaaaauuguagccuaugucaauaucuugaaauauuucccucauguuuccuguaguaguuuugaaugucagguguugacuucaagguuuuugauguauuuugaauuuugauuuguuccuuuuuuguacagugugaugggggauaugguuuuaguuuuuuaauauguggauauucaguuuucuuagcaccauuuauugaagagacucuccuuucuccaucagauguucuuggcaucuuuguugagaugguuuuagcuauauguguuuauuucuagguccuuuguuuuauaucaguggucucugucugucuguucuuuuuugucauuaugauuuuuuuauucuuauucauccagcauugcuuuuuguucaagguuaccuuggucauuuggaguuucauaugaauuuuaggauugugauuucuaguucugugaagaaugucauuggaauuuugcugggcuuaggauugaguucagagaauacuuuugguaauaugaccauuuuuacaauauuaauuuugcccauccaugaacauagaaugaacauccuucuaccuuucuaguaucuuuauuuccuuuguuuaguauuuuauaaauuucaauguagaaguauuuuaccuuauugaucagguuucuguuguuugucucuguuuuauucauuuguggcuauuaugaaugggauuguuuuuauuucuuucuuagugaauucauuauugcugcauagaaaaucuauuaauuuuugcuuaaauugcuuaccaauucauccaucuacuaaucaaacccaauucaauuuaucacugagaucggaugagauucucuuuguuuucagggucagauggcugaagacuuagcaguuguaagcaucuuuugauggagacuuugggguucucuugguauagaaucauauggcuaauuugauuucuuccuuuucuauuugauuuccaucuauucuuuugcuagcuaaaaugugaaguacuguauugaggaagaguggcaagaguagauagagaucuuugccuuucuuuuuauagcccaugacugucuuuauuaucuuugcaugaacuggggggucaauauuuaugucucagcuucacagcuuggcccuuucucugccucugaagaucauauauauguccauauccuuuccuaccuuguaucugaauaugugcugaguaugcauaccuaaaacagccccauguaguacuacauagaugcuugauguuuucagacuugagauuuaauauauuuggauacaucuuguuuuaauaauuagcuaaaugaaaguuuauaaucaaaugcagagccugugaaucacuucugcagaaugugaccuguucuagaaauguuaauaacagggaguuggacauaugaaguaaggcuuuuuauaccauguauuuuauauaugcuuaguauuacaucuuuuuuaaaaaaaaaagauuuauuuauuauauauaaguacacuguagcugacuucagacacaccagaagaggcuaccagaccucuacagaugguugugagcuaucaugugguugcugggauuugaacucaggaccucuggaagagcagucagugcucuuaacugcugcucccuacauuuuauuuuuuaauuuuaaaauauuuuaugugugacuggagagauggcucugcaguuaaaagcaccaacugcuuuucuagaggacccagguucaauucccagcauccacguagcaguucacaauaaucuguaacuccaagauccaacagccucaaacagacuuacauggagacaaaacuucaguguauauuaaaaaaaauaaaauaaauaucuaauguauaugaauguuuugccuacuuguaugucugugcaccgugugcaugucuggugcuuguagagaucagaauugauaucagaucuacaacugggcuauggaugguuguaagccaccacgaaggugcaaggaauugaaucuggguccucugaaagaacaacaaaugcucuaaacuucuuuagucccuuaaauauuuuaauuaaauguuuguauccuuauaguauuuucuguaugguuuauuaaguauacuuuguuuugcaauguuuaucaaaucuuuucuuauaucaaaaauauuauuuuaaauaaaauuuauaaaauauaaccuauauuuauaaauaguuuuuaagggcauauuaguugaaaauugcaaugcuaguaagaugauugugauuuuuuuuauuuuauuuauuuauuugucuuuuugagacaggguuucucuguauagcucuggcuguccuggaauucacuuuguagaccaggcuggccucgaacucagaaauccgccugccucugccucccgaauuauuuauuuauuuaauuuuuguuuuuugagacaggguuucucuguauagcccuggcuguccuggaacucacucuguagaccaggcuggccucgaauucagagauccgccugcaucugccccccaagugcuggaauuaaaaggcgugcgccaccacugcucagcguaauguuuauuuuugcugguaaaauacuuuguuaaccuuuuuuucccuccucacaggcugaaaggucagauuccugaaauuaaacagacuuuggaaauucugaaauacaugcagaagaaaaaaguaaguguaccuuuguuugcagguauaagcaaaucagcauuguuuuggcagaggccugauuuccuugacucuuugguuauaggcauuucauuuguuuuguaggguucacccuaucuuuuugagcauauguaguaauguuaaaaguaguauacuuucaccaaaaaagauggcuuuguggucuuccccuaaaaugacgccuaauucuaaggucuucacuuagauuauuuuguaaauuuuuaauuagaaaugauuuuagguauucuuaaaauguuuuauucugagguaguaacauuuaagaguguauuuauuuauuuguuuuuauuuuuaugugugugcuggcauacuggcuuuguagaaggaguuugugagugacccuuuuguuucuguuuuuacuuuuuggggaggggguuucuuguuuuuauuuuuuauuguuuuguuuugaauaguuugagaagauuagguguagauugucuuuaaaugucugauauaauuguucugugaaauuuucugguccuggacucuuuuuuagcuggaaggcuuuuuauuauuauauccucuccucauuucuuaggagccuguuuaggucauugacuucuugguuuaauuuuggugguuuggcugaauccuacucauccauuucuuuuagguuuuccaucuuaguggaguacagguuuuuaaaauagucccucauaauauucuacauuucuuugaugucuguuguaauguuucccuguucauuucugauacuguuaauuuggaucccucuuuucuuucuuuugguuaguugggccaaggguauuaaguuuugucugucuuucaaagaaucagaucuucgguuuuuugauucuuuauauuguuuucuugguuucuguuuaguugauuucugcucugauuuuuauuauuuuuugauguugauuugguuuggauuugguucguucuuuugaguugcaucauuaaaccauuuauuuguguucuuucugauuuuuuuaaauguaagcacuuagagcuguacauuuuccucauagggcugcuuucagugugucuuagagagguguucucuuuuagaagacgcuuccaugugaugcugaguagaauguauucuuuggucuuuggguaugauauucuguagauaucuguuagguccauuugauguacgaugucaauuaauucugauauuucucugucuuuugucuagaugaccugucuauuggagaaagugggguauugaaaucaccuacuaauggacugauguuuaucugugucuaaauucaguaguacaguuuuuuuuuuuuuuaaugaaauugggugccccagaguuagcauauuuguuuaggauaguaauagcuuccugguugacuguucccuugauuagaaugaugugucccucuuuaucuguucugauaguuuaaagucaauuuugucagauauuaggauagugacaucugcuugauuccuagucucauuugauuuagguacuuuuguuuauccuuuuacucuaaggcauuauguaucuuuaaaacuaagauguguuuuggaaacuuacaaucuuuacaguuguaggaacuauuauuauuuuuauuuuuugguuggggaacuugaggcauagauaaacagugacaugcuaaauuuacacagcuaguaaguagcugaaucagaguccauuuccagucauuuggugguaauagucauuuauuucuuuuccaacuaaauaaaucuucaugaugguacuguuuuaaaugucuugggauuagguggauuaggugugggauuccuccuguauaaccuugauaucaacuuggccuguuugugguacugucauuucuuuuaaaggagucuaccaauucaauggagacgagauucuuacuggccgauaaccuguacugcaaagcuucagucccuccuacugauaaaguaugccuaugguuggggguaaguacauguuauagccacagccaauauaguuguaaaccaagguuuucugacuagcaaaacaguauuucuucuuuuuuuuuuuauguuuucacugacuuaucuuuuuuuauuauuagauauuuucuucauuuacaauucaaaugcuaucccaaaagucccuuauacccuuccccuacccuguuuucuaacccacucacuccugcuuccuggcccugguauuccccuguauuggggcauauaaucuuugcaagaccaaggggccucucuucccagugauggccgacuaggccaucuucugcuacauaugcagcuagagacaagagcucugggggguacugguuaguucauauuguuguuccaccuauaggguugcagaucccuuuagcuccuuggguauuuucucuagcaccuccauuggggaccauguauuccauucaguagaugacucugagcuuccacuucuguauuugccaggcacuggcauagccucacaagagucaucuauaucagggucuuggcggagaugagauggaaggaacggccgugcagagacugccccaucuggggauccaugccauaaucaaccaccaaacgcagacacaauugcauaugccaguauuucuucuuacuaugcaauguuuuuaucucccuuugauuuuagaaagaauaaagcuguagaguucaaguaguccuuauuagaaacuuacuggaauuaagaguguuuuuaaagauguuuaaagauuuuucccaaucaagacaaaaaauugaccaaaucuagucuuguaguuguguguguguguguguguguguaaacacaggaguuugaguaugcugggaaagcagucuaccauggaucuagucaucaccccccccuuuuuuuugauguuugguuuuugguuuuuuucgagacaggguuuguauagcccuggcugucuugggacucacuuuguagaccaggcuggccucgaacucagaaaucugccugccucugccucccaagugccaccaccgccuggcccccuuuguuuuuuuaagacucauguaguccauacugucuucgcaucauucuugccuuuguuuaccaaauacugagauggcagacauaccaccaugcccaacuauuucuccaguuaauguuuugucuuuuuuaaaugcauaagaaggaagagaguggggagaagauguggcucauuugguaaaguacuugcuuuacaagcauuacaacuugaguccaauacccagaacucacauaaaaaaugcuagacauuguauguuugagauccuaucccuugggagucagagauaggaggauuacuacgagucauuggccaguuagucuagccuaauugaugggcucuggccaaugagaaacccuauuuuaaaugaugacaccuaagguugugcuuguguuuacauacaugcacacauauauacaaacauauauaaaaagcauguaacagaaggaagaguaaaagucaaacaguacuguuuuacucugauaaauguuugucuauaagacuguaauaguuuuacaaagagcccuauaaauuuaaggagaaaaagauuauaaaaacucugagguuagaauaauuuaguuuuuuauuuuaugugcaugaguauuauguacuuggaucuauguucacugcaugcaugccuggugcucauggaggccagaagagggugucacauucccugaaaguguaguuaagagauuguugugagcugugaugugggugcugggaauugaagccuagcucgcuagugcucucuagucacuagaggagacuguucuuaaaaauauucugcuuuagauacuuucauagauuuuugucuaugcuuuuucuucauucuuucccuuuuuuugcuguuuuauuuauuuauuuauuuauuuauuuuauuauuuugagacagguucuuucuaugugucccuugcugucuuggagcucacuauguaaacuaggcuggccucaaacucaaagagaucugccugccucuaccuccugagugcugggauuaaagacugacacugugccuggcccagcacuuucugugcuuuuucacccuugcuuuucuuagaccccagaccuagcuaaauacaggauuuuuuuuuucuuuuacucaaagcaagcuccuaugcaaaguagcaaguacacaaugcacacuguuuccugcuauccagauugccucauuggaaggauuuuccuuugcugcuguuguaagacaugcucuagugcuaugaacaauggaucauuuaacacagugaaacucaauuuuaugauauaguuaguuuauguacucaguguuuguuaguugaguucauuucaguuuccuguuuagucuuaguucuguuuuuaaaaggaaagauucaguguuuaucacuuaggcuuuuauuuucucauuuuuaacauucucugaaaauuucacacguauauacaauguauuuuuaucauacccauccucacuauguuccuucaguucucccaggcacuucaaccuguuuccuucuagacuuuaugugaguuuuuugucaucauuaguagcucccugauuucaauuaguacugaccauauauagauggcuauaggggccaucugcugaggcaugggcaaccuaccaaugccagcaucucuggggagggacuuucguucagcagcuaagggguugggcaucugaagcuccuccuuuuauccaugcuggaauguuagcuggauuaauuucauauaggcaaucauggcuauugugaguugauuugcucaucaaccaugccauguccagaagacagcauuucacacuucuucucuggcuuuuauauuccuucugcccacaucugugaugcucccugagccuuggauugggggaaguugauguagaaaacuuuuuuuuuaagguugagcauucacagucacuuagucugaacagaccaguuaugacucucuguaguaaccacuccccacugcaaaaagaaucuucucugaaccaagauugagagcagcaaaauauucugguauaaacaaaaaagaaggcaguuugacaugaccauuuaguggaacagcagcaguuaagcccaacuuagggcuggucuauuaucucucagucauggccuacuaaaguauagaaaauauacccgaauguaucacuguggaaagacugucuauauucagcuuauuuugacgugguuacauuuguaaagaaauuauaugcucaaauaauuuuuaaauuauuuuuuuugcagucugaaguacugaggguuaagacuggauuuuuuuuggaaaaagacacugcuuaauccauaauauauuuuauuucugcauaagguuuuagguaccgggagguuagagcuucaguauaucuuuugauguacacaguugaauucaaauuaacaucuuaaguucauuuucuugcuuuugccccuauauuccaaaauccuuuucagacauaguggguagaacuauccauuaagaucuguugggucaugccauuauucuguccaaauuuuguggucguuucucaucuuauuucaaggacaaucuuuugaguagcuggcaagucccaaugcagucuaguacucuuuuauacuucucuuaccuaauuuuccaguuuuuuguuuggucacacuuggacuucuuccuggaccuagauaaucgugauagauaaauaaauaaauaaauaaauaaauaaagggucugccucagagccuuuauuguggaauucuuuuuagcuuuucuagcuguaacugcccaaguuauauuuuuagaacacaugauagcaugucauuuuucugaugaagguuccaucauuuccucugucaaaagcuaggaccacuucugguacaaugugacuuuuacuuagucucacagauaucguuucuuguaaacgugggguuuuccuccuugcuuuuuuuuuuuuaaagaauuguguaugagugagugaguguaugugguguauguaugugagagagagaaagggugaagggagagaggggagagagaggauagaaaggagagagagaggagagagggagagacagagagagagagagagagagagagagagagagagagagagagagagagagagagagauaugaguauagguguucagaggccagaagaaggcaucaauucugugaaguuggagucacaggcaguugcccaacaugagggcugugacccaagcucugguccucuggaagaacagcaugugcucuuaaccauucugccaccuuucuagccucuuguuguccuuuuaaucuugcgauagaguuuuaauauucccauguuaggagauauuuaaguugucuuuggguuuccugucuagagaacagcacuauggccaauacuuaugcauguauaaaccaguaaagaaaggcuucccuuuuuguacaccucuuugggauagaauuguuuaagucuaagaguaaaucuauguacuccauaaaacauuuuuuugaggcaaggucucauuuagugcagucuuaaaaugaucauuuaagugggucuaacuggguuuucugcucaggaccaaguguuaagugaccaaaauuaaaguaccaguauguuuugcagccucauuccugugcuauguguagaacugaaguccuguuuccuugcugguguuuacacuguaugugcauuuauugccgcgugaacccuucuguuuucaaagccaacagugacaagaauaauccuagauuucagaucuuugcaauauuuucuugugccaucaaccuuggacaauucucugucccugaaguuugauauagauuauuauuaggcuuacccagguuguagcuauaugcuaggauccacucugacaaaucucuccagagccacagagaguagagugggacuuguggccucagagagccauauuuuccccuaauagagaacucuaucacaaaaggacauacacuuacgugauuucauuuaucaaaaguucaauuauagacaaaacuacacguuagagaagucaggaaaaugauuacuuuuggggugagaguguuggggauuacuagaaguguacacagaaagcauuuacaguguuggugcuuaucuguucucugccugguuaguuuccauagauccucugggaagauucaacccucucguaggcuuuuaaaauugaauaauuauuacuuugugguacuaggguugaacugagggacuuaugccuauuaggaaguugcuguauuucugauuuacaucaaccccuuaauuauuuuuugacuauacauauuuauaggggacaguaugguaauuuaguauguauauacaaaguguacugaucuacuaagugcaauuaauauuuccaucccuauacuacuuugcauuuaagcucccguuuucuaguauuucaucaacuauauaauaggagucaggcaucaugacaguacauguaaucucaacauuugguaggcuaauugccucaaguucaagguuaaccugggcuacuggguaagacugucaaaacaucccucuuccauauauauagauaguagaguguugugaauuguaguucauauaacuguucuuuagaacacuagaacugcacuuuaccuauuaccaaauuccuucuauccucuaucccaaaauuccucccagucucuaauaguuacuauacauacauuuuuaaaagaguaucuacuuguaaagagauauagccugcuauauuuguucuuugugucugaauuaaaacuucugucuuccaguuagcguacugaucuuuauauuauuuagagucccguaucuaccaugaguaaaagucucaaaucaucucuuugaagaaauuuucucucuuguuaacaauuaagauaaaauuugcuauuuaaaaguauauaguuucauaguuuuuaguguguucauaguugugcaaccaucaucucuuucuaucuccagaacauuuuauuuaucccauaaaguaaccccauuucuucauucuacuaucuccuuuccuauggcauccaccacacuugaccuuuaccagauggcuaagaaguuguagcaacuaccaauuuacuuucuuucucuguguaucagcuucauuccuucauuacacccuguuguguguauaaaccauaccuucuuuauucauugucauauuugguuuauuucuucuuuuuggcuauugugaauacauuuuugugccaacauauauuuucaguguuuuugaguuauguauguuuccuggucuauaauguuuguuuguuuacuugcuugcuuacuuccuuuuuuuuuuuuuuaauacagggucuuucuauguaguucuggcuuuccuagaacuugcuauauagagucuauagcaagacucugcuuuuuccuccaaagugcugguaaugaagacaugaacuauauguccagccuauuaauguuagcuuugugggaguuuuuguuuguuuugguuauugcuuuuuaguugagauugaauaacuaccauuacagccacccaucuuacacaacacagagccuuguguaagcuaggcaggcauuuuaccaaugaacuauguccucaguucuuguuuguuuguuugcuuguuuguuugcuuguguaaagucuuccuauguugcccaggcuggccuugaccuccuacucuucuugccucagaaucuuaaaugcuggguuaaugcuuuuugcuuuaugcuucuuuguuuuuugagagauuguuauguauccuaggcuugcaauaaacuauauagcugaggaugaccaugaauuccugacccauuuugucuuucccucccgaguacuggcauuuacagguuugaguuuuucuguuuugcuuucuugagauaaacucuuaauagauagcacaggcuggccuugaacuugaaauucuccuuccuuacuuuucugcauuccaggguuauagccaugagucucuaugcuaagcuuuaauacuugcugggcaaccaacacauuuauauguaauuuaagaggcacagacacauuaucuuagucauuuucucuugcuauaacugaauuaucaaagacugagaaauuuauaaagaauugagauuuauuugaugcaucuggaaacugggaaguucaagaggauaguguuagcaucaggugagagcaacaggugagagcuguaucauauggcagaggaggucauguagugaaauaguaaacauacuaguuuggcucucuuuuuacagaguuacuaaugccaucuuggagguucuuuccucaugauguaaucugauuacuucccaaagaccccaucuccaaauaccacuaguauaugaauuugguacuuuucauucuggaggacaaauauuaaauuuauuuuuuuauagcaaggauaucuaugaaagccugcuucucauuagcucagugugccugccuuuuaaguaaucaagagucuauuucuugauauucuucaagaaaaaauuuauacauacauagguaagaccacauccaucugucuuuuuacagaaauaguaacacuauucuaccuuuugcacacuucauuucaaaauguguguugugauuuuguguauugauaccucauuuucuacauaccuguaacucagggguuagcaaauuuucuguaaacugucaaauaguaauauuuucugcuuuucaggauacauggccuuuguuuucugcccuacuguagcaaaguccaagacaaguggacuguguuuaacccaagggcugcauuuucagauacuuacccuaaccucgagauuauaaaguaauugucaugacuauuuuucuucaggcuaauguaaugcuugaauaugauauugaugaagcucaggccuuguuggaaaagaauuuaucaacugccacaaagaaucuugauucucuugaagaagaccuugacuuucuucgagaucaguuuacuaccacagaagucaguauccuuuuaacaaauaaagggaagaaagagaaagauuuuuuaaaaaauuucuaaauauuguuuucaugggaagaaugacuuuauucuuaaauaaaugugaaguuagagauugcauaagauaaugacugucauuugaauaaaaaaguuuaaagguagaauaauaaauuagaaauguaaagauguggagagcagacucacugugaugaaauaaguuucuuuucaaauaguuuuacuaagauaccuuuauaauagguuaauuucacaaacauguaagucuucuauaaguuaggugcagugauccaagcuugugauccuagcacuucaaaagcugaggcaagaguauuaucaaccugaggccacccuggggcuacauaaugagacccagucuuuaaaaagucuuugcaauuucugcaaggaugcuaagccauaugagucaugaaaauuaguagagggaaaaggguaucaaagucuuugucuguuuaaaguacauauauaaaauagguccuugaugaccacauagcaguuguaaagaaguccauguauuuaggaucaggauaauuuaaaguuugagaaugauagauguguccuggaguuaggucaggaaaugcuuuuuaggagguaaaacuuaaacuguuuugaaaugcaauacaaaauuuguagggaaaggaaugcuugcaagcaagcucuuuucuccucuguuuuccuuuccuuuucuuuuuuuuuuuuuuuuuuuuugcugugguaaaagucugaccagaagcaaccuaggggaggaaaggauuuauuuggcauguacuuccagguuacagcucaucacugagggaaguuagagcaagaauuugaaacagaaaccacauaggaucacugcuugauagcucucacauacucauccucagcuagcuuuuuuauacugcccauggaguggugcuacccacagugaacuagauccucuuacaucaacuaacaacaagacuaucccauacagacaugucacaggccagucagagugaugacucuaaucugugucaaguuaaagcuaacugggauacucugcuuuaucucuuuuuguuccugacacacucaagaaaaauacccagcacuugggaggcagaggcaggcggauuuugaguccaagccuggucuacagagugaguuccaggacagccagggcuacacagagaaaccugucucgaaaaaccaaaaacaaaaaaaccccaaacaaccaagaaaaagaacaaagaaaaguaccuaagugccauucuuuauacuucucuuuuccuaauaaccaagagucauccagucaugucagcuuuuccccaugagguuuucuguacuauaauguuacuuaguuuuggugcuauagaaccuacacauaguagaccuguucuuuacaacaucuccagcaugaauuuaccgagucauacaucuuuguuuuauuuccuugguuauauacuuuaauuauuagcugguuuauauaauauaugcauauagucagucuugagugcuuuccacuagucuuauaccucagccagugucaugacaugcauugaauuucauaaacagguccuucucuagaauauuacaaauuucauauaacuaguuguuuuauucaucccuaaaaugucccaggcuguuuguauuuucuucuuuuguucuuuuauuuguuccuccuaccuggaaugauuucucuuuauuuacuuggagauacuccuuuauuguucauauaucaguuuaagcaucagagcauucuucaacauuuugcaauccugucagaguggguuuuuuuuuucugcuuugcauguaaugcuuuguuuuccuggcuggccacaagcucuucaagugcaggaacugaagucucccaaacauguaucauguaguaggaaaauucuugggugaggcaagauagguuuuuuugaggguuugugccaggauuaucaucuaacuaaugugaauacuugguucagcuaugaaaucccuaguuccuaggaaggcuaauuagaccuuccuuggugggugggggcuguuaacugugagggaaaaaaugaaauguaauggaaaaaucauacaaaucgaguucuaggaaacuuagagaaaagugccauuuaucaucaauauaauacuguauaaacuggaaaaguuagaauaguagacaggcauuagaguauguucuaaugaaucuaaacuccaugaaggaaggggcuucaccuagcuuguucaaggcuuagucaaaacacaguagguauuuaguaaacuaaaggaucuguuuagcccagauaaaauuuuggguaaucguauucauuuuaacauuuuauguuaggauauagaaugaacagaauuuucuuagcaauuuuuuuguuuuuuguuguuuauuguuuguuuguuuguuuucgagacaggguuucucuguguagcccuggcuguccuggaacucacucuguagaccaggcuggccuugaacucagaaauccaccugccccuaccucccgagugcuggaaucaaaggcgugcgccaccacgcccugcucuuaacaauugguaguauagcaacauagcuaucaacaguauuugccacuaguaucuuugugauuuccguguuuucuuuuguuuuagcuuuaugaguaaauuauaauuucauuguuaccuuugguauuauauuuucauuuuccuugacaguuauugcagauauggccaggguuuauaauugggauguaaaacgaagaaacaaagaugauucuaccaagaauaaagcauaacacuggcaauugaaaaugugauucagguuuucaaacauguuaaauaagccaagguuuaaagauugaucuaauuuucacugauuuuuuuuuucacagcaagauuaaaauuuaaaaacaccauuuuauuuauuuaugaaaacaaaauuacuuucaaauauuuuaugaaauuaccaguauuuuuuucauauuucccuaaaauguaaugcugcuuuuguuuuauuuuaucuguuauaagacaacuccuaacugaaauggccgagaacugugaggaaugcuauggaagcugcugaauacugggcaccagagcaguuuucuuuuucuuuauugguugauauuacucucacuggauaugguaaaccuuuuagaggcaggaaagacauacaguuccaauauuuguaagcuuguucuccuuuaguacuugaagggcauuaucaucuuuuguugcuguuuuguucuguaaaugggguuucauguauuucugccuaacaaguagcuuuuauaauacucugaacuuuucagaaaauuguuauuugcuuuccuacacaguaugagggcuauugacauccauaacacuuugaucccaaguaaguauagugugucuacaaugacaauauaagggagacuugaucaaugcuagagaguacuacccauucaaaacuguaagcuaagguaauuuuuauauuauguaacaguuuuccaaagcaccucgaacaggaagaguaacauaaauauaaaucugcauuauuugaaaagaguuguaagcuuuuuuauucaugauaaaauuuacauaggacagauauaaucucuggaaagccauugguacugacugugguaaaaguacuuggugauacagauucugguaaaaacacaugcauguuauuccaucucuguguaguaaaaaguauacuuguacaauguuuuguacuuguauuucauguuauuaaaauagugauguucaaccuguugccugacaauuuuuucauuuuaaucuuugucuuaaucuauauauguuucuggcaaauaccauaaaauagguaaaacaauuauuuauauugcauuggucuggagacuuuuaaguccaauugaaauacaagggcagaaccuucaugauuuacucauccccccccccccguccccguccccauaucguaauacuuuggggguauuagacaggagaaagaaaaucccagauaauaucuuuuuguuuuguuuuguuuuguuuguuuucgagacaggguuucucuguaucucccuggcuguccuggaacucacucuguagaccaggcuggccuccaacucagaaaucugccugccucugccucccgagugcugggauuaaaggcgugcaccaccaugcccagcucucagauaauaucuuaacaugagucuccacaguuuuuaugagaugcauuuauuguacauaacuaguauauuuuuuauuuauucucuuuugugcucuuuuuuuuuuuuuuuuuuuggcuuuuucgagacaggguuucucuguguagcccuggcugaccuggcacucgcuuuguagaccgggcuggccucgaacucagaaaucugccugccucugccucccaagugcugggauuaaaggugugcgccaccacgcccggcuuuuuuuuuuuuuuaaaguuuuuuuuuauuacauauuuuccucaauuacauuuccaaugcuaucccaaaagucccccauacccucccccccacuucccuacccacucauucccauuuuuuuuggcccuggcguuccccuguacuggggcauauacaguuugcguguccaaugggccucucuuuccagugauggccgacuaaaaauucuaccagagaacuccuaaaccugauaaacagcuuuggugaaguagcuggauauaaaauuaacucaaacaagucaauggccuuucucuacacaaagaauaaacaggcugaaaaagaaauuagggaaauaacacccuucucaauagucacaaauaauauaaaauaacuaguauauuuuaagagcuuuauauuuuguagaaagaacagaaaaccuuuggaaggaauaagcaaguaagauuuuaaucuaaaauauaccaaacuuucuuuuuuauuauuuauuauuuuggacaauacauuuucccuuucauuaacuccucucaaacuuucuuuuaguuuuucuuuuauaaauuuucuuuaguuuuccuuuuaaaaauuuuuaaaauuuuagaauuuguaguuuguaaauacuauauuucccacacuguaguaauuauauugguacaagaugucccuguuaauauaggaaugguauucuucuuuugucuuaaauauaaaaauuuaaauaugaauuugcaagccgggugugguggcgcacaccuuuaaucccagcgcuugggaggcagaggcaagcggauuucugaguucgaggcuagccucgucuacaaagugaguuccuggacagccagggcuauacagagaaacccugccucaaaaaacaaaaccaaccaaccaaacaaacaaaaacaacaaaacagacaauaagaauuugcagaugaugucauuuuuuucaugauauacaguuuuagaauaauauaaccaucuagguauauaacauggugucaucagacacaauauacacaaaauauacugagugagaauauaugggcugaaguuuguuaaacuugauguacaguaacuucaguuuaacguuuuccuuuauaaaaucuuuacaugugaggaacacugaaaaauaaugggguggagauguuuaaauucuacuugaaguccuuaaccaaccaaccuucuuccuuucaccuuuccuuuccuaucucucuuuuuugauuagggcauuacucuaucccuagcuggacugaaacucacugugauccugaguuggccuuagacucaugaucuuccugccucaggcucccaaaagcuaagauuggauguuugugcuaccaucucuaccuacuucccuguuaaucacuaucccuaugcucagcuucuauuucuuguuuuaugcauaaauuuauagaaaaaauaguauauuuauaauguauucauucuuaacaugaaacuggcucauaaaaugcguuuuuccuuugagacagacucugaaugucccaaguuugcaggucccgcugcuccuaccuaccaagaguuaagauuauaagcaugaaucaccaggccaugauucaugcuuauuuuaugauuauuuuauuauuacucucauaauacucuuaauauuauuuucuaguuuuaaaauaaacuauaagugaaccacaguuagcucauuguuuuauuagguauuuggguugcaucuaaacuaugccuuucuguuuucauauaagacuuuuuccuguauuuagaauuuuuucugaaacuagauugccaaaaaaugaaauuauagagucaaaaguucuagcauuuuacuuucaaguuaacagagcuguuuuguuaauagagcuugauacagcugcuuugagaaauaagugaagcauuguuaacuaagacccacaguagcuugaaaaacuguuuuccuucucuaaaagcucaggaucauggguaauuuguucaucuuuaaagcagagacaagucaaacugguauuuucuucauccucuuguuuguuauguaauuuuuccuaaacucauguuuuccuuuuucuugauuauauuucauauucccuccugccauauaaagacuguaauaacuauagggguaguaccuuguucagggccauaaagcauguauaagccagaauaaaauugaggucugguuuccaggcaaaaacucuaccucuguaccauguuuugguacuuuugaaauaucuaaguaugaaauguuaaauuuaguuccauuaugaacaaauuuucucuuuuuucauuugcuguucucagcaugaaacuuaagugauaacacuucuaagucauaaaauacuuuucaaccuuuuuacuuugguagcuauaaucucauaccuauuucacagccaugucugugcuuguuuugcacugauguggcauaaguugcccaaaggaauuaagugcaugagcaacacccauuacugcuguuuuguguauauaacuauauccuugcaacuggaguuacaggaaaguggccucacguugguaucugaauuuggguccugugcaggaguguuaugagcucuuaacuacugaacugcuucuccagcccccauuauuucuuuuuuuuuuuccuaaauuaaauuuuauucuuuuuauguuuguguaugugugccuguuugaaugcucucaggccacaagaaugagucagaucuuauggagcuggaguuaacaaguaguuaugagccacccaaugugagugcuagggacuaagcuuggguccucuacaacaguaguauaugcucuuaacagcugagacauaucgccaaccaaaccccuucucacuuuaguuucuuuuuuuuuuaacuguuuuuugaaaauuuauuuuauguauaugaguauuuugccugcaugcauauaugugcacuucauccaugccuggugucauggauucccuggaacuggaguuacagacauuuguaaacugccauguggaugcuaggaauugaacccuggucuuuaacaguaacagcucuuaaccgcugagccaucucuccagcccagaucuuuuucuuuuuaacuccaaagguaagugacuaugagaagaaagguuccaauucaagaucagagacacaucuaagacaaaagaaaugguuuuauugguuuauauguuauauauuagaaguuguuuauauuugguauguuauauauuagcuucacauaauuacuuuucuuguaguagcuuuaaacaagaguauugcccaagguuucaucugcacauaaaaacaccuguggauuauguucugaaguugaauuaaagaguauacuuuuguuugugucccuuugacuguuguuuaaugauaaacuugcuauaagccauuaagccauaaagauaaaccuaauguguacaggacuuuuugacaaauuauucauaagauauuauaguuuugaauaacuuugugcuuuggauuuaugauaauucuauuugguguuuggguugcuguggguugaguuaauguguuggaacuuucaaccuguauggcaauguuuagaggugguauacuuuaggaagggugucuuaguuauuuuucuguugcugugauaagcacuacgaccaaggaaacuuuuaaaaguaaagauuuaauugggccuauauuccaguggguuagaguuuauuaugguagagacaugaacagcugauagcucacaucucaggcgcaagcaggaggcagagaauacacugggaauggcaugaaucuuuuuuccccaucuauucacuuuacaucugaucacagaccccuuccuuccagucucuccccucauacaccccuccccuucccauucucuucucugagaaagguaccagcccacccugacacauccucuuuuacuagggccagaaaaggcagcccaauuagggaaacaggauccacagguaggcaacagacugagggacagcuacugcucuaguuguugaagaccaagcugcacuucuacauaugugcaagggguuggggggcuagguccgacacauauaugcucuuuggugguuagucucugagagccaccaaggguccagauuaguuaacucccggucuucuucagguccuuuaauccuucccccaacucuuccacaagacuccccaagcucugucuaauguuuggcaguaggccucugcaccaauuucagugagcugcaguaagacaacuaaaggagaucaaggggauacaaauuggaaaggaagaagucaaaguauugccauucgcagaugauaugauaguacauacauaagugauccccaaaauucuaucagagaacuacagcugauaaacaucuucagcaaaguggcuggauucaaaauuaacuaaaaaaaaaaaaaucaguagccuuccuuuauacaaaugauaaaugggcugagaaaggaauuaggacaacaccacccuucacaauagucacaaauaauacaacauaucuugcuguaauuauaaccaaacaagugaaagaucuauauaacaagaacuucaagucucugaagaaugaaauugaggaggauaacagaagauggaaagauuccuccauguccaugcauagguaggauuagcauaguaaaaauggccaucuuaccaaaagaaucuauagauucaaugcaauuuccaucaaaauuuuaacacaguucuuucagaccuugaaaaaacaauucucaacaugaaauggaaaaacaaaacucaagauagucuaaaacaaucuugaacaauaaaagaacugaagguaucaguaucccugauuucaaggcauacuacagagcaauauuaauaaaaacuacaugguauuauuauagaaauagacaaguugaugaauggagucaaauugaaaaaccucucaagucacuugauuuuugacaaggcaugaaacuugaauauucaaagccaacuccuaauguucuacuuccuccagcaaggcuuuacuucuuaauccuucucaaacauugccaccaacuggggaggagcaaguauucaaacaugagccaauguauuaccauuauuagucaaacaacugcagaggcauacagugaaguaagcuuggagguacuguccucgggcaagauuaggauaguauuuguagaauccuaguugguuuuugcaagaguauauuauaaaaaccugagccuggcucuugaaaucuuuuuggcuucuggucuuagaacaugagcucuuuuauguguuuauguugugauaccaucaaaggaucacuuaacaaaacugagaugauggcagccugucuuuaaacauccauaccuaugaacuaaaguaacuuuuuucacuuauucuuuuaaaaucuaucuauuuaucuaucaaucaaucauuuuuguuuuauguaugaguguucugucugcauguauaccuguaugccaggagagggcaucagauccuuuauagauguucaugauccaucauguuauuuccucuggaagagcagccaguguccuuauccacugagucaucggggcagcaccuagucuccauuuuguuauuguaguacagaauagaccaagacacaaggauagauggagguagauagugaucagauaggaaauauguuuuagauacuuuuaguuucuuuuuuaaaaagauuuauuuauuuuauguauaugagcauacuguagcugucuucagacauuccagaagaggacaucagaucucauuacagaugguugugagccaccaugugguugcugggaauugaacucaggaccuuuggaagagcagucaaccgcugagccaucucucuagcucccuacuuuuaguuucuuaaguaaacccaucuuagucugaauaauuuuaguuucucuaaaucacaacugugaaaucuagagaauaaaaauagaaaaaaugagucaaugaauaauaaauucuugguuuuccuuuuuuauguucaaagcuacuucaguccauggcuguacuagggugaccuaccuccucuucucucccuccuccuuccccucuucucccuuucuuccucuccucuccuguacccuccuuuuuuccuucucucccucccccuuuucuauuguuugugguaauuuuuuuuuucuagaucgagucucauacuccaggcuuucaaacucacacuacauagcuaaggaugaccucugccuccuaaguguuggaauuauuaauaaauauuuucuacuuuuucuaacccagcaauaauuucucagugaaguaguucacagauggcuuaagagugaaacuuuuaucuacugccagguaugguauaccugcucauaaucucagcacaaaucuaacaugaacuacaaacaaauaagcaaagaaaaagcuagguuuugugcaugccuuauuguuccagcuuucauggaguaggggaagagaaucaugaauuugaggucagcuggaucucaaaacaaaaucaacuggaaaauguaugcuuuguaggaucaccaaaucaaaguauuugauauguucuaucacagcuaugauuugaauguuucuaccaugcugucucuguugugauugaagauuugaucccacaagauaguguuaggaaguaucauggaacuguuaugaaauaaggccuagugggaggucuuuaaggaacuugaaaaugccuucaggagguaguucuuaggagaggcuuguuuuaaaagaaauauggccaccagcagggcuaggggguguauagggaacuuuugggauagcauuugaaauguaaauaaaguaaauaucuaauaaaaaaguuaaaacucaaaacacucaacuuuuaagaaaacauagacuaaaaauauacacuaagccaaacaaaccauaauacagcagauauaauuauaucagauaaaauagacuuuaaauaaaaaacuauaaauuaagguaaagaggaacauuauuuaaugagaaaagauugugucauuaagacacaaaacucuaagagauacaguugcauacaacaccugaaauuggagcacauaaauauauaaaguaaauauuaacauaucaaaaaauaaagacuauauaauacauuauuaucagaguacuuugauaucacaacuucaaaaauggacauaauccagacauaaaauuaauaaacaauaaauuugaguuauaccuuacaucaaauaguucuaacaaacauuuauagaauaucucauccaacaacaaaacagacauuuuuguaaaguuuacauggaauauucuucagaguagaccuuauauuugucccuaaauaaaucaggaaauguaaacacacggaaguuauaaaauaguuuuucuggcuacagaguaugaaagcugaagaugguaauauucagauaacuaaccaauaugugcaaauuaaacaaugugcuuaaaacaaccagcaaauaagagagaagaaauuuaaaggguuacuuaaaacaccuugaaauguaauaucccaaaauuuacagacuacaggaaaagagcuucuaacaagagggagauuuauagcaauaaaugaguguauuaaaagacaaagaugucaaauaaaugaucuaauauuauuauccaaaggaaguuaaaaaaaaaagaacaaauuagguccagcauuaguacaaagaaauuauuauacuagaaaugaauaaagauugaaauaaauauuacaagugaaaucauagaaauagaaacaaccauaagacauuaagaugaauaaguacauacaaagaaaaggggagaagcaaaccuagaaacauacaaaauuaugagaaauggaaaaucugaacaaagugugguuacagcuacuugggacacuagaaggauccaaggaguccaggaguucuaagcuagccuaugucaauauaaagacggaauaagaaagaaggggaagggaugagaaagagcaggggaaagggaagggagaagggaaacugaaagggggaauaaaauaaaggaagggaaaagggaaaaaaacaauagcauaacaaaaauaaagaagaugucaucagauuauaugccccaggggaaugccaccgccaggaagcaggaguggguggguuggggagcagugcagcggggagcguauaggggacuuuuggggaggaaacuagaaaaggggauagcauuugaugucucuaguugcauguguagcagaggauggccuagucagccaucaaugggaagagaggcccuugguuuugcgaagaucauaugccucaguacaggggauaccagggccaggaagcaggaguggguggguuagggagcauggugggaggagggcauaggggacuuuuggaauaguauuugaaauguaaaugaagaaaauaucuaauaaaaagagaaauguaaaugaagaaaguaucuaacaaaaagaaaaaaaaaaguauuuugugcccagauguauugacuauaggcuccugcugauguuguuaccaauuacuccacagauuaugaaaaauaaaauaagacuacuugucugaaaaaaaaaagaugucauuauuaauaagacaucucccgccaaagacaagucuagaaccugagaacuucauugcugaaauaaaauaaauauuuaaagaggaacuaauaucacuuuagacucaucugauaauagaguaauaauuaaaauauauuaggaaaugcaaagaacuugauaguuaaaaaauuuacuaggcaaguguccugaauagaaaaauuuucauagacacauaaaugaacaauaguauaugaugaaauaauaaauaucacuaaucaucagggaaauacaaaugaaaaccauaauguguuauugccucacaucugucagagcaacuauuuuuuuuuaagaugaaagauaaauguucauagggauacagagaaaaccuuguguacuacuguuggcaauguacauuagacaauagcauggaaguucucaagcaauuaaacuaucauauaaucuagcaauaucacuauuggguauauuuucaaaggauauaaaaauuagcaugucaaagagauaacuauauuucccauguucccugcuacaguaugaguauuugucuagccuacauucaucuaaggcccauucccauugucaaacaaaacaaauaaauaggugugccauguccauuagcacauacaugaauaagaaaaaauaauacauaugcaacuagaauacuagcuggccauuaaaacuauaaauuuauguuugugacaaaaugcauggaacuaaaagauauuguaucaagugaaauaagccaaucacagaaagacaaggaccacacaaauggaauauuaaaagguccaacucauagaaaaaaaagaguauaggagaguauaggaauuaagaugauguugaucaaaggucacgcaauuccaauuaggaagaauaagcucaagagugccauuggauaaugugugacaauaguaauaacauuguauauacuugaaaauuguucaaaacacuuuaaauguuauuagcuuaaauaaaaaaguaaaaucauagggcuagagagaaggcucaauggauagugacacacaagucugaugaccugaggcuagaacccaaaagagcauguaaagccaaaacugagcagagcagcacacaucuauagucccagugugacccuacugagagauggaaaguagaaacaggagaauuucuggaagcuuagaggguuacuuagccaggcauaagcaguagcaaacauuaagagaccugucucaauguaggugaggacugacacccaaaucugaucuccacaugcaugcccacauucacucaacuugaacauacuuaaacaaugaaguauuuuauauguucuaucacagcuaugauuugaauguuucuaccauggugugugaacaccaagaaaaugggagucauuagucagcuccuuaccauaaugaaauaacccgagaugagcuacuuuaaacagguuuuuuucuacuuaguuuuagagcucgaggcacaaaugguaugauguagguuuaguaaaagccauuucuguuucacuucacaguguaacagcaauagaagaagcaaccaaguuacuucucaaaccaacagcaaagacagcuagguggaaccagccauauuucuuuuuuuuaaaaaacauuuuuuauuagauuuuuuauauacauuuuaaaugcuaucccgaaaguucccuauacccucccucugcccugcuccccuacacacccacucccgcuucuuggcccuggcauuccccucuacuggggcauauaaaguuugcaauaccaaaaggccucuuuuuccagugauggccgacuaggccaucuucugcuacacaugcagcaagagauaggagcucuggggguacuaguuaguucauauuguuucacccauaggguugcagacuccuucagcuccuugggugcuuucucuagcuccuccauuggggcccuguguuccauccaauagcugacugugagcauccacuucuguauuugccaggcacuggcauaaccucauacgagacagcuauaucagggucccuucagcaaaaucuugcuggcauaugcaauagugucuggguuuggcggcugauuaugggauggauccccggguggaguagucucuggauaguccauccuuucgucuuagcuccaaacuuugucucuguaaauccuuucauggguauguucccuauucuaaggaggaaugaaguauccacacguuggacuuccuucuucuugauuuucuuguguuuugcaaauuguaucuuggguauucuagguuugugggcuaauauccacuuaucaaugagugcauaucuaaugacuucuuuugugauuggguuaccucacuaaggaugauauccuccagauacauccauuuguccaagaauuucauaaagucauuguuuuuaauagcugaguaguauuccauuguguaaaugugccacauuuucucuauccauuccucuauugaggggcaucuggguacuuuccagcuucugucuauuauaaauacggcuguuaugaacauaguggagcauguguucuuauuaccaguuggaaaaucuucuggguauaugcccaggagagguauugcuggaucuuccaguaguaauauguaaaauuuucugaguaacugccagauugacuuccagagugguuguacaagcuugcaaucccaccaacaauggaggaguguuccucuuucuccacauccucaccagcaucugcugucaccugaauuuuuuaucuuagccauucugacuggugugagguggaaucucaggguuguuuugauuugcauuucccugaugauuaaggauguugaacauguuuuuucaggugauucucagacauucgauauuccucaguugagaauucuuuauuuaucucuguaccccauuuacuaauggggcuauuagaauuucugggguccagcuucuugagcucuuuguauauauuggauauuaguccccuaucagauuuaggauugguaaaaauccuuuccuaaucugcugguggccuuuuugucuaauuaacagugucuuuugccuuacagaagcuuugcaauuuuaugaggucccauuuaucaguucuugaucugacagcacaagccauuccuguucuguuuaggaauuuuuccccugugccauaucuucgaggcuuuccuccacuuucuccucuauugauuucagugucucuggguuuauguggaggucuuugauccacuuagacuugagcuuuguacaaggagauaagaaugaaucaauuuaaauucuucuacaugauaacaguuaaggcagcaccauuugcugaaaaugcugucuuuuuuccacuggaugcuuuuagcucccuugucaaagaucaaguaaccauagguguguggguucauuucugggucuucaguucuauuccauugaucuaccugucugucccuguaccaguaauaugcaguuuuuaucacaauugcucuguaguacaucuuaauggcaggcauggugauuuccucagaaguucuuuuauuguugagaauaauuuuugcuauccuagguuuuuuguuuuuccagaugaauuugcaaauugcccuuucuaacucacugaagaauugaguugaaauuuugauggggauugcauugaaucuguagauuucuuucggcaggauagccaauuuuacuauaucaauccugccaauccaugagcaugggagaucuuucuaucuucugagaucuuuaauuucuuucuucagagaguugaaauucuugucauacagaucuuucacuuccuuaauuagagucacaccaaaguauuuuaaauuauuugagacuauugugaaggguguuguuucccuaauuucuuucucaguccguuuauccuuuguguagagaaaggccauuuuuuuuuguuugaguuaauuuuauauucagcuacugcauugaagcuguuuaucagguuuaggaguucuuugguggaauuuuuggggucacuuauauauacuaucauaucaucugcaaauagugauauuuugacuucuuccuuuccaauuuguauccccuugaucuccuuuuguugucuaauugcccuggcuagaacuuuaaguacuauacugaauagguagggagaaagugggcagccuugccuagucccugauuuuagugggauugcuuccagcuucucaccauuuacuuugauguuggcuacuguuuugcuguagauugcuuuuaucauguuuagguaugggccuugaauuccugaucuuuccaagacuuuuaucaugaaucgguguuggauuuugucaaaugccuucuccguguuuaaggagaugaucaugugguuuuugucuuugaguuuguuuauauaauggauuacauugauggauuuccguauauuaaaccaucccugcaucccaggaauaaaaccuaauuggucaggauggaugauuguuuuaauguguucuuggauucgguuagcgagaauuuuauugaguauuuuugcaucgauauucauaagggaaauugguuugagguucucuaucuuuguuggaucuuucugugauuuagguaucagaguaauuguggcuucauagaaugaguuggguagaguaccuucuacuucuauuuuguggaauaguuugugcagaacuggaauuagaucuuuuuugaaggucugguaguacucugcacuaaacccaucugguccugggcuuuuuuuuuuuggcugggagacuauuaaugacugcuucuauuucuuuaggggauaugggaauguuuagaucguuaacuugauccugauuuaacuuugguaccugguaucugucuagaaauuuguccauuuuguccagguuuuccaguuuuacugaguauagccuuuuguagaaggaucugaugguguuuuggauuucuucaggaucuguuguuaugucucccuuuucaguucugauuuuguuaauuaggaugcuguuccugugcccucuagugagucuggcuaaggguuuaucuaucuuguugauuuucucaaggaaccagcuccucguuugguuguugauuuugccccugaguucgauuauuuccugccucuacuccuuuugggugaauuugcuuccuuuuuuuagagcuuuuagguguguugucaagcugcuagugugugcucucucuaguuucuuuuuggaggcauucagagcuaugaguuucccucuuagaaaugcuuuccuuauuuauaauagccagaagcuggaaagaacccagaugccccucaacagaggaauggauacaaaaaaugugguacauuuacacaauggaguacuacucagcuaaaagaaugaauuuaugaaauuccuaggcaaaugguuggaccuggagggcaucauccugagugagguaacacaaucacaaaagaacucaaauaauauguacucacugauaaguggauauuagcccagaaacuuaguauagugagauauaagguacaauuugcaaaacacaugaaacugaagaagaacgaagaccaaaguguggacacuuugccccuucuuagaauuggaaacaaucacccauggaaggacuuacagagacaaaguuuggagcugagacaaaaugauggaccaucuagagacugccauauccagggauccaucccauaauuagccuccaaacgaugacaccauugcauacacuagcaagcguuuguugcaaggaccgugauauagcugucucuugugagacuaggccggggccuagcaaacacagaaguggauacucacagucaacuauuggauggaucacagggcccccaauggaggagcuagagaaaguauacaaggagcuaaagagaucugcaacacuauagguggaacaacauuaugaacuaaccaguaccccggagcucuugacucuagcugcauauguaucaaaagauggccuagucggccaucacuggaaagagaggcccacuggacaggcaaacuuuauaugccccaguacaggggaacgccagggccaaaaaaaugggaaugggugugugugggggggugugggagacuuuugggauagcauuggaaauguaauugaagaaaauacauaauaaaaaaaagaaaaaagaaaugguuucauugugucccauaaguuuggguauguguggcuucauuuucauuaaacucuaaaaagucuuuaauuucuuucuuuauuccuuccuugaccaagguaucauugagaagaguguuguucaguuuccacgugaauguuggcuuuccauuauucauguucuuauugaagaucagccuuaguccaugguggucugauaggaugcaugggacaauuucaauauuuuuguaucuguugaggccgguuuugugagcaauuaucuggucaauuuuggagaaggucccgugaggugcugagaagaagguguauccuuuuguuuuaggauaaaauguucuguagauaucuguuaaguccauuuguuuaauaacuucuguuaguuucacugugacccuauuuaguuucuguuuccacgaucuguccauugaugaaagugguguguugaagauucccacuauuauugugugaggugcaauguguguuuugagcuuuacuaacguuucuuuaaugaauguggcugcccuugcauuuggagcauagauauucagaauugagaguuccucuuggaggauuuucccuuugaugaguaugaaguguccugucccuccuuguccuuuuugauaacuuuggguuggaagucgauuuuauccgauauuagaauggcuacuccagcuuguuucuucagaccauuugcuugcacaauuguuuuccagccuuucacucugagguaguaucugucuuuuccccugagauggguuuccuguaagcagcagaauguuggguccuguuuguguagccagucuguuagucuaugucuuuuuauuggggaauugaguccauugauauuaagagauauuaaggaaaaauaauuguugcuuccuauuauuuuuguuuuuagaguuggcucuuuaagggauuuuucuguuuccucuuuaagggcuucuaccuguuuagcacuguucuccuguauuucuuuaagugaguuauuaauguccuucuugauguccucuaccagcaucaugagauaugauuuuaaauaucagucuuauuuuucagguguguugggguauccaggacuggcugaggugggagugcuggguucugaugauggugaguggucuugguuucuguuaguaagauucuuacauuugccuuucaccuucugguaaucucuggaguuaguuguuauaguugucucugguuggaucuuguuccucuugugauucugugauucucugugauucuuagccucugucagcagugcugggauuucagcucucucuuaagugucaguggucagaguauuguuugaggcaagcucucuucuugcagggaaggugcacagauaucuggaguucagaacugccuccugguugaagaugaaugccagaaacaguaccugucccagaagacguguugccucugcagucugcaugcucaccugcacagacuggucuccgagggacccgggacacaagauggcucucucaccugcucugguggucagaguccuccaggguggacaccucuccucuggcggggaaggugcccaggugucuggagccugaaauauggucuguuccagaagcuguguugcuucugucugucccagaagcuguguugcuucugcagucugcacucuuaccugcgcagauuggucucugagggacccgggacccaagaucuugagguuguaucuuacauauauuuaugggucuuauugauaguuuuauugcaguucuuggggauuuagucuagggccuuguguauuuuagccaacuguucuacaaccaacuaacaccccaaguccuagcuuuguuuguuuguuuguuuuuuuauacaucuauucagccacuauauguuuuguguuccaugcauggaugcaugccuccaucccugucccccuuccccucccccacuuuuuucucuguguguaccucauaacccaggguuuccuucaugcuaagcaggcacuuagcuacaugguaaguaggcaccgaacuauaucuccaaccucugguuggguaauuuauauuuauauucagaauaauuaucgagagggaagaccucccacuauuuuguuuaaaucuuucuagauguuuuguaguuucuuucauuaucucccucauuuccuuccuuccuuccuuucucuugucuuuuuuuuuuuuuuuuuuuuuuuuuuggugauaaggugaucuucucuaucacuaugcugcaauuuuuuuucguaucuuuuguguaccuacuauagguuuugacuuuguguuuaucaugaagcuuucucuaaaacaucuuguaguuauaacagguuauaauaaauuaauaaguuaucugauugcacaaaaacuucuagauuuuuacuuuuauauuuuuugcuccuguuuuauuuuauuuuauuuuuuaauguuacaguguaaauuuuggcauuguauaauuuuaacacauucuuguggauauuauuuuuaauaguauacugucauuauuuuacugcaaucacucauguuaaugugaugacaagcaucuacaauucuaguauuucuaucuagagguuggaaagauggaaagaggagaaacuugugguacgguuauccccagcacacauugcaguggcagaaacaauaugagagacuugucucaggaagguagaaagagagaacuaacuuccaaaacuuguccuuuuacugccacacuuaggucauagaacccaugugcaucauaauaauugugaagucaaaacuuauauuagauacauaaaggauaagaaauaaggaauuaaaucauacuaauagauaagaucaccuuaucacacacauacaaaaaaaugacaacaacaaaggaagaaaaagagugaggaggggucaaggaagagacuaccaaaaaccccacaaaacauuuaacagaauaguggugggagguccuuccauuucaguaauuauacugaauguaaauauaaauuacccaaccagagacuggggaugugguuuagugccuacuuagcauguaguuaaauaaguguguguguguaauaaaaaauaacuggaaaaauaugauuaaagcccucaauguaacagcuuugcuguaauaagagcccuucuaucgcuuaccacuccaagccucacccuugucaaagaaaugugcauguccaggucaguggggauuguauuuuuaacauuucccaauauagccucuagucagccaagcucugaucugggcaguguauguguuauucccagguaacaauuagcuuuuuuuacugaguggucuaccuaaaauguuuuguuuucaguauauauauauauauauauauauauacauauauauauauauauaugauggaaauaguauaugauuauauuuacaacuacugaggaauggaauuucaacauagcauuauggcaacacaguuuaacccuuaauaguuguuguaugauuuguagauuguugaggaagacaugcauuacauuguaauauuacaguggcuuagaugagaaauauaucucagaggcacaaauauuugaucacuugguucuuuguuggugucauuguuuggggaacuuauguaucuuuuacguccuguagcuuugcuauacugcuccagucacaugcugccaugcuuaaccaccacgauggacuuaacucuuugaaggaaccauaaaccaaaauaaacucuuccauaaguugcuuuuuuaauaguguuuuucacagcaacaggaaaguagcuaauacaaauauauagcagaacaguauuccauuuccuuucauauuucuauggaugugugcuucuacaaucuuagaagauaucugacugaguacgguagaaacugccacugcuuccuaagugcugggauuacucaaagauguuuugccuauguuuucuucuagcaguuuuaguauuucagguuucacuuuuaggucuuuaauacaugacugccuaaacaugaucugaucaaaggcaauaacaguagacaugcuaacacgguugggggaaaguucaugagaccccaauuccagacaaagaacuacagacagaaaggaauucugagaguagaagugucuuagacaggguuucuauuccuggacaaaacaucaugaccaagaagcaaguugggggguggggaagcguuuauuuagcuuacacuuccauacugcaaggaagucaggacuggaacucaagcaggucagaaagcagaagcugaugcagaggccauggagggauguuacuuacuggcuugcuuccccuggcuugcucagccugcucucuuauagaaccaagacuaccagcccagagauggcaccacccacaaggacccuucccccuugaucacuaauugagaaaaugccuuacaguuggaucucauggaggcauuuccccaacugaagcuccuuucucugugauaacuccagccugugucaagaugacacaaaacuagccaguacaggaagagauggucuucccguggaugagcauaccaguuagauuauccaauauaaauggucagcccugaaaacauauacaaguaccauuauacagacugaguagguuguauuuauguauuuauuccaucaaauugaaagagagcaaacagggaaguacauggggaugauuuuagggagugaugagaaggggaaaugaugugauuuauaaucucaaaaaauaaaauuguuuuuuauucugcacaccuguacaauguguuuacaucaaaucuaccuguuguucuuucugauuccacuccauccagaccaagaugggcagaggacauguguccugcccuuccaauuuuauguguuccuuacuuuuuaaagacugagucucuuuaauuaauacuuccaguauauauguggauuuagggccauccacuggcauguggucaaccuaugagggacugcaucucugaagaaaacugacuuucucuucuccaggagccaucaacugcaauagcugcuuagcuagggguggggcuuugugagcuccuucccuguccauggcggauuggagaccugaagcuagaacucccuuaaaagcuuauucccuacuggcuaacuuuuuaaaauaacacuacaaguugccugggaagaauuaucauuaacagucucacccagauaugaaugaaugaaugaaugaaugaaugaauuagcacuccaaaugcugcuccccuucccagucccucacucucagagucucucucccauggucccuucucuucuuugagaggguggacccucucuggguaucacccccacccccauccuggcacaucaagucuuugccagguuaaauguauccucucccacugagggagaccuuuccaucaucaaauauuuucaauuucuuucuuuggggacuugaaguucuuauuuuacaggucacguaacuguaugguuagaguuacaccaaauauguuauauuauuuguggcuauugugaaaggaguuguuuuccuauuuucuuucuugccuuuuuaucauuuguauaaaggugggcuacugacuuuacacaaauguacccagccacuuugcugaagcuguuuaucagauguaggacuucuuugguagaauuuuggggucacuuauguauacuaucaucuacaaauagugauacuuuuacuucuuccuuucuaaccgugaucaccuuucucugucuaauugcucuagcuagaacagguagggggagagugggcagccuugucuugucccugauuuuagugggauugcuucaaguuucucuccauuuaguuugauguuggcuguuggcuuguuguauauuguuuuauuauguucagguaugugccuugaaucccugcuuuuuccaagacuuuuacuaugaaaggguguuggaauuugccagaguuucuuuuuucaccaucuaaucagaugaucauguacuuuuuuuucauucaguuugcuuauauaauagauuauguugauggauuuucauauauuguaccauuccugcaucccuggggugccuauuagauuguggugcauaauguuguuuguucuuggauacuguuugugagauuuuuaucgaguauuuuugugucgauguucauaagucaaauuggucugaaguucuuucuuugucuuugcaugguuuagguaucaugguaacuguggccucacagaaugaauuagguaguguuccuucuguuucuacucaguggaauaguuugaggaguauuguuauuagcucuucuuugaaagcuuggcagaauucugcauuaaaaccaucuggccccgagcuuugcuguuguugggagacucguaaugacugcuucuauuuccuuagguguuguucaaauuguuuaccugauuuuaauuuaacuuugguuucuauaucucucucaaaacucauccauuucauuuacauuuuccaguuuuguggaguacaggcuuuuaaaguaagaccuaaucauuuucuaauuuccucaguguccauugucaugucuuccuuuuuguuucugauuuuauuuggauauugucucugugacuuuuaguuaauuuagcuguuaguguuuaucuuguugauuuucucaaagaacaaucucuugguuuccuugauucuuuguauuguucucuuuguuucuaauugauuaaacucagcccugaguuuggauuuccugcugucuaccccucuuuuguguguuugcuucuuuuuguucuagagccuucagguaugcuauuaaguugauaguauaugaucucacuaauuucuuuguagaggcaauuaguguguagaaguuuccucuuagcacugcuuucauuguguuccauaaaguuuggguauguuuugccuucauuuucauugaauucuagaaagucuuugauauuuucauuuuuuuuccugaccaagugauuacugaguagagaauuguucaguuuucaugagugaaauguaucuuggguaugcugagcuuuugagcuaauauucacuuaucagugaguauauacuauguguggucuuuugugacugaguuaccucacucagaaugauauuuucaaauuccauccauuugccuaagaauuucgugaagucauuguuuuuaauagcuaaguaguucuccauugcguaaaugcaccauauugucuguauccguuccucuguugaagaacaucuggguucuuuccagcuucuggcuauuauaaauaaggcugcuaugaacauaguggagcauguguccuuuauacauuuggagcaucuucuggguauaugccaggaguaguacagcuggguccucagguacuacuauguccaauuuucugaggaaccgccagacugauuuccacagugguuuuuaccagguugcaaucuuaccagcaguggaaggguguuccucuuugucuacauccucaccaguaucuacugucaccugacuuuuugaucuuagccauucugacuggugugaggugaaaucucagggucauuuugauuugcauuucccugaugacuaaggauacugaacauuucuuuagguguuucucagccaaucgauauuucucaguugagaauucuuuuuuuguuuaccacucaaaguuauuuuuuuaauuauuuaaauagaaaucugauauugccaaagaaguauacaagagccaaagaagaugaaguuuuucuggcuaauaauuaugaaauauguaagaauccacgauagcagaguuuauuccuuugauaaaauaaugaagugacccaauucuaaugggcuuugauguguaaagaaaugguguuuucacuuaugugagaaaguuuaaaaaauaauuuagccuaaucuagaacagagaaaagggaggagcauaucugcaccuccuuggggucccaaauaacaugccugugggagaugagauguguagucaaccauuaagugucccauacaacaaaagaaaaacagacaagggggcgagugggcacagauuuaagaacagagcuuccagcauagcuaagcagcagcauuugccugccuuuggaccacugugaagauccucugcaaaucccucugugcugugcuucucggccauucgauauuccucaguugaaaggugcuggcacaacuggcgguuaucauguagaagaaugcgaauagauccauuucuaucuccuuguacuaaggucaaaucuaaguggauuaaggaacuccacauaaaaccagagacacugaaacuuauagaggagaaaguggggaaaagccucgaagacaugggcacaggggaaaaauuccugaauagaacagcaauggcuugugcuguaagaucgagaaucgauaaaugggaccucauaaaauugcaaagcaaaagacaccgucaauaagacaaaaaggccaccaacagauugggaaaggaucuuuaccuaucccaaaucggauaggggacuaauauccaauauauauaaagaacucaagaagguggacuccagaaaaucaaauaaccccauuaaaaaauggggcucagagcugaacaaagaauucucaacugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuggaaaucagucuggcgguuccucagaaaauuggacauaguacuaccggaggauccagcaauaccucuccugggcauauacccagaagaugccccaacugguaagaaggacacaugcuccacuauguuuauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuaggcaaauggauggaccuggagggcaucauccugagugagguaacacauucacaaaggaacucacacaauauguacucacugauaaguggauauuagccccaaaccuaggauacccaagauauaagauacaauuugcuaaacacaugaaacucaagaagaaugaagacugaaguguagacacuaugccccuccuuagaauugggaacaaaacacccauggaaggaguuacaaagacaaaguuuggagcugagaugaaaggauggaccauguagagacugccauauccagggauccaccucauaaucagcauccaaaugcugacaccauugcauauacuagcaagauuuuaucgaaaggacccagauguagcugucucuugugagacuaugccggggccuagcaaacacagaaguggaugcucacagucagcuaauggauggaucacagggcuccgaauggaggagcuagagaaaguacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaauggaaaaaaaaaaacaaaaacucaggugacagcaaaugcuggcgaggauguggagaaaggggaacacuccuccauuguuggugggauugcaagcuuguacaaccacucuggaaaucagucuggugguuccucagaaaauuggacauaguacuaccggaggaucccacaauaccucuccugggcauauauccagaagaugucccaaccgguaagaaggacacaugcuccacuauguucauagaagccuuauuuauaauagccagaagcuggaaagaacccagaugccccucauagaggaauggauacagaaaaugugguacauuuacacaauggaauacuacucagcuauuaaaaaaaugaauuuaugaaauuccuaggcaaauggauggaccuggagggcaucauccugagugagguaacccaaucacaaaggaacucacacaauauguacuuacugauaaguggauauuagcccagaaacuuaggauacccaaguuauaagauacaauuugcuaaacgcaugaaauucaagaagaaggaagaccaaaguguggaaacuuuaccccuuccuagaaaugggaacaaaacacccauggaaggaguuacagagacaaaauuuggagcugugacaaaaagauggaccaucuagugauugccauaugcagggauccaucccauaaucagcuuccaaacgcugacaccauugcacacacuagcaaaauuuugcugaaaggacccagauauagcucucucuugugagacuaugccagggccuagcaaauacagaaguggaugaucacagucagcuauuggaugggucacacgacccccagugcaggagcuagagauauuacccaaggagcuaaagggaacugcaacccuauagguggaacaacaauaugaacuaaccaguacccuggggcucuugucucuagcugcauaugaaucaaaagauggccuagucggccaucacugcaaagagaggccccauuggacaugccaacuuuagaugccccaguacaggggaacaccagggccaaaaagggggaguggguggguaggggauuggggguggguggguaugggggaccuuugggauagcauugaaaauguaaacgaggaaaauaccuaauaaaaaaaaagaaaauucuuuguuuagcucuguaccccauuuuuucuuuuccuuuauuuuauuuuuaauuuauuuuuacacuccauauucuauucccuggucccccgcauccacucccaccccacccugucuccacguguaugcccccacaccccaccccaccagaccucuaaacucccuggggccuccagucucuugaugguuaggugcuucaucucugaaugaacacagacccagaaguccucuacuguauguguguugggggccucacaucagcugguguaugcuguuuggagaaaaucucggggguccagauuaugcugguccuccuacaggauuguccuucuuuucagcuucuuucagccuuuucuaauucaacaacaggggucagcugcuucuguccauugguugggugcagauaucugcaucugacucuugcagcuucuuguugugucuucuggagggcauucaugauagguccccuuuuuugagugcuucauagccucaguaauagugucaggccuugggaccucuucuugagcuggaucccacuuugcgccuaucucugaaccuucuuuuccucaggcuccucucuauuuccaccccuguaauucuuucagacaggaauaauuaugggucagaguugugaauugggggauggcaacccuaucccucacugucuuccugcuggagguggacucuauaaguucccucuccuacugugugucaucuaagguuccucccuuugaguccuggaauucucucaccucccaggucucuggaacauccuggggggucccccaaccuccuauuuccugagguugccuguuuccauucuuucugcuugucauucagucuuuucccucacccaguaccagaucagguuccccucucuccccaacucccccuccccugguccaauuucccucucagguccuucccuccauccccacuugugauugcuuucuucuuucucucaaguggaacugaggcguacucacuuaggcacuucagcuuguugagcuuaggguuauuugguucucuggagucuaacuuccugaguucuuuguauauauuggauauuagcccucuaucagauguaggguugguaaagauuuuucccaaucuguugguugccauuuugucuuauugacaguguccuuugccuuacagaagcaugaagacccacaggcaagcauaguacuauagaaggagccaagaguuuuacaucuaaauccacaagcaggacaagagagccacuggaucaggcuuagcauuugaagccucaaagucuaccucuagugacacacuuucucaaacaaaugccccuccauaagcauucaaauaugaguccuucggggcuauucuuauucaaaccaccauaacugcuaaaaguauauuguaguauuuucuuccagcaagagcugaauaucguggaaaaauuuaaucccaaccugggguuucuacccuaccuuugaccauucaguuuuuggauaaaagacacacauacaaucuuuauauuuauaauaagccuuaaucagcaaaagagcuggacaauaucuauccuuuaugcuauuaugucuauuucagagucaauaaucccauuauauaauuugccauauuuugccugggcugcucuuaauucuaauuaacuaaaccacaugaucauuuuuuucaugacucaccuaacucaugguugcuucuuccuccauucaccuuuuucuccaccugguuucucccaaagaggucauacaaaacuguaaucauugaaaaaauagccauuuuuaugcugauaaccaaagcaagaucauauugaaucuagaugccuuguacuuaccuucuuucccaauauaaaaaacauuuuucuuuuuaacuuugaaauuucuccuuaaggacuuuauuuucuuauauuuaaauuaaauauuugucucuaugauuuuaaaaauuagcuucucuucucuuauauuguucuuuaaauucaauaacuuuucaguaaggucccucuugggaccuuuaguuuguaccuugugcaguguuagccccgcuacagcucuucagcuagcucagggcucucugccuggccaggccucuccaacuugcccugcuucugcuuuaagccuucauccccaggcaucugacccguaugcccugccguauuugguugugccagcaccucuuaccagacagugaucugaggacucaguggacccagaugaggcuaucauuuuuccccccaugggccuuagcauaagcuaugcuuucugccaagcagagugcugucuuuccagagcagcauacagucuauuucuaucagugcaaagccuucucagcugcuguuguccagcuggucccaagcagcaguagcuugaaagccacauuucuggggagauuugugcuucucaaccggguaacuucuguugauaguuuggcuucaugucccauauaaggugugccgaaaaguaguacaaccacuuuaaacuuaucccugauuagcuuucaaguaaauuagauucagacuacguuuauuuuauuuggcuuugauaauuacuggggaagguaaccccuaaucuacuuuucuguuggccuggcuaccugcccagcaguguaccccaaauacuugcuguuucuccuggccacaugcucaugguccaucuccucucagcugacuggcacugugcuuugcucuugggaaaagucccaacuucuguguuuugauuuuuaaauuuacuaggggcuucuuuaaaaagccuccuucauacuaucucucucugcagguuccuucuucuuggcuaagaaaucuuuccagcuguuugucuuguguuguucugagaagcuuuggcuuugcucucccucucccccucucccuuccccucccccucccccuucuucucccuuuuuaaaaaaggguccagaccucuugucuggcuagcccaauuauucccugcuuuuaccugagccuuuuuagacuguaagcuuggguucuaauugccauugaguuaagcgccauuuaguuguaguuaugcccugguucugcuuccagcucuaugcucccagaaauaugauucagacucacauuauauuuacaaauacuuuggcuauauagcuaggcucuacuuugacuaaaauucuuuuuccucccagugucucaccucuauuuccugccuaagccauagguuauaggcuuuuuaauugacaggugaggcaucgaagcaucuauacaguacacaagaugaucucucuauagaacauuuaucaaauauuuuagaaaauuuaaguaaaauauuuuuuauucaaaacaaaacaacuugcaauuuugguguucaauguacauacaauugucaauagugaaaauucucuuucauauauguuacauuuagaucuacaaagauaaaaauuucagaauaauauaaauuguucaauacuaaaaaauacuauccuuauucauuaauuuauguugcuaaccucagucagaaacugaguagauuuuaauguguagucaugcuggaggaaacuucauugcgucuccuucacugaauauagacaauauauggaagaaguauuugagacacugaaaagaagauaccagugaagcaucaggaaaaacaagagaauucauaguaccuuggaaccuugcugugagcaugccacuuuuucuucugguuucuuucuaccaaaugacaaucugacaugucauggcacagccugaaaacuaaaauucuggauuaguuuccggagcugccaaaagggagccccaggaaaauaaagacuaccaggaaagggaaaaauggaaaaaauuuggaaagugaucccauaguguugauuuaaauucccaggcuccuaucugcacuauaaaaacuuaacucuauuucuagauucugagaacuaaaccaaaagauagaccacaauccaguucccagauuggguaccugauugugggccagcacagggaacagcuaaguggcuuugaaagccgaacugauauguaaucauaacccacaaaggaccuagaagauuuaaauaaucauaauugcaugauaugaauacauuauauuuaaguguauggaguauaauaaaaaaugcuugguauauaaagaaccacagaaauacuuauuuacaugaaaaaacaaauaaugaguuuauauaaauaacauaaaaauagauuauaauucagaaaaagcaaaaguguuaugaccaagaucugguucuuugauaauauuaguuaaaaauaaguaaaccuuuaacaauguugaauaauaaaaauacaaaugaacaauaugaaaaauuucuaucuacucauacauuuuuuaauuacacaaaguaccauauuugaaaauuuacuugaaguagaugauuuucaaaguauauauauauauauauauauauauauauauauauauauauauacauauacauauauauauauaaauuuauucaugagaauauauacauuuauaggcuacauaaugcucugguagucauucccgauccuauuggccacuugcccacuccaacucaaaaguggccuugcucuuuaacuucagaauccauguugcugcuaaaaaaccagcuaguuggggaacagcuaagcugaucucauaagagaccuguaguccuacuccaggaaagagaaugaauauaugugaaaaacaaaacauccucuuauuauugaaaauugauauuauauaaaauguagcuuuuuugcuacagagguugaggagaugcucaauaaaauuaucuccagauagggaaccucgauauauaauaguauagucuuacaaaauacuauucacucuguuuaaucuguggcuugucaaauauacuuacuuguaaugccuccuaccaccagauuucuuuuaaucaccauggauuacaaucuggaaauauuguuaugaaccagucacaaacaugaauacaaguguaaauauccuaaauauuaguggauaaaaucaagcaguauuuuaaaaauacauugugauuuaagaagaguuuagcauaauaaugugaagaaauauguuuuaacaugagcagcuuuacugaaauaauuguguugacagguuaaugguugaaugucauuugauucucucagugaauaccagaaaaacaauugaaaacuuaagcauaaagucuuccuccaaauacuuaguagacuagcaauaugguaaaauuuauauaguauuaguuaauaccaaccugggguuucuacccugccuuuuaccauuuaguucacagauaaaaacacuacacucagccuuuauauuuacaauuagccuuaaacagcugggcagauacuacucucuaugugauuagaaucuacuuuccuauagauaaccucaaguuauuacuuauguuucaucuggacugcucuuaacuccaacuggccagccuucagggccaucuucucuugauuccuaacccauggaagcuucuccuuccuacucuccuaccccuuccuccuccuuguucuccccugaacccaagcccagaaauccuaaaccccaccuaugacuccucugcccagcuauugguuguuggcaucuuuauuuaccaaucagaaauaacuggggggcagggucauaagucaacaugcagaauccaggucuugggggcuuguacuuagcauuacaauacauagcaagaucaaaccucaacaguuaucaaauucaauuuuagucaguguaaauaagaaaaaaacugagaggaaaauauuagagaaagaaaaaacauauggauuauaauuucugucuaacaaguagaagaaacccauuaaaaauuaguugaauaauagaguuuagcaaggauuuucuuauaagcuauuaaauuuuaacaaauucacaaauuuccuacauguuagaaaugaucaguuagaauaguuggagccaguauaauuaauguaugcaaccuacuucaaaguaaauaaaaaauucuugcaauaaacagaauauggcuaaacaugagaaaacaauaaaaaguuacuaaugagcacaaagcauuaagaugauuuauuaugcaaaauuuguaaagaugggugugucuuccauggaucauuguuccugagugaaauuaguuucaauaaaaaucccaaccccugggcuugagaaauggcucaguggauaacaaccacauaguggcucacaaccaucuguaaugggaagcugacauccucuucuggugugucugaagauagagacaguaugcucauauacauaaaauaaauaaauaaauccuucaaaaagaaagaaagaaagaaauuccaacccuaacucagggaaaaguugacacauuuauucucaaauucucaaauccuguauaaaaguagcaaagacaaauuugagauaaaagguaauuuuuaaagucugauugaauuaaccaaacuagaacaauguaauauuagucuaggaguagaaaaauagaucaaugacuagauaugaugauuccugauggaaccugaaaucuauuauaaagauacagauguuuuguagguuuuaggcagagaaggccugucugcaccuaacauuauugcuacaaaauaucaauauaacauacaguauaagaaauuuacauaaauuacaaaaaucaaagggaggggauggcuagagagaugguucacugguuaagaucacuugcuuucagaggacuggaguucaguucccccgucucauaccaggugauucacagcagcauauagcuccagcuccaggggaucuaauacccucucuuggcuuccauagguacuagcauaaauguacauaaauauaaguacauugcaugugagugcacacacacacacacacacacacaaauuuaaaaagcaaaacucuuuacaaaaacuuuaaaauuaaaagauaaaaacauuuauugaauggaaaauaauuuuuccucccagcguauuuucuagcuacuugguuuaucaauucugagggaaaaguuguuuccaguuucuuacagauaauagaucuuacugcuaaauauuagagacuucuguauuaccaaauaccagaauuuagaaaaaaagucaggauuuuuuuuugccauauaugaagagcacagaagaaauuuccauguacaaauuugucuuacugaugaaugauaaaaagcucagcacucuucauuaguuaugacuacuuuuaacuccaagcauagaaagucaauaauuaaagauauacacauuuaaaaauauuguggugaagcaggagcauuuccaugaguuugaggucagucuauauuauauagugaguuucagagcagcuuaggcuacagagagagacccuaugucacccaucucucacuaaaaacuaaaauguugauauauuauuaaccucuccagccugcaaagaguuaaaaauuauauaauacugaauguagacauuaccauacauuguucauggauuuucaguaaaacauuccuauagaacaauuuaaugacauauaaaaauuuaaauaagcaugauauuugauucauaaauuucauuuguaagauuuuuaacuugacuuaauuagguacauaaauuagauauauaugcauauauuuuauaagacuugauuaaauaaaauaucacauguucauacaguggaauguuauuguaccuuuuaggagacuuucauguaggagaggugaagaaaugcauaaaucaaagugagauuauuaucuaauauuucaaagaaucuuaauaaagguugucuccaguguagggaaaucuaugauucaauuauauugucaaggacccaguuuucuugagucucugcucugccauguucuaacuaacucuucuuuugaucacauucaauaaauauguacaugcacugauugacuguaguuaguaauuagcaaagacacagaaucugcccucaugcaguuauagaaaauuuacuguauaagaaaaaauuaacagaacaauguguuacaugauaccauuuguacaagagauucauuuaugugcaaauauaauuucuaucaucuuaugacuauuaugacuaagugcuuuuuuauauggauugucucaucucauccuuaccacaacuuuaugagcuaaauaccaucauucaguauaugaugugugaaauauaugugugaaaggggacucagagauauugaguugcacuuaauuucugguagagucagaauuugaacuuauauuugucuuggaagagaagaucuguaaugaaauaaacaaaaacacuuucuuuaggaauugguaauuaaaugcaguugacuacaagagccaagaaaaaggaagagaauauugauaaauuaguagugggccaugguugauugccuaaaguuguaacaaaaguuuaaacaggccuuaugggagacagugacaaacagaucuuguaaucagagaauuccagaggcuacagaauagaaucaugugugugugaucaggaggggucaaggucauuggugaagaaaguaugauuauuauuuuuauauaacucacagccagacagaucagaugauggaaagccuuguaguuaugccaagaaauguaagauuuuuuucaauuuuguucaaaugugaugagaaagcauggguaaauucuaauuugggugaagaaugacuugaucuguuaugguaugauaacucuacacauuuugggaaugugucauggauaugugaauaagaaguagggagaaggguaagauaauugaaguaguucagagucaauaauagcuuggacaauggugauagcaaugaugauggagaaaaauaguucugaguuugaggaauuuauaucugugugucuuaagcaaauuaacuacauugguuugaugcuuaaaagauggccugaauuacuuugcaaagcagagaguaguugaaauuaugggaguggauuggauugucugguaaggagagauuuugaagaguagaggaacaguauugugucuuuccacacaacuuccggagaagcuuagugaaugcagaagccguucuaccaacaaauccuaugacuacaauuuauuucauuguuuaccuaaacccacugcugcauuaugacauuaccaccuacuccuuuucugugaaauauaucuccaggauuuccaugaucuccuuuuaugccagugguucucaaccuuccuaaugccccugaccuuuuaauacaguucuuuauguuuuggugacaccccccccaaccauaaaauuauuuucauugcuacuucauaacugaaauuuuacuauuguuaugaacuguaauguaaauaugugguauguaggauaucugauaugcaacccugugaaucauucaacccccaaaugguuuucgaccacagguugagaaccaguucucuaguuuuuuuucccccuuuuaggcaucccagaaucuuuguuguuccucaggcaagguuaaagaacagggccuuggucugucuaucagcagugauguuuggaggaauguguucccuaguaucuguuagcuauucaaagauuuuggaagcuucugacccuauaacuugauggauuugaaaagcaauccauaaagcuaucucagaaaagaauuaggagcaaggguagagcauuaacaaaagcccugaggugggaaaacucuuggcauguuugaagaacaaaaaaggaagagcuggagagauuaagaaaacauacugcucuuguagagggccugaauucagucccccuaucuugugggucuuaacugccuguaauucuaggugcauguugucuguagacauuuggcuucugaggaacagaacacacacacacacacacacacacacacacacacacacacacacacacacacacacguauauauaaaauuaaaauaaagaacaagaaaggaaacugagaugaacaagaaaucagauguaagaaaugaggucgcagagguggcaggauggaauucauuuuaggguucuucuguagacuauuggaaggauuuuguguuuuaagcugaaugaaauugauaagcacaggaauauuaugaguaggugacuguuuuaacucauguauuaucagacucccuugggcuguauggauaauagacugguagggaagggguagcaagaaugacuguagggagaccaguuuuaucacaauaauucaggugauaagugacaguggacaacagcagcauuaacacauuaaagguguuaaaaagcuguuaaauucuugucuuauucuucugccaacauaauuuucagauagaucaaauguggaguaagaaagagaaggaaagaagaaugacuuuaagcuuuuaggcaggaaugcuuuggagaaaguuaacauuaccuuuaggagcuugauuaaauucaggacauguuaaauuugucauucuaauggacaaucaaauugaaaugacagguaaguaguugguuaugaaagucuggaguccauggguaauagaugagcucaacauaucaguccagggcuuacuggcucacagauaauuuuuaaaaccaacgaauggcuggggucaccaagggaauuaauauaaauaaagaaacgauaaguuuaagccuagauaaaauuuaaagguguggaaagcucuaugaaaugcagcuucauaguuaauuucucuuucuucuuuucuuacuccuccccuuaauuuacuuaagccugcaaaaaugauaaggcaguacugagauuagucuguguaugccuagauucagaauuucuuuuauauuucuuucagaugugcacuauccaccuuggaaaguguauuugaugacugcauuccagucugggucccauguccucacaugauaguaugccacagucagauuugaaaaacacaacaaccaaccaaccaacaaacaaaacaaaacacccaagggaauuuagcuuggaaaagacauuccagugaagacaguaguuauaauuaacuacuugccuggugacagaauuauaaaucuugauuaaaaauuacaaugcuuaaguuuuaggcuucacacaaccaacuuuuuacauagugguuugggcugaaaaugaauaauaauauuucugugauuuucaacaugaaaaccauauaucuuuaaaauuguguccucuuuuuggcuuucagauacuuuugacuauguuuaugcaagguaugucauauccaauugguauacgcuacaguaugggauugguaucuuacugguauccuuguuugcaacaaugaagggacacauucuagaaauagcuacaacacacauauggaaucucucagucacaugaucaaccauuuuacuaaauacaagcauauuuucauucacauacagcuaaauaaagaauuuuucacauuucauuacaguguacaacaaauugaggcaaaguauacaguacauuuuguucuggaauauaagacaaucuaauccaacaugcaguugugaucguuguuacaguuaaucuuuucuuuaccuauguaguaaaauagcuucuaaugcauuauccuuaguauuuuaugaacaccugauuuuuucacauuuauugucuaaaacccacuuauugcagugacaacagcacugaauucuacuaaaaggauuuuugagauuuuuuuaaaacuuauggaagaagucaaguucagccaccucugcugcauuuaugcuggguacuuugaaacccacuuuuaaaagccaggaauggcaaaguauauaauguauuuucgucaagaaaacuguagaccuguuuuauuucuaccccugcccccuugagucaacaagagucuaaucaacucuuauuuauccacuggauaauccuggguuuuagaacaaucuagacauguguaucauuguugaaauuuuguguuaacccacaaaaaagguuguauuugccuucuacaaccaagaaucuggcaauuuaaaauacgugaaaugauuauagaaugaaugaucauuuaucugcaauugauaaugugaauugguccaaaaugacuuguuuauacaaguuggagcaaagguggcuaaacaaccuuucauaauuuuuauuauuuggguuauuuuagcugaaacaaauucccagauucacacauauucauucugaacucgaacaggauauugcaaauauaauuugccauucuuucuaccacaauguauauaugagaaacuugacucuaaucagaauaguuuucuuacugucaaaaguauggcuuuugccuagcugaacuggcuacaauccaaaaagaaauuuaaagcaucacuucuuuuuaagaagauaaugaauuuuucaucucagccauucuaauuugcugaugugguuagcugucuguucaccugagaauuaagagcugacucucucggguagacaggagcccaauguagguacauagcagacagguagucaaggucauugugaggugaguacuuuauccccaacccacuccccauuguuguauuugguuccuuuuaauaaaauauucauaguguuugugagaagaacauuuauaacccauacaguuuuaauguguuuucaguugugcaguuaaucccuuauuuaaugcccucuugucaauaauaccugaguggccuuuaccuuuuauucauuucuagauuccugcaagauuauagcugagcuguaaaacaaggaaaacauauucuaucauguagagaauauuuauuuauagucacaugucuccaaagguuaauaaauuaaucacuuauucauaugaauaaugauccagugaaaaaagcuagguaucagguaggcuugguucuugcuuucuuauuauguaaaaugggaucaaaaaucucacaguccuauuauggugaucaaaugagugaaauaaauuaauaugaauaauuuuuaaggauuccaagacuacguguugagccaauacucagaauagaaccaaugaccaagggcuugacuuaggguuuuuguuuguugacaaucucuguguugucguugucagguaucugaagaagcaagcaguauacuuacuucgggauuaugguucccugaugcagugaaaguccagguaugauuagaggggaaauaauguggccuuugaguuacaguguuuccuuuuucuccuuacaugaucauuuuacauggaagaauuucuuucacauaguuggcaacuuuaucaugccaguguacacuuuucucaaaugugauaacaacaauaugugaaugacuucccuuuucauauucacagcaguuuuacuagaaugcuagaccuugaaagagcuuuaccaaauaguugauucauaugggcuuuucauuuuacaguugaacuguuagaaguggcuugauguguuuguauaaaacccagcacacaucuggcacgguauuaucauugaauaaguugauaucauacucuuuuuuuuuucaguuaucuuaauuguccccaauugauacuugauuucuuucuauauguuucuuuauggucaccaugucugaaaaguuguaauaccaaggaacuguuuaucugucuguagguguuuuccuggaaccuaacuuucaaauacccagacccuuaauaugugguccacaaagggcacacagagcagccauugcugagccuggcccacaaaacaaggucugguccagccccugucagcaauuuagucccucagucacagcacccaggcucccuaucuacccacacaugagccugucagagauccaggccuaggaagaaggcucauuuauuauccaaacguugaguucucuucagucacauaaggauucuauuuauuuugauaacuuuuaaguucaagugggagaguauguuuugaaaauggaaggguuaacuagcacaaacaucuccucucugauuugauaaccucuucugaagaaugaacaacauuugguacaaauccacucuucaccccuucccaacccuccuggauuguaaucuccccccuuuuaaccagcucauauaugucucuugucaggucugugaaggcuuucuccacauuaauggcaucucgggcugacgucucaauguacuucaugccguaugcagcagccaguuucucggccucguggcgagucacuugccucuguguauccaggucacacuugugacccaccagaacaaauacaauuugguagggcugaacguguacuuuggucucuucuaaccacucauggacauucuggaaggaccugcgguugguaaugucaaauaagagaagaccaccuacugaauuccuguaguaggcgcgagugauggaucuaaaacacaagaaagaaguaaagaauaaaguucgugcucaaacuccuucacuccaacgaacucaguguauucuaguguuccugauuccugacaguccuuuaguaaauacaaaugcagucuauaacaauaaugacaaguuuucaacugaguaaaauguuaagaaugcucgugaacuuucagguauuuucccuugaauuuauuauaauugauaaccccugaaaauaucuugcaaaauauuucauuuuucuauuuaucauuaac

SEQ ID NO: 9588 - RNA, 60986 nt, Mus musculus
guuaaugauaaauagaaaaaugaaauauuuugcaagauauuuucagggguuaucaauuauaauaaauucaagggaaaauaccugaaaguucacgagcauucuuaacauuuuacucaguugaaaacuugucauuauuguuauagacugcauuuguauuuacuaaaggacugucaggaaucaggaacacuagaauacacugaguucguuggagugaaggaguuugagcacgaacuuuauucuuuacuucuuucuuguguuuuagauccaucacucgcgccuacuacaggaauucaguagguggucuucucuuauuugacauuaccaaccgcagguccuuccagaauguccaugagugguuagaagagaccaaaguacacguucagcccuaccaaauuguauuuguucuggugggucacaagugugaccuggauacacagaggcaagugacucgccacgaggccgagaaacuggcugcugcauacggcaugaaguacauugagacgucagcccgagaugccauuaauguggagaaagccuucacagaccugacaagagacauauaugagcugguuaaaaggggggagauuacaauccaggaggguugggaaggggugaagaguggauuuguaccaaauguuguucauucuucagaagagguuaucaaaucagagaggagauguuugugcuaguuaacccuuccauuuucaaaacauacucucccacuugaacuuaaaaguuaucaaaauaaauagaauccuuaugugacugaagagaacucaacguuuggauaauaaaugagccuucuuccuaggccuggaucucugacaggcucauguguggguagauagggagccugggugcugugacugagggacuaaauugcugacaggggcuggaccagaccuuguuuugugggccaggcucagcaauggcugcucugugugcccuuuguggaccacauauuaagggucuggguauuugaaaguuagguuccaggaaaacaccuacagacagauaaacaguuccuugguauuacaacuuuucagacauggugaccauaaagaaacauauagaaagaaaucaaguaucaauuggggacaauuaagauaacugaaaaaaaaaagaguaugauaucaacuuauucaaugauaauaccgugccagaugugugcuggguuuuauacaaacacaucaagccacuucuaacaguucaacuguaaaaugaaaagcccauaugaaucaacuauuugguaaagcucuuucaaggucuagcauucuaguaaaacugcugugaauaugaaaagggaagucauucacauauuguuguuaucacauuugagaaaaguguacacuggcaugauaaaguugccaacuaugugaaagaaauucuuccauguaaaaugaucauguaaggagaaaaaggaaacacuguaacucaaaggccacauuauuuccccucuaaucauaccuggacuuucacugcaucagggaaccauaaucccgaaguaaguauacugcuugcuucuucagauaccugacaacgacaacacagagauugucaacaaacaaaaacccuaagucaagcccuuggucauugguucuauucugaguauuggcucaacacguagucuuggaauccuuaaaaauuauucauauuaauuuauuucacucauuugaucaccauaauaggacugugagauuuuugaucccauuuuacauaauaagaaagcaagaaccaagccuaccugauaccuagcuuuuuucacuggaucauuauucauaugaauaagugauuaauuuauuaaccuuuggagacaugugacuauaaauaaauauucucuacaugauagaauauguuuuccuuguuuuacagcucagcuauaaucuugcaggaaucuagaaaugaauaaaagguaaaggccacucagguauuauugacaagagggcauuaaauaagggauuaacugcacaacugaaaacacauuaaaacuguauggguuauaaauguucuucucacaaacacuaugaauauuuuauuaaaaggaaccaaauacaacaauggggaguggguuggggauaaaguacucaccucacaaugaccuugacuaccugucugcuauguaccuacauugggcuccugucuacccgagagagucagcucuuaauucucaggugaacagacagcuaaccacaucagcaaauuagaauggcugagaugaaaaauucauuaucuucuuaaaaagaagugaugcuuuaaauuucuuuuuggauuguagccaguucagcuaggcaaaagccauacuuuugacaguaagaaaacuauucugauuagagucaaguuucucauauauacauugugguagaaagaauggcaaauuauauuugcaauauccuguucgaguucagaaugaauaugugugaaucugggaauuuguuucagcuaaaauaacccaaauaauaaaaauuaugaaagguuguuuagccaccuuugcuccaacuuguauaaacaagucauuuuggaccaauucacauuaucaauugcagauaaaugaucauucauucuauaaucauuucacguauuuuaaauugccagauucuugguuguagaaggcaaauacaaccuuuuuuguggguuaacacaaaauuucaacaaugauacacaugucuagauuguucuaaaacccaggauuauccaguggauaaauaagaguugauuagacucuuguugacucaagggggcagggguagaaauaaaacaggucuacaguuuucuugacgaaaauacauuauauacuuugccauuccuggcuuuuaaaaguggguuucaaaguacccagcauaaaugcagcagagguggcugaacuugacuucuuccauaaguuuuaaaaaaaucucaaaaauccuuuuaguagaauucagugcuguugucacugcaauaaguggguuuuagacaauaaaugugaaaaaaucagguguucauaaaauacuaaggauaaugcauuagaagcuauuuuacuacauagguaaagaaaagauuaacuguaacaacgaucacaacugcauguuggauuagauugucuuauauuccagaacaaaauguacuguauacuuugccucaauuuguuguacacuguaaugaaaugugaaaaauucuuuauuuagcuguaugugaaugaaaauaugcuuguauuuaguaaaaugguugaucaugugacugagagauuccauauguguguuguagcuauuucuagaaugugucccuucauuguugcaaacaaggauaccaguaagauaccaaucccauacuguagcguauaccaauuggauaugacauaccuugcauaaacauagucaaaaguaucugaaagccaaaaagaggacacaauuuuaaagauauaugguuuucauguugaaaaucacagaaauauuauuauucauuuucagcccaaaccacuauguaaaaaguugguugugugaagccuaaaacuuaagcauuguaauuuuuaaucaagauuuauaauucugucaccaggcaaguaguuaauuauaacuacugucuucacuggaaugucuuuuccaagcuaaauucccuuggguguuuuguuuuguuuguugguugguugguuguuguguuuuucaaaucugacuguggcauacuaucaugugaggacaugggacccagacuggaaugcagucaucaaauacacuuuccaagguggauagugcacaucugaaagaaauauaaaagaaauucugaaucuaggcauacacagacuaaucucaguacugccuuaucauuuuugcaggcuuaaguaaauuaaggggaggaguaagaaaagaagaaagagaaauuaacuaugaagcugcauuucauagagcuuuccacaccuuuaaauuuuaucuaggcuuaaacuuaucguuucuuuauuuauauuaauucccuuggugaccccagccauucguugguuuuaaaaauuaucugugagccaguaagcccuggacugauauguugagcucaucuauuacccauggacuccagacuuucauaaccaacuacuuaccugucauuucaauuugauuguccauuagaaugacaaauuuaacauguccugaauuuaaucaagcuccuaaagguaauguuaacuuucuccaaagcauuccugccuaaaagcuuaaagucauucuucuuuccuucucuuucuuacuccacauuugaucuaucugaaaauuauguuggcagaagaauaagacaagaauuuaacagcuuuuuaacaccuuuaauguguuaaugcugcuguuguccacugucacuuaucaccugaauuauugugauaaaacuggucucccuacagucauucuugcuaccccuucccuaccagucuauuauccauacagcccaagggagucugauaauacaugaguuaaaacagucaccuacucauaauauuccugugcuuaucaauuucauucagcuuaaaacacaaaauccuuccaauagucuacagaagaacccuaaaaugaauuccauccugccaccucugcgaccucauuucuuacaucugauuucuuguucaucucaguuuccuuucuuguucuuuauuuuaauuuuauauauacguguguguguguguguguguguguguguguguguguguguguguguguguguguguucuguuccucagaagccaaaugucuacagacaacaugcaccuagaauuacaggcaguuaagacccacaagauagggggacugaauucaggcccucuacaagagcaguauguuuucuuaaucucuccagcucuuccuuuuuuguucuucaaacaugccaagaguuuucccaccucagggcuuuuguuaaugcucuacccuugcuccuaauucuuuucugagauagcuuuauggauugcuuuucaaauccaucaaguuauagggucagaagcuuccaaaaucuuugaauagcuaacagauacuagggaacacauuccuccaaacaucacugcugauagacagaccaaggcccuguucuuuaaccuugccugaggaacaacaaagauucugggaugccuaaaagggggaaaaaaaacuagagaacugguucucaaccuguggucgaaaaccauuuggggguugaaugauucacaggguugcauaucagauauccuacauaccacauauuuacauuacaguucauaacaauaguaaaauuucaguuaugaaguagcaaugaaaauaauuuuaugguuggggggggugucaccaaaacauaaagaacuguauuaaaaggucaggggcauuaggaagguugagaaccacuggcauaaaaggagaucauggaaauccuggagauauauuucacagaaaaggaguaggugguaaugucauaaugcagcaguggguuuagguaaacaaugaaauaaauuguagucauaggauuuguugguagaacggcuucugcauucacuaagcuucuccggaaguuguguggaaagacacaauacuguuccucuacucuucaaaaucucuccuuaccagacaauccaauccacucccauaauuucaacuacucucugcuuugcaaaguaauucaggccaucuuuuaagcaucaaaccaauguaguuaauuugcuuaagacacacagauauaaauuccucaaacucagaacuauuuuucuccaucaucauugcuaucaccauuguccaagcuauuauugacucugaacuacuucaauuaucuuacccuucucccuacuucuuauucacauauccaugacacauucccaaaauguguagaguuaucauaccauaacagaucaagucauucuucacccaaauuagaauuuacccaugcuuucucaucacauuugaacaaaauugaaaaaaaucuuacauuucuuggcauaacuacaaggcuuuccaucaucugaucugucuggcugugaguuauauaaaaauaauaaucauacuuucuucaccaaugaccuugaccccuccugaucacacacacaugauucuauucuguagccucuggaauucucugauuacaagaucuguuugucacugucucccauaaggccuguuuaaacuuuuguuacaacuuuaggcaaucaaccauggcccacuacuaauuuaucaauauucucuuccuuuuucuuggcucuuguagucaacugcauuuaauuaccaauuccuaaagaaaguguuuuuguuuauuucauuacagaucuucucuuccaagacaaauauaaguucaaauucugacucuaccagaaauuaagugcaacucaauaucucugaguccccuuucacacauauauuucacacaucauauacugaaugaugguauuuagcucauaaaguugugguaaggaugagaugagacaauccauauaaaaaagcacuuagucauaauagucauaagaugauagaaauuauauuugcacauaaaugaaucucuuguacaaaugguaucauguaacacauuguucuguuaauuuuuucuuauacaguaaauuuucuauaacugcaugagggcagauucugugucuuugcuaauuacuaacuacagucaaucagugcauguacauauuuauugaaugugaucaaaagaagaguuaguuagaacauggcagagcagagacucaagaaaacuggguccuugacaauauaauugaaucauagauuucccuacacuggagacaaccuuuauuaagauucuuugaaauauuagauaauaaucucacuuugauuuaugcauuucuucaccucuccuacaugaaagucuccuaaaagguacaauaacauuccacuguaugaacaugugauauuuuauuuaaucaagucuuauaaaauauaugcauauauaucuaauuuauguaccuaauuaagucaaguuaaaaaucuuacaaaugaaauuuaugaaucaaauaucaugcuuauuuaaauuuuuauaugucauuaaauuguucuauaggaauguuuuacugaaaauccaugaacaauguaugguaaugucuacauucaguauuauauaauuuuuaacucuuugcaggcuggagagguuaauaauauaucaacauuuuaguuuuuagugagagaugggugacauagggucucucucuguagccuaagcugcucugaaacucacuauauaauauagacugaccucaaacucauggaaaugcuccugcuucaccacaauauuuuuaaauguguauaucuuuaauuauugacuuucuaugcuuggaguuaaaaguagucauaacuaaugaagagugcugagcuuuuuaucauucaucaguaagacaaauuuguacauggaaauuucuucugugcucuucauauauggcaaaaaaaaauccugacuuuuuuucuaaauucugguauuugguaauacagaagucucuaauauuuagcaguaagaucuauuaucuguaagaaacuggaaacaacuuuucccucagaauugauaaaccaaguagcuagaaaauacgcugggaggaaaaauuauuuuccauucaauaaauguuuuuaucuuuuaauuuuaaaguuuuuguaaagaguuuugcuuuuuaaauuugugugugugugugugugugugugcacucacaugcaauguacuuauauuuauguacauuuaugcuaguaccuauggaagccaagagaggguauuagauccccuggagcuggagcuauaugcugcugugaaucaccugguaugagacgggggaacugaacuccaguccucugaaagcaagugaucuuaaccagugaaccaucucucuagccauccccucccuuugauuuuuguaauuuauguaaauuucuuauacuguauguuauauugauauuuuguagcaauaauguuaggugcagacaggccuucucugccuaaaaccuacaaaacaucuguaucuuuauaauagauuucagguuccaucaggaaucaucauaucuagucauugaucuauuuuucuacuccuagacuaauauuacauuguucuaguuugguuaauucaaucagacuuuaaaaauuaccuuuuaucucaaauuugucuuugcuacuuuuauacaggauuugagaauuugagaauaaaugugucaacuuuucccugaguuaggguuggaauuucuuucuuucuuucuuuuugaaggauuuauuuauuuauuuuauguauaugagcauacugucucuaucuucagacacaccagaagaggaugucagcuucccauuacagaugguugugagccacuaugugguuguuauccacugagccauuucucaagcccagggguugggauuuuuauugaaacuaauuucacucaggaacaaugauccauggaagacacacccaucuuuacaaauuuugcauaauaaaucaucuuaaugcuuugugcucauuaguaacuuuuuauuguuuucucauguuuagccauauucuguuuauugcaagaauuuuuuauuuacuuugaaguagguugcauacauuaauuauacuggcuccaacuauucuaacugaucauuucuaacauguaggaaauuugugaauuuguuaaaauuuaauagcuuauaagaaaauccuugcuaaacucuauuauucaacuaauuuuuaauggguuucuucuacuuguuagacagaaauuauaauccauauguuuuuucuuucucuaauauuuuccucucaguuuuuuucuuauuuacacugacuaaaauugaauuugauaacuguugagguuugaucuugcuauguauuguaaugcuaaguacaagcccccaagaccuggauucugcauguugacuuaugacccugccccccaguuauuucugauugguaaauaaagaugccaacaaccaauagcugggcagaggagucauaggugggguuuaggauuucugggcuuggguucaggggagaacaaggaggaggaagggguaggagaguaggaaggagaagcuuccauggguuaggaaucaagagaagauggcccugaaggcuggccaguuggaguuaagagcaguccagaugaaacauaaguaauaacuugagguuaucuauaggaaaguagauucuaaucacauagagaguaguaucugcccagcuguuuaaggcuaauuguaaauauaaaggcugaguguaguguuuuuaucugugaacuaaaugguaaaaggcaggguagaaaccccagguugguauuaacuaauacuauauaaauuuuaccauauugcuagucuacuaaguauuuggaggaagacuuuaugcuuaaguuuucaauuguuuuucugguauucacugagagaaucaaaugacauucaaccauuaaccugucaacacaauuauuucaguaaagcugcucauguuaaaacauauuucuucacauuauuaugcuaaacucuucuuaaaucacaauguauuuuuaaaauacugcuugauuuuauccacuaauauuuaggauauuuacacuuguauucauguuugugacugguucauaacaauauuuccagauuguaauccauggugauuaaaagaaaucuggugguaggaggcauuacaaguaaguauauuugacaagccacagauuaaacagagugaauaguauuuuguaagacuauacuauuauauaucgagguucccuaucuggagauaauuuuauugagcaucuccucaaccucuguagcaaaaaagcuacauuuuauauaauaucaauuuucaauaauaagaggauguuuuguuuuucacauauauucauucucuuuccuggaguaggacuacaggucucuuaugagaucagcuuagcuguuccccaacuagcugguuuuuuagcagcaacauggauucugaaguuaaagagcaaggccacuuuugaguuggagugggcaaguggccaauaggaucgggaaugacuaccagagcauuauguagccuauaaauguauauauucucaugaauaaauuuauauauauauauguauauguauauauauauauauauauauauauauauauauauauauauauacuuugaaaaucaucuacuucaaguaaauuuucaaauaugguacuuuguguaauuaaaaaauguaugaguagauagaaauuuuucauauuguucauuuguauuuuuauuauucaacauuguuaaagguuuacuuauuuuuaacuaauauuaucaaagaaccagaucuuggucauaacacuuuugcuuuuucugaauuauaaucuauuuuuauguuauuuauauaaacucauuauuuguuuuuucauguaaauaaguauuucugugguucuuuauauaccaagcauuuuuuauuauacuccauacacuuaaauauaauguauucauaucaugcaauuaugauuauuuaaaucuucuagguccuuuguggguuaugauuacauaucaguucggcuuucaaagccacuuagcuguucccugugcuggcccacaaucagguacccaaucugggaacuggauuguggucuaucuuuugguuuaguucucagaaucuagaaauagaguuaaguuuuuauagugcagauaggagccugggaauuuaaaucaacacuaugggaucacuuuccaaauuuuuuccauuuuucccuuuccugguagucuuuauuuuccuggggcucccuuuuggcagcuccggaaacuaauccagaauuuuaguuuucaggcugugccaugacaugucagauugucauuugguagaaagaaaccagaagaaaaaguggcaugcucacagcaagguuccaagguacuaugaauucucuuguuuuuccugaugcuucacugguaucuucuuuucagugucucaaauacuucuuccauauauugucuauauucagugaaggagacgcaaugaaguuuccuccagcaugacuacacauuaaaaucuacucaguuucugacugagguuagcaacauaaauuaaugaauaaggauaguauuuuuuaguauugaacaauuuauauuauucugaaauuuuuaucuuuguagaucuaaauguaacauauaugaaagagaauuuucacuauugacaauuguauguacauugaacaccaaaauugcaaguuguuuuguuuugaauaaaaaauauuuuacuuaaauuuucuaaaauauuugauaaauguucuauagagagaucaucuuguguacuguauagaugcuucgaugccucaccugucaauuaaaaagccuauaaccuauggcuuaggcaggaaauagaggugagacacugggaggaaaaagaauuuuagucaaaguagagccuagcuauauagccaaaguauuuguaaauauaaugugagucugaaucauauuucugggagcauagagcuggaagcagaaccagggcauaacuacaacuaaauggcgcuuaacucaauggcaauuagaacccaagcuuacagucuaaaaaggcucagguaaaagcagggaauaauugggcuagccagacaagaggucuggacccuuuuuuaaaaagggagaagaagggggagggggaggggaagggagagggggagagggagagcaaagccaaagcuucucagaacaacacaagacaaacagcuggaaagauuucuuagccaagaagaaggaaccugcagagagagauaguaugaaggaggcuuuuuaaagaagccccuaguaaauuuaaaaaucaaaacacagaaguugggacuuuucccaagagcaaagcacagugccagucagcugagaggagauggaccaugagcauguggccaggagaaacagcaaguauuugggguacacugcugggcagguagccaggccaacagaaaaguagauuagggguuaccuuccccaguaauuaucaaagccaaauaaaauaaacguagucugaaucuaauuuacuugaaagcuaaucagggauaaguuuaaagugguuguacuacuuuucggcacaccuuauaugggacaugaagccaaacuaucaacagaaguuacccgguugagaagcacaaaucuccccagaaauguggcuuucaagcuacugcugcuugggaccagcuggacaacagcagcugagaaggcuuugcacugauagaaauagacuguaugcugcucuggaaagacagcacucugcuuggcagaaagcauagcuuaugcuaaggcccauggggggaaaaaugauagccucaucuggguccacugaguccucagaucacugucugguaagaggugcuggcacaaccaaauacggcagggcauacgggucagaugccuggggaugaaggcuuaaagcagaagcagggcaaguuggagaggccuggccaggcagagagcccugagcuagcugaagagcuguagcggggcuaacacugcacaagguacaaacuaaaggucccaagagggaccuuacugaaaaguuauugaauuuaaagaacaauauaagagaagagaagcuaauuuuuaaaaucauagagacaaauauuuaauuuaaauauaagaaaauaaaguccuuaaggagaaauuucaaaguuaaaaagaaaaauguuuuuuauauugggaaagaagguaaguacaaggcaucuagauucaauaugaucuugcuuugguuaucagcauaaaaauggcuauuuuuucaaugauuacaguuuuguaugaccucuuugggagaaaccagguggagaaaaaggugaauggaggaagaagcaaccaugaguuaggugagucaugaaaaaaaugaucaugugguuuaguuaauuagaauuaagagcagcccaggcaaaauauggcaaauuauauaaugggauuauugacucugaaauagacauaauagcauaaaggauagauauuguccagcucuuuugcugauuaaggcuuauuauaaauauaaagauuguaugugugucuuuuauccaaaaacugaauggucaaagguaggguagaaaccccagguugggauuaaauuuuuccacgauauucagcucuugcuggaagaaaauacuacaauauacuuuuagcaguuauggugguuugaauaagaauagccccgaaggacucauauuugaaugcuuauggaggggcauuuguuugagaaagugugucacuagagguagacuuugaggcuucaaaugcuaagccugauccaguggcucucuuguccugcuuguggauuuagauguaaaacucuuggcuccuucuauaguacuaugcuugccugugggucuucaugcuucuguaaggcaaaggacacugucaauaagacaaaauggcaaccaacagauugggaaaaaucuuuaccaacccuacaucugauagagggcuaauauccaauauauacaaagaacucaggaaguuagacuccagagaaccaaauaacccuaagcucaacaagcugaagugccuaagugaguacgccucaguuccacuugagagaaagaagaaagcaaucacaaguggggauggagggaaggaccugagagggaaauuggaccaggggagggggaguuggggagagaggggaaccugaucugguacugggugagggaaaagacugaaugacaagcagaaagaauggaaacaggcaaccucaggaaauaggagguugggggaccccccaggauguuccagagaccugggaggugagagaauuccaggacucaaagggaggaaccuuagaugacacacaguaggagagggaacuuauagaguccaccuccagcaggaagacagugagggauaggguugccaucccccaauucacaacucugacccauaauuauuccugucugaaagaauuacagggguggaaauagagaggagccugaggaaaagaagguucagagauaggcgcaaagugggauccagcucaagaagaggucccaaggccugacacuauuacugaggcuaugaagcacucaaaaaaggggaccuaucaugaaugcccuccagaagacacaacaagaagcugcaagagucagaugcagauaucugcacccaaccaauggacagaagcagcugaccccuguuguugaauuagaaaaggcugaaagaagcugaaaagaaggacaauccuguaggaggaccagcauaaucuggacccccgagauuuucuccaaacagcauacaccagcugaugugaggcccccaacacacauacaguagaggacuucugggucuguguucauucagagaugaagcaccuaaccaucaagagacuggaggccccagggaguuuagaggucuggugggguggggugugggggcauacacguggagacaggguggggugggaguggaugcgggggaccagggaauagaauauggaguguaaaaauaaauuaaaaauaaaauaaaggaaaagaaaaaaugggguacagagcuaaacaaagaauuuucuuuuuuuuuauuagguauuuuccucguuuacauuuucaaugcuaucccaaaggucccccauacccacccacccccaauccccuacccacccacucccccuuuuuggcccugguguuccccuguacuggggcaucuaaaguuggcauguccaauggggccucucuuugcagugauggccgacuaggccaucuuuugauucauaugcagcuagagacaagagccccaggguacugguuaguucauauuguuguuccaccuauaggguugcaguucccuuuagcuccuuggguaauaucucuagcuccugcacugggggucgugugacccauccaauagcugacugugaucauccacuucuguauuugcuaggcccuggcauagucucacaagagagagcuauaucuggguccuuucagcaaaauuuugcuagugugugcaauggugucagcguuuggaagcugauuaugggauggaucccugcauauggcaaucacuagaugguccaucuuuuugucacagcuccaaauuuugucucuguaacuccuuccauggguguuuuguucccauuucuaggaagggguaaaguuuccacacuuuggucuuccuucuucuugaauuucaugcguuuagcaaauuguaucuuauaacuuggguauccuaaguuucugggcuaauauccacuuaucaguaaguacauauugugugaguuccuuugugauuggguuaccucacucaggaugaugcccuccagguccauccauuugccuaggaauuucauaaauucauuuuuuuaauagcugaguaguauuccauuguguaaauguaccacauuuucuguauccauuccucuaugaggggcaucuggguucuuuccagcuucuggcuauuauaaauaaggcuucuaugaacauaguggagcauguguccuucuuaccgguugggacaucuucuggauauaugcccaggagagguauugugggauccuccgguaguacuauguccaauuuucugaggaaccaccagacugauuuccagagugguuguacaagcuugcaaucccaccaacaauggaggaguguuccccuuucuccacauccucgccagcauuugcugucaccugaguuuuuguuuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauucggagcccugugauccauccauuagcugacugugagcauccacuucuguguuugcuaggccccggcauagucucacaagagacagcuacaucuggguccuuucgauaaaaucuugcuaguauaugcaauggugucagcauuuggaugcugauuaugagguggaucccuggauauggcagucucuacaugguccauccuuucaucucagcuccaaacuuugucuuuguaacuccuuccauggguguuuuguucccaauucuaaggaggggcauagugucuacacuucagucuucauucuucuugaguuucauguguuuagcaaauuguaucuuauaucuuggguauccuagguuuggggcuaauauccacuuaucagugaguacauauugugugaguuccuuugugaauguguuaccucacucaggaugaugcccuccagguccauccauuugccuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuauaaacauaguggagcauguguccuucuuaccaguuggggcaucuucuggguauaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaguugagaauucuuuguucagcucugagccccauuuuuuaaugggguuauuugauuuucuggaguccaccuucuugaguucuuuauauauauuggauauuaguccccuauccgauuugggauagguaaagauccuuucccaaucuguugguggccuuuuugucuuauugacggugucuuuugcuuugcaauuuuaugaggucccauuuaucgauucucgaucuuacagcacaagccauugcuguucuauucaggaauuuuuccccugugcccaugucuucgaggcuuuuccccacuuucuccucuauaaguuucagugucucugguuuuauguggaguuccuuaauccacuuagauuugaccuuaguacaaggagauagaaauggaucuauucgcauucuucuacaugauaaccgccaguugugccagcaccuuucaacugaggaauaucgaauggccgagaagcacagcacagagggauuugcagaggaucuucacagugguccaaaggcaggcaaaugcugcugcuuagcuaugcuggaagcucuguucuuaaaucugugcccacucgcccccuugucuguuuuucuuuuguuguaugggacacuuaaugguugacuacacaucucaucucccacaggcauguuauuugggaccccaaggaggugcagauaugcuccucccuuuucucuguucuagauuaggcuaaauuauuuuuuaaacuuucucacauaagugaaaacaccauuucuuuacacaucaaagcccauuagaauugggucacuucauuauuuuaucaaaggaauaaacucugcuaucguggauucuuacauauuucauaauuauuagccagaaaaacuucaucuucuuuggcucuuguauacuucuuuggcaauaucagauuucuauuuaaauaauuaaaaaaauaacuuugagugguaaacaaaaaaagaauucucaacugagaaauaucgauuggcugagaaacaccuaaagaaauguucaguauccuuagucaucagggaaaugcaaaucaaaaugacccugagauuucaccucacaccagucagaauggcuaagaucaaaaagucaggugacaguagauacuggugaggauguagacaaagaggaacacccuuccacugcugguaagauugcaaccugguaaaaaccacuguggaaaucagucuggcgguuccucagaaaauuggacauaguaguaccugaggacccagcuguacuacuccuggcauauacccagaagaugcuccaaauguauaaaggacacaugcuccacuauguucauagcagccuuauuuauaauagccagaagcuggaaagaacccagauguucuucaacagaggaacggauacagacaauauggugcauuuacgcaauggagaacuacuuagcuauuaaaaacaaugacuucacgaaauucuuaggcaaauggauggaauuugaaaauaucauucugagugagguaacucagucacaaaagaccacacauaguauauacucacugauaagugaauauuagcucaaaagcucagcauacccaagauacauuucacucaugaaaacugaacaauucucuacucaguaaucacuuggucaggaaaaaaaaugaaaauaucaaagacuuucuagaauucaaugaaaaugaaggcaaaacauacccaaacuuuauggaacacaaugaaagcagugcuaagaggaaacuucuacacacuaauugccucuacaaagaaauuagugagaucauauacuaucaacuuaauagcauaccugaaggcucuagaacaaaaagaagcaaacacacaaaagagggguagacagcaggaaauccaaacucagggcugaguuuaaucaauuagaaacaaagagaacaauacaaagaaucaaggaaaccaagagauuguucuuugagaaaaucaacaagauaaacacuaacagcuaaauuaacuaaaagucacagagacaauauccaaauaaaaucagaaacaaaaaggaagacaugacaauggacacugaggaaauuagaaaaugauuaggucuuacuuuaaaagccuguacuccacaaaacuggaaaauguaaaugaaauggaugaguuuugagagagauauagaaaccaaaguuaaauuaaaaucagguaaacaauuugaacaacaccuaaggaaauagaagcagucauuacgagucucccaacaacagcaaagcucggggccagaugguuuuaaugcagaauucugccaagcuuucaaagaagagcuaauaacaauacuccucaaacuauuccacugaguagaaacagaaggaacacuaccuaauucauucugugaggccacaguuaccaugauaccuaaaccaugcaaagacaaagaaagaacuucagaccaauuugacuuaugaacaucgacacaaaaauacucgauaaaaaucucacaaacaguauccaagaacaaacaacauuaugcaccacaaucuaauaggcaccccagggaugcaggaaugguacaauauaugaaaauccaucaacauaaucuauuauauaagcaaacugaaugaaaaaaaaguacaugaucaucugauuagauggugaaaaaagaaacucuggcaaauuccaacacccuuucauaguaaaagucuuggaaaaagcagggauucaaggcacauaccugaacauaauaaaacaauauacaacaagccaacagccaacaucaaacuaaauggagagaaacuugaagcaaucccacuaaaaucagggacaagacaaggcugcccacucucccccuaccuguucuagcuagagcaauuagacagagaaaggugaucacgguuagaaaggaagaaguaaaaguaucacuauuuguagaugauaguauacauaagugaccccaaaauucuaccaaagaaguccuacaucugauaaacagcuucagcaaaguggcuggguacauuuguguaaagucaguagcccaccuuuauacaaaugauaaaaaggcaagaaagaaaauaggaaaacaacuccuuucacaauagccacaaauaauauaacauauuugguguaacucuaaccauacaguuacgugaccuguaaaauaagaacuucaaguccccaaagaaagaaauugaaaauauuugaugauggaaaggucucccucagugggagaggauacauuuaaccuggcaaagacuugaugugccaggaugggggugggggugauacccagagaggguccacccucucaaagaagagaagggaccaugggagagagacucugagagugagggacugggaaggggagcagcauuuggagugcuaauucauucauucauucauucauucauucauaucugggugagacuguuaaugauaauucuucccaggcaacuuguaguguuauuuuaaaaaguuagccaguagggaauaagcuuuuaagggaguucuagcuucaggucuccaauccgccauggacagggaaggagcucacaaagccccaccccuagcuaagcagcuauugcaguugauggcuccuggagaagagaaagucaguuuucuucagagaugcagucccucauagguugaccacaugccaguggauggcccuaaauccacauauauacuggaaguauuaauuaaagagacucagucuuuaaaaaguaaggaacacauaaaauuggaagggcaggacacauguccucugcccaucuuggucuggauggaguggaaucagaaagaacaacagguagauuugauguaaacacauuguacaggugugcagaauaaaaaacaauuuuauuuuuugagauuauaaaucacaucauuuccccuucucaucacucccuaaaaucauccccauguacuucccuguuugcucucuuucaauuugauggaauaaauacauaaauacaaccuacucagucuguauaaugguacuuguauauguuuucagggcugaccauuuauauuggauaaucuaacugguaugcucauccacgggaagaccaucucuuccuguacuggcuaguuuugugucaucuugacacaggcuggaguuaucacagagaaaggagcuucaguuggggaaaugccuccaugagauccaacuguaaggcauuuucucaauuagugaucaagggggaaggguccuuguggguggugccaucucugggcugguagucuugguucuauaagagagcaggcugagcaagccaggggaagcaagccaguaaguaacaucccuccauggccucugcaucagcuucugcuuucugaccugcuugaguuccaguccugacuuccuugcaguauggaaguguaagcuaaauaaacgcuuccccaccccccaacuugcuucuuggucaugauguuuuguccaggaauagaaacccugucuaagacacuucuacucucagaauuccuuucugucuguaguucuuugucuggaauuggggucucaugaacuuucccccaaccguguuagcaugucuacuguuauugccuuugaucagaucauguuuaggcagucauguauuaaagaccuaaaagugaaaccugaaauacuaaaacugcuagaagaaaacauaggcaaaacaucuuugaguaaucccagcacuuaggaagcaguggcaguuucuaccguacucagucagauaucuucuaagauuguagaagcacacauccauagaaauaugaaaggaaauggaauacuguucugcuauauauuuguauuagcuacuuuccuguugcugugaaaaacacuauuaaaaaagcaacuuauggaagaguuuauuuugguuuaugguuccuucaaagaguuaaguccaucguggugguuaagcauggcagcaugugacuggagcaguauagcaaagcuacaggacguaaaagauacauaaguuccccaaacaaugacaccaacaaagaaccaagugaucaaauauuugugccucugagauauauuucucaucuaagccacuguaauauuacaauguaaugcaugucuuccucaacaaucuacaaaucauacaacaacuauuaaggguuaaacuguguugccauaaugcuauguugaaauuccauuccucaguaguuguaaauauaaucauauacuauuuccaucauauauauauauauauauguauauauauauauauauauauauauacugaaaacaaaacauuuuagguagaccacucaguaaaaaaagcuaauuguuaccugggaauaacacauacacugcccagaucagagcuuggcugacuagaggcuauauugggaaauguuaaaaauacaauccccacugaccuggacaugcacauuucuuugacaagggugaggcuuggagugguaagcgauagaagggcucuuauuacagcaaagcuguuacauugagggcuuuaaucauauuuuuccaguuauuuuuuauuacacacacacacuuauuuaacuacaugcuaaguaggcacuaaaccacauccccagucucugguuggguaauuuauauuuacauucaguauaauuacugaaauggaaggaccucccaccacuauucuguuaaauguuuugugggguuuuugguagucucuuccuugaccccuccucacucuuuuucuuccuuuguuguugucauuuuuuuguaugugugugauaaggugaucuuaucuauuaguaugauuuaauuccuuauuucuuauccuuuauguaucuaauauaaguuuugacuucacaauuauuaugaugcacauggguucuaugaccuaaguguggcaguaaaaggacaaguuuuggaaguuaguucucucuuucuaccuuccugagacaagucucucauauuguuucugccacugcaaugugugcuggggauaaccguaccacaaguuucuccucuuuccaucuuuccaaccucuagauagaaauacuagaauuguagaugcuugucaucacauuaacaugagugauugcaguaaaauaaugacaguauacuauuaaaaauaauauccacaagaauguguuaaaauuauacaaugccaaaauuuacacuguaacauuaaaaaauaaaauaaaauaaaacaggagcaaaaaauauaaaaguaaaaaucuagaaguuuuugugcaaucagauaacuuauuaauuuauuauaaccuguuauaacuacaagauguuuuagagaaagcuucaugauaaacacaaagucaaaaccuauaguagguacacaaaagauacgaaaaaaaauugcagcauagugauagagaagaucaccuuaucaccaaaaaaaaaaaaaaaaaaaaaaaaaagacaagagaaaggaaggaaggaaggaaaugagggagauaaugaaagaaacuacaaaacaucuagaaagauuuaaacaaaauagugggaggucuucccucucgauaauuauucugaauauaaauauaaauuacccaaccagagguuggagauauaguucggugccuacuuaccauguagcuaagugccugcuuagcaugaaggaaacccuggguuaugagguacacacagagaaaaaagugggggaggggaagggggacagggauggaggcaugcauccaugcauggaacacaaaacauauaguggcugaauagauguauaaaaaaacaaacaaacaaacaaagcuaggacuugggguguuaguugguuguagaacaguuggcuaaaauacacaaggcccuagacuaaauccccaagaacugcaauaaaacuaucaauaagacccauaaauauauguaagauacaaccucaagaucuugggucccgggucccucagagaccaaucugcgcagguaagagugcagacugcagaagcaacacagcuucugggacagacagaagcaacacagcuucuggaacagaccauauuucaggcuccagacaccugggcaccuuccccgccagaggagagguguccacccuggaggacucugaccaccagagcaggugagagagccaucuugugucccgggucccucggagaccagucugugcaggugagcaugcagacugcagaggcaacacgucuucugggacagguacuguuucuggcauucaucuucaaccaggaggcaguucugaacuccagauaucugugcaccuucccugcaagaagagagcuugccucaaacaauacucugaccacugacacuuaagagagagcugaaaucccagcacugcugacagaggcuaagaaucacagagaaucacagaaucacaagaggaacaagauccaaccagagacaacuauaacaacuaacuccagagauuaccagaaggugaaaggcaaauguaagaaucuuacuaacagaaaccaagaccacucaccaucaucagaacccagcacucccaccucagccaguccuggauaccccaacacaccugaaaaauaagacugauauuuaaaaucauaucucaugaugcugguagaggacaucaagaaggacauuaauaacucacuuaaagaaauacaggagaacagugcuaaacagguagaagcccuuaaagaggaaacagaaaaaucccuuaaagagccaacucuaaaaacaaaaauaauaggaagcaacaauuauuuuuccuuaauaucucuuaauaucaauggacucaauuccccaauaaaaagacauagacuaacagacuggcuacacaaacaggacccaacauucugcugcuuacaggaaacccaucucaggggaaaagacagauacuaccucagagugaaaggcuggaaaacaauugugcaagcaaauggucugaagaaacaagcuggaguagccauucuaauaucggauaaaaucgacuuccaacccaaaguuaucaaaaaggacaaggagggacaggacacuucauacucaucaaagggaaaauccuccaagaggaacucucaauucugaauaucuaugcuccaaaugcaagggcagccacauucauuaaagaaacguuaguaaagcucaaaacacacauugcaccucacacaauaauagugggaaucuucaacacaccacuuucaucaauggacagaucguggaaacagaaacuaaauagggucacagugaaacuaacagaaguuauuaaacaaauggacuuaacagauaucuacagaacauuuuauccuaaaacaaaaggauacaccuucuucucagcaccucacgggaccuucuccaaaauugaccagauaauugcucacaaaaccggccucaacagauacaaaaauauugaaauugucccaugcauccuaucagaccaccauggacuaaggcugaucuucaauaagaacaugaauaauggaaagccaacauucacguggaaacugaacaacacucuucucaaugauaccuuggucaaggaaggaauaaagaaagaaauuaaagacuuuuuagaguuuaaugaaaaugaagccacacauacccaaacuuaugggacacaaugaaaccauuucuuuuuucuuuuuuuuauuauguauuuucuucaauuacauuuccaaugcuaucccaaaagucucccacacccccccacacacacccauucccauuuuuuuggcccuggcguuccccuguacuggggcauauaaaguuugccuguccagugggccucucuuuccagugauggccgacuaggccaucuuuugauacauaugcagcuagagucaagagcuccgggguacugguuaguucauaauguuguuccaccuauaguguugcagaucucuuuagcuccuuguauacuuucucuagcuccuccauugggggcccugugauccauccaauaguugacugugaguauccacuucuguguuugcuaggccccggccuagucucacaagagacagcuauaucacgguccuugcaacaaacgcuugcuaguguaugcaauggugucaucguuuggaggcuaauuaugggauggaucccuggauauggcagucucuagaugguccaucauuuugucucagcuccaaacuuugucucuguaaguccuuccaugggugauuguuuccaauucuaagaaggggcaaaguguccacacuuuggucuucguucuucuucaguuucauguguuuugcaaauuguaccuuauaucucacuauacuaaguuucugggcuaauauccacuuaucagugaguacauauuauuugaguucuuuugugauuguguuaccucacucaggaugaugcccuccagguccaaccauuugccuaggaauuucauaaauucauucuuuuagcugaguaguacuccauuguguaaauguaccacauuuuuuguauccauuccucuguugaggggcaucuggguucuuuccagcuucuggcuauuauaaauaaggaaagcauuucuaagagggaaacucauagcucugaaugccuccaaaaagaaacuagagagagcacacacuagcagcuugacaacacaccuaaaagcucuaaaaaaaggaagcaaauucacccaaaaggaguagaggcaggaaauaaucgaacucaggggcaaaaucaacaaccaaacgaggagcugguuccuugagaaaaucaacaagauagauaaacccuuagccagacucacuagagggcacaggaacagcauccuaauuaacaaaaucagaacugaaaagggagacauaacaacagauccugaagaaauccaaaacaccaucagauccuucuacaaaaggcuauacucaguaaaacuggaaaaccuggacaaaauggacaaauuucuagacagauaccagguaccaaaguuaaaucaggaucaaguuaacgaucuaaacauucccauauccccuaaagaaauagaagcagucauuaauagucucccagccaaaaaaaaaaagcccaggaccagauggguuuagugcagaguacuaccagaccuucaaaaaagaucuaauuccaguucugcacaaacuauuccacaaaauagaaguagaagguacucuacccaacucauucuaugaagccacaauuacucugauaccuaaaucacagaaagauccaacaaagauagagaaccucaaaccaauuucccuuaugaauaucgaugcaaaaauacucaauaaaauucucgcuaaccgaauccaagaacacauuaaaacaaucauccauccugaccaauuagguuuuauuccugggaugcagggaugguuuaauauacggaaauccaucaauguaauccauuauauaaacaaacucaaagacaaaaaccacaugaucaucuccuuaaacacggagaaggcauuugacaaaauccaacaccgauucaugauaaaagucuuggaaagaucaggaauucaaggcccauaccuaaacaugauaaaagcaaucuacagcaaaacaguagccaacaucaaaguaaauggugagaagcuggaagcaaucccacuaaaaucagggacuaggcaaggcugcccacuuucucccuaccuauucaguauaguacuuaaaguucuagccagggcaauuagacaacaaaaggagaucaaggggauacaaauuggaaaggaagaagucaaaauaucacuauuugcagaugauaugauaguauauauaagugaccccaaaaauuccaccaaagaacuccuaaaccugauaaacagcuucaaugcaguagcugaauauaaaauuaacucaaacaaaaaaaaauggccuuucucuacacaaaggauaaacggacugagaaagaaauuagggaaacaacacccuucacaauagucucaaauaauuuaaaauacuuuggugugacucuaauuaaggaagugaaagaucuguaugacaagaauuucaacucucugaagaaagaaauuaaagaucucagaagauagaaagaucucccaugcucauggauuggcaggauugauauaguaaaauuggcuauccugccgaaagaaaucuacagauucaaugcaauccccaucaaaauuucaacucaauucuucagugaguuagaaagggcaauuugcaaauucaucuggaaaaacaaaaaaccuaggauagcaaaaauuauucucaacaauaaaagaacuucugaggaaaucaccaugccugccauuaagauguacuacagagcaauugugauaaaaacugcauauuacugguacagggacagacagguagaucaauggaauagaacugaagacccagaaaugaacccacacaccuaugguuacuugaucuuugacaagggagcuaaaagcauccaguggaaaaaagacagcauuuucagcaaauggugcugccuuaacuguuaucauguagaagaauuuaaauugauucauucuuaucuccuuguacaaagcucaagucuaaguggaucaaagaccuccacauaaacccagagacacugaaaucaauagaggagaaaguggaggaaagccucgaagauauggcacaggggaaaaauuccuaaacagaacaggaauggcuugugcugucagaucaagaacugauaaaugggaccucauaaaauugcaaagcuucuguaaggcaaaagacacuguuaauuagacaaaaaggccaccagcagauuaggaaaggauuuuuaccaauccuaaaucugauaggggacuaauauccaauauauacaaagagcucaagaagcuggaccccagaaauucuaauagccccauuaguaaaugggguacagagauaaauaaagaauucucaacugaggaauaucgaaugucugagaaucaccugaaaaaacauguucaacauccuuaaucaucagggaaaugcaaaucaaaacaacccugagauuccaccucacaccagucagaauggcuaagauaaaaaauucaggugacagcagaugcuggugaggauguggagaaagaggaacacuccuccauuguuggugggauugcaagcuuguacaaccacucuggaagucaaucuggcaguuacucagaaaauuuuacauauuacuacuggaagauccagcaauaccucuccugggcauauacccagaagauuuuccaacugguaauaagaacacaugcuccacuauguucauaacagccguauuuauaauagacagaagcuggaaaguacccagaugccccucaauagaggaauggauagagaaaauguggcacauuuacacaauggaauacuacucagcuauuaaaaacaaugacuuuaugaaauucuuggacaaauggauguaucuggaggauaucauccuuagugagguaacccaaucacaaaagaagucauuagauaugcacucauugauaaguggauauuagcccacaaaccuagaauacccaagauacaauuugcaaaacacaagaaaaucaagaagaaggaaguccaacguguggauacuucauuccuccuuagaauagggaacauacccaugaaaggauuuacagagacaaaguuuggagcuaagacgaaaggauggacuauccagagacuacuccacccggggauccaucccauaaucagccgccaaacccagacacuauugcauaugccagcaagauuuugcugaagggacccugauauagcugucucguaugagguuaugccagugccuggcaaauacagaaguggaugcucacagucagcuauuggauggaacacagggccccaauggaggagcuagagaaagcacccaaggagcugaaggagucugcaacccuaugggugaaacaauaugaacuaacuaguacccccagagcuccuaucucuugcugcauguguagcagaagauggccuagucggccaucacuggaaaaagaggccuuuugguauugcaaacuuuauaugccccaguagaggggaaugccagggccaagaagcgggaguggguguguaggggagcagggcagagggaggguauagggaacuuucgggauagcauuuaaaauguauauaaaaaaucuaauaaaaaauguuuuuuaaaaaaaagaaauauggcugguuccaccuagcugucuuugcuguugguuugagaaguaacuugguugcuucuucuauugcuguuacacugugaagugaaacagaaauggcuuuuacuaaaccuacaucauaccauuugugccucgagcucuaaaacuaaguagaaaaaaaccuguuuaaaguagcucaucucggguuauuucauuaugguaaggagcugacuaaugacucccauuuucuugguguucacacaccaugguagaaacauucaaaucauagcugugauagaacauauaaaauacuucauuguuuaaguauguucaaguugagugaaugugggcaugcauguggagaucagauuugggugucaguccucaccuacauugagacaggucucuuaauguuugcuacugcuuaugccuggcuaaguaacccucuaagcuuccagaaauucuccuguuucuacuuuccaucucucaguagggucacacugggacuauagaugugugcugcucugcucaguuuuggcuuuacaugcucuuuuggguucuagccucaggucaucagacuugugugucacuauccauugagccuucucucuagcccuaugauuuuacuuuuuuauuuaagcuaauaacauuuaaaguguuuugaacaauuuucaaguauauacaauguuauuacuauugucacacauuauccaauggcacucuugagcuuauucuuccuaauuggaauugcgugaccuuugaucaacaucaucuuaauuccuauacucuccuauacucuuuuuuuucuaugaguuggaccuuuuaauauuccauuugugugguccuugucuuucugugauuggcuuauuucacuugauacaauaucuuuuaguuccaugcauuuugucacaaacauaaauuuauaguuuuaauggccagcuaguauucuaguugcauauguauuauuuuuucuuauucauguaugugcuaauggacauggcacaccuauuuauuuguuuuguuugacaaugggaaugggccuuagaugaauguaggcuagacaaauacucauacuguagcagggaacaugggaaauauaguuaucucuuugacaugcuaauuuuuauauccuuugaaaauauacccaauagugauauugcuagauuauaugauaguuuaauugcuugagaacuuccaugcuauugucuaauguacauugccaacaguaguacacaagguuuucucuguaucccuaugaacauuuaucuuucaucuuaaaaaaaaauaguugcucugacagaugugaggcaauaacacauuaugguuuucauuuguauuucccugaugauuagugauauuuauuauuucaucauauacuauuguucauuuaugugucuaugaaaauuuuucuauucaggacacuugccuaguaaauuuuuuaacuaucaaguucuuugcauuuccuaauauauuuuaauuauuacucuauuaucagaugagucuaaagugauauuaguuccucuuuaaauauuuauuuuauuucagcaaugaaguucucagguucuagacuugucuuuggcgggagaugucuuauuaauaaugacaucuuuuuuuuuucagacaaguagucuuauuuuauuuuucauaaucuguggaguaauugguaacaacaucagcaggagccuauagucaauacaucugggcacaaaauacuuuuuuuuuucuuuuuguuagauacuuucuucauuuacauuucucuuuuuauuagauauuuucuucauuuacauuucaaauacuauuccaaaaguccccuaugcccuccucccaccaugcucccuaacccacccacuccugcuuccuggcccugguauccccuguacugaggcauaugaucuucgcaaaaccaagggccucucuucccauugauggcugacuaggccauccucugcuacacaugcaacuagagacaucaaaugcuauccccuuuucuaguuuccuccccaaaaguccccuauacgcuccccgcugcacugcuccccaacccacccacuccugcuuccuggcgguggcauuccccuggggcauauaaucugaugacaucuucuuuauuuuuguuaugcuauuguuuuuuucccuuuucccuuccuuuauuuuauucccccuuucaguuucccuucucccuucccuuuccccugcucuuucucaucccuuccccuucuuucuuauuccgucuuuauauugacauaggcuagcuuagaacuccuggacuccuuggauccuucuagugucccaaguagcuguaaccacacuuuguucagauuuuccauuucucauaauuuuguauguuucuagguuugcuucuccccuuuucuuuguauguacuuauucaucuuaaugucuuaugguuguuucuauuucuaugauuucacuuguaauauuuauuucaaucuuuauucauuucuaguauaauaauuucuuuguacuaaugcuggaccuaauuuguucuuuuuuuuuuaacuuccuuuggauaauaauauuagaucauuuauuugacaucuuugucuuuuaauacacucauuuauugcuauaaaucucccucuuguuagaagcucuuuuccuguagucuguaaauuuugggauauuacauuucaagguguuuuaaguaacccuuuaaauuucuucucucuuauuugcugguuguuuuaagcacauuguuuaauuugcacauauugguuaguuaucugaauauuaccaucuucagcuuucauacucuguagccagaaaaacuauuuuauaacuuccguguguuuacauuuccugauuuauuuagggacaaauauaaggucuacucugaagaauauuccauguaaacuuuacaaaaaugucuguuuuguuguuggaugagauauucuauaaauguuuguuagaacuauuugauguaagguauaacucaaauuuauuguuuauuaauuuuaugucuggauuauguccauuuuugaaguugugauaucaaaguacucugauaauaauguauuauauagucuuuauuuuuugauauguuaauauuuacuuuauauauuuaugugcuccaauuucagguguuguaugcaacuguaucucuuagaguuuugugucuuaaugacacaaucuuuucucauuaaauaauguuccucuuuaccuuaauuuauaguuuuuuauuuaaagucuauuuuaucugauauaauuauaucugcuguauuaugguuuguuuggcuuaguguauauuuuuagucuauguuuucuuaaaaguugaguguuuugaguuuuaacuuuuuuauuagauauuuacuuuauuuacauuucaaaugcuaucccaaaaguucccuauacacccccuagcccugcugguggccauauuucuuuuaaaacaagccucuccuaagaacuaccuccugaaggcauuuucaaguuccuuaaagaccucccacuaggccuuauuucauaacaguuccaugauacuuccuaacacuaucuugugggaucaaaucuucaaucacaacagagacagcaugguagaaacauucaaaucauagcugugauagaacauaucaaauacuuugauuuggugauccuacaaagcauacauuuuccaguugauuuuguuuugagauccagcugaccucaaauucaugauucucuuccccuacuccaugaaagcuggaacaauaaggcaugcacaaaaccuagcuuuuucuuugcuuauuuguuuguaguucauguuagauuugugcugagauuaugagcagguauaccauaccuggcaguagauaaaaguuucacucuuaagccaucugugaacuacuucacugagaaauuauugcuggguuagaaaaaguagaaaauauuuauuaauaauuccaacacuuaggaggcagaggucauccuuagcuauguagugugaguuugaaagccuggaguaugagacucgaucuagaaaaaaaaaauuaccacaaacaauagaaaagggggagggagagaaggaaaaaaggaggguacaggagaggagaggaagaaagggagaagaggggaaggaggagggagagaagaggagguaggucacccuaguacagccauggacugaaguagcuuugaacauaaaaaaggaaaaccaagaauuuauuauucauugacucauuuuuucuauuuuuauucucuagauuucacaguugugauuuagagaaacuaaaauuauucagacuaagauggguuuacuuaagaaacuaaaaguagggagcuagagagauggcucagcgguugacugcucuuccaaagguccugaguucaauucccagcaaccacaugguggcucacaaccaucuguaaugagaucugauguccucuucuggaaugucugaagacagcuacaguaugcucauauacauaaaauaaauaaaucuuuuuaaaaaagaaacuaaaaguaucuaaaacauauuuccuaucugaucacuaucuaccuccaucuauccuugugucuuggucuauucuguacuacaauaacaaaauggagacuaggugcugccccgaugacucaguggauaaggacacuggcugcucuuccagaggaaauaacaugauggaucaugaacaucuauaaaggaucugaugcccucuccuggcauacagguauacaugcagacagaacacucauacauaaaacaaaaaugauugauugauagauaaauagauagauuuuaaaagaauaagugaaaaaaguuacuuuaguucauagguauggauguuuaaagacaggcugccaucaucucaguuuuguuaagugauccuuugaugguaucacaacauaaacacauaaaagagcucauguucuaagaccagaagccaaaaagauuucaagagccaggcucagguuuuuauaauauacucuugcaaaaaccaacuaggauucuacaaauacuauccuaaucuugcccgaggacaguaccuccaagcuuacuucacuguaugccucugcaguuguuugacuaauaaugguaauacauuggcucauguuugaauacuugcuccuccccaguugguggcaauguuugagaaggauuaagaaguaaagccuugcuggaggaaguagaacauuaggaguuggcuuugaauauucaaguuucaugccuugucaaaaaucaagugacuugagagguuuuucaauuugacuccauucaucaacuugucuauuucuauaauaauaccauguaguuuuuauuaauauugcucuguaguaugccuugaaaucagggauacugauaccuucaguucuuuuauuguucaagauuguuuuagacuaucuugaguuuuguuuuuccauuucauguugagaauuguuuuuucaaggucugaaagaacuguguuaaaauuuugauggaaauugcauugaaucuauagauucuuuugguaagauggccauuuuuacuaugcuaauccuaccuaugcauggacauggaggaaucuuuccaucuucuguuauccuccucaauuucauucuucagagacuugaaguucuuguuauauagaucuuucacuuguuugguuauaauuacagcaagauauguuguauuauuugugacuauugugaagggugguguuguccuaauuccuuucucagcccauuuaucauuuguauaaaggaaggcuacugauuuuuuuuuuuuuaguuaauuuugaauccagccacuuugcugaagauguuuaucagcuguaguucucugauagaauuuuggggaucacuuauguauguacuaucauaucaucugcgaauggcaauacuuugacuucuuccuuuccaauuuguauccccuugaucuccuuuaguugucuuacugcagcucacugaaauuggugcagaggccuacugccaaacauuagacagagcuuggggagucuuguggaagaguugggggaaggauuaaaggaccugaagaagaccgggaguuaacuaaucuggacccuugguggcucucagagacuaaccaccaaagagcauauaugugucggaccuagccccccaaccccuugcacauauguagaagugcagcuuggucuucaacaacuagagcaguagcugucccucagucuguugccuaccuguggauccuguuucccuaauugggcugccuuuucuggcccuaguaaaagaggaugugucagggugggcugguaccuuucucagagaagagaaugggaaggggagggguguaugaggggagagacuggaaggaaggggucugugaucagauguaaagugaauagauggggaaaaaagauucaugccauucccaguguauucucugccuccugcuugcgccugagaugugagcuaucagcuguucaugucucuaccauaauaaacucuaacccacuggaauauaggcccaauuaaaucuuuacuuuuaaaaguuuccuuggucguagugcuuaucacagcaacagaaaaauaacuaagacacccuuccuaaaguauaccaccucuaaacauugccauacagguugaaaguuccaacacauuaacucaacccacagcaacccaaacaccaaauagaauuaucauaaauccaaagcacaaaguuauucaaaacuauaauaucuuaugaauaauuugucaaaaaguccuguacacauuagguuuaucuuuauggcuuaauggcuuauagcaaguuuaucauuaaacaacagucaaagggacacaaacaaaaguauacucuuuaauucaacuucagaacauaauccacagguguuuuuaugugcagaugaaaccuugggcaauacucuuguuuaaagcuacuacaagaaaaguaauuaugugaagcuaauauauaacauaccaaauauaaacaacuucuaauauauaacauauaaaccaauaaaaccauuucuuuugucuuagaugugucucugaucuugaauuggaaccuuucuucucauagucacuuaccuuuggaguuaaaaagaaaaagaucugggcuggagagauggcucagcgguuaagagcuguuacuguuaaagaccaggguucaauuccuagcauccacauggcaguuuacaaaugucuguaacuccaguuccagggaauccaugacaccaggcauggaugaagugcacauauaugcaugcaggcaaaauacucauauacauaaaauaaauuuucaaaaaacaguuaaaaaaaaaagaaacuaaagugagaagggguuugguuggcgauaugucucagcuguuaagagcauauacuacuguuguagaggacccaagcuuagucccuagcacucacauuggguggcucauaacuacuuguuaacuccagcuccauaagaucugacucauucuuguggccugagagcauucaaacaggcacacauacacaaacauaaaaagaauaaaauuuaauuuaggaaaaaaaaaaagaaauaaugggggcuggagaagcaguucaguaguuaagagcucauaacacuccugcacaggacccaaauucagauaccaacgugaggccacuuuccuguaacuccaguugcaaggauauaguuauauacacaaaacagcaguaauggguguugcucaugcacuuaauuccuuugggcaacuuaugccacaucagugcaaaacaagcacagacauggcugugaaauagguaugagauuauagcuaccaaaguaaaaagguugaaaaguauuuuaugacuuagaaguguuaucacuuaaguuucaugcugagaacagcaaaugaaaaaagagaaaauuuguucauaauggaacuaaauuuaacauuucauacuuagauauuucaaaaguaccaaaacaugguacagagguagaguuuuugccuggaaaccagaccucaauuuuauucuggcuuauacaugcuuuauggcccugaacaagguacuaccccuauaguuauuacagucuuuauauggcaggagggaauaugaaauauaaucaagaaaaaggaaaacaugaguuuaggaaaaauuacauaacaaacaagaggaugaagaaaauaccaguuugacuugucucugcuuuaaagaugaacaaauuacccaugauccugagcuuuuagagaaggaaaacaguuuuucaagcuacugugggucuuaguuaacaaugcuucacuuauuucucaaagcagcuguaucaagcucuauuaacaaaacagcucuguuaacuugaaaguaaaaugcuagaacuuuugacucuauaauuucauuuuuuggcaaucuaguuucagaaaaaauucuaaauacaggaaaaagucuuauaugaaaacagaaaggcauaguuuagaugcaacccaaauaccuaauaaaacaaugagcuaacugugguucacuuauaguuuauuuuaaaacuagaaaauaauauuaagaguauuaugagaguaauaauaaaauaaucauaaaauaagcaugaaucauggccuggugauucaugcuuauaaucuuaacucuugguagguaggagcagcgggaccugcaaacuugggacauucagagucugucucaaaggaaaaacgcauuuuaugagccaguuucauguuaagaaugaauacauuauaaauauacuauuuuuucuauaaauuuaugcauaaaacaagaaauagaagcugagcauagggauagugauuaacagggaaguagguagagaugguagcacaaacauccaaucuuagcuuuugggagccugaggcaggaagaucaugagucuaaggccaacucaggaucacagugaguuucaguccagcuagggauagaguaaugcccuaaucaaaaaagagagauaggaaaggaaaggugaaaggaagaagguugguugguuaaggacuucaaguagaauuuaaacaucuccaccccauuauuuuucaguguuccucacauguaaagauuuuauaaaggaaaacguuaaacugaaguuacuguacaucaaguuuaacaaacuucagcccauauauucucacucaguauauuuuguguauauugugucugaugacaccauguuauauaccuagaugguuauauuauucuaaaacuguauaucaugaaaaaaaugacaucaucugcaaauucuuauugucuguuuuguuguuuuuguuuguuugguugguugguuuuguuuuuugaggcaggguuucucuguauagcccuggcuguccaggaacucacuuuguagacgaggcuagccucgaacucagaaauccgcuugccucugccucccaagcgcugggauuaaaggugugcgccaccacacccggcuugcaaauucauauuuaaauuuuuauauuuaagacaaaagaagaauaccauuccuauauuaacagggacaucuuguaccaauauaauuacuacagugugggaaauauaguauuuacaaacuacaaauucuaaaauuuuaaaaauuuuuaaaaggaaaacuaaagaaaauuuauaaaagaaaaacuaaaagaaaguuugagaggaguuaaugaaagggaaaauguauuguccaaaauaauaaauaauaaaaaagaaaguuugguauauuuuagauuaaaaucuuacuugcuuauuccuuccaaagguuuucuguucuuucuacaaaauauaaagcucuuaaaauauacuaguuauuuuauauuauuugugacuauugagaaggguguuauuucccuaauuucuuuuucagccuguuuauucuuuguguagagaaaggccauugacuuguuugaguuaauuuuauauccagcuacuucaccaaagcuguuuaucagguuuaggaguucucugguagaauuuuuagucggccaucacuggaaagagaggcccauuggacacgcaaacuguauaugccccaguacaggggaacgccagggccaaaaaaaaugggaaugaguggguagggaagugggggggaggguaugggggacuuuugggauagcauuggaaauguaauugaggaaaauauguaauaaaaaaaaacuuuaaaaaaaaaaaaaagccgggcgugguggcgcacaccuuuaaucccagcacuugggaggcagaggcaggcagauuucugaguucgaggccagcccggucuacaaagcgagugccaggucagccagggcuacacagagaaacccugucucgaaaaagccaaaaaaaaaaaaaaaaaaagagcacaaaagagaauaaauaaaaaauauacuaguuauguacaauaaaugcaucucauaaaaacuguggagacucauguuaagauauuaucugagagcugggcaugguggugcacgccuuuaaucccagcacucgggaggcagaggcaggcagauuucugaguuggaggccagccuggucuacagagugaguuccaggacagccagggagauacagagaaacccugucucgaaaacaaacaaaacaaaacaaaacaaaaagauauuaucugggauuuucuuucuccugucuaauacccccaaaguauuacgauauggggacggggacggggggggggggaugaguaaaucaugaagguucugcccuuguauuucaauuggacuuaaaagucuccagaccaaugcaauauaaauaauuguuuuaccuauuuuaugguauuugccagaaacauauauagauuaagacaaagauuaaaaugaaaaaauugucaggcaacagguugaacaucacuauuuuaauaacaugaaauacaaguacaaaacauuguacaaguauacuuuuuacuacacagagauggaauaacaugcauguguuuuuaccagaaucuguaucaccaaguacuuuuaccacagucaguaccaauggcuuuccagagauuauaucuguccuauguaaauuuuaucaugaauaaaaaagcuuacaacucuuuucaaauaaugcagauuuauauuuauguuacucuuccuguucgaggugcuuuggaaaacuguuacauaauauaaaaauuaccuuagcuuacaguuuugaauggguaguacucucuagcauugaucaagucucccuuauauugucauuguagacacacuauacuuacuugggaucaaaguguuauggaugucaauagcccucauacuguguaggaaagcaaauaacaauuuucugaaaaguucagaguauuauaaaagcuacuuguuaggcagaaauacaugaaaccccauuuacagaacaaaacagcaacaaaagaugauaaugcccuucaaguacuaaaggagaacaagcuuacaaauauuggaacuguaugucuuuccugccucuaaaagguuuaccauauccagugagaguaauaucaaccaauaaagaaaaagaaaacugcucuggugcccaguauucagcagcuuccauagcauuccucacaguucucggccauuucaguuaggaguugucuuauaacagauaaaauaaaacaaaagcagcauuacauuuuagggaaauaugaaaaaaauacugguaauuucauaaaauauuugaaaguaauuuuguuuucauaaauaaauaaaaugguguuuuuaaauuuuaaucuugcugugaaaaaaaaaaucagugaaaauuagaucaaucuuuaaaccuuggcuuauuuaacauguuugaaaaccugaaucacauuuucaauugccaguguuaugcuuuauucuugguagaaucaucuuuguuucuucguuuuacaucccaauuauaaacccuggccauaucugcaauaacugucaaggaaaaugaaaauauaauaccaaagguaacaaugaaauuauaauuuacucauaaagcuaaaacaaaagaaaacacggaaaucacaaagauacuaguggcaaauacuguugauagcuauguugcuauacuaccaauuguuaagagcagggcgugguggcgcacgccuuugauuccagcacucgggagguaggggcagguggauuucugaguucaaggccagccuggucuacagagugaguuccaggacagccagggcuacacagagaaacccugucucgaaaacaaacaaacaaacaauaaacaacaaaaaacaaaaaaauugcuaagaaaauucuguucauucuauauccuaacauaaaauguuaaaaugaauacgauuacccaaaauuuuaucugggcuaaacagauccuuuaguuuacuaaauaccuacuguguuuugacuaagccuugaacaagcuaggugaagccccuuccuucauggaguuuagauucauuagaacauacucuaaugccugucuacuauucuaacuuuuccaguuuauacaguauuauauugaugauaaauggcacuuuucucuaaguuuccuagaacucgauuuguaugauuuuuccauuacauuucauuuuuucccucacaguuaacagcccccacccaccaaggaaggucuaauuagccuuccuaggaacuagggauuucauagcugaaccaaguauucacauuaguuagaugauaauccuggcacaaacccucaaaaaaaccuaucuugccucacccaagaauuuuccuacuacaugauacauguuugggagacuucaguuccugcacuugaagagcuuguggccagccaggaaaacaaagcauuacaugcaaagcagaaaaaaaaaacccacucugacaggauugcaaaauguugaagaaugcucugaugcuuaaacugauauaugaacaauaaaggaguaucuccaaguaaauaaagagaaaucauuccagguaggaggaacaaauaaaagaacaaaagaagaaaauacaaacagccugggacauuuuagggaugaauaaaacaacuaguuauaugaaauuuguaauauucuagagaaggaccuguuuaugaaauucaaugcaugucaugacacuggcugagguauaagacuaguggaaagcacucaagacugacuauaugcauauauuauauaaaccagcuaauaauuaaaguauauaaccaaggaaauaaaacaaagauguaugacucgguaaauucaugcuggagauguuguaaagaacaggucuacuauguguagguucuauagcaccaaaacuaaguaacauuauaguacagaaaaccucauggggaaaagcugacaugacuggaugacucuugguuauuaggaaaagagaaguauaaagaauggcacuuagguacuuuucuuuguucuuuuucuugguuguuugggguuuuuuuguuuuugguuuuucgagacagguuucucuguguagcccuggcuguccuggaacucacucuguagaccaggcuuggacucaaaauccgccugccucugccucccaagugcuggguauuuuucuugagugugucaggaacaaaaagagauaaagcagaguaucccaguuagcuuuaacuugacacagauuagagucaucacucugacuggccugugacaugucuguaugggauagucuuguuguuaguugauguaagaggaucuaguucacuguggguagcaccacuccaugggcaguauaaaaaagcuagcugaggaugaguaugugagagcuaucaagcagugauccuaugugguuucuguuucaaauucuugcucuaacuucccucagugaugagcuguaaccuggaaguacaugccaaauaaauccuuuccuccccuagguugcuucuggucagacuuuuaccacagcaaaaaaaaaaaaaaaaaaaaagaaaaggaaaggaaaacagaggagaaaagagcuugcuugcaagcauuccuuucccuacaaauuuuguauugcauuucaaaacaguuuaaguuuuaccuccuaaaaagcauuuccugaccuaacuccaggacacaucuaucauucucaaacuuuaaauuauccugauccuaaauacauggacuucuuuacaacugcuauguggucaucaaggaccuauuuuauauauguacuuuaaacagacaaagacuuugauacccuuuucccucuacuaauuuucaugacucauauggcuuagcauccuugcagaaauugcaaagacuuuuuaaagacugggucucauuauguagccccaggguggccucagguugauaauacucuugccucagcuuuugaagugcuaggaucacaagcuuggaucacugcaccuaacuuauagaagacuuacauguuugugaaauuaaccuauuauaaagguaucuuaguaaaacuauuugaaaagaaacuuauuucaucacagugagucugcucuccacaucuuuacauuucuaauuuauuauucuaccuuuaaacuuuuuuauucaaaugacagucauuaucuuaugcaaucucuaacuucacauuuauuuaagaauaaagucauucuucccaugaaaacaauauuuagaaauuuuuuaaaaaaucuuucucuuucuucccuuuauuuguuaaaaggauacugacuucugugguaguaaacugaucucgaagaaagucaaggucuucuucaagagaaucaagauucuuuguggcaguugauaaauucuuuuccaacaaggccugagcuucaucaauaucauauucaagcauuacauuagccugaagaaaaauagucaugacaauuacuuuauaaucucgagguuaggguaaguaucugaaaaugcagcccuuggguuaaacacaguccacuugucuuggacuuugcuacaguagggcagaaaacaaaggccauguauccugaaaagcagaaaauauuacuauuugacaguuuacagaaaauuugcuaaccccugaguuacagguauguagaaaaugagguaucaauacacaaaaucacaacacacauuuugaaaugaagugugcaaaagguagaauaguguuacuauuucuguaaaaagacagauggauguggucuuaccuauguauguauaaauuuuuucuugaagaauaucaagaaauagacucuugauuacuuaaaaggcaggcacacugagcuaaugagaagcaggcuuucauagauauccuugcuauaaaaaaauaaauuuaauauuuguccuccagaaugaaaaguaccaaauucauauacuagugguauuuggagauggggucuuugggaaguaaucagauuacaucaugaggaaagaaccuccaagauggcauuaguaacucuguaaaaagagagccaaacuaguauguuuacuauuucacuacaugaccuccucugccauaugauacagcucucaccuguugcucucaccugaugcuaacacuauccucuugaacuucccaguuuccagaugcaucaaauaaaucucaauucuuuauaaauuucucagucuuugauaauucaguuauagcaagagaaaaugacuaagauaaugugucugugccucuuaaauuacauauaaauguguugguugcccagcaaguauuaaagcuuagcauagagacucauggcuauaacccuggaaugcagaaaaguaaggaaggagaauuucaaguucaaggccagccugugcuaucuauuaagaguuuaucucaagaaagcaaaacagaaaaacucaaaccuguaaaugccaguacucgggagggaaagacaaaaugggucaggaauucauggucauccucagcuauauaguuuauugcaagccuaggauacauaacaaucucucaaaaaacaaagaagcauaaagcaaaaagcauuaacccagcauuuaagauucugaggcaagaagaguaggaggucaaggccagccugggcaacauaggaagacuuuacacaagcaaacaaacaagcaaacaaacaaacaagaacugaggacauaguucauugguaaaaugccugccuagcuuacacaaggcucuguguuguguaagauggguggcuguaaugguaguuauucaaucucaacuaaaaagcaauaaccaaaacaaacaaaaacucccacaaagcuaacauuaauaggcuggacauauaguucaugucuucauuaccagcacuuuggaggaaaaagcagagucuugcuauagacucuauauagcaaguucuaggaaagccagaacuacauagaaagacccuguauuaaaaaaaaaaaaaaggaaguaagcaagcaaguaaacaaacaaacauuauagaccaggaaacauacauaacucaaaaacacugaaaauauauguuggcacaaaaauguauucacaauagccaaaaagaagaaauaaaccaaauaugacaaugaauaaagaagguaugguuuauacacacaacaggguguaaugaaggaaugaagcugauacacagagaaagaaaguaaauugguaguugcuacaacuucuuagccaucugguaaaggucaagugugguggaugccauaggaaaggagauaguagaaugaagaaaugggguuacuuuaugggauaaauaaaauguucuggagauagaaagagaugaugguugcacaacuaugaacacacuaaaaacuaugaaacuauauacuuuuaaauagcaaauuuuaucuuaauuguuaacaagagagaaaauuucuucaaagagaugauuugagacuuuuacucaugguagauacgggacucuaaauaauauaaagaucaguacgcuaacuggaagacagaaguuuuaauucagacacaaagaacaaauauagcaggcuauaucucuuuacaaguagauacucuuuuaaaaauguauguauaguaacuauuagagacugggaggaauuuugggauagaggauagaaggaauuugguaauagguaaagugcaguucuaguguucuaaagaacaguuauaugaacuacaauucacaacacucuacuaucuauauauauggaagagggauguuuugacagucuuacccaguagcccagguuaaccuugaacuugaggcaauuagccuaccaaauguugagauuacauguacugucaugaugccugacuccuauuauauaguugaugaaauacuagaaaacgggagcuuaaaugcaaaguaguauagggauggaaauauuaauugcacuuaguagaucaguacacuuuguauauacauacuaaauuaccauacuguccccuauaaauauguauagucaaaaaauaauuaagggguugauguaaaucagaaauacagcaacuuccuaauaggcauaagucccucaguucaacccuaguaccacaaaguaauaauuauucaauuuuaaaagccuacgagaggguugaaucuucccagaggaucuauggaaacuaaccaggcagagaacagauaagcaccaacacuguaaaugcuuucuguguacacuucuaguaauccccaacacucucaccccaaaaguaaucauuuuccugacuucucuaacguguaguuuugucuauaauugaacuuuugauaaaugaaaucacguaaguguauguccuuuugugauagaguucucuauuaggggaaaauauggcucucugaggccacaagucccacucuacucucuguggcucuggagagauuugucagaguggauccuagcauauagcuacaaccuggguaagccuaauaauaaucuauaucaaacuucagggacagagaauuguccaagguugauggcacaagaaaauauugcaaagaucugaaaucuaggauuauucuugucacuguuggcuuugaaaacagaaggguucacgcggcaauaaaugcacauacaguguaaacaccagcaaggaaacaggacuucaguucuacacauagcacaggaaugaggcugcaaaacauacugguacuuuaauuuuggucacuuaacacuugguccugagcagaaaacccaguuagacccacuuaaaugaucauuuuaagacugcacuaaaugagaccuugccucaaaaaaauguuuuauggaguacauagauuuacucuuagacuuaaacaauucuaucccaaagagguguacaaaaagggaagccuuucuuuacugguuuauacaugcauaaguauuggccauagugcuguucucuagacaggaaacccaaagacaacuuaaauaucuccuaacaugggaauauuaaaacucuaucgcaagauuaaaaggacaacaagaggcuagaaagguggcagaaugguuaagagcacaugcuguucuuccagaggaccagagcuugggucacagcccucauguugggcaacugccugugacuccaacuucacagaauugaugccuucuucuggccucugaacaccuauacucauaucucucucucucucucucucucucucucucucucucucucucucucucucucucucugucucucccucucuccucucucucuccuuucuauccucucucuccccucucucccuucacccuuucucucucucacauacauacaccacauacacucacucacucauacacaauucuuuaaaaaaaaaaaagcaaggaggaaaaccccacguuuacaagaaacgauaucugugagacuaaguaaaagucacauuguaccagaagugguccuagcuuuugacagaggaaaugauggaaccuucaucagaaaaaugacaugcuaucauguguucuaaaaauauaacuugggcaguuacagcuagaaaagcuaaaaagaauuccacaauaaaggcucugaggcagacccuuuauuuauuuauuuauuuauuuauuuaucuaucacgauuaucuagguccaggaagaaguccaagugugaccaaacaaaaaacuggaaaauuagguaagagaaguauaaaagaguacuagacugcauugggacuugccagcuacucaaaagauuguccuugaaauaagaugagaaacgaccacaaaauuuggacagaauaauggcaugacccaacagaucuuaauggauaguucuacccacuaugucugaaaaggauuuuggaauauaggggcaaaagcaagaaaaugaacuuaagauguuaauuugaauucaacuguguacaucaaaagauauacugaagcucuaaccucccgguaccuaaaaccuuaugcagaaauaaaauauauuauggauuaagcagugucuuuuuccaaaaaaaauccagucuuaacccucaguacuucagacugcaaaaaaaauaauuuaaaaauuauuugagcauauaauuucuuuacaaauguaaccacgucaaaauaagcugaauauagacagucuuuccacagugauacauucggguauauuuucuauacuuuaguaggccaugacugagagauaauagaccagcccuaaguugggcuuaacugcugcuguuccacuaaauggucaugucaaacugccuucuuuuuuguuuauaccagaauauuuugcugcucucaaucuugguucagagaagauucuuuuugcaguggggagugguuacuacagagagucauaacuggucuguucagacuaagugacugugaaugcucaaccuuaaaaaaaaaguuuucuacaucaacuucccccaauccaaggcucagggagcaucacagaugugggcagaaggaauauaaaagccagagaagaagugugaaaugcugucuucuggacauggcaugguugaugagcaaaucaacucacaauagccaugauugccuauaugaaauuaauccagcuaacauuccagcauggauaaaaggaggagcuucagaugcccaaccccuuagcugcugaacgaaagucccuccccagagaugcuggcauugguagguugcccaugccucagcagauggccccuauagccaucuauauauggucaguacuaauugaaaucagggagcuacuaaugaugacaaaaaacucacauaaagucuagaaggaaacagguugaagugccugggagaacugaaggaacauagugaggauggguaugauaaaaauacauuguauauacgugugaaauuuucagagaauguuaaaaaugagaaaauaaaagccuaagugauaaacacugaaucuuuccuuuuaaaaacagaacuaagacuaaacaggaaacugaaaugaacucaacuaacaaacacugaguacauaaacuaacuauaucauaaaauugaguuucacuguguuaaaugauccauuguucauagcacuagagcaugucuuacaacagcagcaaaggaaaauccuuccaaugaggcaaucuggauagcaggaaacagugugcauuguguacuugcuacuuugcauaggagcuugcuuugaguaaaagaaaaaaaaaauccuguauuuagcuaggucuggggucuaagaaaagcaagggugaaaaagcacagaaagugcugggccaggcacagugucagucuuuaaucccagcacucaggagguagaggcaggcagaucucuuugaguuugaggccagccuaguuuacauagugagcuccaagacagcaagggacacauagaaagaaccugucucaaaauaauaaaauaaauaaauaaauaaauaaauaaaacagcaaaaaaagggaaagaaugaagaaaaagcauagacaaaaaucuaugaaaguaucuaaagcagaauauuuuuaagaacagucuccucuagugacuagagagcacuagcgagcuaggcuucaauucccagcacccacaucacagcucacaacaaucucuuaacuacacuuucagggaaugugacacccucuucuggccuccaugagcaccaggcaugcaugcagugaacauagauccaaguacauaauacucaugcacauaaaauaaaaaacuaaauuauucuaaccucagaguuuuuauaaucuuuuucuccuuaaauuuauagggcucuuuguaaaacuauuacagucuuauagacaaacauuuaucagaguaaaacaguacuguuugacuuuuacucuuccuucuguuacaugcuuuuuauauauguuuguauauaugugugcauguauguaaacacaagcacaaccuuaggugucaucauuuaaaauaggguuucucauuggccagagcccaucaauuaggcuagacuaacuggccaaugacucguaguaauccuccuaucucugacucccaagggauaggaucucaaacauacaaugucuagcauuuuuuaugugaguucuggguauuggacucaaguuguaaugcuuguaaagcaaguacuuuaccaaaugagccacaucuucuccccacucucuuccuucuuaugcauuuaaaaaagacaaaacauuaacuggagaaauaguugggcauggugguaugucugccaucucaguauuugguaaacaaaggcaagaaugaugcgaagacaguauggacuacaugagucuuaaaaaaacaaagggggccaggcggugguggcacuugggaggcagaggcaggcagauuucugaguucgaggccagccuggucuacaaagugagucccaagacagccagggcuauacaaacccugucucgaaaaaaaccaaaaaccaaacaucaaaaaaaaggggggggugaugacuagauccaugguagacugcuuucccagcauacucaaacuccuguguuuacacacacacacacacacacacaacuacaagacuagauuuggucaauuuuuugucuugauugggaaaaaucuuuaaacaucuuuaaaaacacucuuaauuccaguaaguuucuaauaaggacuacuugaacucuacagcuuuauucuuucuaaaaucaaagggagauaaaaacauugcauaguaagaagaaauacuggcauaugcaauugugucugcguuuggugguugauuauggcauggauccccagauggggcagucucugcacggccguuccuuccaucucaucuccgccaagacccugauauagaugacucuugugaggcuaugccagugccuggcaaauacagaaguggaagcucagagucaucuacugaauggaauacaugguccccaauggaggugcuagagaaaauacccaaggagcuaaagggaucugcaacccuauagguggaacaacaauaugaacuaaccaguaccccccagagcucuugucucuagcugcauauguagcagaagauggccuagucggccaucacugggaagagaggccccuuggucuugcaaagauuauaugccccaauacaggggaauaccagggccaggaagcaggagugaguggguuagaaaacaggguaggggaaggguauaagggacuuuugggauagcauuugaauuguaaaugaagaaaauaucuaauaauaaaaaaagauaagucagugaaaacauaaaaaaaaaaagaagaaauacuguuuugcuagucagaaaaccuugguuuacaacuauauuggcuguggcuauaacauguacuuacccccaaccauaggcauacuuuaucaguaggagggacugaagcuuugcaguacagguuaucggccaguaagaaucucgucuccauugaauugguagacuccuuuaaaagaaaugacaguaccacaaacaggccaaguugauaucaagguuauacaggaggaaucccacaccuaauccaccuaaucccaagacauuuaaaacaguaccaucaugaagauuuauuuaguuggaaaagaaauaaaugacuauuaccaccaaaugacuggaaauggacucugauucagcuacuuacuagcuguguaaauuuagcaugucacuguuuaucuaugccucaaguuccccaaccaaaaaauaaaaauaauaauaguuccuacaacuguaaagauuguaaguuuccaaaacacaucuuaguuuuaaagauacauaaugccuuagaguaaaaggauaaacaaaaguaccuaaaucaaaugagacuaggaaucaagcagaugucacuauccuaauaucugacaaaauugacuuuaaacuaucagaacagauaaagagggacacaucauucuaaucaagggaacagucaaccaggaagcuauuacuauccuaaacaaauaugcuaacucuggggcacccaauuucauuaaaaaaaaaaaaaacuguacuacugaauuuagacacagauaaacaucaguccauuaguaggugauuucaauaccccacuuucuccaauagacaggucaucuagacaaaagacagagaaauaucagaauuaauugacaucguacaucaaauggaccuaacagauaucuacagaauaucauacccaaagaccaaagaauacauucuacucagcaucacauggaagcgucuucuaaaagagaacaccucucuaagacacacugaaagcagcccuaugaggaaaauguacagcucuaagugcuuacauuuaaaaaaaucagaaagaacacaaauaaaugguuuaaugaugcaacucaaaagaacgaaccaaauccaaaccaaaucaacaucaaaaaauaauaaaaaucagagcagaaaucaacuaaacagaaaccaagaaaacaauauaaagaaucaaaaaaccgaagaucugauucuuugaaagacagacaaaacuuaauacccuuggcccaacuaaccaaaagaaagaaaagagggauccaaauuaacaguaucagaaaugaacagggaaacauuacaacagacaucaaagaaauguagaauauuaugagggacuauuuuaaaaaccuguacuccacuaagauggaaaaccuaaaagaaauggaugaguaggauucagccaaaccaccaaaauuaaaccaagaagucaaugaccuaaacaggcuccuaagaaaugaggagaggauauaauaauaaaaagccuuccagcuaaaaaagaguccaggaccagaaaauuucacagaacaauuauaucagacauuuaaagacaaucuacaccuaaucuucucaaacuauucaaaacaaaacaauaaaaaauaaaaacaagaaacccccuccccaaaaaguaaaaacagaaacaaaagggucacucacaaacuccuucuacaaagccaguaugccagcacacacauaaaaauaaaaacaaauaaauaaauacacucuuaaauguuacuaccucagaauaaaacauuuuaagaauaccuaaaaucauuucuaauuaaaaauuuacaaaauaaucuaagugaagaccuuagaauuaggcgucauuuuaggggaagaccacaaagccaucuuuuuuggugaaaguauacuacuuuuaacauuacuacauaugcucaaaaagauagggugaacccuacaaaacaaaugaaaugccuauaaccaaagagucaaggaaaucaggccucugccaaaacaaugcugauuugcuuauaccugcaaacaaagguacacuuacuuuuuucuucugcauguauuucagaauuuccaaagucuguuuaauuucaggaaucugaccuuucagccugugaggagggaaaaaaagguuaacaaaguauuuuaccagcaaaaauaaacauuacgcugagcagugguggcgcacgccuuuuaauuccagcacuuggggggcagaugcaggcggaucucugaauucgaggccagccuggucuacagagugaguuccaggacagccagggcuauacagagaaacccugucucaaaaaacaaaaauuaaauaaauaaauaauucgggaggcagaggcaggcggauuucugaguucgaggccagccuggucuacaaagugaauuccaggacagccagagcuauacagagaaacccugucucaaaaagacaaauaaauaaauaaaauaaaaaaaaucacaaucaucuuacuagcauugcaauuuucaacuaauaugcccuuaaaaacuauuuauaaauauagguuauauuuuauaaauuuuauuuaaaauaauauuuuugauauaagaaaagauuugauaaacauugcaaaacaaaguauacuuaauaaaccauacagaaaauacuauaaggauacaaacauuuaauuaaaauauuuaagggacuaaagaaguuuagagcauuuguuguucuuucagaggacccagauucaauuccuugcaccuucgugguggcuuacaaccauccauagcccaguuguagaucugauaucaauucugaucucuacaagcaccagacaugcacacggugcacagacauacaaguaggcaaaacauucauauacauuagauauuuauuuuauuuuuuuuaauauacacugaaguuuugucuccauguaagucuguuugaggcuguuggaucuuggaguuacagauuauugugaacugcuacguggaugcugggaauugaaccuggguccucuagaaaagcaguuggugcuuuuaacugcagagccaucucuccagucacacauaaaauauuuuaaaauuaaaaaauaaaauguagggagcagcaguuaagagcacugacugcucuuccagagguccugaguucaaaucccagcaaccacaugauagcucacaaccaucuguagaggucugguagccucuucuggugugucugaagucagcuacaguguacuuauauauaauaaauaaaucuuuuuuuuuuaaaaaagauguaauacuaagcauauauaaaauacaugguauaaaaagccuuacuucauauguccaacucccuguuauuaacauuucuagaacaggucacauucugcagaagugauucacaggcucugcauuugauuauaaacuuucauuuagcuaauuauuaaaacaagauguauccaaauauauuaaaucucaagucugaaaacaucaagcaucuauguaguacuacauggggcuguuuuagguaugcauacucagcacauauucagauacaagguaggaaaggauauggacauauauaugaucuucagaggcagagaaagggccaagcugugaagcugagacauaaauauugaccccccaguucaugcaaagauaauaaagacagucaugggcuauaaaaagaaaggcaaagaucucuaucuacucuugccacucuuccucaauacaguacuucacauuuuagcuagcaaaagaauagauggaaaucaaauagaaaaggaagaaaucaaauuagccauaugauucuauaccaagagaaccccaaagucuccaucaaaagaugcuuacaacugcuaagucuucagccaucugacccugaaaacaaagagaaucucauccgaucucagugauaaauugaauuggguuugauuaguagauggaugaauugguaagcaauuuaagcaaaaauuaauagauuuucuaugcagcaauaaugaauucacuaagaaagaaauaaaaacaaucccauucauaauagccacaaaugaauaaaacagagacaaacaacagaaaccugaucaauaagguaaaauacuucuacauugaaauuuauaaaauacuaaacaaaggaaauaaagauacuagaaagguagaaggauguucauucuauguucauggaugggcaaaauuaauauuguaaaaauggucauauuaccaaaaguauucucugaacucaauccuaagcccagcaaaauuccaaugacauucuucacagaacuagaaaucacaauccuaaaauucauaugaaacuccaaaugaccaagguaaccuugaacaaaaagcaaugcuggaugaauaagaauaaaaaaaucauaaugacaaaaaagaacagacagacagagaccacugauauaaaacaaaggaccuagaaauaaacacauauagcuaaaaccaucucaacaaagaugccaagaacaucugauggagaaaggagagucucuucaauaaauggugcuaagaaaacugaauauccacauauuaaaaaacuaaaaccauaucccccaucacacuguacaaaaaaggaacaaaucaaaauucaaaauacaucaaaaaccuugaagucaacaccugacauucaaaacuacuacaggaaacaugagggaaauauuucaagauauugacauaggcuacaauuuuuucaauaggauuccaguagcucaaaauacagaauuguaaaaugaaauuauaccaaauuaaaaagcucugcacagcaaaugaaccaaucaguagacuaacaaguuuagagcggauagaaaauauugccaacuauuuaccuaauagugcauugauaucuagaauauguaaagaauuaaaaaaaacuuaaccaaaagaaaaaauaauccaauaacuaaguagauaaugauuugacguaccaaauggcuaauaaauguauaaagaaaauguucaacaccuuuaggccucaaaaaaugcaaauuaaaacuacaaagauuccaucucacuagagucaaaacaguaucaucccaaauacuugggaggcagagacagaaagauugaaaguucaagaacuaccuggacaauuuaagaaccuauuucaaaauaaaaaaaaaaaaggacuagcaguauaacucaaaaguagaacacuugccuuguacacaugaggcccuagguucaaugaaccaguacgguacacaccuguaacuccaacauuugggagguagaggcagaagggucaggaccucaaggucauccuuugcuacauagcaaauucaagaccagacuacacuacaugagacccuaucucaaaaauaacuaauuagcaguauuggcaaggauauacaggaaaaggguacuuuauauacuguuauauaauauaaaugcaauguuaccuuacauaauauaacuuauaauaccuuuuauaaaaaaaacaguaugaaugcuccucagaaacauaaaaaugaggccagagaaauggaucaaaauccuuacugaugagcaaccuuaguucaaccucugaaucucacaaaacaaaacaaaacaaaacaaaacaaaacaaaaaaacaggauucaauggcuagcaucuguaaucucagcauggcaaaaugagaacugcccgagagacaggagaacugcccagaggcucacaggucagcuagugugaguacacaaaguggcaaaaauaauagcaagagagacccugccuccacaagguagcagaaggaaaaugauucuagaaaguuguucucugaccuccacaugugcgcacuauagcacauuugagcauaugcuuguggcauggcaugcaugaaccugcauacauaugagcacacacacacacauaauugaaaaacuaaaaauggaaacacuauuugauucagcuuuauuauuccugagugcauauccaaagaaaauaaaguaaugaaguucugugcauacuaauauuguggcauuauucacaauaaucaagaacaucagaugauuggauaaacagguauauaugcaaggucuaugcauauauguagaaauagaacauuaugcaauaauuuaguaagaaugaaaauaugucacuuacaacaccauuagcagaacuuuagguuaucauguuaaauaaaauauaccagacuaaaguaaaaggaaaggaugguuggcaucagggaaaaugaauaugaucuaagcacaauauuugcauguauaaauauaucagaguaaaauucauuaguguauacaacuuauauucauuaauaauuauaguaaagauuuuuaaauguagaaauuuugauuaccuccuuuuuuucugagcaagguugaguuccauaaacuuauacuucugguauuguucauccagcuucuuuaacacuguaucugcagucucauucccaggcugcuucaugaaagaaucuacaucuuccuuuaauaugaaaaaucauacgaaguuuuaaauucauauuacaaaccugauuuuuacuacuuuguuuauaaaauguaaaagaacaaguuuuguuuuccucaaagguuuguuucauuuaauuuuuuuugaagaaaaaauuucauaaaauaaucugaucaacuuccccucucccaacuccuccaagauccucccaccucuccaacuccccaauuucucuuucuuuagaaaauaggcaaacaaacaaaaagccauaauuuuaaaaacaaaaaaaauccauaaaaacacaaaaucugaaaugaaagcauccaggcaaaaggccaggagggagaaaaauacucaaacaauacuacacaaaaagucuacaacaauacgauugaauuaauuuugugguggccgucuauuuacugcccugcauggaauccacccguuaguauggcuaauauaccuagugagacuccacuggagagaacuaauuuuucuuuucugaaagcuuguuuuuaauuaaaaaccuaacuauaaagaguuaaagauggcugcccuggagcucagugguauaccacuugccuacaagacagguggcccuagguuauccccagcacuggcagaagaaaaguuaaagagaaguuagacaugaugcuacaggucuguuaucccagaacuuaggaaguagaagcgaaaggauccaaaguugucagccuggacaacauacuuugucucaaaaaaagaaaaaaaaaguucaagaaagaccauuucggacaguuuacauacauuauguagguaauuuauucuuuauuuuucuguuuuuaauguaagacacaugaacuugccugcuuuauacauuucucauguggcucuaguaauaaauaugaaaauugcuagcaaugaagcacacugccuacucaugugcccuagucacuaaagaauugagcaaauugugugccaaaguuaucauuuuucuuacugauuuaauucaauugaauacauauuuuauuuuucaaaauaaguccauaaauauugucacccauagaaacucaagacuaagcagcaagauggaaguuggguaggauucaaauacucucagacauagaauuuuauguuguuaaaauaucaugccacuuccauuaguuuuggaacaucaagauaauuauauaaaguuuggacugcuuauuacaucguguugguauaaaauuuaaccauaaaauuuuacagccaguugucacagugucugucuuuaaccuacaaacuuggaaagcagaagcaggacaggcacuaugaauuugaggccauccuaauccaaacagugaguucuaagccaaccugggcugucucaaaaaaauaaauaaauaaaauaaauaaauaaaaguuuauuuuacgguaaaucccucagauaaaguuuguauucauuaauuccauuucugaaguuacugcuaucggguuauauuuaagacagaauggaaauuuauauauuuacauccuuauauaucaggcauuauaauaggaucaggagaaauaacacaaaauuuccucaccucuaaguagcagagcaugaccaaagagguucuaaagcucuccugacugcucaaaugcuacuucuggauaccucuauuucuggguuucaucaacuacaucuacaaaauuugaacaacaguaacucccucauaaaguuuugcaaauuuucuaagaaaauuucugaaccucagaaaauauuacuucauguaaagaucacuugaaaaauauuuuuaaaagcacagaacauugagaauacacauaaaaauuuauuccaccagcacauuaaaauauacaauauaaaaugugauuuaaguaaaagaaaaaaagggucuuuugaagaauguuagcaauaagacagaauauauauaauuuuugguacauaccaaaaaagaaucaaggaaauuuugacuaagauuuuauaugcuucaguacaaauauuuaacuugggucgguccuguuacaugaaaccuuccaauugcauuucccacaaucuucacaacugcauaaaauuuguugucuacaaacugcuuaaauaguauuacuaaaagcaaauauaaaaugguuucaaaaaccuaauaacagccgguugcccauuacauaagccucaauucuuaaaagcaagaacacauggacuuaacguuugugcuaacguuuacuuuucucagcagucugcuuccauucccaaggaaacggaccacggccgugcucaagcugacugggugccacucaguacccacacccuacaaacagcugcucugccugcucucugugcuaaauguccacccaucuacaucuccggcaucacugcggucuugagcucaauaaccguugcugcuguuuuuuguuuuucuuuaggcgacaacaggcagcaacuggucaguuucaagggacgccacgccccaauccgccucgcauccgucuccagcuacccaguucuccucccugcucccucuucugggccgggguuggacuaccuuucuucaaagcuaucgcccgccaggccuaaaaagccaagaugcaggaagaggcaaaaggccagacauucccuuccgggacccuuuagcucuguuccucccaacgacccagaccugggaagugacuggaaagcaaucuccaauaucagauuaagacgcugagaaagaguuucuuaccacaaacacugcuucaggaaucccuaaguggagccgccgcccguuuccagcagcaguuucuaggccgcauccguccuuagccgccgccaucuucagaaagcaccagagcaaauaacuaccuucugaggcaucgaucguuggcguc

SEQ ID NO: 9589 - RNA, 1447 nt, Mus musculus
ugcugugguaaaagucugaccagaagcaaccuaggggaggaaaggauuuauuuggcauguacuuccagguuacagcucaucacugagggaaguuagagcaagaauuugaaacagaaaccacauaggaucacugcuugauagcucucacauacucauccucagcuagcuuuuuuauacugcccauggaguggugcuacccacagugaacuagauccucuuacaucaacuaacaacaagacuaucccauacagacaugucacaggccagucagagugaugacucuaaucugugucaaguuaaagcuaacugggauacucugcuuuaucucuuuuuguuccugacacacucaagaaaaauacccagcacuugggaggcagaggcaggcggauuuugaguccaagccuggucuacagagugaguuccaggacagccagggcuacacagagaaaccugucucgaaaaaccaaaaacaaaaaaaccccaaacaaccaagaaaaagaacaaagaaaaguaccuaagugccauucuuuauacuucucuuuuccuaauaaccaagagucauccagucaugucagcuuuuccccaugagguuuucuguacuauaauguuacuuaguuuuggugcuauagaaccuacacauaguagaccuguucuuuacaacaucuccagcaugaauuuaccgagucauacaucuuuguuuuauuuccuugguuauauacuuuaauuauuagcugguuuauauaauauaugcauauagucagucuugagugcuuuccacuagucuuauaccucagccagugucaugacaugcauugaauuucauaaacagguccuucucuagaauauuacaaauuucauauaacuaguuguuuuauucaucccuaaaaugucccaggcuguuuguauuuucuucuuuuguucuuuuauuuguuccuccuaccuggaaugauuucucuuuauuuacuuggagauacuccuuuauuguucauauaucaguuuaagcaucagagcauucuucaacauuuugcaauccugucagaguggguuuuuuuuuucugcuuugcauguaaugcuuuguuuuccuggcuggccacaagcucuucaagugcaggaacugaagucucccaaacauguaucauguaguaggaaaauucuugggugaggcaagauagguuuuuuugaggguuugugccaggauuaucaucuaacuaaugugaauacuugguucagcuaugaaaucccuaguuccuaggaaggcuaauuagaccuuccuuggugggugggggcuguuaacugugagggaaaaaaugaaauguaauggaaaaaucauacaaaucgaguucuaggaaacuuagagaaaagugccauuuaucaucaauauaauacuguauaaacuggaaaaguuagaauaguagacaggcauuagaguauguucuaaugaaucuaa

SEQ ID NO: 9590 - RNA, 1447 nt, Mus musculus
uuagauucauuagaacauacucuaaugccugucuacuauucuaacuuuuccaguuuauacaguauuauauugaugauaaauggcacuuuucucuaaguuuccuagaacucgauuuguaugauuuuuccauuacauuucauuuuuucccucacaguuaacagcccccacccaccaaggaaggucuaauuagccuuccuaggaacuagggauuucauagcugaaccaaguauucacauuaguuagaugauaauccuggcacaaacccucaaaaaaaccuaucuugccucacccaagaauuuuccuacuacaugauacauguuugggagacuucaguuccugcacuugaagagcuuguggccagccaggaaaacaaagcauuacaugcaaagcagaaaaaaaaaacccacucugacaggauugcaaaauguugaagaaugcucugaugcuuaaacugauauaugaacaauaaaggaguaucuccaaguaaauaaagagaaaucauuccagguaggaggaacaaauaaaagaacaaaagaagaaaauacaaacagccugggacauuuuagggaugaauaaaacaacuaguuauaugaaauuuguaauauucuagagaaggaccuguuuaugaaauucaaugcaugucaugacacuggcugagguauaagacuaguggaaagcacucaagacugacuauaugcauauauuauauaaaccagcuaauaauuaaaguauauaaccaaggaaauaaaacaaagauguaugacucgguaaauucaugcuggagauguuguaaagaacaggucuacuauguguagguucuauagcaccaaaacuaaguaacauuauaguacagaaaaccucauggggaaaagcugacaugacuggaugacucuugguuauuaggaaaagagaaguauaaagaauggcacuuagguacuuuucuuuguucuuuuucuugguuguuugggguuuuuuuguuuuugguuuuucgagacagguuucucuguguagcccuggcuguccuggaacucacucuguagaccaggcuuggacucaaaauccgccugccucugccucccaagugcuggguauuuuucuugagugugucaggaacaaaaagagauaaagcagaguaucccaguuagcuuuaacuugacacagauuagagucaucacucugacuggccugugacaugucuguaugggauagucuuguuguuaguugauguaagaggaucuaguucacuguggguagcaccacuccaugggcaguauaaaaaagcuagcugaggaugaguaugugagagcuaucaagcagugauccuaugugguuucuguuucaaauucuugcucuaacuucccucagugaugagcuguaaccuggaaguacaugccaaauaaauccuuuccuccccuagguugcuucuggucagacuuuuaccacagca

SEQ ID NO: 9591 - RNA, 6194 nt, Mus musculus
ugaugagucagagugcguggugcugaugcugcugccauuucaucaccuuugcgagcgcagcauccaucccuucguucccccagcgccugggccuaccuugcuucaggcuaccaggccagugauguucucgcggccgaucuagaaacggguugaucugugcuaaggccuugguggggcgcccccucccgccuccccaggcccgggccgaagaguccugccaggccacugccauggaggccaucuggcuguaccaguuccggcucauugucaucggcgauuccacggugggcaaguccugccugauccgccgcuucaccgagggccgcuuugcucagguuucagaucccaccguggggguagauuuuuucucccguuugguggagaucgagccaggaaaacgcaucaagcuccagaucugggauacagcgggucaagagagguucaggugggagugcaccacgggcccgcgcgagcagugggagggucuuuggggcuuauucagucccuggggaaagaggacuucccgguucuuuucgcgaugcugccagggugacaaacaagggucugucuggggcuuuucaagcccacuuugagcuaccuuugaguucgaugcaggaaagaaccgcccaggcaggagaaggccauucauuaucacauuauuugaaccacaacuccaucaaucugcuuuugguagcuaauaaauaacuugaaauugaucacuguauaauucaucaaaaucagacccuaugauucauaguuuaaaaaaauccaagucauuuuaacauaacugaaagcuauagguagguagauguauauugacuucuuucuauauauccguuuauauuuguggggaagaaaagacagagggagagacagagacacagagagaaugaauaugcccuaauauaaaggaaauggagacugauuaauugacugucuuguaaccaucauacagucaguugccagaggguggaaucauuucugaagaaauaguaugagguuacucacauaagagaauuccauauaaaguaaauagucagagccccugacuucuuggaacuucaguacuagcauggucagaagaaacagaaacagaggcaacacacaaaagaguguuuuguuguuuguauuuauaugccacucccuacuguaccacugggcacauaaucauucagcauguuuauuuuucuuucacaauccuuugcucuuccuuuguaguauuuauuuguaauuucauguaugaauacagaggagagaccggagaagaugaagcccaaguaaagauaggaaaugcccagaauagggaaaagcauaaauaaaacauaagugacagaaaacaaacuaauaaaaacuuuguagagaacaguuugaacuaaaguaagguagaacaggaggaaccagagcaaaaggacucaguucauaaacacugacucauucuccacugaacauuaguuggacgcagaagauacuaguuagguaauuaaguugccucuaacuucccacuuguacaaagcucuggcaaauacuuuauauaaguucucaugaauaaagaaaggucucuuauauauguuugcugggaucucuguaugaauggcuuguucauauuuacuauuuauuauguauuauauaguauugauuuguaggacuacuuuacagauuaucccaacaccaacagugguggcauagcccuauaauuccagcccucugaaggcugaggcaagagaacgauaaguaguugaaggccagccuggacuucugucuaacaaaaagaacauuaacccuuuuaugucauguauguugugagcuauuuccccaauaugucauuuguauuuuuauguuuuuuuuuaauuuagggucagugucuaguucuauauaacuuuacacuaugauuaaaauacuuugauaucuucugugcuaaauacaaaccacuaaugcauaaauauauucuagagcuuggauacacugcucauugauuucucaaaucaacauuuucacaaauuggagcauuuuccaauacaauuaucauuccccauuaaucuucaaacauaaagaaauuaugaauauccauuucccagggcuaauaucccugguucuagagaccugaacuuauuuguaaggccuacccauaucaucuucuagcuugggcuguaauucccuagacauuucccccacauuaacacugagccauuuucccauacauuuucagcuauuauuuaucauacccucucaagaagacagaaauccuaaaaauagauuucaaaaauugcaguagucuaaagcaagugauuauauaggcaaguuauucuacauccuuucaugagauucuacauucuuaagcaaaacacauuauauguuuguaauaagguucgucaacucaagaaacuaaaauaugugauguuucuucuguuuaagaaguacaauaaauguacaaguaggcuaaaauaaccuaauuacaugauucaaaauaauaauauaacuucauuggaacacuuucacuauuuuggcagauucucccagcuagugccuccucagucagccucuuugaauuuugucagugaauacagauggaaggauuuucuccagaacaauauuaaauauguuguuuuauuuuauguguauagaguuuugccuacauauauguuugugaaccacaugaguggcuggugacuaugcaggucaagagaggaugucagauccucagaagcuggaauuaaagacaguugugagcugccaugugugugcuggaaauuaaguucagguccucugggagagcaaauagcgcucuuaacuacugcaccauuucucuagcccugccucagaacauuuuaccauccccauuuucccauucucauucccaaguggcuuaggaaauacaaagcaagauugucuuuuuccucacagaagagauugauugaugaccccugcuagaaaaaaauagcaauaacgggaacaaacaaacacaaaacagguuaaugauaaauagaaaaaugaaauauuuugcaagauauuuucagggguuaucaauuauaauaaauucaagggaaaauaccugaaaguucacgagcauucuuaacauuuuacucaguugaaaacuugucauuauuguuauagacugcauuuguauuuacuaaaggacugucaggaaucaggaacacuagaauacacugaguucguuggagugaaggaguuugagcacgaacuuuauucuuuacuucuuucuuguguuuuagauccaucacucgcgccuacuacaggaauucaguagguggucuucucuuauuugacauuaccaaccgcagguccuuccagaauguccaugagugguuagaagagaccaaaguacacguucagcccuaccaaauuguauuuguucuggugggucacaagugugaccuggauacacagaggcaagugacucgccacgaggccgagaaacuggcugcugcauacggcaugaaguacauugagacgucagcccgagaugccauuaauguggagaaagccuucacagaccugacaagagacauauaugagcugguuaaaaggggggagauuacaauccaggaggguugggaaggggugaagaguggauuuguaccaaauguuguucauucuucagaagagguuaucaaaucagagaggagauguuugugcuaguuaacccuuccauuuucaaaacauacucucccacuugaacuuaaaaguuaucaaaauaaauagaauccuuaugugacugaagagaacucaacguuuggauaauaaaugagccuucuuccuaggccuggaucucugacaggcucauguguggguagauagggagccugggugcugugacugagggacuaaauugcugacaggggcuggaccagaccuuguuuugugggccaggcucagcaauggcugcucugugugcccuuuguggaccacauauuaagggucuggguauuugaaaguuagguuccaggaaaacaccuacagacagauaaacaguuccuugguauuacaacuuuucagacauggugaccauaaagaaacauauagaaagaaaucaaguaucaauuggggacaauuaagauaacugaaaaaaaaaagaguaugauaucaacuuauucaaugauaauaccgugccagaugugugcuggguuuuauacaaacacaucaagccacuucuaacaguucaacuguaaaaugaaaagcccauaugaaucaacuauuugguaaagcucuuucaaggucuagcauucuaguaaaacugcugugaauaugaaaagggaagucauucacauauuguuguuaucacauuugagaaaaguguacacuggcaugauaaaguugccaacuaugugaaagaaauucuuccauguaaaaugaucauguaaggagaaaaaggaaacacuguaacucaaaggccacauuauuuccccucuaaucauaccuggacuuucacugcaucagggaaccauaaucccgaaguaaguauacugcuugcuucuucagauaccugacaacgacaacacagagauugucaacaaacaaaaacccuaagucaagcccuuggucauugguucuauucugaguauuggcucaacacguagucuuggaauccuuaaaaauuauucauauuaauuuauuucacucauuugaucaccauaauaggacugugagauuuuugaucccauuuuacauaauaagaaagcaagaaccaagccuaccugauaccuagcuuuuuucacuggaucauuauucauaugaauaagugauuaauuuauuaaccuuuggagacaugugacuauaaauaaauauucucuacaugauagaauauguuuuccuuguuuuacagcucagcuauaaucuugcaggaaucuagaaaugaauaaaagguaaaggccacucagguauuauugacaagagggcauuaaauaagggauuaacugcacaacugaaaacacauuaaaacuguauggguuauaaauguucuucucacaaacacuaugaauauuuuauuaaaaggaaccaaauacaacaauggggaguggguuggggauaaaguacucaccucacaaugaccuugacuaccugucugcuauguaccuacauugggcuccugucuacccgagagagucagcucuuaauucucaggugaacagacagcuaaccacaucagcaaauuagaauggcugagaugaaaaauucauuaucuucuuaaaaagaagugaugcuuuaaauuucuuuuuggauuguagccaguucagcuaggcaaaagccauacuuuugacaguaagaaaacuauucugauuagagucaaguuucucauauauacauugugguagaaagaauggcaaauuauauuugcaauauccuguucgaguucagaaugaauaugugugaaucugggaauuuguuucagcuaaaauaacccaaauaauaaaaauuaugaaagguuguuuagccaccuuugcuccaacuuguauaaacaagucauuuuggaccaauucacauuaucaauugcagauaaaugaucauucauucuauaaucauuucacguauuuuaaauugccagauucuugguuguagaaggcaaauacaaccuuuuuuguggguuaacacaaaauuucaacaaugauacacaugucuagauuguucuaaaacccaggauuauccaguggauaaauaagaguugauuagacucuuguugacucaagggggcagggguagaaauaaaacaggucuacaguuuucuugacgaaaauacauuauauacuuugccauuccuggcuuuuaaaaguggguuucaaaguacccagcauaaaugcagcagagguggcugaacuugacuucuuccauaaguuuuaaaaaaaucucaaaaauccuuuuaguagaauucagugcuguugucacugcaauaaguggguuuuagacaauaaaugugaaaaaaucagguguucauaaaauacuaaggauaaugcauuagaagcuauuuuacuacauagguaaagaaaagauuaacuguaacaacgaucacaacugcauguuggauuagauugucuuauauuccagaacaaaauguacuguauacuuugccucaauuuguuguacacuguaaugaaaugugaaaaauucuuuauuuagcuguaugugaaugaaaauaugcuuguauuuaguaaaaugguugaucaugugacugagagauucca

SEQ ID NO: 9592 - RNA, 57770 nt, Mus musculus
cauauccgcagggcggagcgagcacucaguaagaaaggauagcuuuucucccuuuucugcuucgcucccaacuaagaaugcagagucagggagauggcgcagagacaaugcugcuguccauugaagcccuccaaaggucggagauucgaucacaggacagccuggccuggaccaaguaaguuuaucccuacucucugacuccuucugagaugcggaaggaguugguggauagagcggucuuugugcaucuccucuccccucugaguguguaacccugagcugggagccuugggcuuuagagcgcgcagggaucccucugggcagaggagggaacaccacgugacuuggccuuguuggugaguuuagggauagugaguuuugugcucugggcagcaucuggagagccuugguggaagagccucaugggggacucggaagcaguucccuagaacagaaugcugagaaagcugagagguuucagggaccuucacccuaacccaccgcuagggaggugcagguacuggggugguuugaacuguauaauuguuaaagcaugggcugcccuguggguggcugcuucgacuccccaaacuuaaccacuaagaacuuuuacuauuagggauguuuuaaacagacagacaaguagacagacagacggacccuacaaacagaagcagcaaaacccucugcauuugugagugugcauuggcaaguucucacaaaauaaucagggccauucuuucuguuuuucguuuucuuuuucuaguuuuguuuuuguuuuuuuuuuuuuuuuccccgaggcaugguggucucuguguguaguucuggcuguccuggaacgcacucuguagaccaagcuggacucaaacgcauggagaugccacugcacucugccucccaagugcuggaacuaaaggcgugggccgccacugccuggugcccauguacaucuucauugcucuagacucuagacuuguggaccugggcagguaggaaauuaugguucugcugauuauugcagcacugauuguagauaccgaagccuugcacauacacggaaagccacucugcugcagaauuguaugcuccuuguaauaguaaaggaauaauuaaacuuggaaauuaaaaaaaaaagaaaugauuugagauacuaaggucuauaauaauacacaaugugccuaagucgagcaaguccuauuuuaaaaguaggucagaugcuauguauuuauaggaaugucugcauuugugugaaaguguauacaagauacuuguauuucuuguuauucauaccaaaggagaaguaaugaagugauagauauaguuccuauuuaccacaauaacuacuauauucaaauacaguacuuuuuuugcugaguuuuaaaucauauguaggaaaauguaagcuuccucuagagucuagaacgcuaaagaaaugaccugguacccaaaaaaaaaaaaccaaaacguguucccucuccauuuauuuguuucucauacugacacaguuuauaaagguguauucagugaaccagacauaaagccauggauuuugcauagccauugcuaugugugguggauuucauucccaugaagcuuuaggaccuugcuaacucuuuagguuuuuguuguuguuuucccaaaguaagugucuuacacccaauacccugcauccuucaucuacaagauacugagauuacgggucuauguuaacacauccagcacuguagaacucuuuuuauaauguguuuauguuuuaaccuugugaguauguguauguugguguguguguguguaugaagcauucgugaguuuacuauguaaaggacaguguacauguucaucagaagacaacauuuuaaucuucuuugaauauggugucucucugccacuguacuguccacgccaggguaacuagacuacauuaugaguuuauuguguucucuuugcuuuguaucugccuauacaaagauagggauaacacauccacaacaggcccuggguguauguccaggauuuccagggagcugagcuaaagaugucaugcucacggagcuaacaaacuuuaucuacuuagaaaccucuaggauaauaggaugccauaccgcaauaaacauuauuauauacacggaaaacaguaaaaacgaaugcaaccugucucaacaaucugugguugaaaggaguaugugguuauguuccuuagagaaaugaaauauugcaggaauacaaaauccaaauauguuuaaaaaaaauuaacuccagaccugcugaacccaaccacaccccauccccuuccuaugucuccuauuaucuuggguuucacuucccuucuuuugaaaaaaggcucuaaccuugagcugagcagcagggucccaggcugcucaagaaaacacccacauccccagaacacuucagugguccaggaggauucaccaugauccaauacaagcaaccucauugugagcaccaagugggccaggagccuaggaaguuuccuggauuccagugaaacugaggagaaacacaaacugccaagggaugcucuauuuccaaggguguccaaaacagcccaggcugccaggguaccauccuucuggguccuugaaagccugcuugcugugaugauugacauccaagcaggcagcagccuacuuaggacuucuccuuacuaccuucccuuccugaacauccagggagaugaggcaggauaaagggucaaaagagaccugaccuucucugccauagccagggauuucuggaagaauagaaaugguucuggaauucacagaugcaguggucuaggaucuuagaagacugggagacccgauuuuguuucuuugucugccugucugucucuguccuuucuaucugucccccugccucucugucucugucuuugucucugucugucuucugucucucucugucucucaccaucucucucuaccucucucucucucucccucucuguuugugucuguguauguauucagugugugucccauggucaaaaaccuaggagacucaagucccugaaggagguccaucuugauucaggguuuggcaguucuuaugguguugagcucgguauugugugagaaggacagguuuggcuguaggggaaacccucaaggcuucaaauguauucccaggccauaggucaggugugcaggaggugcauaaagauccuagggcuaaggcagggguauuguccccuauacuucuguucagguggaugagacaacuguguaacacuaauauggaggguggcuggaucaguccuuccuugugguugcaggccuugcaccucugagaacucagagcaggccugccugugcagacagaacucucuugguuguauuagagcagaucccuccugcaauuugguagggagggagaauugagaggcaaugucaggcuugucuccucgagacuguuagaggggucuucuuccaccagcugugaacuaagaucucaggagugcgaggcuggaccucuggagauucucagugcucaugaaaggaaggcuugccugugggaggggaaaucauuucucacauggucaugguauacaucauguggaaccaaagagacccaucugcccuggaaacugugcauggaacuauacauauugguaauccagaggcagagaauagauagguagguagguagguagguagguagguagguagguggguggguguguugcaagccaguuguuauuacccuguguuagugagcauguggagagaaaguuagaaugugccuuuagaauugucagugggaccccucagacgaccuuggugugaagugaccuaggaggucaggggaguagaugugcugcaggcauccuguugggauaagugggcauuggucauugugcuuuguguguagcugcccgucaucugcggugcacuugaaugucuuucgagagcucugaguugcaugcaugcccaguuccagcacagguagguaggcggcugugugggaggacacaguagaaggauccaugugugagagugacuuggggacuuuggaggaaggaaggugagagcauuguggugucccccuucccucuccagugcugucugcugguugguaaagggcugggguguaguggaggugggguggagaauuuagggagaggagauacugugugggagcaggacuuaccucauaauaguugccugauugcccgguuaccuggccaugcuuacuuaguuggagcugagaauugggggccugguagccacaguugcagguugggcuggaguaauuguuccuucucuugauguguccuuguucucaggucagguugauauggcuaggcggccugcuggcgagauagugggagugggcgguccgccccucaggaccucugacuuggacagaugacuggaugacucucuggggcagcauucaccggaacucauauggaggggacugccugagaaaccaaccugugugccuggguaagaagaccaagcuuuucuuccggggucccuucuuuucaucucccauuggacucgggguucaggccagggacacugaaggccucacaggcacauacaacugcccacccauggccuuggguccacugcagcacuuccugcugccaggugggaagccagugcugggccuggugccccacccgcaccaggugugcgcucugaucaaccuugccugugcccagugcucucugacaccacuucccuguugcccuaccaggcagcccguggucaugcagggagggccuucuuggcugugugccuggaccuggaaacuugagagagugugcccagggaccacagagucugccccccaggaagagaaguaacugacugucagcuuuagaggacacccagaugggcagggucaggcaggcagccacuggaucucugggccagccccaggcccuuggccuggccuggcacugagcgggcaggaccaacuccuggucuugcaguccaggcacucacuuguuucagaggcuccacccuuaugguccagagugacacagguagggcucccugauggucagguccaaagaccugcuccagccccuuagggcuucccuucucaaguucucugaccaggcccuccaguagcuggcagcugcccugcaguugaggagugucugugaucagugaccauucugucucaacacugcacuccacccagccccggacacuuauucacccucaucaucacuauucccaaaccuguacacacacacacacacacacacacacacacacacacacacacacacacacucacucacucacaccagccaagcacauaagaaaacauuucuuaggcacuagcaggacacagagagacauucugcccaguggaagcccuagugcucaggcuccauguuuguggcuggugguugcauguuggcguuuuuuugccacuggaagggcggagggagaaugcccagcagccuggcaguugccauucucggugcucuacugccaucacgcggaauugguuugagguuuccgccugcacaucccugcgccucucugaacauggcggccaacccgcucuuuuccuggcagccaaggagagacuggggacucccugagaccuucuuggcccaggagagaccugcgagcgagcaagcaggauccagcucacuagaggacagggcuggcgacacaagguuugucuagccugacucaggaagcacagccuuccagguccugagcacaguucaggcggacauguuagguuugcaagggcucaugggaucucuggacucugcaaugugcacccaaggcugcaucuggguucuugugggcaacuuguccugccagucacuguucaccagacagauccagguuccccuugcuuuuguuugaugaucccugucagcugcuuucaggcaugcccacccauccaacacccccccaaccccaccccgugaauacacagagagagacaaacucugugugugugugugugugugugugugugugugugugugagagagagagagagagagagagagagagagagagagagagagagagaugcagguuaucaugcuucucugcucuguuucaguaucucagguagcucuugugaccaggcccuccaguggcuggcagcugcccuacaguugaggagugucugugaucagugaccauucugucucaacacugcacuccacccagccuggaacacuuaugcacccucaucaucacuacucccaaaccuccacacacucacacacacacacacacacacacacacacacacacacacucacucacaccagccaagcacauaagaaaacauuucuuaggcacuagcaggacacagagagacauucugcccaguggaagcccuagugcucaggcuccauguuuguggcuggugguugcagguuggcguuuuuugccucuagaagggcagagggagagcgcccagcagccuggcaguugccauucgcgguguuuuacugccaucaagcggaauugguuugagguuuccgccugcacaucccugcgccucucugaacauggcggccgacccgcucuuuuccuggcagccaaggagggacugggggcucccugagaccuucuuggcccaggagagaccugcgagugagcaggaucgaccucacuaggggacagagcuggcgacaaaagguuuggcuagccugauucaggaagcacagccuuccagguccugagcacaguucaggcggacauguuagguuugcaagggcucaugggaucucuggccucugcaaugugcacccaaggcugcaucuguguucuugugggcaacuuguccugccagucacuguucaccagacagauccagguuccccuugcuuuuguuugaugauuccuggcagcugcuuucagucaugcccacccauccaacccccccccacccccaccccgugauacacagagagagacaaacuguguguguuucugugugugugugugugugugugugugugugagagagagagagagagagagagagagagacagagagacagagagagagagagaugcagguuaucaugcuucucugcucugucucaguaucucagguagcuuuuguggccagauagauuucuuucauccaguuagcucccucccugcaggccucaauuccuccucauucccuuccuauguuucgggucaucuuggguuucccuuccucucuuuuagaacagacucucucuuugagcugugcugcggguucagagcagggucccaggccccucgggaaaacacccucaucccuagaacccuucagugguccuggaggcuccaccaugauccugugcaagcaaccucacugugagccccaugugggccaggagccuagccaguguccuggccucuggugaaacugaggagaaacagcuuagaaacagccaggcuaugcuguauuuccaaggguguccuaaacagccaaggcugccaggguaccauccuccuggguccuugaaagccugcuugcugugaugauugacauccaagcaggcagcagccuacuuaggacuucucccuacuaccuucccuuccuuaacauccagggagaugaggcaggauaaagggucaaaagaaaccugaccuucucugccguagccagggauuucuggaagaauagaaaugguucuggaauucacagaugcaguggucuaggaucuuagaagacugggagacccgaguuucuuucuuugucugccugucugucucuguccuuucuaucugucccccugccucucugucucugucucugucucugucucugucucugucuucugucucucucugucucucaccaucucucucuaccucucucucucucccucucuguuugugucaguguaugugugugucccauggucaaaaagcuaggagacucaagucccugaaggagguccaucuugguucaggguuuggcaguucuuaugguguugagcucaguauugugugagaaggacaggauuggcuguaggggaaaccuuaagguuucauguauccccaggccauaggucaggugugcaggaggugcauaaagauccuagggcuaaggcagggguauuguccccuauacuucuguucagguggaugagacaacuguguaacacuaauauggaggguggcuggaucaguccuuccuugugguugcaggccuugcaccucugagaacucagagcaggccugccugugcagacagaacucucuugguuguauuagagcagaucccuccugcaauuugguagggagggagaauugagaggcaaugucaggcuugucuccucgagacuguuagaggggucuucuuccaccagcugugaacuaagaucucaggagugcgaggcuggaccucuggagauucucagugcucaugaaaggaaggcuugccugugggucgugaaaucauuucccacauggucaugguauccaucauguggaaccaaagagacccaucugcccuggaaacugugccuggaacuguacauauuggugauccagaggcagagaauagguagguagguagguagguaggaagguggguggguguguugcaagccaguuguuauuacccuguguuagugagcauguggagagaaaguuagaaugugccuuuagaauugucagugggaccccucagacgaccuuggugugaagugaccuaggaagucaggggaguagauguguugcaggcauccuguugggauaagugggcauuggucauugugcuuuguguguaggugcccgucaccugcggugcacuugaaugucuuucgagagcuucgaguugcaugcauggcgaguuccagcacagguagguagguggcugugugggaggacacagauagaaggauccaugugugaaaaugacuuggggaccuuggaggaaggaaggagagagaauuguggugucccccuucccucucccgugcugucugcugguugguaaagggcugggguguaguggaggugggguggagaauuuagggagaggagagauacuguagggagcaggacuuaccucauaaugguugccugguugccugguuaccuggccaugcuuacuuaguuggagcugagaaucgggggccugguagccacaguugcagguugggcuggaauaauuguuccuucucuugauguguccuuguucucaggucagguugauauggcuaggcggccugcuggcgagauagugggagugggcggcccgccccucaggaccucugaccuggacagaugacuggaugacucucuggggcagcauucaccggaacucauauggagaggacugccugagaaaccaaccugugugccuggguaagaagacuaagcuuuucuuccggggucccuucuuuucaucucccauuggacuugggguucaggccagggacacugaaggccucacaggcacauacaacugcccacccauggccuuggguccacugcagcacuuccugcugccaggugggaagccagugcugggccuggugccccacccgcaccaggugugcgcucugaucaaccuugccugugcccagugcucucugacaccacuucccuguugcccuaccaggcagcccguggucaugcagggagggccuucuuggcugugugccuggaccuggaaaguugagagagugugcccagggaccacagagucugccccccaggaagagaaguaacugacuaucagcuuuagaggacacccagaugggcagggucaggcaggcagccacuggaucucugggccagccccaggcccuuggccuggccaggcacugcaugggcaggaccaaccccuugucauacaguccaggcacucacuuauuucagaggcuccaccccuauggcccagauuuacacaggguuuagauagggcucccugauggucaguuccaaagaccugcuccagccccuuagggcuugccuuucucaaguucucugaccaggcccuccaguggcuggcagcugcccuacaguugaggagugucugugaucagugaccauucugucucaacacugcacuccacccagccuggaacacuuaugcacccucaucaucacuacucccaaaccuccacacacucacacacacacacacacacacacacacacacacacacacacacacacucacucacaccucccaagcacauaagaaaacauuucuuaggcacuagcagggcacagagagacauucugcccaguggaagccauagugcucaggcuccauguuuguggcuggugguuguagguuggcguuuuuugccucuggaagggcagagggagagcgcccagcagccuggcaguugccuuucuuggugcucuacugccaucaagcggaauugguuugagguuuccgccugcacaucccugcgccucucuuaacaugguggccgacccgcucuuuuccuggcagccaaggagggacugggggcucccugagaccuucuuggcccaggagagaccugugagccaucgagcaguauccagcucacuagaggacagggcuggcaacacaagguuugucuagccugacucgggaagcacagccuuccagguccugagcacaguucaggcggacauguuagguuugcaagggcucaugggaucucuggacucagcaauguguacccaaggcugcaucuggguucuugugggcaacuuguccugccagucacuguucaccagacagauccagguuccccuugcuuuuguuugaugauuccugucagcugcuuucagucaugcccacccauccaacacccccccacacccccacccugugauacauagagagagagacaugcucuguauauguuuguguguguaagagacagagagagagagagacagagagagagagagagagagagagagagagacagagagagagagagaugcagguuaucaugcuucucugcucugucucaguaucucagguagcuuuuguggccagauagauuucuuucauccaguuagcucccucccugcaggccucaauuccuccucauucccuuccuauguuucgggucaucuuggguuucccuuccucucuuuuagaacagacucucucuuugagcugugcugcggguucagagcagggucccaggccccucgggaaaacacccucaucccuagaacccuucagugguccuggaggcuccaccaugauccugugcaagcaaccucaccgugagccccaugugggccaggagccuagccaguguccuggccucuggugaaacugaggagaaacagcuuagaaacagccaggcuaugcuguauuuccaaggguguccuaaacagccaaggcugccaggguaccauccuccuggguccuugaaagccugcuugcugugaugauugacauccaagcaggcagcagccuacuuaggacuucucccuacuaccuucccuuccugaacauccagggagaugaggcaggauaaagggucaaaagagaccugaccuucucugccauagccagggauuucucucaaguauagaaaugguucuggaauucacagaugcaguggucuaggaucuuagaagacugggagaccugaguuucuuucuuugucugccugucugucucuguccuuuuuaucugucccccugucucucugucucugucucucucaccaucucugucuaccucucucucucucccucucuguuugugucuguguauguauucagugugugucccauggucaaaaaccuagaagacugaauuuccugaaggaggaccaucuugguucaggguuuggcaguucuuaugguguugaccucaguauugugugagaaggacaggauuggcuguaggggaaacccucaaggcuucauguauccccaggccauaggucaggugugcaggaggugcauaaagauccuagggcuaaggcagggguauuguccccuauaguucuguuuagguggaugagacaacuguguaacuguguggaggguggcugcuucaguccuuccuugugguugcaggccuugcaccucggagaacucagagcaggccugccugugcagacagaacucucuugguuguauuagagcagaucccuccugcaauuugguagggagggagaauugagaggcaaugucaggcuugucuccucgagacuguuagaggggucuucuuccaccagcugugaacuaagaucucaggagugcgaggcuggaccucuggagauucucagugcucaugaaaggaaggcuugccugugggucgugaaaucauuucccacauggucaugguauccaucauguggaaccaaagagacccaucugcccuggaaacugugccuggaacuguacauauuggugauccagaggcagagaauagguagguauguagguagguggguggguguguugcaagccaguuguuauuacccuguguuagugagcauguggagagaaaguuugaacgugccuuuagaauugucauuggaaccccucagacgaccuuggugugaagugaccuaggaggucaggggaguagaugugcugcaggcauccuguugggauaagugggcauuggucauugugcuuuguguguaggugcccgucaccugcggugcacuugaaugucuuucgagagcucugaguugcaugcauggcgaguuccagcacagguagguagguggcugugugggaggacacagauagaaggauccaugugugagagugacuuggggacuucggaggacugaaggagagaacauuguggugucccccuuacgcuuccagugcugucugcugguugguaaugggcugggguguaguggaggugggguggagaauuuagggagaggagagauacuguagggagcaggacuuaccucauaaugguugccugguugccugguuaccuggccaugcuuacuuaguuggagcuucgaauugagggccugguagccacaguugcagguugggcugaaauaauuguuccuucucuugauguguccuuguucucaggucagguugauauggcuaggcggccugcuggcgagauagugggagugggcgguccgccccucaggaccucugauuuggacagaugacuggaugacucucuggggcagcauucaccggaacucauauggaggggacugccugagaaaccaaccugugugccuggguaagaagacuaagcuuuucuuccggggucccuucuuuucaucucccauuggacuugggguucaggccagggacacugaaggccucacaggcacauacaacugcccacccauggccuuggguccacugcugcacuuccugcugccaggugggaagccagugcugggccuggugccccacccgcaccaggugugcgcucugaucaaccuugccugugcccagugcucucugacaccacuucccuguugcccuaccaggcagcccguggucaugcagggagggccuucuuggcugugugccuggaccuggaaaguugagagagugugcccagggaccacagagucugccccccaggaagagaaguaacugacugucagcuuuagaggacacccagaugggcagggucaggcaggcagccacuggaucucugggccagccccaggcccuuggccuggccaggcacugcaugggcaggaccaaccccuugucaugcaguccaggcacucacuuguuucagagccuccgccccuauggcccagauuuacacaggguuuagauagggcucccugauggucaguuccaaagaccugcuccagccccuuagggcuugccuuucucaaguucucugaccaggcccuccagugcuuugcagcugcccugcaguugaggagugucugugaucagugaccauucauucugucucaacacugcacuccacccagcccgggagacuuaugcacccucaucaucacuacucccaaaccagcacacacacacauacauacacacacacacacacacacacacacacacacacacacacucucucacaccagccaagcacauaagaaaacauuucuuaggcacuacuagcagggcacagagagacauuuugcccaguggaaggccuagugcucaggcuccauguuuguggcuggugguuguagguuggcguuuuuugccucuggaagggcggagggagagcacccagcagccuggcaguugccauucgcggugcucuacugccaucaagcggaauugguuugagguuuccgccugcacaucccugcgccucucuuaacaugguggccgacccgcucuuuuccuggcagccaaggagggacugggggcucccugagaccuucuuggcccaggagagaccugagagccaucgagcaguauccagcucacuagaggacagggcuggcgacacaagguuugucuagccugacucaggaagcacagccuuccagguccugagcacaguucaggcggacauguuagguuugcaagggcucaugggaucucuggacucugcaaugugcacccaaggcugcaucuggguucuugugggcaacuuguccugccagucacuguucaccagacagauccagguuccccuugcuuuuguuugaugaucccuuucagcugcuuucaggcaugcccacccauccaacacuccccccaaccccaccccgugaauacacagagagagacaaacucugugugugugugugugugugugugugugugugugugugugagagagagagagagagagagagagagauagagagagagagagagagggagagagagagagagagagagaaagagagaugcagguuaucaugcuucucugcucuguuucaguaucucagguagcucuugugaccaggcccuccaguggcuggcagcugcccugcaguugaggagugucugugaucaguggccauucugucucaacacugcacuccacccagccuggaacacuuaugcacccucaucaucacuacucccaaaccuucacacacacacacacucacucacaccagccaagcacauaagaaaacauuucuuaggcacuagcagggcacagagagacauucugcccaguagaaggccuagugcucaggcuccauguuuguggcuggugguuguagguuggcguuuuuugccucuggaagggcggagggagcacgcccagcagccuggcaguugccauucgcggugcucuacugccaucaagcggaauugguuugagguuuccgccuacacaucccugugccucucugaacauggcggccgacccgcucuuuuccuggcagccaaggagggacugggggcucccugagaccuucuuggcccaggagagaccugagagccauggagcaguauccagcucacuagaggacagggcuggcaacacaagguuugucuagccugacucgggaagcacagccuuccagguccugagcacaguucaggcggacauguuagguuugcaagggcucaugggaucucuggacucagcaauguguacccaaggcugcaucuggguucuugugggcaacuuguccugccagucacuguucaccagacagauccagguuccccuugcuuuuguuugaugauuccugucagcugcuuucagucaugcccacccauccaacccccccccacccaaaccccgugauacacagagagagacaaacuguguguguuucugugugugugugugugugugugugugugugugugugugagagagagagagagagagagacagagagagagagagaugcagguuaucaugcuucucugcucugucucaguaucucagguagcuuuuguggccagauagauuucuuucauccaguuagcucccucccugcaggccucaauuccuccucauucccuuccuauguuucgggucaucuuggguuucccuuccucucuuuuagaacagacucucucuuugagcugugcugcggguucagagcagggucccaggccccucgggaaaacacccucaucccuagaacccuucagugguccuggaggcuccaccaugauccugugcaagcaaccucacugugagccccaugugggccaggagccuagccaguguccuggccucuggugaaacugaggagaaacagcuuagaaacagccaggcuaugcuguauuuccaaggguguccuaaacagccaaggcugccaggguaccauccuccuggguccuugaaagccugcuugcugugaugauugacauccaagcaggcagcagccuacuuaggacuucucccuacuaccuucccuuccugaacauccagggagaugaggcaggauaaagggucaaaagagaccugaccuucucugccauagccagggauuucuggaagaauagaaaugguucuggaauucacagaugcaguggucuaggaucuuagaagacugggagacccgaguuucuuucuuugucugccugucugucucuguccuuucuaucugucccccugccucucugucucugucucugucuucugucucucccucucucucucucccucucuguuugugucuguguauguauucagugugugucccauggucaaaaaccuaggagacucaagucccugaaggagguacaucuugguucaggguuuggcaguucuuaugguguugagcucaguauugugugagaaggacagguuuggcuguaggggaaaccuuaagguuucauguauccccaggccauaggucaggugugcaggaggugcauaaagauccuagggcuaaggcagggguauuguccccuauaguucuguuuagguggaugagacaacuguuuaacacuaauauggaggguggcuggaucaguccuuccuugugcuugcaggccuugcaccucugagaacucagagcaggccugccugugcagacagaacucucuugguuguauuagagcagaucccuccugcaauuugguagggagggagaauugagaggcaaugucaggcuugucuccucgagacuguuagaggggucuucuuccaccagcugugaacuaagaucucaggagugcgaggcuggaccucuggagauucucagugcucaugaaaggaaggcuugccugugggucgugaaaucauuucccacauggucaugguauccaucauguggaaccaaagagacccaucugcccuggaaacugugccuggaacuguacauauuggugauccagaggcagagaauagguagguagguagguagguagguagguagguagguggguguguugcaagccaguuguuauuacccuguguuagugagcauguggagagaaaguuagaaugugccuuuagaauugucagugggaccccucagacgaccuuggugugaagugaccuagaaggucaggagaguagaugugcugcaggcauccuguugggauaagugggcauuggucauugugcuuuguguguaggugcccgucaccugcggugcacuugaaugucuuucgagagcucugaguugcaugcauggcgaguuccagcacagguagguagguggcugugugggaggacacagauagaaggauccaugugugagagugacuuggggacuucggaggacggaaggagagaacauuguggugucccccuuacgcuuccagugcugucugcugguugauaaagggcugggguguaguggaggugggguggagaauuuagggagaggagagauacuguagggagcaggacuuaccucauaaugguugccugguugccugguuaccuggccaugcuuacuuaguuggagcuucgaauugagggccugguagccacaguugcagguugggcuggaauaauuguuccuucucuugauguguccuuguucucaggucagguugauauggcuaggcggccugcuggcgagauagugggagugggcgguccgccccucaggaccucugacuuggacagaugacuggaugacucucuggggcagcauucaccggaacucauauggagggggcugccugagaaaccaaccugugugccuggguaagaagacuaagcuuuucuuccggggucccuucuuuucaucucccauuggacucgggguucaggccagggacacugaaggccucacaggcacauacaacugcccacccauggccuuggguccacugcagcacuuccugcugccaggugggaagccagugcugggccuggugccccacccgcaccaggugugcgcucugaucaaccuugccugugcccagugcucucugacaccacuucccuguugcccuaccaggcagcccguggucaugcagggagggccuucuuggcugugugccuggaccuggaaacuugagagagugugcccagggaccacagagucugccccccaggaagagaaguaacugacugucagcuuuagaggacacccagaugggcagggucaggcaggcagccacuggaucucugggccagccccaggcccuuggccuggccaggcacugcaugggcaggaccaaccccuugucauacaguccaggcacucacuuguuucggagccuccgccccuauggcccagauuuacacaggguuuagauagggcucccugauggucaguuccaaagaccugcuccagccccuuagggcuugccuuucucaaguucucugaccaggcccuccagugcuuugcagcugcccugcaguugaggagugucugugaucagugaccauucauucugucucaacacugcacuccacccagcccuggagacuuaugcacccucaucaucacuacucccaaaccagcacacacacacauacauacacacacacacacacacacacacacacacacacacacucucucucucucacaccagccaagcacauaagaaaacauuucuuaggcacuacuagcagggcacagagagacauuuugcccaguggaaggccuagugcucaggcuccauguuuguggcuggucauugcagguuggcguuuuuugccucuggaagggcggagggagagcacccagcagccuggcaguugccauucgcggugcucuacugccaucaagcggaauugguuugagguuuccgccugcacaucccugcgcuucucuuaacaugguggccgaccccgcucuuuuccuggcagccaaggagggacugggggcucccugagaccuucuuggcccaggagagaccugagagccaucgagcaguauccagcucacuagaggacagggcuggcgacacaagguuugucuggccugacucaggaagcacagccuuccagguccugagcacaguucaggcggacauguuagguuugcaagggcucaugggaucucuggacucugcaaugugcacccaaggcugcaucuggguucuugugggcaacuuguccugccagucacuguucaccagacagauccagguuccccuugcuuuuguuugaugaucccuuucagcugcuuucaggcaugcccacccauccaacacuccccccaaccccaccccgugaauacacagagagagacaaacucugugugugugugugugugugugugugugugugugugugugagagagagagagagagagagagagagauagagagagagagagagagggagagagagagagagagagagaaagagagaugcagguuaucaugcuucucugcucuguuucaguaucucagguagcucuugugaccaggcccuccaguggcuggcagcugcccugcaguugaggagugucugugaucaguggccauucugucucaacacugcacuccacccagccuggaacacuuaugcacccucaucaucacuacucccaaaccuucacacacacacacacucacucacaccagccaagcacauaagaaaacauuucuuaggcacuagcagggcacagagagacauucugcccaguagaaggccuagugcucaggcuccauguuuguggcuggugguuguagguuggcguuuuuugccucuggaagggcggagggagcgcgcccagcagccuggcaguugccauucgcggugcucuacugccaucaagcggaauugguuugagguuuccgccuacacaucccugcgccucucugaacauggcggccgacccgcuguuuuccuggcagccaaggagggacugggggcucccugagaccuuccuggcccaggagagaccugcgagccaucgagcaguauccagcucacuagaggacagggcuggcaacacaagguuugucuagccugacucgggaagcacagccuuccagguccugagcacaguucaggcggacauguuagguuugcaagggcucaugggaucucuggacucagcaauguguacccaaggcugcaucuggguucuugugggcaacuuguccugccagucacuguucaccagacagauccagguuccccuugcuuuuguuugaugauuccugucagcugcuuucagucaugcccacccauccaacccccccccacccaaaccccgugauacacagagagagacaaacuguguguguuucugugugugugugugugugugugugugugugugugugugagagagagagagagagagagacagagagagagagagaugcagguuaucaugcuucucugcucugucucaguaucucagguagcuuuuguggccagauagauuucuuucauccaguuagcucccucccugcaggccucaauuccuccucauucccuuccuauguuucgggucaucuuggguuucccuuccucucuuuuagaacagacucucucuuugagcugugcugcggguucagagcagggucccaggccccucgggaaaacacccucaucccuagaacccuucagugguccuggaggcuccaccaugauccugugcaagcaaccucacugugagccccaugugggccaggagccuagccaguguccuggccucuggugaaacugaggagaaacagcuuagaaacagccaggcuaugcuguauuuccaaggguguccuaaacagccaaggcugccaggguaccauccuccuggguccuugaaagccugcuugcugugaugauugacauccaagcaggcagcagccuacuuaggacuucucccuacuaccuucccuuccugaacauccagggagaugaggcaggauaaagggucaaaagagaccugaccuucucugccauagccagggauuucuggaagaauagaaaugguucuggaauucacagaugcaguggucuaggaucuuagaagacugggagacccgaguuucuuucuuugucugccugucugucucuguccuuucuaucugucccccugccucucugucucugucucugucuucugucucucccucucucucucucccucucuguuugugucuguguauguauucagugugugucccauggucaaaaaccuaggagacucaagucccugaaggagguacaucuugguucaggguuuggcaguucuuaugguguugagcucaguauugugugagaaggacagguuuggcuguaggggaaaccuuaagguuucauguauccccaggccauaggucaggugugcaggaggugcauaaagauccuagggcuaaggcagggguauuguccccuauaguucuguuuagguggaugagacaacuguuuaacacuaauauggaggguggcuggaucaguccuuccuugugcuugcaggccuugcaccucugagaacucagagcaggccugccugugcagacagaacucucuugguuguauuagagcagaucccuccugcaauuugguagggagggagaauugagaggcaaugucaggcuugucuccucgagacuguuagaggggucuucuuccaccagcugugaacuaagaucucaggagugcgaggcuggaccucuggagauucucagugcucaugaaaggaaggcuugccugugggucgugaaaucauuucccacauggucaugguauccaucauguggaaccaaagagacccaucugcccuggaaacugugccuggaacuguacauauuggugauccagaggcagagaauagguagguagguagguagguagguagguagguagguagguggguggguggguugcaagccaguuguuauuacccuguguuagugagcauguggagagaacguuagaaugugccuuuagaauugucagugggaccccucagacgaccuuggugugaagugaccuaggaggucaggagaguagaugugcugcaggcauccuguugggauaagugggcauuggucauugugcuuuguguguaggugcccgucaccugcggugcacuugaaugucuuucgagagcucugaguugcaugcauggcgaguuccagcacagguagguagguggcugugugggaggacacagauagaaggauccaugugugagagugacuuggggacuucggaggacggaaggagagaacauuguggugucccccuuacgcuuccagugcugucugcugguugauaaagggcugggguguaguggaggugggguggagaauuuagggagaggagagauacuguagggagcaggacuuaccucauaaugguugccugauugcccgguuaccuggccaugcuuacuuaguuggagcuuccaauugggggccugguagccacaguugcagguugggcuggaauaauuguuccuucucuugauguguccuuguucucaggucagguugauauggcuaggcggccugcuggcgagauagugggagugggcgguccgccccucaggaccucugacuuggacagaugacuggaugacucucuggggcagcauucaccggaacucauauggagggggcugccugagaaaccaaccugugugccuggguaagaagacuaagcuuuucuuccggggucccuucuuuucaucucccauuggacucgggguucaggccagggacacugaaggccucacaggcacauacaacugcccacccauggccuuggguccacugcagcacuuccugcugccaggugggaagccagugcugggccuggugccccacccgcaccaggugugcgcucugaucaaccuugccugugcccagugcucucugacaccacuucccuguugcccuaccaggcagcccguggucaugcagggagggccuucuuggcugugugccuggaccuggaaaguugagagagugugcccagggaccacagagucugccccccaggaagagaaguaacugacugucagcuuuagaggacacccagauggguagggucaggcaggcagccacuggaucucugggccagccccaggcccuuggccuggccaggcacugcaugggcaggaccaaccccuugucauacaguccaggcacucacuuguuucggagccuccgccccuauggcccagauuuacacaggguuuagauagggcucccugauggucaguuccaaagaccugcuccagccccuuagggcuugccuuucucaaguucucugaccaggcccuccagugcuuugcagcugcccugcaguugaggagugucugugaucagugaccauucauucugucucaacacugcacuccacccagcccuggagacuuaugcacccucaucaucacuacucccaaaccagcacacacacacauacauacacacacacacacacacacacacacacucucucucacaccagccaagcacauaagaaaacauuucuuaggcacuacuagcagggcacagagagacauuuugcccaguggaaggccuagugcucaggcuccauguuuguggcuggucauugcagguuggcguuuuuugccucuggaagggcggagggagagcacccagcagccuggcaguugccauucgcggugcucuacugccaucaagcggaauugguuugagguuuccgccugcacaucccugcgcuucucuuaacaugguggccgaccccgcucuuuuccuggcagccaaggagggacugggggcucccugagaccuucuuggcccaggagagaccugagagccaucgagcaguauccagcucacuagaggacagggcuggcgacacaagguuugucuggccugacucaggaagcacagccuuccagguccugagcacaguucaggcggacauguuagguuugcaagggcucaugggaucucuggacucugcaaugugcacccaaggcugcaucuggguucuugugggcaacuuguccugccagucacuguucaccagacagauccagguuccccuugcuuuuguuugaugauuccugucagcugcuuucaggcaugcccacccauccaacacuccccccaaccccaccccgugaauacacagagagagacaaacucugugugugugugugugugugugugugugugagagagagagagagagagagagggagggagggagagagagagagaaagagagagagagaugcagguuaucaugcuucucugcucuguuucaguaucucagguagcucuuauugccaggcccuccaguggcuggcagcugcccuacaguugaggagugucugugaucaguggccauucugucucaacacugcacuccacccagccuggaacacuuaugcacccucaucaucacuacucccaaaccuucacacacacacacacucacucacaccagccaagcacuuaagaaaacauuucuuaggcacuagcagggcacagagagacauucugcccaguagaaggccuagugcucaggcuccauguuuguggcuggugguuguagguuggcguuuuuugccucuggaagggcagagggagagcgcccagcagccuggcaguugccuuucuuggugcucuacugccaucaagcggaauugguuugagguuuccgccugcacaucccugcgccucucuuaacaugguggccgacccgcucuuuuccuggcagccaaggagggacugggggcucccugagaccuucuuggcccaggagagaccugagagccaucgagcaguauccaucucacuagaggacagggcuggcaacacaagguuugucuagccugacucgggaagcacagccuuccagguccugagcacaguucaggcggacauguuagguuugcaagggcucaugggaucucuggacucugcaaugugcacccaaggcugcaucuggguucuugugggcaacuuguccugccagucacuguucaccagacagauccagguuccccuugcuuuuguuugaugaucccuuucagcugcuuucaggcaugcccacccauccaacacuccccccaaccccaccccgugaauacacagagagagacaaacucugugugugugugugugugugugugugugugagagagagagagagagagagagggagggagggagagagagagagaaagagagagagagaugcagguuaucaugcuucucugcucuguuucaguaucucagguagcucuuauugccaggcccuccaguggcuggcagcugcccuacaguugaggagugucugugaucaguggccauucugucucaacacugcacuccacccagccuggaacacuuaugcacccucaucaucacuacucccaaaccuucacacacacacacacucacucacaccagccaagcacuuaagaaaacauuucuuaggcacuagcagggcacagagagacauucugcccaguagaaggccuagugcucaggcuccauguuuguggcuggugguuguagguuggcguuuuuugccucuggaagggcagagggagagcgcccagcagccuggcaguugccuuucuuggugcucuacugccaucaagcagaauugguuugagguuuccgccugcacaucccugcgccucucuuaacaugguggccgacccgcucuuuuccuggcagccaaggagggacugggggcucccugagaccuucuuggcccaggagagaccugugagccaucgagcaguauccagcucacuagaggacagggcuggcaacacaagguuugucuagccugacucggaaagcacagccuuccagguccugagcacaguucaggcggacauguuagguuugcaagggcucaugggaucucuggacucagcaauguguacccaaggcugcaucuggguucuugugggcaacuuguccugccagucacuguucaccagacagauccagguuccccuugcuuuuguuugaugaucccugucagcugcuuucaggcaugcccacccauccaaccacccccccccacccugugauacauagagagagacaaacuguguguguuucugugugugugugugugugugugagagagagagagagagagagagagagagagagagagagagacagagagagagagagaugcagguuaucaugcuucucugcucugucucaguaucucagguagcuuuuguggccagauagauuucuuucauccaguuagcucccucccugcaggccucaauuccuccucauucccuuccuauguuucgggucaucuuggguuucccuuucucucuuuuagaacagacucucucuuugagcugugcugcggguucagagcagggucccaggccccucgggaaaacacccucaucccuagaacccuucagugguccuggaggcuccaccaugauccugugcaagcaaccucacugugagccccaugugggccaggagccuagccaguguccuggccucuggugaaacugaggagaaacagcuuagaaacagccaggcuaugcuguauuuccaaggguguccuaaacagccaaggcugccaggguaccauccuccuggguccuugaaagccugcuugcugugaugauugacauccaagcaggcagcagccuacuuaggacuucucccuacuaccuucccuuccugaacauccagggagaugaggcaggauaaagggucaaaagagaccugaccuucucugccauagccagggauuucuggaagaauagaaaugguucuggaauucacagaugcaguggucuaggaucuuagaagacugggagacccgaguuucuuucucucugucucugucucugucuucugucucucccucucucucucucccucucuguuugugucuguguauguauucagugugugucccauggucaaaaaccuaggagacugaauucccugaaggaggaccaucuugguucaggguuuggcaguucuuaugguguugagcucaguauugugugagaaggacaggauuggcuguaggggaaaccucaaggcuucauguauccccaggccauaggucaggugugcaggaggugcauaaagauccuagggcuaaggcagggguauuguccccuauaguucuguuuagguggaugagacaacuguuuaacacuaauauggaggguggcuggaucaguccuuccuugugcuugcaggccuugcaccucugagaacucagagcaggccugccugugcagacagaacucucuugguuguauuagagcagaucccuccugcaauuugguagggagggagaauugagaggcaaugucaggcuugucuccuugagacuguuagaggggucuucuuccaccagcugugaacuaagaucucaggagugcgaggcugguccucuggagauucucagugcucaugaaaggaaggcuugccugugggucgugaaaucauuucccacauggucauggcauccaucauguggaaccaaagagacccaucugcccuggaaacugugccuggaacuguacauauuggugauccagaggcagagaauagguagguagguagguagguggguggguguguugcaagccaguuguuauuacccuguguuagugagcauguggagagaaaguuugaacgugccuuuagaauugucauuggaaccccucagacgaccuuggugugaagugaccuaggaggucaggggaguagaugugcugcaggcauccuguugggauaagugggcauuggucauugugcuuuguguguaggugcccgucaccugcggugcacuugaaugucuuucgagagcucugaguugcaugcauggcgaguuccagcacagguagguagguggcugugugggaggacacagauagaaggauccaugugugagagugacuuggggacuucggaggacggaaggagagaacauuguggugucccccuuacgcuuccagugcugucugcugguugauaaagggcugggguguaguggaggugggguggagaauuuagggagaggagagauacuguagggagcaggacuuaccucauaaugguugccugguugccugguuaccuggccaugcuuacuuaguuggagcuucgaauugagggccugguagccacaguugcagguugggcuggaauaauuguuccuucucuugauguguccuuguucucaggucagguugauauggcuaggcggccugcuggcgagauagugggagugggcgguccgccccucaggaccucugacuuggacagaugacuggaugacucucuggggcagcauucaccggaacucauauggagggggcugccugagaaaccaaccugugugccuggguaagaagacuaagcuuuucuuccggggucccuucuuuucaucucccauuggacucgggguucaggccagggacacugaaggccucacaggcacauacaacugcccacccauggccuuggguccacugcugcacuuccugcugccaggugggaagccagugcugggccuggugccccacccgcaccaggugugcgcucugaucaaccuugccugugcccagugcucucugacaccacuucccuguugcccuaccacgcagcccguggucaugcagggagggccuucuuggcugugugccuggaccuggaaacuugagagagugugcccagggaccacagagucugccccccaggaagagaaguaacugacugucagcuuuagaggacacccagaugggcagggucaggcaggcagccacuggaucucugggccagccccaggcccuuggccuggccaggcacugcaugggcaggaccaaccccuugucaugcaguccaggcacucacuuguuucggagccuccgccccuauggcccagauuuacacaggguuuagauagggcucccugauggucaguuccaaagaccugcuccagccccuuagggcuugccuuucucaaguucucugaccaggcccuccagugcuuugcagcugcccugcaguugaggagugucugugaucagugaccauucugucucaacacugcacuccacccagcccuggagacuuaugcacccucaucaucacuacucccaaaccagcacacacacacauacauacacacacacacacacacacacacacacacacacucucucucacaccagccaagcacauaagaaaacauuucuuaggcacuacuagcagggcacagagagacauuuugcccaguggaagaccuagugcucaggcuccauguuuguggcuggucauugcagguuggcguuuuuugccucuggaagggcggagggagagcacccagcagcguggcaguugccauucgcggugcucuacugccaucaagcggaauugguuugagguuuccgccugcacaucccugcgccucucuuaacaugguggccgacccgcucuuuuccuggcagccaaggagggacugggggcucccugagaccuucuuggcccaggagagaccugagagccaucgagcaguauccagcucacuagaggacagggcuggcgacacaagguuuggcuggccugacucaggaagcacauccuuccagguccugagcacaguucaggcggacauguuagguuugcaagggcucaugggaucucuggccucagcaaugugcacccaaggcugcaucuggguucuugugggcaacuuguccugccagucacuguucaccagacagauccagguuccccuugcuuuuguuugaugauuccugucagcugcuuucaggcaugcccacccauccaaccacccccccaaccccaccccgugaauacacagagagagacaaacucugugugugugugugugugugugugugugugugugugugugagagagagagagagagagagagagauagggagagagagagagggagagagagagagagagagagaaagagagauucaaguuaucaugcuucucugcucuguuucaguaucucagguagcucuugugaccaggcccuccaguggcuggcagcugcccccccacccccaccccgugauacacagagagagacaaacuguguguguuucugugugugugugugugugugugugugagagagagagagagagagggagagagagagagagagagagagagggagggagagagagagagagagagagagagagagaugcagguuaucaugcuucucugcucuguuucaguaucucagguagcucuugugaccaggcccuccaguggcuggcagcugcccugcaguugaggagugucugugaucaguggccauucugucucaacacugcacuccacccagccuggaacacuuaugcacccucaucaucacuacucccaaaccuucacacacacacacacucacucacaccagccaagcacauaagaaaacauuucuuaggcacuagcaggucacagagagacauucugcccaguggaaggccuagugcucaggcuccauguuuguggcuggucauugcagguuggcguuuuuugccucuggaagggcggagggagagcgcccagcagccuggcaguugccuuucuuggugcucuacugccaucaagcggaauugguuugagguuuccgccugcacaucccugagccucucuaaacauggcggccgacccgcuguuuuccuggcagccaaggagggacugggggcucccugagaccuucuuggcccaggagagaccugcgagugagcaagaucgaccucacuaggggacagagcuggcgacaaaagguuuggcuagccugacucgggaagcacagccuuccagguccugagcacaguucaggcggacauguuagguuugcaagggcucaugggaucucuggacucugcaaugugcacccaaggcugcaucuggguucuugugggcaacuuguccugccagucacuguucaccagacagauccagguuccccuugcuuuuguuugaugauuccuggcagcugcuuucagucaugcccacccauccaacacaccccccccccccacccugugauacauagagagagacaaacugugugugugugugugagagagagagagagagagagagagagagagagagagagagagagagagagagagagagagagagagauaugcagguuaucaugcuucucugcucugucucaguaucucagguagcuuuuguggccagauagauuucuuucauccaguuagcucccucccugcagggcucaauuccuccucauucccuuccuauguuucgggucaucuuggguuucccuuccucucuuuuagaacagacugucucuuugagcugugcugcggguucagagcagggucccaggccccucgggaaaacacccucaucccuagaacccuucagugguccuggaggcuccaccaugauccugugcaagcaaccucacugugagccccaugugggccaggagccuagccaguguccuggccucuggugaaacugaggagaaacagcuuagaaacagccaggcuaugcuguauuuccaaggguguccuaaacagccaaggcugccaggguaccauccuccuggguccuugaaagccugcuugcugugaugauugacauccaagcaggcagcagccuacuuaggacuucucccuacuaccuucccuuccugaacauccagggagaugaggcaggauaaagggucaaaagagaccugaccuucucugccauagccagggauuucuggaagaauagaaaugguucuggaauucacagaugcaguggucuaggaucuuagaagacugggagacccgaguuucuuucuuugucugccugucugucucuguccuuucuaucugucccccugccucucugucucugucucugucuucugucucucccucucucucucucccucucuguuugugucuguguauguauucagugugugucccauggucaaaaaccuaggagacucaagucccugaaggagguacaucuugguucaggguuuggcaguucuuaugguguugagcucaguauugugugagaaggacagguuuggcuguaggggaaaccuuaagguuucauguauccccaggccauaggucaggugugcaggaggugcauaaagauccuagggcuaaggcagggguauuguccccuauaguucuguuuagguggaugagacaacuguguaacacuaauauggaggguggcuggaucaguccuuccuugugcuugcaggccuugcaccucugagaacucagagcaggccugccugugcagacagaacucucuugguuguauuagagcagaucccuccugcaauuugguagggagggagaaaugagaggcaaugucaggcuugucuccucgagacuguuagaggggucuucuuccaccagcugugaacuaagaucucaggagugcgaggcugguccucuggagauucucagugcucaugaaaggaaggcuugccugugggucgugaaaucauuucccacauggucaugguauccaucauguggaaccaaagagacccaucugcccuggaaacugugccuggaacuguacauauuggugauccagaggcagagaauagguagguagguagguagguagguagguagguagguggguggguggguugcaagccaguuguuauuacccuguguuagugagcauguggagagaacguuagaaugugccuuuagaauugucagugggaccccucagacgaccuuggugugaagugaccuaggaggucaggagaguagaugugcugcaggcauccuguugggauaagugggcauuggucauugugcuuuguguguaggugcccgucaccugcggugcacuugaaugucuuucgagagcucugaguugcaugcauggcgaguuccagcacagguagguagguggcugugugggaggacacagauagaaggauccaugugugagagugacuuggggacuucggaggacggaaggagagaacauuguggugucccccuuacgcuuccagugcugucugcugguugguaaagggcugggguguaguggaggugggguggagaauuuagggagaggagagauacuguagggagcaggacuuaccucauaaugguugccugguugccugguuaccuggccaugcuuacuuaguuggagcuucgaauugagggccugguagccacaguugcagguugggcuggaauaauuguuccuucucuugauguguccuuguucucaggucagguugauauggcuaggcggccugcuggcgagauagugggagugggcgguccgccccucaggaccucugacuuggacagaugacuggaugacucucuggggcagcauucaccggaacucauauggagggggcugccugagaaaccaaccugugugccuggguaagaagacuaagcuuuucuuccggggucccuucuuuucaucucccauuggacucgggguucaggccagggacacugaaggccucacaggcacauacaacugcccacccauggccuuggguccacugcugcacuuccugcugccaggugggaagccagugcugggccuggugccccacccgcaccaggugugcgcucugaucaaccuugccugugcccagugcucucugacaccacuucccuguugcccuaccaggcagcccguggucaugcagggagggccuucuuggcugugugccuggaccuggaaacuugagagagugugcccagggaccacagagucugccccccaggaagagaaguaacugacugucagcuuuagaggacacccagaugggcagggucaggcaggcagccacuggaucucugggccagccccaggcccuuggccuggccaggcacugcaugggcaggaccaaccccuugucauacaguccaggcacucacuuguuucggagccuccgccccuauggcccagauuuacacaggguuuagauagggcucccugauggucaguuccaaagaccugcuccagccccuuagggcuugccuuucucaaguucucugaccaggcccuccagugcuuugcagcugcccugcaguugaggagugucugugaucagugaccauucauucugucucaacacugcacuccacccagcccgggagacuuaugcacccucaucaucacuacucccaaaccagcacacacacacauacauacacacacacacacacacacacacacacacacacacacacucucacaccagccaagcacauaagaaaacauuucuuaggcacuacuagcagggcacagagagacauuuugcccaguggaaggccuagugcucaggcuccauguuuguggcuggucauugcagguuggcguuuuuugccucuggaagggcggagggagaucgcccagcagccuggcaguugccauucgcggugcucuacugccaucaagcggaauugguuugagguuuccgccugcacaucccugcgccucucuuaacaugguggccgaccccgcucuuuuccuggcagccaaggagggacugggggcucccugagaccuucuuggcccaggagagaccugagagccaucgagcaguauccagcucacuaggggacagagcuggcgacaaaagguuuggcuagccugauucaggaagcacagccuuccagguccugagcacaguucaggcggacauguuagguuugcaagggcucaugggaucucuggacucagcaaugugcacccaaggcugcauuggguucuugugggcaacguguccugccagucacuguucaccagacagauccagguuccccuugcuuuuguuugaugauuccuggcagcugcuuucagucaugcccacccauccaacacaccccccccccacccugugauacauagagagagacaaacugugugugugugugugagagagagagagagagagagagagagagagagagagagagagagagaugcagguuaucaugcuucucugcucugucucaguaucucagguagcuuuuguggccagauagauuucuuucauccaguuagcucccucccugcagggcucaauuccuccucauucccuuccuauguuucgggucaucuuggguuucccuuccucucuuuuagaacagacugucucuuugagcugugcugcggguucagagcagggucccaggccccucgggaaaacacccucaucccuagaacccuucagugguccuggaggcuccaccaugauccugugcaagcaaccucacugugagccccaugugggccaggagccuagccaguguccuggccucuggugaaacugaggagaaacagcuuagaaacagccaggcuaugcuguauuuccaaggguguccuaaacagccaaggcugccaggguaccauccuccuggguccuugaaagccugcuugcugugaugauugacauccaagcaggcagcagccuacuuaggacuucucccaaaccugcacacacacacacacacacacacacacacacacacacacacacacacacucucucucucucucucucucucucucacucacaccaggcaagcacauacaaaaacacuucuucggcacuagcaggucacagagagccauucauggaaggccuagugcucaggcuccuuguuuguggcuggugguugcugguuggccuuuuuuuuuuuuuuuuugccucuggaaguggggagggagagcgcccagcagccuggcaguugccauuuuuggugcucuacugccaucaagcggaauugguuugagguucccgccugcaugucccugugcucugauuuuaggacaggucugggacacagggucuagcagguaagcacagccuuccagguccagaaggcagugcagggucccaugccucucagguacacacaacaguccacccauuucccuggguccacuguggugcuuccuguuggugacaagccugugauguuccuuuguuccacuuuagacucucuaucuauauagauguggcugucuuucaccuccuauagauauucccgccagugucuuguaugugguguuauuaaucauucuuguuaucacuuuccuccuguauacacuuuacucuaauuuuuuuuguauucacuguggcagucaauaggccaugccaguuccaguacaacuggcuucacaaagauuucuauucgacuuuguguuucuacuguauugucccuaucuuguccggaacugcagccaguauucuuauugauauauugcuuaucugagacuaguagcaauaacuauuuuaacaauuuaucucuuauuaauuuguuaacacauauagagugaaaaauguauaauuuacugcuaucuuggucguauuucuaucaccugaaauaguuacaucuugauaaaaaaaaccacgugccugucucacaugcuacagggacugagcuaaaugcuuacaagggaaaaggguuaugcaauuagccaugaaccuuaaggaauauuucaugacacuagagaagaaaacaaaauugcaaaugccucuuucaacagacucagaaagcauuuuuuuuaccuuuuaauuaucaauaugaucacuucuggcaaaaugggacaguuaaauaucacuaguucagggguuagaacucaucuuuucaucagaacaucagauuaaauaaagcuacuaagacugugucuuauguuaauguaccuguuucucuuuugcuguuuuguugaauguucugauggcugaaggaauuacauuuaguggucgaaaugauaaaaaaguuacuagguuucaguguauuaccaugauauucuuaaucuuucaauacaauaguauuuucaucuuaagguuacaguagacaguguguaaccuuaaguuuucaaagacuacuuuuuaugacuuuucuuaucuucccuucuagcccaccaccuaccagagguauuggaaaagaacggauacggaggaaguggacccauuuagaggugauuauuuggagcaaaucccaucugcuuugucaguuauugagcaguuccguucauaggcuggcaauggcagcuugauccacucucaaagucuucauggauacaccagcaguccguucaguaaaguccagauagcagcaguugcacgaccuagcaggaacaaccaggccucagcugaagacaguagucuacaggaggcauuggacuagcaugaaugucaggagaaacuuacagcugugccucucuuaaggaagugaagaucagugaagacaggagaccaaaaggcguuuagcugugcaagcaagccaagcccuucucccagucccuccaaacaucacuaguccuccacaggacuugucucaccauguguugccucagcaaaacucaccuuuacaaacacagcuuugaaggccaguuuuuugaguuaauaauguaaacaaauguuauucuacgacaaacguagaauucaagagaaaaauggaguaaugaguaaaccagacauuaaaaaagauucuauaaaugaucgaauuaccuuuaggcuacugcagcuuagguauaauguaaggggaguaauaaucuacaaauaagcaaaugagccaagaugaccaagauggaaaugguuugauuaggaauuugauuagggaaguucugccaaggcagggauaguugggguggacaccuuuagucccagcacuggggcuuuaugcaugcuaaggacgagcucuauugcugggccccacgcucuagagucaaugcucuaaaauacugcacaaacuaauucucagacauuaacugcaggaagaaugcucuaauccuagaugaguguuuucaaaacaaaacuuagcagcgaagaccaaaaaauacagaaaaagcacccaaaacagacgaaaugccaguucaucaggaagccaaaacuugacagaaauaucucucaaauaacauuuaaucucucucccuuuguucuaauccuguccccacccagcaaccaccugauguguaauuugguuuucuaagugaccauagccaucggucagagacacuaagcugggcccaaauaaaagaagaaaauaaauaagaaguuaaauuaaguuaaaacccuugggucucacuugaaccaauaucucuuaaauuuuuguacaucguugacaccccugaggauauuuacauuuuucaccuuuagcgacuagaauguguaucaucuagccaggcaaugguacacaccuuucuuuaaucccaauacucaggaggcagaggcagguagaucccaguguuugaggccagccuggucuacagagagagccuagguaggccaggguuacacagagaaaccaaguccuaagaaaagagagguguggggaagggagaaauuguguaucacuguaugaucuuucuuuccuaaguucuacuuggcuaccuucuuguauguucucaguagaugcuaauccuauuuacauuguggcauuuuggugcuuguauuaagcaaaucacaaugggccuuccuuaggacuggacuggaagggaacaauuucaaugucuuuaagaaggcagagagagccagaaaauggccgcggcuaagaauuaaguuuacaaaaccuuccagcugguaaauuccuuacaaaguacaaaacaguguguaauuauuuuccaagcguuuugugugauugucuuuccaaucuccaguuuaaaaaagcagaaaucaaaccuagcaguacaucucugaagcaaugacagcaaucuaacguuccagagaaaugagggagcacgcugguuucaccagaauccauccuaccaguaacguuauucaccgagagcuaaggucaugguugauggugaacuuuucccauucugaauuugauaugaacauaacauuuuaauaauaugagcaucuaagaaacagacccagaucaaaagcgguuuuaacuggaaacuaaaauugcaaucagcaggcacgaugguaccucuuuauuuucucauuaaagcugccaacauucuggaacccauuucuggcucacucacugcuucuaaugcuucuaacuacacacacacacacugugugugugugugagaagggagaggcuuuguauucggaagacuugucauuuuguuuuguuuuguuuuguuuuguuuuguuuuguuuuguuuuucgagacaggguuucucuguguaacccuggcucuccuggaacucaccuuguagaccaggcuggccuugaacucagaaauccuccugccacugccucccaauugcugugauuacaggcaugcaccaucacugcccggccaagacaucuuuuuuuuucuuuuuucaaacauaaauaguguacuuuauuaaaaauaaaauuguaacagaauaacuuaguaaugacaaaucaaguaacauaacaagauaccaacaaaaggaaugaagaggcauugcuccagcucacuagugaucuccuuuaaacaggaaaggcugcuagucuagcgguucuggccccaucuguacaacacagagauaaagaaucggugcaaaaaaaaaaaaaaaaaaaacaaacaaaauaaaacaaagaccuauguguaaagccaccuucaaauaauugacugagaucucucuaggaccagggcucgagcagagaugguuaaagugcuaucaguguugagaacuacaggucuaaaguaauauaaacaauauaaaaaauguccucaaaacaaaaucaguaagcugaccagaucauuucuuucaccucagaaaaagggaggaggggcaggcaucugcuuccuacuguucucuauccauuguuuggcuagauucauugccuaugcuguuaauaaacagcaaauagcgaaagguaaaacaagcuacccaaauggaaguucucacgaguuuaaguuuacacucuuuuaaaacaaggcuagcuuucagaaacaaucucacauuuuaauuuugcauagauacucaagucuccuauuuguucaaccaaggggauccaauaagauguacuagcaaguauuuaugagcaucagcuguauaaacguauucauuccguguaccacaaauaagcuuuguuugacagagcaaguguagcagaccugagggcuuccucugaaacugccaaaaccuccuuuuccaagauaagcaucuucaaagucaagagcaugaacaaaacuuuuucauuaaaaaugcaaacacgaaguauuuugucugcagcugugccacacccucaacagcucuccauuaggagauucaguagucauuaguuauuuaucccaaaacccuuccucaguuuucagguuugaaaaaaggauggaaaagaacucaaauucagagaaucccauuucuucagaugcuucugucaggacuccaugucaaucucaacuccuucauucuuguccucaaguguuucugucaggcuguuugcacucacaucuucaagagcugccagaucaagagagggcagaggguuccuccaauacuggaauguauuauacugccaaaacucuucaggcugcuggcugugcacccggucggcuaccugcgggcuucccgcguuuucuacucugucgccgccgcccgcagcccgggguuccuccugcucgccaggaggcggcucuccgggcucccggcuacagcccugcagcuccugucugucguccccgccaugauccccgcgucccccuggcgcuugaggggccgagccgucccagacggcgggacccagagcggcggcuccucggggaagucgcugagcaggagccgcuuccaaggcacgcggaacgugagcggcucagccgcacgccgcuuggccaugggccagggacgagggucgcacgggugucggccgagggcggagggcgaagggcagccaagacaucuuaugccaucacauucucuaaugacugauuaaaaauauaaaucauuugcauacagcuuauguuauccauaacagucacgaugcuucuacaagcauuguaguucugaaaauaugauagggacacuaacaugccacagggggaaaaaaaaggaaggcuaccuagcugccaauccaagugcuugcgcaaaguaaugagcuaacauuuaacaaauguacaaaguguauuuuuugaaaaaaaaaaaaacacugaaaaacauaguugaaaaaaaucacuagguguaacuuuaauuauuuucaaaaccuauuuuuaaugauaguuguuaaacacuuuaaccuccuuuguagcccaccauccaccagagguaguggaaaagaaggguaaccuguuuagaaaaguucuuuggaguaacucccaucuguguugucuggaaauuggcaguucaguucacaggcuagcaguggcaccucaguccacuaccaaucacuugauggauauaucagcaguccaauaugguagaguugggauagcaaacauggaucagcaguagugacacuaccuaacagagacacucagccucagcagaaguuagcaggacaccauggccaacaggaaugccaggagaaguucuuggcugugccucucucaagaaagcgaagaucagugaagacuccauaccaacaaccauuuagcuaugcaagcaagccaagcuuagccucagccuguggcguucuauuuaucuucccuuccuccuccaagggacuugccuccacacauggaucugccucaccugacaucuuucugucauggagggggaaacuaacuaucuaucuaucuaucuaucuaucuaucuaucuaucuaucuagauuauuuauuuugaaacaggguuuugaacucuuggagaugugaccaagcagugggauuagaggugugugccaucacuucuuuuuuuuuuuuuuuuuuuuccucuuuguuguuuuuuuuuuuauuuuuuauuuuuuuauuuuuuuuuaauuagguauuuagcucauuuacauuuccaaugcuauaccaaaagucccccauacccaccccccccacuccccuacccgcccacucccccuuuuuggcccuggcguuccccuguucuggggcauauaaacuuugcguguccaaugggccucucuuuccagugauggccgauuaggccaucuuuugauacauaugcagcuagagucaagagcuccgggguacugguuaguucauaauguugauccaccuauaguguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguguaugcaauggugucagcguuuggaugcugauuaugggguggaucccuggauaugugccaucacuucuugcuugaaaaauauagucagggucucccuaucuagccuucgcuagcccuguacuguugagaucuuccuguagccacucuagcacaaggauuauagacugcaaggauuccuggcaggccucaacauaccaagcuuuauucucuuuuauaaacccaugcaugaugucagcauuuacauuaaaacaggaaaaguuuguguuggggaaaggguagcacuaugguuuccacuaacccagagggaaauccugagacaauuguugguauaauuaaaauaauugcauaugauuagagcaggugcaagaagcuagugaaagaacuuuaaauccuaauacucaauuuauugcugguaaagagaguuucgaagcacuauuaauuaauugaacaaaaccugugauuagucaugauuacagagauuuuucucugcccacugugauuuuguugaguuucuaagcagauaaucaaggcuauuauuguuaauagauaaggaaaacgauuuccauauuuugucacaaaugaagugagacaaaguaauugucucugcucucccuuaccacacagaguaggaaacaauggcaaggaaaauaaguucuagaguuuuguuucauaaauaagggauccuuaaauuaaaaaauuaguuccacaacaccuuugagagcugccucuugaggacucuguauccaacgccauguaaaaacuacagagguuuguaggaaaagccagagucaggagagcuuuucagugaguuucugauagacucugcacaagcauuuuccacacaguaccccacccccacaggcaaauacacacucacccucacagacaccccaugcugcuuuuaugugcuucgguguaaugccccaaaaaacuuuaguaauaaauucuucccagcaacgaccuuuugaguguacaauugauacugguaaaaucccaguauaucaaaagacuguguuuccuugauaugcaaauaauuaaauauuuauugagaaccuaacauguagacaacaccgcacuagguauuuagaggggcaauacaaauaguauuaaucagaaugggcagaaauacuggcagaaggaccgcuucuguguuagucaggugguguauaaggaaaccugugaauuucaugggauucagcaaugcuuacagccuaugccugugcaaugcaaagacucacacagugauggguuuuuguuucuguucuggauuuuuuuuuuagacuuaauaaaauuuuauuucucucaaacacaaucuuucuaucuuagaacaugaucucggaaaacaaaaaaauaaauuuuucauuauagaauucucagaauucaaguguuuuuucuuuuaaauaauguuuuggauaguuaaauaugaugcgugugcuuuugaugcacuguauagauguuuaaauuauuuucaucuaagauaauugcaaucaugucauugaguuuuaagauacgauuuuaauuuaauuuacugauuauuuuauuuauuuacauuucaaauguugucccccuaucuggucccccuuccaccagcacuccaccucaucccccuuccccuuuaccucuaagagggagcucacccacccacccauucccacuucaccccucuaguaccccucuucuuuggcacaucaaggcuccacaggagcaaguguguacucccacccccugaggccagacaaggcagcccucugcuacaaaugcauacagggacacagaccagcccaugaaugcucuuugguugguggcuuuauaguaagaugugauguuauuuuuuuuuuaauuuccucaguuucuguuguucauuucagauuuugcuaauuuggauacugucucuuugcccuuuaguuaauuuggcuaaggguuaaucuaucuuguugguuuucucaaagaaccagcucuuagcuuuguugauucuuuguauagcccuuuguuucuauuugguugauuucagccccgaguuucauuauuuccugcauucaccuccucuuggguuuguuuuuccuuuuuguucuagaguuuucagauaugcugucaagcugcuaguguaggaucucuccaauuucuuuaugagggcauuuagugcuaagaggaaaacucuuucauugugucccauaaguuuggguauguuguaccuucauuuucauugaauucuauaaaguguuugauuuuuuuucuuuauuucuucccugaccaaguugucauugaguagagaauuguucaucuucccuguguaugugggcuuuccguuguuuuuguuguuauauaacaucagccuuaguccguggugaucugauaggaugaaugggaauauuucagucuuuuaucuguugaggccugcuuugugaccaauuuuauuuucaauuuuggagacgguuccaugaggugcugagaagaagguguauucuuuuguuuuagggugaaaugcuucauagauaucuguuaaauccauuugguucguaacuucaguugguuucacuguguuucuguuuaguuuguguuucaaugaucuguccauugaugacaguugguguugaagucuuccauuauuauugugugaguuucaguguguguuuugagcauuaguaaaguuuguuuauggucaucucuuucuuuggguugggagaguuuucuucugugauuuuguugaacaugcucucuggcccuuugaauugggaaucuuuacuucuaucccuguuauucuuaguuuuagucuuuucauuguauauugaauuuccuguauguuuuggguuaggaacauuuugcacauuguauuuucuuugaccuucuaaaguauguuacaugcuugggauucucuguuauaucucuuguauucuguuggugaugcuuacaucuguaacuccugaucucuuuccuagguuucccaucuccaggguuguuuccauuuuuauuuuuauuuuuuuacuuuuauucuuacuucuuggacugcuuuguucaauaccuucaccuauuugcuuuuguuuuccuguauuuccuuuuuuccccaauuuuuaauuagguauuuacuucauuuacauuucaaaugcuaucccaaaaguccccuauacccugcccccgcuccccuacccauccacucccacuucuuggcccugguguuuccucuguacuggggcauauaaaguuugcaagaccaaggggccucucuucccaaugauggcugacuaggccaucuucugcuacauacgcagcuagagacacaagaucuggggguacugguuaguucuuauuguuguuccaccuauaggguugcagaccccuucagcuccuuggguacuuucucuagcuccuucauugggggcccuguguuccauccaauagcugacugugagcauccacuucuguguuugccaggcacuggcauagccucauacaagacagcuauaucaggguccuuucagcaaaaucuugcuggcauaugcaauagugucuguguuugguggcugauuaugagauggacccccggguggggcagucucuggauggucccuccuuucgucucagcuccaaacuuugucucuguaacuccuuccauggguguuuuguucccaauucuaagaaggggugaaguguccacacuuuggucuucauucuuuuugaguuucauguguuuugcaaaguuuaucuuggguauucuaaguuucugggcuaauaucuacuuaucagugagugcauaucaugugaguucuuuugugacuggguuaccucacucaggaugauacccuccagauccauccauuugccuaggaaguuaauaaauucauuguuuuuaauaguuuaguaguacuccauuguguaaauguaccacauuuucuguauccauuccucuguugagggacaucugguuucuuuccaacuucuggcuauuauaaauaaggcugcuaugaacauaguggagcauauguccuucuuaccaguuggggcgucuucuggauaugugcccaggagagguauugcuggauccuccaguaguauuauguccaauuuucuaaggaaccuccagacugauuuccagaaucguuguacaagcuugcaaucccacuaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuccaggugcuucucugccauucuguauuccucaggugagaauuccuuguucagcucuuuagccccauuuuuuaaugggguuauuugauuuucuggaguccaccuucuugaguucuuuauauauauuggauauuaguccccuguccgauuugggauagguaaagauccuuucccaaucuguugguggucuuuuugucuuauugacagugucuuuugccuugccgaagcuuugcaauuuaugaggucccauuuauugauucucgaucuuagagcacaagccauugcuguucuauucaggaauuuuuccccuguacccauaucuucgaggcuuuucccuacuuccuccucuauaaguuucagugucucugguuuuauguggaguuccucgauccacuuaaauuugaccuuaguacaaggagauaguaauggaucaauucgcaaucuucuacaugauaacagccaguugugccagcaccauuuguugaaaaugcugucuuuuuuccacuggaugguuuuagcucccuugucaaagaucaagugaccauagguguguggguucaucucugggucuucaauucuguuccauuggucuacuugucuguugcuauaccaguaccaugcaguuuuuaucacaauugcucuguaguaaagcuuuaggucgggcauggugauuccaccagagguucuuuuauccuugagaagaguuuuugcuauccuagguuuuuuuguuauuacagaugaaucugccgauugcccuuucuaauucguuugaagaauugaguuggaauuuugauggggauugcauugaaucuguagauugcuuuuggcaagauagccauuuuuacuauauugauccugccgauccaugagcaugggagaucuuuccaucuucugagaucuucuuuaauuucuuucuucagagacaugaaguucuugucauacagaucuuucacuuccuuaguuagagucacgccuagguauuuuauauuauuuguggcuauugagaaggguguugucucccuaauuucuuucucagccuguuuauccuuuguguagagaaaggccauugacuuguuugaguuauuuuuauauccagcuacuucacugaagcuguuuaucaggcuuaggaguucucugguggaauuuuuagggucgcguauauauacuaucauaucaucugcaaaaagugauauuuugacuucuuccuguccaauuuauauccccuugaucuccuuuuguugcauaauugcucuggcuaggacuucaaguacaauguugaauagguagggagagaguggacagccuugucuagucccugauuuuagugggauugcuucaagcuucucaccauuuacuuugaugcuggcuacugguuugcuguagauugcuuuuaucauguuuagguaugggccuugaauuccugaucuuuccaagacuuuuaucaugaauggguguuggauuuugucaaaugcuuucucagcaucuaacgagaugaucaugugguucuugucuuugaguuuguuuauauacuggauuacguugaugauuucuguauauugaaccaucccugcaucccugggaugaaaccuacuuggucaggaucgaugauuguuuugauguguucuuggauucaguuagcaagaacuuuauugaggauuuuuguaucaauauucauaagggauauuggucugaaguucucuaucuuuguggggucuuuuuguggauuagguaucagaguaauuguggcuucauagaaugaguuggguagaguaccuucuguuucuauuuuguggaauaguuugugaggaacugggauuagaucuucuuagaaggucuuauagaacucugcacuaaacccaucugguccugggcuuuuuuugguugggagacuauuaaugacugcuucuauuucuuugggggauaucaggcuguuuagaucauuaaccugaucuugauucaacuuugguaccugguaucugucuagaaacuucuccauuucauccagguucuccaguuuuguugauuauagccuuuuguagaaggaucugaugauguuuuggauuucuucgggaucuguuguuaugucucccuuuucauuucugauuuuguuaauuagaaugcuuucccugugcccucuagugaaucuggcuaaggguuugucuaucuuguugauuuucucaaagaaccagcuccuugauugguugauucucugaauaguucuuguuuccacuugguugauuucaccccugaguuugauuauuuccugccuucuacuccucuugggugaauuugcuuccuuuuguucuagagcuuuuagguguguugucaagcugcuaauguauguucucucuaguuucuuuuuguugucacucagagcuaugaguuuuccucuuagaaaugcuuucauugcaucccauaaguuuggguaugaaguggcuucauuuucauugaacucaaagaaguccuuaauuucuuucuuuauuccuuccuugaccaaaguaucauugagaagaguguuguucaguuuccaugugaauguuggguuucuguuauuuauuuuuuuauugaagaucagccuuaaugcauggugaucugauaggauacaugggacaauuucaauauuuuugaaucuguugaggccuguuuugugaccuauuauguggucaauuuuggagaagguaccaugaggugcugagaagaagguauauccuuuuguuuuaggauaaaauguucuguagauaucugucagauccauuuguuucaucacuucuguuaguuucaaugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggagcauagauauucagaauugugaguuccucuuagaagauuuuaccuuugauaagagugaagugccccuccuugucuuuuuugaugacuuuggguuggaagucaaucuuaucagauauuaggauggcuacuccagcuuguuucuucauaccauuuguuuggaaaauuguuuuccagccuuucauucugagguagugucuaucuuuuucucugagaugaguuuccuguaagcagcaaaauguugggucuuguuuguguagccaguuuguuagucuaugucuuuuuauuggggaguugaguccauugauauuaagagauauuaaggaaaaguaauuguugguuccucuuuuuuuguuguuaaaguuggcauucuguuuuuguggcuguuuucuuuuagauuuguugagagauuaccuucuuguuuuuuucuagggugggguuccuguccuuguauugguuuuuuucuguuauuacccuuugaagggcuggguucguagaaagguaaugugugaauuugguuucgucauggaauacuuugguuucuccaucuaugguaauugagaguuuggcuggguauaguauccuuggcuggaauuuguguucucuuagugucuguauaacauauguccaggcucuucuagcuuucauagucucuggugaaaaaucugguguaauucugauuggcuugccuuuauagguuacuugaccuuuuucccuuauugcuuuuaguauucuaucuuuauuuagugcauuuguuguucugauuauuaugugucgggaggaauuucuuuucugguccggucuauuuggaguucuguaugcuucuuguauguucaugggcaucucuuucuuuagauuugggaaguuuucuucuauaauuuuguugaagauauuugcugguccuuugaguugaaaaucuucauucucauccaccccuauuauacguagguuuggucuucucauuguguccuggauuuccuggauauuuugaguuaggaucuuuuugcauuuuccauuuucuuuaauuguugugcagauguucucuauggaaucuuuugcaccugagauucucucuuccaucucuuguauucuguugcugaugcucgaaucuaugguuccagauuucuuuccuaggguuucuaucuccaguguugccucacuuugaguuuucuuuauugugucuacuucccuuuuuaggucuaguaugguuuuguucauuuccaucaccuguuuggauguguuuuccucuuuuucuguaagaacuucuaccuguuugauuguguuuuccuguuuuucuuuaaggacuuguaacuguuuagcaguguucuccuguauuucuuuaacugaguuauuaaaguccuucuugauguccucuaccaucaucaugagauaugcuuuuaaaucugggucuaaguuuucggguguguuggggugcccuggacugggcgaagugggauugcuggguucugaugaugaugaguggccuugguuccuguuaguaagauuccuacguuuguuuaccuuucgccaucugguaaucucuggaguuaguucuuauaguugacucuguuuagagauuguucuucuggugauuuuguuaccaucuaucagcagaccugggaaacagacucucuccucugaguuucagugcucagagcacucucugcuggcaagcucuccucuuacagggaaggugugcagauaucuuguguuuggaccuucuccuggccgaagaagaaggcccaaaacaggaccuuucccagaagcuguguugcuuuggcaugucccugaagcugucagcuucuguggugcucacucucaccugugcagacuaaguuccuaaguuuggcggagucccggaaccaagguggcgcccgcugcuccugaggcugagagcuuccgagccaggcagacaccuguccucuggucgggaugguagccggcugucuguggcccgaaaagggugcugucucagcggcucuguggcuccgccugucccagaagcuguccgguucuguggugcacccucucaccuguucagacuaauuuccuaaguucggaggagucccggaaccaaggugaugcccgcugcuccugcggcugaggccuuccgagccaggcagacaccuguccucuucuuuggcauuucuaauuuccccaacauuauaugaaacuuucugccucuaaaggauggcauccuuuauagauuguuuguggauacaucaacauucucacucugucaguggguacuccaaauaguguuucugacacagaaaccucagaauuauuccuucagcaccaagaagacucacaguuuucccccaugcuugaaguggggcuuaaaucucucucaaggagucaccagguacacuucgucuaaaccagaaauucaaauacacuccaggcauucuucucuaguaagguucagaccuacaacuuaagaaccacagaucuuccaaacuacuguauggaccaaggggacaucugaucugccuauucugaaccagggauccucagaucuuccccaauagccuaagugaccuuaaucuuaccugucuagaaccaaugugcuugggcuggagagauggcucagcaguuaaaagcacugacugcucuuccacagguccugaguucaauucccaucaaccacuuguugucucacaaccaucuguagugggacccgaugccaccuuauggugugucugaagacaaugacaguauacccacauacaugaaauagaaccuaugugacucacaacuuucaccaauaacucaaggggguuucagauguaccuccucaacaucaaauauguuagaaacuccccaguguugaaggcagcacuaacauaugagaaacagaaaccucagaaauucuuuaauugcccucagaauuaccacuucagaacaaaggugucacauugguccucaaugacuaaggaugcccugacacauaugacaugauaagcaaaggacuucagaccucaacaacaucuuaagaaggccacaaauauggcucuuuuacuaucaccaugcaauagcauugaugaagucacaauggggacucagauguacccuucuagacccaggauaauuuauaucuccagaguaaauccaacuccaugaagucaugcacccucagaaguaaaguaucccauaacuucaugggggaugacacucaguugguuuaucuuuugaagagggccuaggccuuacaaccucuaaccauaguagccccugacauuauggguaugccaagggggucagcugaccuuaaguaaaaacaguuuauucuuccuccuuuugcacuggaggggucugaggcaugaagguauagaacuuaccuugugagugaggaguuuaucucaaauauucaggcucagcucuaguguguuuaagacugaauccuugguaccaagaauucacaggagcuuugcucuuuguucauggcugacucaggacuaccauucaacuaagaaagaccagagcuucucccucagacuuuauugguuagggaauacaccuuucaccaccaaaaaacaaacaaacaaacaaacaaacaaacaaaaacaaaaacaaaaacaaaacaaaacaaaaaaccucagagaacuccagauucaagucccauggccaauguauaaaaaccucagccuuuauccaaggcacucuuuaagcuggucaucagaaagguaacuguccucaacacccacaccuguguggccuguuguaaguuuaauagggaacaaauccagggacuuugagccaacuugucagaagaaaacucagauugcuguuaaaucugcaguggaguccucagagauaagaauuuuuuagaguucucugaagauguggaggccuguagucccuggaccaaccuccucuacagaaagugaacagggcuacuccccuacaguccaacaggguugaaggacuuucuccuuuucaaacuuccugugaugaucgaggucauaaaauguaccccuuugacccaaugggcucucauaaaaaucccuucuguucaggagcccaugggauauuuuaccucugaccaaggaacauugcucccucuggucaaauuucacacaaaucaagaggaggaggccaauccuggaaccuuaugccacuuccuuguguacagucacaugacauggugugaaaucaccauucuaacucaguucugguugguugaacauaauucuuaggaggcaaucauccugaggacacaaacccaagcuuuuuaugaaucaugguaucuauacuuggugucuugcuaauucagcuaaagauauggauaccccaggcugugaagaacuguuaggagguguggcaaugcuaggaccuuaugagcuaagguaagcgauuuaauuuuugcucuaaauauuauggggauuuucauacucugaucaucucuccuguuacaaggauaucagcaccuccuuuauccccagggcuacuuacuccuucuaccuuugauuaaggaggcaucacaucuucccacugaagaaaagggacccucugaucauaccaguuuguccaaagaaggcuucgacauucauuuaggucgaggaaucccacacaacuugcucauauuauggacugaaacuuagauauuuuuccuaauguuucccagauuuuuccuucauaucaagguaaacucuagguuuaaaaagguuucaaugaagaaucuuugacauaaauacucugucaaggaagaaacuuacauuuuaucuuugaaauagggaaaaauacacacccugaaauuugaacggagcuuaauacaaauucugcugcuuaaggagccuacagaaaagccacugacaugaaaaacucaagcagauguucauuuuuucucaaggauacuugaaauuaacaucucuuaaccauguguacuucagaaaauccacuuuuauccauagaauccugaggucuauuccucuaggagguccuaaaguuucccuucugaccuugguggccaggcaugcucaaauaaaagaaggaugucaaacacucugaaaugauguucugggacaugacaguaaaaauaugaucccuaaucuaacuucuauuuuuaaggcugucacuugaaauggagcaguuccaucuuaguugcccaugccugcgaugcugcuguacagcuuguggagaacauagagcuagagauuaccaaacaauuuguaagaaaaauguucugauugcuggcaagcacaccucaaagucucagaacacauggguauucuggacuaugaggacauuugcacuuuguaagcuauuuuugacaucuucuuccaauucgcaagguaaacuuuugccugagagauucugugaccuuccugcucuuccuuauccucccaacauauucucuuucucaaaaauaacauucccauauauggucaaaguaguuuuauaccuaacugauuagguauauuuccaaaugugacucauuauguaaacaagguacccuaguccacucugguuugagguuccacaguccaaguuacaaaucagagcaaagaaccugugccaucugccuucaggcaagucaaaagaaauguaauaacuucauuaauucuaccuagaccuggauagaugaacaaagucaaagaaguauccuagccuuuggaagaagaaauauguugcugccuuaucucucccgaaugagcacaaacuaugaaaauacaaaacucugaauaagaauuggaaacuuacgaucauugcuggaaacauucuccacuguauaagguaccagggaccuuuaucuuugacagaaguguauauggcaauuucacagucugccucaggaagauucuguccuccucuuucaguaaggccucggagauuuucucucuuacauggggcucacauuucccaauguuaacuuauuuuuucucacuacacugaauagaaugucagaacucuccuaagacuaacauugcccuaaacccuauuguccaaauguggccuaaaacauguauuaugccuuacauggaauauuccuauuccucccaaguagcuuugagucuuuuuuccuuacagugcugucagaccaugggagacuuauuccacucauucuacauaaaagagcaucuaacauuuccugucuucccaguaggaaucugggccuauugucuacuuccauucaccaaguggauuuuagaccuucaguuucugcaaagggguccugggaaaucaaagucuauugaaaggacucucagaacuagcuccugugucuaagggguuuuucagaccucuacccucuacacuaguggacuucagguccaccucugcaacuaaagaaccaaccaccagagccugucuuuugcccaugccucacaaacaccccuauuaaugaaguuugcuucaaagcuaacuucucugucuaagauauccauacaacacauuugcaaccagagauaccucacaauucucucucauaggacagaagacagaaaucugaaauugucucucacauccugugccucaaaguuggucaucaaaaugcacuauucauaucuuuuauucacagaugugugcagcugaacacgucgaggaaacauaagugcuugcauaacuacuuauccuguuggaagauuuuugugaccauugccuggacucucaaagauguuacacagaguaugcauauggggaaaauacuagcaagcuagugaggcagagucugaacauuccuccaguacccaauggagucuagaaccuuccucugcugaccaugggugaacuagauauuucuguccuacaaaguaugacuggggaccucuaccuugggaaccaagacauucaggauuucucuucuguugaagguggucuaagaauuucccauucugagaaacaguuauuagaacuccuguguuagucaaauacuccacacuguugucuagagaacugugccuugguccuuccauuccccaacaauguggccucggaucuugcccaccucugcaagagggaauguuaaccgcugucuuugacaaaaggaagcuuacacauuccuuuauuccaaaggugacauuagauaugcucuuuugaauagcaguguaucacgccauguauccucaagcauccucuuaugucuuugaacuacauccaaucuauauucucuaaauaaggaagauucaaaccuuucaccuuuuaucagaauggcaagggaaauauauuguuccucucugguguguggucccaggccaucuguguagaauuauugacaggauccuauguuaugcucugcaaucuaaucaaauuuuugcgacccauauauggacauaucaagacaaacuggaggaggaaaccuagccagggacagacauccaggcuguuugaaaaaugcuuggguuguugcuugaacucccccagacuaaacacgagauguggaacuucuaccaacuaaggaagaguuggaagcugaagagcaguggagugucgcacccaccucgucuggcaaggaagacacaacacggucuacaaggcaugacuaugccagugccugcaaaguucaaacaagauaaaaagggauuggguuuuuccuaggggccguugagggugguauacccauuacuuggaaaacagaggagccuguauggguuccucaauggccucuuuccucugaaaaauuaguagcugccaaagaauuaguagaggaacaauugaaauuaugauauauuaaaccuucccagucaccuuggaauauacccauauuugugacuaaguaaaaaucaggcaaauggaggcuccugcaugaucuucaagccauuaauaaucagaugcagauuaugggccccauacagagaggucugccccuacuuucuaguuugcccaaagaguggccuauuauaaucauugauauuaaggauuauuuuuuucucuauuccccuugcauugugugauagcgaacacuuugccuuuacucuuccuucugugaauaaugaagagccugauaaaugguaucaguggauaguuuuaccucaagggguggcaaacagaccuacuaugugucaacuuuuuguaggagaagcccuacaaccuguccaugaugcauuccca

SEQ ID NO: 9593 - RNA, 587 nt, Mus musculus
ucuguggucccugggcacacucucucaacuuuccagguccaggcacacagccaagaaggcccucccugcaugaccacgggcugccugguagggcaacagggaaguggugucagagagcacugggcacaggcaagguugaucagagcgcacaccuggugcggguggggcaccaggcccagcacuggcuucccaccuggcagcaggaagugcugcaguggacccaaggccaugggugggcaguuguaugugccugugaggccuucagugucccuggccugaaccccaaguccaaugggagaugaaaagaagggaccccggaagaaaagcuuagucuucuuacccaggcacacagguugguuucucaggcaguccucuccauaugaguuccggugaaugcugccccagagagucauccagucaucuguccaggucagagguccugaggggcgggccgcccacucccacuaucucgccagcaggccgccuagccauaucaaccugaccugagaacaaggacacaucaagagaaggaacaauuauuccagcccaaccugcaacuguggcuaccaggcccccgauucucagcu

SEQ ID NO: 9594 - RNA, 587 nt, Mus musculus
agcugagaaucgggggccugguagccacaguugcagguugggcuggaauaauuguuccuucucuugauguguccuuguucucaggucagguugauauggcuaggcggccugcuggcgagauagugggagugggcggcccgccccucaggaccucugaccuggacagaugacuggaugacucucuggggcagcauucaccggaacucauauggagaggacugccugagaaaccaaccugugugccuggguaagaagacuaagcuuuucuuccggggucccuucuuuucaucucccauuggacuugggguucaggccagggacacugaaggccucacaggcacauacaacugcccacccauggccuuggguccacugcagcacuuccugcugccaggugggaagccagugcugggccuggugccccacccgcaccaggugugcgcucugaucaaccuugccugugcccagugcucucugacaccacuucccuguugcccuaccaggcagcccguggucaugcagggagggccuucuuggcugugugccuggaccuggaaaguugagagagugugcccagggaccacaga

SEQ ID NO: 9595 - RNA, 587 nt, Mus musculus
agcugagaauugggggccugguagccacaguugcagguugggcuggaguaauuguuccuucucuugauguguccuuguucucaggucagguugauauggcuaggcggccugcuggcgagauagugggagugggcgguccgccccucaggaccucugacuuggacagaugacuggaugacucucuggggcagcauucaccggaacucauauggaggggacugccugagaaaccaaccugugugccuggguaagaagaccaagcuuuucuuccggggucccuucuuuucaucucccauuggacucgggguucaggccagggacacugaaggccucacaggcacauacaacugcccacccauggccuuggguccacugcagcacuuccugcugccaggugggaagccagugcugggccuggugccccacccgcaccaggugugcgcucugaucaaccuugccugugcccagugcucucugacaccacuucccuguugcccuaccaggcagcccguggucaugcagggagggccuucuuggcugugugccuggaccuggaaacuugagagagugugcccagggaccacaga

SEQ ID NO: 9596 - RNA, 151975 nt, Mus musculus
ccccccagucucgacgcucgggagcgacaagccgccagcgcccccgccccgccgccgcugcagcgcccuccggccgccauucgccaccgaaacuuuccagcgcuagcucuucucguggacuagguggcgggccagggguagcgcgcggcugcuccggggcgcuuggcccucgucggccuccgcgcggcccgggguuggugacgguggacccgccaguacgcugagugcgcggccacaaguugcacggcucgcggcgaggugaguacacgccgggcaggggcucaaacuucucgggccgaggggcgcgguggugaccccaaucgcgggcccugaagcuucaggaggggcaaguucccgugugcccccccaaccccagguugggcgcgcucccugcacgccgaacaauaccucuggggcggccgcuccccgaaguggccgcgcgcgcggggggcgggaaaggccugggugcgccuuuguuuuggggagagggaaaggcaaguuuagggacgcucugcaguucgucccagcaucucuuugucugaggcuccagaggggguuggcugggcugacccgcgucgcccugggacuugggggccgcgcgggauccccuugugggggaggggagccucauucauccucgaggcgcgggccggcgcucccggaacacgguggacgcgcggcggcgcgcgggggauaguggcuggcccguuugugaucaguuuccgaggcgcaaacugucagggaaguccgggagcccccuccccauaccuacucccaggccuggucucggggaccagggugugugugggggggugacaacgacggagggcggcuccucuggcuaggugagggagagggaccgcccaguacggccuggggaggguguaaaccuguugcuuuggggcuggggagggguucuccagaucugcacucacccacauccucgucuuaggaauuucccuuacguagagaagggugcugggagcaggaguuuauguaggaggggugcgccuuugaacgucggugaucuucggguuuugugacaacuuuaggaggagacuacaggcccgcuggugcuggauggggccugggcuucacgugcgugaccagugagcaaucaggagcuuggggcuuuuuuuuuucccucucucucucuuuuuuucuuuuucuuuuuuuuuuucccccagcgucuggcguucucagaggccuccgcacuguaaauuccgcaguuagggucggcuuguuucuuucugaccaaguguuguggggcaaaaccuaaaacagcuccccucccccuaaccaaaaccuaagccauacugcuagugcaaguguuuguuucuguucugcuuuggugugugugccuugaccugacuaguguuuuucucugagcuagucccugguuuaacuuaaaagaggacacaagaauacaggaggaggagugagugcuuuguccuacucccccccccccccagucuugguuuaggguagcaaauaggucuuggugagccuaugaaauuuaccauuggucauuucuaaagacacauaucaagguaugaaauaguguugaguguagauggcacuuuuauuuuuaaagggauuucguguccaagugugcugcagauuauuuucauggcaccacccaccaguguaauuaguacaacgaugaaagucgaaguucacuugauccacuuauuaaaauggcccccuaaagcuuuucaagccuuuaaucacacacacaccuguaggacaggcaugggugauuugggguguaaggcucucauuuaccccaggauauguccuuacuugggucagagaauuccacuuaggcagcacuacuaaaagaaaaaggaagauauuuuacuccuuuuaaugguauugggcagauacucauuucaaguuuaccucgguuuugcuguuggguuuugcuauuuuucuaggcccugggagucacaccaaagcaaggccuuugagggacacugugaauggaagcugauugucuucuaguauggugggugggcuaccaggauccuuggggugaugauaauuuucuuugaugcgggauuauugugguuugaaugagaauggccuccuuaggccauuugaaugcuagguccucaauugguggaaauguuuuugagaagguuuagaaguguggccuuuuaagguauguguauccuuuugagguuucaaaggcccacacuauucccaguuagcucacucucugccugugcuugcggaucagauguaagcucucaugcuccagugccaugccuaccugcugccacaaucccuguuacgauggauagucauggacuccaaccagcccucugaaacuauaaguacuaguggguucuucuguaaguugcuauggucaugguguuucuucaaggcaauagaaaaauaaacaagacaauuggaucaguucagagaauuauaaacaccuucagguuuuauauauuaaugucuauaacuuaaguuugcuuuaguagacaguauagguaccagaagugugauauaggacuguggaauuguaaaugguccugaagccuguuuuuuaauguucucauguauauguagauguguuugugcacuuauguuucugguugcauguguauauguaugaaggagguggaugucagaaauugauaugggaugucuuccuuuaguugguaauuaucuauccauguuauuuuuuucagauaggguuucuuucucauucaaguugaagcucacuaauuuggcuagacugacaagccccaaggauccuccucaguguuggaaucauagauacagacuguagcacucacauuuuuacauggguucccagggauuaaauucagguccucgauguacugauugagcuaucuccuugaacaccacuuuuuuuuuuuucgagacaggguuucucuguguagcccuggcuguccuggaacuaacucuguagaccaggcuggccucgaacucagaauccaccugccucugccucccaaguucugggauuaaaggcgugcgccaccacugcucggcuuugaacacuaaucagaggcucuauguuuuuuauuguuauggucacauggugaaucuaccuugugagggcguuuacugggaaccauaacugagaaacugguuacuuagagcauccaagcugcuguguccauuccaaauguuuggaaacaagaggauacuaugaaaaagcccaccuacuugaccaguugcuggaccauggaauucuguaauuuuuuugagcaucauuuuaugcauuugcaaaaaucaaaaggaggggcuaaugauguagcucaguugccuagcaaucagggcuuagcaaaagaggccagcccugaguucaguccccauuuguagaugucauuucagcguugagagaagguagagagaaagguuaguaacaggcacaguuugguugcacagagagguugucuuagcuaucgugccugaggccuuugguucgauccccauucuagaaagaaaccaagcaaaaacuuugcauuuuauuaugcaaauaaagaaacaaacuucacuuuaccagaauguccuguaaugaagauuuuaauuuuuuacauuugauuuauuuauuuguaugugcuugcacacguagaagucaggacaagguauaggagucauuucucuuuuuccaucuuguggguuuugggugucaaauuaggcaccaaaucccuuacuggauacaccacauuaagaugaggacuuuauaggccuuucugauauggauuacaaucgcuguguccauucuuuagccaaggaaacugauuuuuuuuuuugauuuugguuuuuugagacaggguuucucuguauagcccuggcuguucuggaacucacuuuguagacuaggcugcccucgaacucagaaaucugccugccucugccucugccucugucucugccuccagagugcugggauuaaaggccugcgccaccacgaccggcuuggaaacugauucuuaacagagggcaaguaaugcacucauacauacauaggggagggacaggcaugugagucccaaagcccagcucuuaaacuuggucuuucuccacauucuugccuaucuaguguggauuuucgcacuugaaacaagagaucuauaaauuccauuccccuuucccaccccucagauuuccauuaaauuuugauagggaucugucaaucaguauuaguuauuucuuucucaucaucuuggaaggcagaucaugauguggggauuguuuucuccuauagcuuugcuacugagucacacauguauauguccuuagaauuagcugaaaacagcucuggucuauuggaguccauuuuauggauucaacagcacaugagauucagccaguaaguaacaugucuuacugagcagaguuaaaugugcaaaggucuggucgcccagagcuguucugguacuuggugaaguuuucauaaacaaagcaggaauuugaguguagcuuuugaagggugcuuuuugauuuuggaauaauucacaggcagguuuauuuaaacaauugcaugugugugugcgugcaugugugugugugugcgggcacauguucauguuguugaucaauuucucacgucauuccucagcugucuaucuugauuucaguuuuugaguguuuaccugugcacauguguacagaugugugggcauaugaaggccagaaguugauacuaaauuuuauguuuugaacagggguucuuauugaacuuggagcucaccaguuuuucugcacuguaguguguguguguguguguguguguguguguguguguguguauaaaguaaccaccugacuagugagugucagggaucuuccuugucucucauucacagcucuaggauuauaggcauauaccaaccacuaucccuauauuuuuacauggauacugagaauagguccucauacuugagcggcaagcacuuugcccaccgagccaucuuccuggcucccccaccccuuucuuauugagacaggcuuucauuauauaauucugaucguccuaggacuuguuuuguaaaccaggcuggcuuugaacugaagacagcugcugauucugucucucaagugcuaggauuaaagucaggccacuuaccagcaugccuagcccccacuauguauuuugagauaaggucuuucauuggccaggugauucccagaaaggccagacuucugaccugauguucaccucggcacagcauuuuuuuuaaccccaagacagggucuguguaaccugacuguucuggaacuugcucuguagaccaaccaagcuggccuggaacgcagggcucugcaugcuucugacccugcugggauuaaaggugugugccacuacugccuggccagcuuguacagcuuguguguguguguguucauucugagaauuaaacucagguccucgugcuuguguugcaaggacuuugcuggcccaacuaccucuccagcccccagauuuuucuguauuugugugugauaguaaguauuaagucuuauacauaugagauguagguaaaguacucaaccauggagcuacauccacaaacuccauuuuauucugagacaaagacuucaccagguugacuaagcuagccuugaguaggugauccucuugaauagcugagaugaugggccugugccaccucaccuggucugugucugaaaucucuaauuguaaacucuggguagguaccuuggauucuuuccauuccuuucuugaaguuuagauccuaaauacugaguuugaauucaggaggucaaagucuuccaaauuaaaggauccacagaagaagugcuuccacaggugguguuggucacagcagucaguuccuuucaaaaauaaaaacauagcuauuaguguuuccugaacauuggccguugauucaagguauuuuuauuaguuauuugauauaucauaucaaauaguuauguggauguguuagcgaugucauuuguaagagaggacaaggaaggggaaaaacucaacguguguuuccuggagucucuuugcaucuguccucaugcacaauuuuuaucuuuugauuuuaaucuuauuauuguuuggauucacucauucacucucucugccucccuucuucucccuccuccucccucuuucuuucuguucuuugagccagaaucccacuacauagucccuggcuggcucuguagaccaggcuuguccgccauugucuccuaaaugcugggaugaaaaauuccauacuugguuuaauuaauuuauauuuugugugugguauaugcauguguucauaugugugcauuugggcaugcagauguauacauuauuuugugcacacacauauaugccagagguugauuuuuagcugucuuccuuguaguucguccuuccauuuuaggagacaggagcucuuacugaacuuggaccucucaccauugcugggauuccagauauacacuguacugggaaagagggaagggugacagagggcgagaccugaggggaaaaucuugcugagucucugucuccaaaggccaguuccuuccuuuauacuaaaaauagccauggaaaaagaaaaaaaguuuaucuuucaaacauuaagaaggauaaauguuugcaaaaugauuuuaaucuugcuuccucguuggaggugguuuuaaaacguauuuaguagugaaagauuaacaguuuauugaauguaguauaccugugaguuuuuuaaaggggaaaaagggugaaucugaggugucaggaaaccugagguagggaucaacugucuuggcucacucagcugagaaacugugauguucagugcugagcgaucacuguaggucacagaggugggaaaucuugaucaggaaguuggggcucaaaggggggaaccccagaauuuacuugagauaucuuuaugcccacaggaaaugacuugaacuauguauggguccauuguaaaagcuauuuugaaucgucucccucaauggcuuauuuuugagcaugaccucccucugaggaacucuuuuucaccuauagaagagagucagucaccucagggcuauccgaggauccuaaugggaauaggcacggggccucacacuuaccaucccuuuugaagagagcugauuucagauucucugcaagaucaguaggugguguuaagcacugagccuuuucucuaguccugccugcaacucuuuagucucuuuucucagccucuggagugcugggguuacaaacauguuguacacagcuggcaggcacaccagugauuugggggcaggguauguuaggaaauaaaugaccauaguugcugauagguacaauaagaguuucagaugcuuauagaaaaaagggaaaaaggauauaggguacuugaagaaugguucaggccugugggcaugggggaagaggggcagagaaacucugccucccaagcagccagagcccaggaauacacgaaacuuucuguuucuugcuguguguuacagaucacuagauuuggcuuucggucacguucuuauuugugguguugauuaggagaacucucagauagagcccugucucaagcuuaugcagacucaggaaggaaccaauugaaacauuggucagccuggaauuucauugccacacagguaggcuaagaaaccugaaaggggggcuggugagauggcucaguggguaagagcacccaacugcucuuccgaaggucaggaguucaaaucccagcaaccacaugguggcucacaaccaucuguaacaagaucugacucccucuucuggaaugucugaggacagcuacaguguacuuuaaauaaauaaauaaaucuuuaaaaaaaaaaaaagaaaccugaaaggguauagagaggcaaggagugucucaaacuuuuugucugauuguggacuauagaugcugcuucugucagcaucuguauagcugguggcauagugaaaugaaccagagguuuggggacugugcuggucaguuuuuuuuuuaauuugacacaagucaaggucaucuaagaagagagaagaaaccucaacugagaaaaugucuucaucaaauugaccuguggguaaguaaguucauggaugugggaggaccuagcauaugugggaggugccacucuugggcagguaguccaaaguuuuacuauaagauaacaagcugugcaagucauggggagcaagccaguaaguagcaccccuucaugcccucugcuccagguuauuauauuauaauuauagcauuucuccuuugccuuuucucccuucaaauccuccuauauacugucgucuguaauucuagucccaggggcucugucauccucuucuggccucuguguaucaggcaggcacaugguguacauauacccauacagcuaaaauguucauacacauaaauauaguacaauaaauaaaucuuaaaaaaaagaaagcaguaauuuuucuguacagaaccugcuaacagguauuaaauaucauuuaauaucuacagugguucagaaggugggugcuaggcugcuuggcuguuaucuucaaacacaggacacuugaguaugcaaaacucuuaaauucuuccccauagaucagucaugugagaguaaguuaggauaaaauagagaauucauuuuguguuuguuuuuuggaaaaaauauuguuuuauuguuguuugguuuuauuuguuguccuuuuuugacaggggcuuguugaggcagcauuucuuguugcccagguugaucuuauauuuacugugugacugauguugacuuugaauuccuccuguuucccccugccucagccucccuggugcugcaaugcugggugugcacgggugaagacagcuaccaucaggcaaagcaagcuaacuggaaauggugugugcuuuugaaaccucaaagcaagaccuagugauuuacacacacacacacacauacacacacacacacacacacacacacacacacacacacucacacacuccuaauccuucccaaacaauucaacugcuggggaccaaguauucaaguauaugagccugucggggccagucucauuuaaaccaucaccuguuaagugugugggaucacuuggaucugugugucuagcaguguauacauguuguuuguguauaugugugcacggcauugugaguuacauguuuacacaucugugcggaggccagaggucaacauugggcaucuuccucaccuaauauuuggagacaguucccuuacuggagcuugcuuauuuguugacuggacagugagcucuggugcucugccugucuccauguacccagcacugguauuacaaacuacugcagcugccuuuuauguggguucuggagaaggaagucguuuccauguucgugcaaucugugcauuauaaaccacaccguuuccucaggccuaggugucaagauucuaauuagaaagccauacauuaauuuuuuugcuaugaccacuuuuucccuucagauuugcuaaggaucaauauuuuauguugacuaaaugcuaggguugguaggaauagacacuuauuucugccucagacucagucuguuguuuuuucaugauuaaaauaggcacuguacaguuaacaguaggauaggaugugaauuauaguuaaacacagugucugucucugucucugucucugucucucuuuguagugaaaguuaaagcagguagaaauucuuacuggccuaauaccuugucuaccagccacugcccaacuucugcuugagaccuugccuggugcccaaucaggucuugguuuaaugcugcaggucaacaagauucugugacacugcuuuaggucugagccagcauccucaugucuuuguugagugacagcagucauuuuccauuugaugauucaacagccaguugcaugauuguaguauuucagaaaucugucuccaaggauugccuaaaugagcuguaucuuugaacccuacugguuuguauuuccuguguguugaaacaauauacuuacuauguacagguauuucugcacuauuccugagaguucaaggggacuggucaagacgagggaaaagccacuggaacaugaaugcucuugaguccaggaacauggcagagagaauacagaaugaaauguuuugucuggugacacugaguaagaacuguugacagaauucacucaaggaaugaaaguggcuuccccuuagaagaugaggcuauuaaaaugaguugucauggauuuuccauggaaauaaaaaucauuauucuguucaaauaauugugaggcugauaauuauaaagaucugaaguuagcaaaauuacauagcccaaguuaauuacauuaguguucucaaaccaaauauagaguaagauuaacauuucuaugucaguccagccuccuagccuuagcugccuucucccauucucuuuuccuuuccuggcuuuuucuuccccuucccucucuguuauuuuuccuccucccucucucuucccuucuuuuuucucuuuuguuauugaucccagggucuuguacaugguaggcaaacauuauaacacugaacuauauucagaauaucccaguuagcugccuucugaauauauguguuuagaguauccuagaugaguuuucaggaaaauuugucaaaacaagagacuuugaguuuuuucuuuccugugugugugugugugugugugugugugugugugugugugagagagagagagagagagagagagauguggguggaguucuucaaauaccagagguaaaggcauggaauaauuugccagcucuuuuuaugauauuaagaugauggcaccuagggcccuguucaagcuagguaagugcucuagcacugaacuauuuccuaccuccauuuaggacacuauuggagaagaugacuaaauagcuguuccuucuaccucccaaauccugggauuauagguguucaccaccaugccaaccuuauggugcuggagaacaaauuuaaggcuuuguacauaugagccaaauacuccuauaacuaaacuacagucaggguauuuacagaccucccuccucacuuaaaaauacauauuguucagcagccagucauaguugcuagugcacaccuuuaaucccagcacucagguggaucuuugaguuauagucagccugguuuacagagccaguuccaggacagccuuggcuacacagagaaacccugucucaaaaaaaaaaaaaaaacaacaacaacaacaaaaccagaaaauaugguuuuguuuuauuuuuuuccauuuaaacaaacuguuauaaaauuaccuagaguggccaaaacuuaaaauaaaagauuauauuuaaaauuuguguauguguauggguguuuuuccuucaugucugugcaccaugugugugccuuugccugaggagaucauaggaguucauuugaucuccugaauugguguuacagaaggcuguaaaccacuggcaacugaaucuagguucuuuggaggaggagcaaaugcucuuaacugcugagccaccuuuccaggccccauuuuuuuaaaaucuuuuugagacagucuuuguaacacagugugaauuagaauuuacuccaaacucauggcagucuuccuguaucagucucccaguaaguauugcagaugucagucaccccauaccuccucaagcuuugauccucugucucauuguaaaaagcuggaauugcagguguguaucaccaugcucugcccuguugaauuggucuuuuuuuggguggggaucuuacuuucuucaugucauaguaaaugagcagcaggaggccauuaccguaaucuuguuuuucugugaugucuucacuuuuuuucaguucaugguuugcucucugauuuccuguucuauuuacuuuuccauucaguguucuauauuuggacaacaaauauauuucuguggguggguuucuggugucccagauguucaugagaguggaauuuccccaagcacaccagggggggcuggguagcagcuuguguuuggcuuuguguaucuccuagaguugaaauaagaugguccuaaauguggagugggcagcagcucccuuuguuuugcuuugccuugcccucaguguuugcuuuagauuugguugcuggagauaccagcuucggggauguuuccuuugucauagaccucacuuucauuuauuuauuuuucuuuugcagcacuggagauggaaggcagagccuuaugcaugcucucucccacugagugauacucccccauccccuccacccuggacauagaacucuaaagucugcuuuuuuuuuaucgaagugacuguucuucagcauuguugguuuaaaugacaugccacgaaagucaccaucuuaagugaccuauguagaccucaguauuagaagguuguagaacauucucauuguaguucauguccaguggucaguugauucccuaacccugccaucgccaagcucuggauaaguguuuuguuuccucaaauuuuagaacccuuucuagauuuaauuaaacuuucggaguuguaauauuagacuuaauacugcucuccccuccccuccuuaccaaggggagugguugacguguuaguuuaauuggcaucccaccucaguuucuuucugucugucugugucugucucucucucucucucucucucucucucucucucucucucucugaggugguguaucucuguguagcucaggcuggccucaaacuuguaguuuuaaugcuucaaccuccagagugauggcagauucuaggcauggccuccuauacuuuuuauaugcagaugcugggaagggaacccagggcuuaaugcaucugaggucagcucuccagcugagcuacagcacuagcccuggguguuugaaaaucuugugaagucuguucucuccuucugccucugucugugucccgggaaucacacucagguuucucaggcuuuguaacuagcaccuugacugguugagcccucuuagaauuuuugacugcaguauaaaggagauauguagaugguucauaaagaugguucaugaagcccccuggccuucugauuguuuucauagaugaaacacaagccuuugauacugaccaucaaguaggcauuauuuuuauaaaacaaaggguuuacaagacucaggagcccauuuuagaaaaggggggaugauuuucuacccccugagaagugucuauucaugaauaaacaaacaaugaauggccaaugcagauagaagaauuggggaccuggggcuuuccucugggaauugcuuuucguuuguguggguucuguucugaaggggccuggcugacugacacuugcuuuacuuaagaauucaugagcuugcugucugcaauuuguguggccugcagccuccucuccagcucuugucugcuucugcuacaggacucuagccugcacagaucugucugcucccuugcaauuucuguguggcuccuggcuuucuuucagagauagcgcucuuuuucuguauuuuugauacaggcuuguuauguagccuaggcuggccuggaacucaguauguugccaauuuggcagugaucccaaaugaaaauccauucuuuuuuuucuaagaccggaaauagaaaaaugcugcuuuaagccgggcggugguggcgcacgccuuuaaucccggcacuugggaggcagaggcagacggauuucugaguucgaggccagccuggucuacaaagagaguuccaggacagccagggcuacacagagaaacccugucuugaaaaaaaacaaaaaccaaaccaaaccaaacaaacaaaaaauacugcuuuaaaaagagcccaggcugugcaaaucucugucucugccacucucuagaauaacaguguucuauaggguagaguaauuuuuuagacuuuuuuuuccuagcaaguucugcaauacugugcaaauaugcagccucauacuuuuaaucuauauggaaucauuuuacgccuguuuagcuucaccuacuuuauuuuuguuuuuauuaaguuauguugaaaauaaaguaggaaugaagcaugcauuuaaucaacuuuugguacacauacgugugcacacauaaauaucuguaaaacuuggaugacaaccaaauaccaaguauucuuccuacucuccaguuucccaguaccuuuugguaaucuuacuuguacauuuggauaccccugaucugcccucagauaaucucugauccuucuuccccacccccaaacuaaccuuuugugccugcuaggcaauucuuuuaccagugagcuacagccucagacccuggggugaauguaugacaauaaauacuggagguuguugaauuggccccuggugggcuugcuagcauauaaaagggccaggucccacucacaagcuucuuucuuuguuagguagugccugggucugccuuccuaacccgcuucccagaggcagcugccuuuggaagacucacacacacuuuaaagggcucuugccuucaaggaagucuuuaaaaauggugaccaggaauucauucuuucuuuugacacuuuucucucccauacuguucuuugucuuuuaagguugcugguagcugagacacuagguuucacauuuuuguaugugugguugaauaugacuccuggguuugauuucuugguggcaagaagaaucuauuggggauccccuggggugagcaagguagggugcuaaucaucuuuacaccccagccuugaaauucugccuuccucaucaaauggaggcuuacccuuauugaucccugccuguagcugguauggcucuuggauggagucuuggaauggguaagcaccuacuuaugugugacaggcugguaaucauacuuacuaugucuaagucugcaacguacuacugugccugcugggacuuaaugguaaauggaaugcauuacuuguuuuuucuuucauagccaaaccaauuccauccuuuaugcacccucacccuucauagagccagacucaagcucgucgacccacuuugaauuccuuggcuagucucuugugagaagugugauacaggaccauauugaagaagcuagagaucauaaaaauauuuagaucauggccagcuuuaguaauauugauuuaguuuauucggggaaaagauauguuugugugaaagcaagucugcaugauuaccaacuuccugguucugucuuucuuguuuguagguggugccaggaauccauccugugaauucuagguggaucucugccucugaguccaaaaccucagcccuacaucuuuucucuugcugcugagcagagcucauucuucuuagcauaaccaguucugaagaugcuguaggagggagggcuuauucgggauaauuucaugaauauauguaaucacuucagguacuguaugacugaccaaugauuucauccaagucuagcuuggugaaccaaugaguucuuuaggguuacuuacaagagaaaaggugacucagaggcaguuauaucacuaaaaaucccacuccagugugggugacagcucacaaaagcugcaucccuggaucuuguugcuugcucagcuuuaucauagagauuuuccucuguaguaauuaauuuacaugacuucagggaggggauguguggaccuuaugacuuaaaaaauuaaauuauguuuauuuaugugugcaugugcacaugcucacauaugcuccuuugccacaguuccagaguggaggucagaggacaaguugugggaucuggucucccuucuaccuaccaugugaguucuggggagcaccuugcaacucucuaagcguuccuaaaccuguaaauuucacuaacuuauuaauucuucugagccuauauccuccuuguagggaauauuugauagcaagaggacuaugucuaugagaugcuggaauuaaaaaauagccaaaguacaugguuaucauagcagaugcuuuagcuuuuuuuuuuuuuuuaagcuggugaugggguaauguauuagggagacugggggauaggaaugugagggugggugggcuagauagaaaaggggguggaugcuagagauugaaccuuggaccuugagcuuguguuaagugugcauuguuuguuuuacaaugacauuuuucccaagaaugcacacaacuugaccuuuuaaaguguguaguugagaaguuuccuaguguguuuaagaaauaguguacucagcauuucuaauucuagaauauuuucaucaucuuccaaagagauccucuggcaucaugacaucacccccaucuucccucuggccacagaucuccuuucugucauucuggcuuugcuuagaauuuauauuucaucaaaauggaguuauuacacguguccuuuaaugccugucuuuuugcuccuaauuaaaaaaaaauuggagccaggcauggugguugguaugugccuuuaaucguaaucccagcacuugggaggcagaggcaggcugaucucaaggccauccuggucuacauagcaaguuccaggacauucagugcugcaugguaagacccugacucaacaaaacauaaauaccaaagccauaaaacaaaaauccuguuaguuaacuuauuuauguauguguacacacauguuuaauuguguguauacauguauguggaagucauagguuucuucaagugucuuccuuaauugccauuaaccuuauuuuuugaguuaggaucucucaaugaucuuggagcucauugauugaaccaggcuugcuggccagcaagcucuagauuucaucuucuuguccccauauauacagagcuaugauuagaggugugugucacugugcuuagcaguuuuuacuggugcugggauuugaauucgaguccucgaguuuucuugacaagcaguuacacagugagcccucuucagcauuucaguuaauauuuuucuuguuuacccauguugaaaaaugguuagaguagagagggcuugggugugaggugaaagauauagggaauagucauagucagcaauuucucgugauuauauuagguguggagauugguccacagguacaguauugugcaugaaauuaagugugguucagcugccaauugagccugcacugccauuuuucuccuuucucuuuccaucuuucucucaguucccuccacccagaggucaacuuagcaaacagcucgguaugguaaagugcuuguggugcaaacaugaggaucugacugaggccccaguguccaugugaaaguuugggcauggguguacacacuggugcugccagugcuggggaaacggggaaagaaggauccccggggcuuacuggauaaccagcuggcuugggcugcugguucauugagagauccuaggucaaaaagaguaagguggaaaguauguuggaggaagacacacaagguugaccccuggccucuacauguguacacacacaugcaaaugcacacacacacacagaacucaacaugcaagaacauacagcaaguucuuuuugggggaggagaucagcugcuucugcugaccugugucuucuguagcagugcauuuuggguggaguguuaggaaugcuaggaaggcgggcuguucuguggugaagauucaggaaucuuuccugacuuucucaaaaguauguguggcauucuuuuggugucugggagugccaagcagguagaacauuccagagccacaaauuuugcugauaugguaguaaaaucaugaaguguuuacuuuucaguaccaauuguauauauagagagacaaauuuacauuccaggauuggguuugagaauauagagauuauuuuuauuuuauuuuguggugcuggcaaagcaaccuggaagcuggugcuuuaguaacuaaucacuccaucacugauuuccuucuccugaccucaaagcugauguuauccaguuuuccgugaggauaucaguacuuguuaugauugguaaggcugaaagugcuuuucugguuaaucaaauuuaaaauucaucacagggccaucaacuuaccagcucccuaagcaagauaguaauacccaccucauuauuguaguuuuuaaagauuauugguuuucuuuguauuucuauguauguuugcauguaaguguguguaccacaugagugcagugucuagggaacccagaagagagcacuagauagauagcagaauacauagcauggaacuagaguuauauaggugguugugaauugccauguggcuacugggaacugagguuuuauccgaaagaacaguaaguaucuuaacugcagagcgaucccuccagacuucuauuuuacaguuuugaaggucagaaguuugaagauagcaguaagcuacuuucuuuucuguaggcucaacauuuccuuacuuugaguuucuagaugcugucccuuuaugucccuuuauaguuauacuuagccaggauuucuuuuccucuuagauuuuuggucauguguggggcuuucacuuguacagcagggcccugcuucuuucccaagaaccucaggaucucuauuugcuucuuugagcuguugggacuuucucugaguuucaaccauagacacuucuguggacucugacuuuaacacugagaguugaacuaaguuugaagagacugccacagugccagcagaaguagcagguaagacccauuccugaaaguuugagaaugcuguaugugacucuguaggggccuaaauccauaguaccuggguuaugguaccacagaauaguagaggaaaaccaaugggauugggauuagaaaacuuggcuugcugaucagaguuuuaugcuuuagaaaguuuaaaaguguagcagucagcuuuuugcuguaguaauguuacauaacaaauaguacuacccuauucagaacauuacauauuuuagugucucuuacuugcccaguagucauugacauggccauagcugcuuuugacuuggcuagugccaggaaagucuggucagguugugcucugaaugauauauuauguacuggggccaagggauccuagggcaagucuuugugcuucuuucauuagauaaauuaggguagaaugcaggcacauuuaaauaucugcuugucacucucaauaacaucccuuugaguaagucacaguuuccuuaaggagguggaggguuauauuaguugagaauagcuguagagucacagggcagauagagcaagcauaguugucuauuaugggcaagcaagccagggcagcuuuugcuguuucugggagucagggaagaugaccuaaguaugagagucugguuacucuuaagucuagaaauaagcucuugauggaugcugagagccccgagagcugguuacauaaggaacuucuugguuuaagacucugauuuucagcuugcauagucacaauuagggguggagguggggagcuugccuagcaccaaacugguggaagccaggguuguucccaaaacaagaaaguguuuugccuaaacaccaggagaagcagguaauuggcgcaguuucaugcacuuuguagguaagagucaaaucuuacaagguugacccauauggaaggggaauuggugaggcuuucugaagggccagguuaggaaguauauaccuguaauguacagcacaugugugaaacccuggcuucaguccccagcacugggggaaaacauuaauuguccagaauuccacagauagcuauacaaagaccaguugaaagccaagggugcuaguaagguuucuguuacuugugaauuguuuuuuuuuuuucuuuguagaugcauuuuucagcuuuaguaauucuuuccuauuauucagauuaauaaaugaaucuuuuauuugcuguggaaaaugauuuuaauaagagauuuccuuaggagauuuaggguuuuuuuuauuuuugauuuuuuuuuuccuuuucaaggguccaugcugguuuuuaugcaaauaggauuuaggggcaagggcaguagugcuggacaucucaccaguccugauuguagccuuuuuuaaaagucgauaaaggccuauuuguuucacaguuuuaaauuauaguacauuuuuucaaggaaagcauaguagaaagaaauuggaagcuucuguucacauaacauccauagucaagagcauagaauacugauuuagauucuugauagcagcacuuguaccuucaauacuuuuuaugcacucuagaguaguugguauaugguaauuacugguugguugcuaaugucaucaguugcaacauaagugaaaguugcacucuugggaagguacuguuucucaaccaucuagcccuuuuuuuuuuuuuuuuuuuuuuuuuugguuuuucgagacgcgguuucucuguguagcccuggcuguccuggaacucacucuguagaccaggcuggccucaaacucagaaauccgccugccucugucucccgagugcugggauuaaaggcguucgccaccacacccggcaagcaucuagcucuuacaugucacuguuauucuccuuucucucuuuuccuuuccucccuuaccuuuuauguggaaggacaccguuuagcugagucccugcaggagaauagggucugcucccucccucccuuauucccucuucucuuccucucucccuuccuucccccucccccucccccucuuccucccagagucuccuguaucuaaggcuggccucaaacugcuguguagucaaggauaaucuugaccuuccauucguccugccucuaccuuccaagugcugggauuauagaugugcaucuucauguccaauuuuauggaguguugggggcaugugcaaggcaagcacucuagcaacugagccauuucuucagccccucuguucuuuguaccauguuaacuacccaucugcuaggcuguuaggacaagcagacaggauggugagacagaaauagaaacaucaaguaaauuagguuguggagagagggguggggccuagguguuuggcuucacuaagaaaaugagaaaucuggguaguauuuuccaagcauaggccuaucuuuuucaaaugucauuaugucacuaguuuagcuuauuuccaacuguguuuucugucaaagacaauugacaugagggccuggagauaugguucagugguuaagagcacuugcugcccuuguagagaacccccgauucaauuuauagcacccauauugaguagcucagaacuaccuguaacuucaguucuagaggaucuggcauucucuuuuggccucugagauaagcuacauucacgugcacauacucucacaaacaacuaaaaauccuaaaaaaagaucagugugaaaauaauguagucuuuucagaguaaaguguuaguaguuacaaaucaauaucuauuuucugcuuuuguuuuucuuuuuuaagaaaagguacccuaagacuggcagguaugauauuaaauuuuuuauuuuuacuuuuacuuauuugugcuugugugcaguuggcucauguauggaaguuagaacagcagccugcaguucucucuucuaccuugugggaucugggcauugaacucugcucauugcaaacuuugcaaaugacuuuaccugcuuuguaaccuaggucagaccuaaucucaggauuucucugcuucaguuuccugaguuuugagaugacagacaugugucaucaugucuggcuauccagaaauuccuaaugccugguagagaaagaauuuucuuuucuuuccuuuucuuuccuuuucuuuccuuuccuuuccuuuccuuuccuuuccuuuccuuuccuuuccuuuccuuuccuuuccuuuccuuuccuuuccuuuuuuaucuaucuaucuaucuaucuaucuaucuaucuaucuaucuaucuaucuauguaucuauuuauuuauuuguuuauuuagguuuuucgagacaggguuucucuguguagcccuggcuguccuggaacucacucuguagaccaggcuggccuccaacucagaaauccaccugccucugccuccugaguacugggaucaaaggcgugcgccaccaugcccagccauuuuuuuuccuucuugaaaaguucuuggaaaaucagccaaauuuauuucucugucccucucucucucucuucccucccucccuccuucccucccuuccucccuuccucccuuccucccucccuuccuuccucccccucucuuucuuuaaguuuuguuuuuaaaauugcacuguuaacaaauguagccugggcuguguuucuugugcuuuucuuucauucuuuuucuuuuguuuugucauguucuguuuuauuuguuuguuguuuguuuauuuauacugaucuagcuuuuagaugcugauuuguuuucuaacaagagugugguuuuaggugggagggaagguucggaggcucugagaggaguugggggaaagaaaaccauaaauaguauauuauggaaaaaucuauuuucagcaauagaaaaaaaagaaaauugauaaucuuuuuugcuuuuguaaauuuaaaauuuaaauacagcuauuuauuugugugguucuuguuugcucacacaugugcaccauuacacacaucuggagaucagaugacaacauaccaaaauugauuuuuuuuguccacuuuccgggcugugaauauggaacuuuagaucaacaggcuuaguggcaaaugccuuuaccuacugagccauaucauuacaccaucuuguguauauuuauuaaagaaguacauugguaccuuuuaaaaagguuuuuuucagagccgggcgugguggcgcacaccuuuaaucucagcucucgggaggcagaggcagguggauuucugaguucgaggccagccuggucuacagagugaguuccaggacagccauggcuacacagagaaacccugucucugaaaaaccaaaaaaaaaaaaaaagguuccuuuguguuuccgagccuccauccuuugagccauguuugcuuguugugaaugccugcacuacagaagagagguucacuuugagucccuguggcuccuucuuugcuuucuuggaaccaucuccacaucugcucuuagacuuguguaaaacaggaagaagcacuuaacagacuguuucguaaccuagauuugcucuuggccuaaauuuuauuuuuuucccucuuugucaaucuacccccuagacaaacggguuaaauugcaaaguucuucugagagaugcugagucauagaaaucccugaggagaccuggccugccagacaguuccagagccagcacucagcacaggggaaagacugaccucuggccuucauuuccuaguuuuuuuccuccuuggcucuagcuuuuuccauuuguagcugccacugauggccauguuaccaaauuuuacuccaauaaaaguggguagcauguuacucacauaagaugccugugcugaggacuaaggcaugcagaguuugggaguggagagugaaaggguaguuuaagaugucuucaggaauagggaaucacaguuagaugauuuuagguuucuuuuucuugguggaugugaggaagcuguugugaugucuaaaccuuaaagugaauucuaaguccuuucuuuaccacaguugauucucaucaaacuuggauaggaagccaaucuuaguuaaccacaggucagcacucugcuuauguuuguuuauugcuguuauaggccaggcuggccuggaacuuaccuagcccaggcuaguaucaauccuuguaucuucucucuagccuucaaccaaaggagugcuaggauuacaacuauggaccaucacucuuggcuuggaacuaauuauuuacuuuuuauuuuaauuuuuguuuacauuuuugagauggggucucuucuguguaguucuggaacuuuauauguaggccagacaggcuucaaacuuauccacagagcuucuccugccucugcaggcaugugacaccacaucugacuuguaaguaauucuagccaacaaaaauuaaaagcucaaaacuaugacugcgcauaacuuagucuuuuuguagaggauaucuacucuuccccacccuuuuuagugcauuguaucauugauguaggagaagcuaaaauugaaagaauugauauuauaaaggacuuuugcuuuggaaucuguuaagucacacaaguggaguuuagcuaaggaguggugccuuaaaaauaccccaaagguaaguaguguguuaaccaggcccguuagagauaagagaauuuuuggaugcugggaugugaaauguuuacuacccuagauugacaagccauuaggcucugauugccucacacuagacacauaagcuggauacuucaagguugggugugcaauguagggcuacaaucaucauuaaauucaggucuguuauuaaguccccugagcucuuaucaggaaagacauuuuaccccuaggugggcaagaugaccauaggcaacaacuauguggaaaaaaaagcaacccaacauugguaugcaucaaauaauucuggcaaaaaaccuuuuuuuuguguguguaacucucuuaucugccuaagcggauauacuugugcucucccauuucuguuuaguucuuugaaguguuacuggggcuagaaccagaaagaaauuaaggauggcaguauuuguggaaugcauuggagcuagaggguauauaaguuaguacucacugagcucuagcauaaaggucgcgucuccauuuuuaagguuuugaauggagaggagagucuuugauucuccuucacuugggguuuuaaccucuaacuccaccaccacacacauauacacagggucucuccguguagcccuggcuguccuggaacauuucucccauguagaaugguuaaaccuuguugguaauugaguuaacauuaaaugaccaaaggaagaggaucacuccaggaugaaauauggccuagcaggcagcacggaguuucaaccucugauagacugaacaccgaaccacuuuguagaaguguauuuauugauuguuauacaaaagcuauuuuuuagaguaagacaaguuuuucauaccaaaacccagaugcaaucuaguguuuuuuucaaggagcacuuuuacccuugcaauuucaguccuuauugagcaguuugcaauauucaauaauguaagacacauuucagguuugccaggaccaucuugugacuaaagucaugcaaaggcuguaaagcucccucagugggaaaaacaaaacaaaacaacuauaaaucacagaaaacaaugacauuuuuaaaaaaagcaaaacaaaaccaaugauuucuuuaaguuauaaguauuucuaaaaaaauaacuacuucauuuugauguuuauccuagauacaaugacaacugauuuuuuuccucuaccagauccccuuuuauuuaagcuauuuuaauuacauugaagauuauguagucacauagugaguagugucuuuuuuucuaucauauuguucuguagauaagccaaaauacauuuuaaagcuaguaaaauuauuacaguaaaaacaaauauaacacucgcuaggauaagaaaucuauugcauuuuuguuaauauuuuuucugugagcaaaauggguguaauauggucuuccauaccaacuuuuauaaacaaucuuuagcauggcaaaacaauaucauacugucuccuaucacaggcguguccuuuaucucuucugacaaaagacuauugaauuuuucauuggguaggauuaacaugccacacagccauuaaacauaacaguaucauuuuuagguuagucuuuguuauuucuccaaaguuucagcuugaugaguuaaaguccucaugucuccucaaguugucagcuuauucucccuuuugggacaccuccuuuugauggauuugucaugugucuuuagauguuucauuuguguggugguuucuggauguccuggucagugcaucaaauaaggagccaucugggacuuuuuuucccugaaaagauacaagcauaauuaacaucaccucaauguuagaagccaggcucgcucgcucucucucucucucucucucucucucucucucucucucucucuuuuuaauuuagcauuuuacuuagguugucuuucuuuaggacaaaugcuuuugggcagcagaaaacucauuaucuuuuaaagugaaaauuuaaaaaaauuaacauagacguaguauagcauguggggauguaaguggguuuaaccucuuacucaccauuuuaauuuuuaaauuugucaauuaaguauuuauaugauggcauuuuauaauagcuugacccuuuggauagaaagggauuuuagcaacaugauuaauauuacaaaauuuuaaaucauuuguuaacauaagcagaaccauuaugauuuuuaguuguaauaaugaguccuaaaaaagacauguauauaaaaggguuauuuacccaaguuaaguuucagauaugacacaaugaauccccagggauccauggggcuugaggcuaugcuuucuagcugacuaguuagggagaggcauucugagugccuugagcucagaucuuuacauaccuggcagcagagauuguccaagacauagacagcuguauuuuuagaugucaagcugauguucauuuauuacuaauuaugcauuaggaguuuggaauauuguauaaaaauugucuuuaugcuauaugaaacaacgucucuaauagaagauaggcucuugggagccucuuuuaacuacuuuucuugccagagucugaucuuuuaucagaucaagggaaagcuuaaaacuaaaaagcaaacaaaauucauuuaauuaacuuaaaugaauuaaauuguuauugacuuuuaaagauuuaaauuuaaggcuuuuaauguaagauuugguaucuuuaaaauuuaggacaaucuuaauuaugaguuuagaaaauccugacacacaaaccgauuggauuugaaaauaccuauucaacugauaguguaaaugaaacaaaauugugaacaauaucaaagcauaguaguucauggaggaagaacuuguuauaggcuuugguuuuuacuacauuuuaaagauagauugauguaacagauuuucaggcuguaacaaaaauaauuuuaggugaaaaauuucaaaauaaucuaauucuuacugauugcauuuuugcuuuaauuucuuuucgucuccaaggaaauuagagaaaauuguaauuauguuuguauuuuuugaccaguguauuaucuagaauaaauauuuuaauccuuuuuaauuuuaauuuucuuuuccuuuuaaaucuaucccaagccuguuuauauuguuaugucuaauuuuuuuguuauuguacaaaacuauaaauuuaaauauuugaccagacaaccauauaguaggcauaccugauuauaaacaaacuacguuuuuaguuacuuguuuuaagcuuaaccuugaaaacaaggccaaagcuugucauuauaaaugaauuaaauuuguacuuagcauaacuacaaacuuaguucugagcacauuaaaaaaaggugauuguuuauaagguaauugacuauuaguuuguaugucuuaauuaucuuuaauaguuuacaacaaguuaauaguuucuauaagauuagaauuuuauagcuuuagacauauaucucuaagucaauuuuuguuaaccugacuauaccuuuauaaccuuaggaauuugucaucauacaaaaauccauucuaauccaaaauaguaauaaacaaaggacuguuuaggacuaagaaguuuuauaggugcuuccuuuuaccaguaacaaccacagcuguuccuggcuuuucuccuaggcugauuuuuuuuuucugcaguguuuucuagagauggagguggaaguucaguauguuuuuuuuuuuucauagucaaaugucuuaauaauccauggaauaaauugauucauacuguuuuuaugauguuaucacuuaaauuaacgcaucuuauaauucuuaagcauguugacuacuaaucucugcucuucuucagaauuaccuuugcugcagguaguacaugauccuuuuugauaacuccagguuuacuuucacaagcauuuguccuggauucuucugccaauagauauacaaagaguaggcaguucagaugaaucaggaggucacagcaccucuccagacagagaggcacagcuccuucugcuugaaggugcucaugaggaagccauggggcuccuugugcuuuuauccacuaggagacugugguggagagcaccuucuuuggugcuggggaucgcacuuuccucagucugggcuuccaguugaauauauuuuauuguuauuuguuugugugccaaagucuuuuuuuuuccuuuuuaaaauauuucucucauacaauacauccuucccuccucuucucccaguacaccugccuuacuucccagucucccccagauccauuccuaauuucccuucagaaaagagcagcccucccagggaugucaaccaaacaaggcauaucaaguuauaaaucuaagaaccucuccucauuucaaagcuggaagagacagcccaguaggaggaaaagguucucaaaaacaggcaauugagacccuacuaccacucuuagaaguaccacaagaagaccaaacuauacauauaaucuuaacauacaugcagagggccuagaucagucccgagaaggcucccugauugucacuucagagaaagccuuugacagaguacaacccuccauguuaaaagucuuggcaagaucaggaauuccugacacauaccuaaacauaauaaaaacaauaugcagcaaaccaauagccaacaucaaauuaaauggagagaaacuagaagcagucuuacuaaaaucagagacaaggccgccuacucucucccuaucuauucaauguaguacucaaaguucuagcuagagcaauuagacaacaaaaggagauaaaggggauacaaauuggaaaggaagaaguaaaaauaucgcuauuugcggauggggugauaugauaguauacauaaaccaccacccaaauucuaccagagaacuccuacagcugauaaacaacuuuaucaaacuggcuggauauaaaauuaacucaaagaaaucaguagccuuccuuuacaaauaagacagguggagaaagaaauuagggaaaaaacacccuucacaguagucagaaauaacauaaaauaucuuggugcaacucuaaccaagcaagugaaagauccguauguuuuaauaaaguuagauuuauuuauuauuuuuaaagcaaggacacugagcugaaugaauauauuaggccuuuuuugucugcuuuuuauuucuaucucuaaacuauucaugccucauccauucuaacuuucugugaacuagacucaauuuucaaguaccucauuccaaauauuuccuuuuauuauauccuuuuuaguuaagucaauuuccauucucauuguaccucuaucuuucaugugcuaauuuauauaugaaguaaguaaauuuugagccucaguauuccuuaaagguacccauuuuggaugagggaaugcaaacuaggguuuuaaaacuauacauuauggccauaagacucuugauuuuuuuuuuguacuccauccauaaaacuaucauccaauuuuaaauaaacagucaguucagauauucaguggccgagaaaacaucuaauaaaaccugauugauuacagugaguuuagacuuuugaucuguauaacccagaaugaguacagucucuccuuuuuuggguggaauuuuguguguaaacauguucuuuguucuuuucaagaacaguauaaaaaagucuauaggauuuuaagauuauccauggaguauuuuuuauaaaaucuuaaaaaaggauuuuuuuuagauuccaaauaacauauuaauaugacuugcugauuauuaacaacauggaacaaauaguuuaccuguauuuuauuuaguggaaaauaauuuuuguauacuccuuaugagcuaaagccuuagcagacacauuaauaagcuaauaaccuuauccagguguuauauuuuuauagacuuuaacugagaguuucaagaaagcaacuuaaagagcagagccaaauccucaguagugauaaacagauaaaagucuacccaaugauauaguucaaaauuauauuuuguucuuucaguauuuacuaugaaaauuaagcauucauuuaagcauuacuuagccaaucaagagaacauccuccauauaaugaguaauaccucuauaaauuuaaacagcauuggcuuaguacuuuauguccuguuugugauuauuuuuguauuagaaguugggguuucaauuuuuuucucaagaagagaccauugauacugaguuauucccacuauuagggaaaaacaaaaaacauuucccaugaagggaccuuuaauacugaguuauucucacuaugagggaaaagcaaaaaacauuuaaacaaaaaucaagccaacaaacaagaaaauuuuaaguucugugccagcugugcuagcucaugcugcauuaguggagccccacccaucauuccuuggaauucuaguguuacugcucugcacugauggguccauagcagaaaaggguaacaaguagucacagcugcagaguucucaguuccagcugucauuaauuccuucuaauuauuuggaauaauuuucuucugcguaguccacuuacguaaaaucuuucuuaccuaggaugaaugcauuccauaugccaucauugcuucuuuaaaucauuucagaucugucauuuuuguaaguuuccaacuaaucugaacauaacuuuaaggauaaugaugauucacaggcauuugcugcauagcaacuggaacgaccugagucaaugucuuuaugaccuuaggcaaccauuccccaauaccaacauaaggaggugaaguagaucauugauuaaacauuucucuuuuuuccacugggaaggaccuuuuuccuggauuaaacacuucccuuucuucuaccaggaaaauccuuucuucccccuuuccuaucuuuuccccccuccaucuguuauucuuugucucuggagauuauuuauuuguauuuguaaauuuugcaaaugugcaguuagugcuucucauuuaacaagcaucuuagcaacuauauauugcuguucugugauggggaauuucccauaucccugccaaauccuggagucuagcuuacccgagauuguacuucacugccaguucuugaguguccauaccuuuuuucaauucaggccccauguugggcgucaaguguugguaauuaagguauucuugugaccaacaaagaaagagguucacucaaggaugaaauauggcuuugcagucagcagggagcuccagccucucauagacugaaugcuuugagaaguauauuuauuguuuguuacacagaaguuaguuuuagaguaaaacaaguuccuuaaaaccuagaucuaauauacauguuucuugaaggagcaccuugccuuugcaauuucagucuuuauuguguaguuuucaauauugaauaauguaagccguuucagguuugccaggaccauguugugacuaaagucuuguaaaggcuguaaagcucccucaugaaaacaacuuuauaaauuacagaaaacacacuguuuuuuuuacaaugacuucuucaaggucuaaguacuacuuuauucugauguuuacccuagaugcaaugacucuaccaauuuuuuuccuacaaaacuugcuguucugucauccaaauugccuucaaccagcaaacuuuugaaggaaaugacagcagucagaaauguaaauacauaguucucauggcuaguugcugcuuuuuguaauuuaaguuucaguccaugagaaugcauguccaauccaaucauuuucauucuggguuuuuuuuguuugguuguuuguuauuuucuuuugugacaggguuuaccugucuagcccuggauauccuggaacucacuaaauauagcccagacugcucuugaacucacagagaucugccuaccucuguuuccuaaaugcugauacugccacuacugccuggcuuuuccuucugguuucuucaguacuuaaaacucaaguuguguuuuaaaaguguguuacugaaaaaauguucagguaugacagacagcaagcaggacacuaccuuucaaagcaaggggaguguugaauaguguuucuguuacaaacuagcuuuccaaacuuggucaugaagccauguccaugcccaauaaauggaggaggccacaacaguaaaagugugcauugagggcuggggugguagcucagcugguagaaugcuugucuagcaugcauaaaacuaugugucuguucaacagcauuacaccuaccaggcauggugguucauaugucuaaugcuagcacuugguagaggcaggaugguccaggaguucagaguuacccucagcugcauagauaguuggaguucagcucaacuggggguagcuauaaaaagugacgggguccauuguuagugugguuuuuuuuuuuuuuuuggugugcguauauauguacauuuguuccuguuugugcauaugucaguaugagaaugcaguaugcauauacuuguagaagccagagguguacuguugcguuccacagaucuauccagcuggcuauugcauagccaacauggcucaagguucuccugucucugccuccauaguccuggaauuacagguguguuccucugugcccagauuucugugugggcucugcaaccuaaauucagucuucauauuuguacaagcaguuuacuaacugaacucucucuucaucucuguuuugguguuuugagacagugucuuaucauauagucgagguugaccuucaauucucuucaaaguacuucugccuuuucucucuugagugcuggcugaagccaccaauucuaacuccuccuuccuuuaaaacguuuuauuuauuuuuuaucugugucucugugugcacacacauguaugugugcccaaggaagcaacagauccuguggagcuagaguuacaugaauauauaagggaguugugucuaccugugcuuuacuaaauagaguuucacugccuuagaaaccuucauguccuuucugucuugaaucuguacauucccuuugggaauacuaccauuagggcuuaggcuguagcucuguuugcagaguguuugccuaccauucaugaagcucuggguugcauuccuagcacuucauaaaacuggacauagggcacacaugccuuccaucccaaacuugagaggugaugacagaggaccauaaugaugacaguccucauuggcuacauugugaguuagaggccacccuggccuacaugagaccuucugucacaaacagacuaaacaaaaugcuuccugucuuuuaugaauggagaaaaacagagaagcuucacaggucaugggguucaucagagcugauaucccaagggaagugaauuguguucucagcaaguaagaaugaggucuauaaagccuggucucuuucuagacaacugaacaguaaccccccuccccugaccccaugaugauguuuugaaauuugcuuaaaauagcuuuguguuuuauucacacaagaguugaauuuuuucuugugucuaauaucaauaacgugaacauuuacaguuaauuuuguauauagugauugugaacauguaacaugcuaauuuugagaacaaaggugcucacguucaagaggacuuaugaggauuggggaugcggcucuguuguagaaugcuugccuaguuugcacaauacccuggagugucaguaaucucugcccaguauauggguaaaguacaaagacugcauucaagcucacugaguuggaaccugcaccuucccaauacuaguuauguauccaagaguagauugugaacucuccaaguauacaguggacauuguuguguauguccugaauggauugugacgaguuuuacaguauggugcuuucagaagaacuggcauaccagcuacaggggauugacuaugcaggagaugauauuauuggcaccagagcagagacuuuuuccugcaguagggcuaggugauagacccauuaguacauucuuccuucuucuagacuaggcugaccuuugaggaaccugaggcugauuucuuuguuguugaaggucagggaggcuguuagugccuauguuuuggcuguuaagaugagaggaugauacuuuccugaugguuugcuggggacagguaucuggaauugcugcaaucucagugcugucuuuagauuuccaugaggauggagggaaagccuuucuaucaaaugacucagagagcacuaggccacuguuuaucgaugagcaacccccagcagacuucuugccugauuggaaaggcuuauuuuugggcaggguucuuugccuuaacucauucagccauaggcuauaaccucuugcaggaacuuuuugaauaauuuugguacuuguaaucuugcaagguccaguaugauugauaaucaugauccucacugauuucagaacccaugacucagggccugucuuaacugagaugccacuggaaaguauaaaauacagaacaaaauagcuaaauacaugauguaaugugaauggaaaugaugacucaggucaugaaccuuaucuuccauuugaucuggggugaucuuugccucaugaaguccaagagcuaaagcaauauaguuguuuauucuccuccccccuccuccuuauugucuuauugugguugguuuauuuucuuuuugagacaguaccucacuauuauguaguccaggcuggagacuccccugccucagacucccaagugcagggauccaagaugugcuuugcugguuuguaaaguccuuuccuaauagacaugcaugcucuguccacacacaguguggcaaggagguuucaugcuuuuauugcaagacacaugccuugguauugagauugagugacugugugagggcaggaguggcaguacuuaauuucaacagccacaauugaugacauccauagcauaggcauuucucaccaagaauguuagaugugugcuggcugagaguucagcaacagauacuagccacuaaagcugguucauuuacugauuugugcaagugagacacagaauaggaguaggaaguuggggggagugucuuaugugcaucugugguggcuuuggguuuaaguaagcaagaauuuauuuuguguguugagacaggaaguggauuauuaggggucuaggucugggagaggcuuagggauaaaguuaauauggucuuuugugagguggaaugaggaaggggcagauaggcuagccucaagcuggcagugcugcuaaggaugacauuaagaucucuuuugaggcaacuauuaggugagaguuuaguagcagcaguuuccuggaaaaugguacgaaggcaacuaacugucuuuugcuguuuauuucucacaggcugcacugaucagaagguggcuuuguuauggaugauaagggccaaccaauuaaaagggacaaaagaagcuugcuaaaggaguauuacagucuagauauaaaauuuaacaaauuacaguuuguuauguuuauucuuggguggauaauaauagaugaggcaggcuggugaggugggauaggagccaagaggcccaggaaaguagaaaggugaagagaagcuuugguggaaccauccccuccuuuucaacaugaggacuuggucugccaggggagggcagcaguguggccuccugacaggaaagugaaacugcaccucaagaggacagaaaaagaagaaaaauaauuagaauuauagcugggacauuuccuuggucuuuguugucagcgugaaagugccuuaggugugacacuggagcugagaggauugcaccacaggagagaugcuccugauauauaguugggguaacugaggugaggguaagugagcacacuagaucucacagcucugagcuguggggacaccaagagugggauggucagaggugaggugguaugauuucuaagccucugguuuugggauggcaugguguuuuuucaaaugcuaggguuucaugccauaaccgaugauaagaagcaguauaugaauucaacagugcccuugagagcccagaggccgucagugcagggaccccgucauguguuuaagagcaaccugcaggaaugauagcgugugagcugaacaagugugagggccuaagcucagagcccaagcaucuacagcaaaagccagagguguacucccauuucuggggaugacugcacaggaagagugauaccuagccuagccagggauggggggaagggggaggggaagguguaggcauuggaaggagguagaggggggaguuaggggacaacaaugacaauuaacuuguuucugugagcagauccugucucaagggggauuguggaggagagcacaccuuguauucuccucuugcugcaguugcaugucaguguguacacaagcacaaaauauguugcaguuggaggcagucuuuaaaagcacaggcuaaucugucaccuguuuuuguacagauaaugaaccagaaaggcuuuuauacuuuuuuuguuguuguuguuuuguuuuuucgaguuucucuguauagcccuggcuguccuggaauucacucuguagaccaggcuggccucgaacucagagauccaccuaccuuugccucccaagugcugggauuaaaggcgugugccaccacugcccggcuggcuuuuauacuuuuaucugaugaguguaguguguauauuuggaggugagcuggaaaccaugugaccgguuaaagugauguagauaucuaaagucagcauuuguacauugaguuucacaggaacaugguuguacuguguguguggcugucuuguuacaaaggguguugugaggguugugacaaaccaacuugacugcuuagggaaaucugugguguuuacugucuaggcugggggagacaguucaauucauauagugcuugcugugcaacaaugaggauuugagauacagucccagaaccuuuggaucucuggggcuugccuacccugccuagugagcccagauccuagagagagauccugucuuaaaaaacaagauggauggcacccaaggaaaaauaacacccaagacuguucuuuugcucuguaugcaucgguacacaugugcuuaugaaccuguguacacacacacacacucucucucucucucucucucucucucucuccccccacccccauucgaaugugcagagcguucagucucuacauguugucagguaugugguaggugucuacaucuuggguuguuucucuuguucaaccauguggggaucaaacucagauccuauuuuuauaauguagaaauugauggugcuuuucuuuuggagagaaaaaucuuuucugaggaaaguauucacauguguuaggcucuuuggugauggcucaguguuucaguuucuuuucucaauucauauuuuggcaugugcaguaggaagucaguguuuucaaccauuagcugugaauuugguagauggcuuuuccuucuuuggguguuuguguuguuauuguucuuuuugaggggaauggguuuuauguagccaaggaugaccuugaauucaugauccucuugcuuuuacuucccaagcgcuguauuguuuuucaaagcauucaagauggagggacacuaaggcacaaauauaaacagauacgcacccccucccuacuguuuugcucugaugagcaguggaaaggggguuggaagagagaagguuauguggacuacaauguuaacaaugacuucuagguaauuuuucaugacacccucuuaaaaugugccuggaaaaauggagagugacaaauggagagugacaaaucucuuugauuuuccuguucuacugugacccgaucuaaaaauaucuuguucgggagaugggcucaagaugcucuggucucuuuggccuaggauaguucuuuuucuuuaaaaugaaaaccaaaacaaaacuuuauuuuguguguuuaugggugcaggaauucacaugugugauggucagaggucaaccugcagcaguuaauucucuccuuguaccaugugcucuuucuuccagggauggaaggaggguccugagucaugcuggcaagcaugauccacugagcaaucuugagggccuugguuggaucagagcuuacagaaacuuggcauucuucacugaaucuucuggagucuguggcugcggggguggggcccaugccugcaguccagucuggcuucacugcagaacucugguuuccauuaugacuuuccuaaauaguccuggcccugcaccuuccuuuuaugaaggaagccagauacugguguacauguguguaagacuuauuugcugagggaccucagcaucagaaucaguaaaacuagaaccugcucaaggcucuaguuuuggcugaaccaaggagauaugauuucacaaagcuuagaaaguauaagaugugcugugaagaucugcggacaggaauuugaaaccauuuucucacacuagagcucaugagaugguuuggugaugggugaagcugagaacaagcacuaaaaggcaggugggcuccagagacccugaacauuggccagagaggaguugacaguccagugguaucaauuauagagauggggauuagcagacagaagacauggacagcuuuuggaaaaccaugcuauuuggaggguaagaaugugaugugucugcagcaggcugaagguaggagacauggaauagugaaugaauggggggaggugguggauccuuggagagacaagucugaccuugaagguagcgagagaaagaauucuugcuugccaaggauuuacuauuacuacaacaacaacaacuacuacuacuacuacuacuacuauuacuauuacuacuaguacuacuauuuguaggugcacauguuugaaaaacuauaccuuaaguguuccucauuuguccccuucccccuuuuugaggcauugcuucucauugucuuggggcuugcuuuucugucugucuucuuagcucugugcuuacucaccagaccuaccaugcucaucuuuaaaacaaaaaaccagaaacacauuuuagagaaaaagcauagaccuucaugcuugcaaggcaagcacuuugaacucacugacuuuucuccuaaguccuguuuuggagcuuauuacauaggcuagccuucuguuagucugauuggcuagccugggaucucuagggauccucuaguuucuaucucccuaacccugggguuauaagagcaugccaucaugucuguguguuacuuuauuuuaaacaugaaucugagggaccaaacucagcuaccuccccagguucuggagaauguuuuaacaugcguagugaugugggauguuuaggggauaacugagagcucuggcauccaucccccucuuggaagaaacucacugccuaggucucccuucaauuuaauagcccuggccuucucaguuucuccaccucccuaaaucuaucccuuguucaucuguggcagggaugggacuggagagugccccucuucucucuuggguucuccccucauaccagguagcccucaucaugcuguugccaaaaggauguuucuaaaacaggcauggcuggcucuucagccuuggggacagguuaucagcaauucccugugccaaggccauaugugccagcugccugccuuuuaggcaagaguuugugcugcuguuucuuagguugacuuuccucugauaccaagcucucuucaaccuuauguuuuuaguucucuuuaccaggcaaaaaaguucuuuuggucucagucauuucuaaauauauuuaaaauagucaccucaaggaagagaugagacacugcgauuauaacaguauuauuaagaaaugacuuacuggguaguuacucuuuccuucuuccuuguuucacagguauaucaugaaauuuaucuugucagucacuuuugaaguauauucucucuucucuucucuucucuucucuucucuucucuucucuucucuucucuucucuucucuucucuuuucauuuucugagacagggauucucuguguagcccuggcuguccuggaacucacucuguagaccaggcuggccucaaacucagaaauccaccugccucugccucccaaguguugggauuaaaggcaugcgccaccacugccgagcauauuacuucuuccugguaagggcauucauuuauaucauccagagauucugcagaaugccuuuaaucuuguagaucugaaacacuguaccugcuaacuauaauguuccaccccacuuccuucaugugcccaguaacuaccguauuaguuuuuuguuucugggguuggcuucucuauugaccucauaaauaaguggaguugcacagcuauacaauauugggggcuaguuuuauuuccuuuaagcuuaaugacuagugucauccacauuguagcaugugucugagucuuuccuuuugagagugacuaguuuucuacuguauguauauacuaucaguguuuagccauccaucuguugauuugguuuguuuccagccuuuggcuucugugaacaugcugcagugaaguugcuacacagguuaccucugagaucugauuuuauuuuuaaaucaucuguguuuuauucauuuuuuguuccccugcugucuucuucucacacccuuguguguaauguguguguguacaugucaugacauguggcagucaagagaacaaucuugggugucaagcgauucucauagcugauccaugaacuucuggagauucucuugugugccucccaucuuccucccauaggagugcugacaucacagauaugugcuacugugccuggcuuuuuagguggguucuagggauuugaacaugggucuuugucuuaggguuuuacuacugugaacagacagcaugaccaaggcaacucuuauaaggacagcauuuaguugcggcuggcuuauagguucagaggcucaguccacugucaucaaggcaggaacauggcagcauccaggcaagcaugauguaggaagagcugagaguucuacaucuuaugcugaaggugcacaagacuagcuacaggaggcuaggaugagggucuuaaagcccaugcccacaaugacacacucccuccaacaaggccacaccucccugggugugccauucccuggaccaagcauauucaaaccaucacagucuucuugcuugcacggcaaacacuaaacacuguaccuacugugucauuucaucagcuucugaaacaguucagacaacaugaucuggcaggccacauuagcugcuaccauuucaaaguaguguugaguguuguggaaugucugugccaucuguugaugaaucucgaguguugcuaauuccagcaggauuuaucaccuguauuaugaaaucugcugaaagcuuagugaaaguaaagcagcuuccaccucucccccaaucguccacauuccaacuaaguccuaagacugauauuuccagaacaccccuggugcuuuuucuuguguuaucuauagcuugaaguucuaccaugaaacauggcuuguucccauccccauugcucauucauucucuggcuugauuagcacuuucugcugaucucauuugauuaguauugucugauaaaccaugcugcagguauaagagaaauaaagacgaugaaggauguauauauguauuacuugcucauucaaaagagggaaugagaaacagacauguagccacaaaugccccugguuuacagcaaucaugaaggcuacucucaagaggaccuuuggggaauuggaugucuuaagugucuaugaggaaagaauguuuaagauagggggucucaagaaugugugugugugugugagagagagaggggggagaagaauaggaaggagauugcuugaaaauauuuccccaguauucuguggacugccuaaaguuaauucuugaguaugcuguacaguacccauggaagggagugcuauccuaauaugcuacuaucuccauagccugugauugcuuggagcagacugucuuagagauaggcagcaggggaaggaaaguagcuguuggaaacaguuggaauguucuagaagaaggcuuccuugagcuagagugggacaauauguugcucuuacucagcagaagaugcaugcucaaguugaaaguucuuugguucugaaucuugccucuugcacuuuagguuagagaugagcuugccauuuugauuugaauauuggaaggauuuuauuccaugucugaauugaaugcauacccccuuuuuucuggaauauagaaucuaacaugucuggaaauuugggacagauuuaucuggaagaggcuggaaaaguaaaaucucccuuguggcaaaugcugugcagaagcacuuguuguucccugcugcugugagaggaaguuauuagcuuucucuugaauauucaaauggucuggagguagguuucugagauggaauuauagaggugugcuuuuuagaaaggaauuauguagauuuaaauggaagaaacugugcagucucucaggaagugcuauggaacuacccugugcaagauuggugugugaacagagggaagcagcccccuuuagcugucauacaaaugugcugugcuauuuaaguagauguggcacauaaaacaauaccagccuggccagcauuuaaauaguuuucuaaguguacaauaugacgaacacauuguccucuguguguuuccuuauguauuuuguacagagaaaauaauuuuucccaaggagacauuugugcuauauucccugauacugugggaacugugaagucguuagguuuuaguuuucugcuuuuugcuucagagggaggaugcugaaauauguagugaugugugaguguuaugcuacacuccugccucaauuuuccuucuaguagugauucuuagaaauaagacuaauaaguacgugccugugguucaaaaugaaggauggagagaggagaugaagggaagagaggagaagaagauggaguggagugauggaggaggaaaaugaauguguauacauaugcauaugagaguuggagaugagaauguuagaguguaugucucuguagagagaaugguagaauguauguuucuauguaaaugugaggaaacuugcuucaguuugacaauuucauucuugauuuuuggcauuccagcucacuuguaugacauaaaucaccaaaaagagaagaauauccucaaauuuagauagcacaguuaaaaagcaauuaaaacaaacucaguuauuaaaauugaaguuauuaucuggguaaaagaugguuuaagauucaguguaugucaacacuuaucuuguggucuuaaaugaucaaugauggcuuuuaaaaauuguguucuuuuaagaauaaaaauacuacaugaauacugacuuuuuaaaaauuuagguuaaaaaaaaucccuucagccuuucaguuuagagauacccuugauuuuccaucacuucuguguguguguuguguauguuguguucaugcagaggucagaggucuguguauggugucaucuuuuauuguuuuccaccuuaccuuuuccuacaaggaaggucuuuagugaaccugaaguucuccauuuuagucauacuggguggcuccucugcucagugaugguguuaaaggcuuguagugaugugguugguuuuuauguggguccagggauuggaacuaaggucugcaugcuugugugaugagcacuuuacccacugacugaucucuccagcucuaguccuugaaaucuuugacauggaagagaguuaagauauucaggauauuuccccaaauccugcucaaauuuaaauuuuaauauuuuucuuauuuuuuuccucauuucuggugagcuaagcuagcuguuagcuuucccuauaagaacaggaauaggaagaauuccacuuauuuaagaagaggauucucacagaucugugcagguguaaggugacagaaucuccagagacauggauuguucucuggggacauucucuggauauuggauauguggauguauggacacacuggugguaaugggaguaagcccaaagaggugauaagaaauucuaaggaguauuuuugguuuugugagaauaacuguguccuuucuuuucagaugauagaacuuggcuuugauuucuuguugaaaugaauaguaaaagauggcauucuuggcaaucuugaaaguucaucuuagucuuuaauguuagacauuguaggauuccuucucuuauaacugugaagcaaauggagacaaacagguguuuaaaaacauuuuuuaaaacaacacuuaaagcauuuuaaaguuaauuguuuuuucucguucuaauucugucauggauguuuuuaguuuuggugguagauaaguauauaaauauguuugauacugaaaguguaagauuuaaugugaagcuucacaguuucuguucugagugguucuuuuaacuguugaguuguauagacuuugcaucugcuuaauuuugguacauggcauuuuauuuuauuuauuuauuugcaguguuuuuuauaaugaaguuuauaaaucaaauuuaaagugugugugugugugugugugugugugugugugugugugugugugugugugagugugugaguguguguguagcaacucauccauuaggcuaggcuggcccacuuauuucaggggucucuccgucucugacugccuggcccugggauuacaaauuggagccacaauaagaccuaccaccaccuauggguucuggagauugagcucugguccuuauauuugcaugacaugcauuuugacugagcuauuucccuaguucccagaguacugcauuuccaguuauguuuaagacaugaguaagcguauggaugaaaaaagcacaaaggaaauggagugaguauucaaggucauacaauguauacagaauaauuuuuuuacaguagagugauaucaaaucuaacagucuaaauuaagcaacuuagguuugagcacauacauuguauuucuaaacacucaauugcauugucauuaaugcacuaugucugccuguaguagaccuaucacaggcagucuuuaccuggucacaaccugaagcuauagccuucaugcuuuuaaaaacacuuuacaagccacaguauuagucauuacagguuauugcauacagccaguggaaguauguugaauguugaguaauucuuguuuggcuaagcauugacacagagugcuuggacugugugguguuaguguuuuguugguggugccccaugcaguuaaauacauuaugugcauuuugauuucacagguaaugacuacucuguguugaauuucggcauuugagcucaucuguugaugucagagugaagcuaauugugauugggguaggguccaauauacuauucauauauuuuccuuucucaccaugagaaaggugcaagacagggagaaaaaaaaaugacugcagguugggcugcugccugaauuuuuauagcagccaugacuuucuuuucuuuaguggcaagacaaggguuaauauauauuucccaaagucuguuacccaaauuuugaguaauccuagaaaguuuuugagauauuucacugaucauuucuuuuuccaacccaguuaugaaacaguuuacuagcucgcuccaugcauuuuuuuugcaguuaugagacaccuuucacugaaccauuugggacuuuccucuggaagcucauguuuauugagcucauugugagcaaaguaggauacuguggggcauggcuggugguuguaaaggaucuuuguccuuaagugcauuauggacuugagucauguauguuagugguuauauuguucuuggguucuucauguagaagaauaauuuuaguuagcuuuaaaagacuuaugacaaaauacauggugggauggcggagauaaccaucucagaggguaaaggugccugcuuccaagacuaccugaguucagucccaggcuccucguuguaggagaacaagcuccugcaaguugucaucagauaucuacaggccugugaguucagacuuggaugcaugcauacacaaagaagugaguaaaugaauagaaugaauguaauuuaaaaaguaacaaaaugccgggcgugguggcacacaccuuuaaucccaggcaaucuggaggcagaggcagguggauuucugaguucgaggccagccuguucuacagggugaguuccaggacagccagggcuacacagagaaacccugucuugaaaaaccaaaaagaaaaaaaaacaaaaaaaguaacaaaauaagaauuuacacauaccauuuaucauuuuaguccuugccauugucucauacuccacgucuucuucucugucaguuucuccaucucccgucugcuucuuuucuacaugcuucuuuugucccucuucucuucccuccucuauuucucuuuaacuccuuccuccuuccucuuuccucuuuccuuuucccuucuuccuaauaccucccauuuccuccuacuuuccuuuccccauucuccccacucuucucugugucuuccguucccccuuauugcucccuccagugcugaugauugaacucagggccaaaguaagcucuuucucucucauguguguuucuugucagguguguguuuugucauagccacaugacaaguagcuacuguaucagggguuaugcacuuuguaauacguaacuugacaauugacauuguggaaauagaucagguuuuguuuuucugguuauucauuugugggcacuugguuuuguucugccuguuggcaguuguuaaugcugcugcugugagccuuggugucuauugauuugaacuugugcuucuguugacaucuguacuagcucaguuugacacaagguagagucaucucagaagagggaacuucaguugccuccuuaagaugagacuguaggcaaacuuguaggggauuuuuuuuuuuuguaauugcugugagugguucuacacuucagcuggugauccuggguuuuauaagaaagcaggcugagaauuccauggagaacaagccaguaaguauuaucccucuauggccucugcaucagcuccugucucaaauucaagcccuguuagaggucccccccccccgacuucuuucaaugauggguuauugaaguguaaguaaaauaaacacuuugccaaguuacuuuuuuuucuuuuuaaauuuuuuuauuagauauuuucuucauuuacauuucaaaugcuauccugaaaguucccuuaugcccccucccucuccccagcccuacuccccaacccaccuacucccacuucccuagcccuggcauuucccaaguuacucuugaucaugguguuucaucacacuaauagaaauccucacuaagacagcauccauguagauagcuuugaacacuggcuugguucuaccaacaccaagaggccuagaucuguaucuggugugcacugggggaaucuauggaagccagaugggugcauuggaaauauggaugacaugggaaguugggguucugagccauaaucuaagaggugauggcucuggaagucugucuuuggugacugaucauacucaagguaugccuuuuuggguuguucaagcuugucuguggucagggucguggcaucgagaccucuaauagaaauggaugcugauugaaggaaugugugaaauguuugcuagggaggguauggaggucugauuacuaauuuaagggagagguuugaggacugcaggcuugaauccauuugacuugcaguuuuuguuuuuucuucucuuuagaugucuaaguuuuguuaguaaaugcauagcauuucauuuucauaauuccagccuaguuuguguuccaaauacccagagacugcaggucauauuugcuguggauauagggacguguacaaguauucuuggaggccaaagguugauguuggcucugcaccccugucauucuucaacuuguucuguaaccauucuguauuuuccuccuggugcugagaguguugugcuguaccuggauuuuacacggaugcuugggauugagcucaaguccuuauguguacaugcuaaacucuucaaccacugggcuguuggcuccggcaugauuguauugguggugguggugguggugguggcacuggcacuggcaaugggacugugccuugugcauucuaggcaagugcuuugucacugaaccacacccuccaccccacuuucccucuuguaaagaaggaugugugggauguucuuuuguauggguuuccagggagauguuugcuguuuauuuuguuuggaagaugccauguguucagagccacagacuaucuuccuuacuugcuggcaagccugaagucugcaugccaggccuuuggcagguacuuguggauggggaaagguuguauggcccagugccaaagugaaugugcacuugcugugaagaagcuggccugaggcccuuccacaguacucaagaugagaaugggcaguagaguagaugcaugacuuagcugccuagaacaugcuacucagugagcaggagggagagagagaauuggcaggagagagaagaugaaagauacagaagaugccaaucuugguuuuuaucuuugugcaccauguguguucagaaugaggaugaggguagauuguguugguguguguguguguugggguggguagcagggaauaucuuagaguacuguguauguguuuaaauuuguagagaccuugugaccuucacugcauucuuguuccuaucuucacuugcauucucagccuguuccuaucuguuugucugucuuucucauauccaugaagugagccucauuacucagccaugugcucucuaucaauuauuucuugucucaccacccaggaaccuuaggagcagcugagugaccaaaacuugaaugucauaggaccacaugaaaucugauguggggaaugacaaggaucaggauaccccugugugaauuagcuucuuuuuaccugugggagagucagaaaaaugcuuaaugaaguaaguuuugggagauuucagugaaguugcauaggugaacaacuuggugcauggacagcugguaaggauuauuucccuugggguguugugugauggucccuaccccucuuucuccagcuagcuguguucuuauuuuugacuugcucagacacccccccccccccgccacucucaaaaaaaaucccgguggcuuucugcuuuuacauacagaguuauguaauauaucaagggguugauuugcauguuuuaacuuuuuauugcugugacaaaauaccugauagaacaccaucaaaggaagacgacuuguuuuuagcucaugguuucaggaguuuuggucacucagcugcuccuaagguuccuggguggugaggcaagaaauaauugauagagagcacauggcugaguaaugaggcucacuucauggauaugagaaagacagacaaacagauaggaacaggcugagacuuccugauccagucacuuccauaauuuccaaucaacuggcaucuauuccuuuagguacaagaaccuucagggacauuuccuauucaagaauaucuucaaauaucuuuugauagucucuguacaguugucuuccuacuaaacuauccucugagauguggucaggacagugacauuuucaucuguguucuuuagaucugguuucuggagccugguucuugaaugugcacggcauuuaaucuuaaaccuugccucuagugauauacuucauucagcgaggcuguacuaccuaaacuuucccccaaagugcuacuaaugggggaucaaguguuuaagugccugagaccauggaaagcauuucucauucaaaccaucaaaccauguauuccucuagauagggucuuagaggagauccauauuugcacauagagaaccuauggauaugcagaaucuauccaggauaacacaucauaacugugugguaaucaggauuggagaggauguaguguacuuggugacuuugucaccaagacaaagucacagaaauuaagguggcaaugaaagaaaauuaaauucaagguccaugacucaugcggcuugcuaguuaggagggcuuuuugggccaagggcaaagaacaaagccuguugcuaagucauucuaggaacuggcuagccagaaagauagaagaggcaauuugcugauguuuaaacuguccaauuguguguaaccacgccaauucuuccccugcccccaacuuuuuuuuauauaaaccccuagcuucugagccucguggaagacuccucugucuccugcaugagacacguguggagcuccgucauuaaacuaccucgugguguuugcaucaagauggucucucgugauuccuugggugugggcaccaucucgggaauugaguggggagucuccccacugcggucuuucagcaacucacucaagaaggaagggugcuggaggagccuagacauugaaaucugagaacaggaucacagccagauggguaucccuaggaagagccaagucagcuuuucugggagccagagagaagacaugaaccaagaaaggacagcacguggccauggccugcccuuguagauaaaauccaccugcuaucuuucucuccucauaaagcugaccaucauauacaggaauaaauuaaaaacaggggaagugauaaauaaggcugaagcagcaaaggaagugacgccaaggauaaucacuguucccuucaaaagugugguuuagggccagacgaaagguuuguguucacaguucaugaaagacuuagaccuuuuguuacccacaagucuaaaugcugagauuuuguccuggugcuguuuucccuuuuuuuuuuuuuuuaaauaagauacuacguauucacuaaugacuuggauauuuuuuggaaaagccuccagggaauaauauugugaauuguuuagcaucuucuauuguuugugacuuccucugguauugucuuuuaaaggguaugaaaucuauccuucugucagcuuaggucagaaugcagucccuuucugcugucuaacuuugccugggcaugaauguaaaauguuccuuugugaaaaguguguuaaguaauuaacaauuagagggagaacuucuguuuucuaggguaaaggggaacuugagaaucaaguauaaaaauauaacugaagaaaauaaaggaaaaugccuguuuaguggaauuuagcucugauuaacucuacuaauucaagauugugggaacaagugguccuuaggggauaauagggcagugcuauuuguuuguauguuuuuguuuuuaguuuauugcauauucaguaucugaggugggaugccuaaguauggggcacuuaugccaugagagcuacauugggccccuucgguucuguuucuccaaggacaggaaagggguuucaccucuugcauaugaacucacuggauggauagaugggcaggggauggguacuguaagaacaguuuaccagaggaacugaugcuugaaaaggagauagauaguguuucaggguaagugcauuuucuggcuuccuccuuuucagauuuuguauacauuuauauuucuuauaagcauaugcuguuuauuuagguuaacauuaaaaagaacaagacagcaacaguuuaaaaaauaaaagcuucuuucucucuaaaugucacuuuccaugguaaguuaugauaauaguuucuuggauauuuuccaggauuuuuuuauguguaaguguguguguguuugcugcuucuuaguguaucuuggacauauuagcauaccaaugcacucaacaucccuaggcuaaucaugaauaggguuauugcagcugggauaacagaagcaauuuguagcuaagcuaauaagguuuuuuagcauugaggauaccaugggaauugaaugaaggcagagacgugggagugguugguuagcacgagucugggcaguuuugcuggacuaagaaacaagacaccagaaaugaacaguguggccuagauaccacagcaaggauaauagagacuauucuuuuccuuggcuuuguaccucaaaaaucagugugugcauuuuaguacguaggugacuauguucauucacagucaagaccaaggacuuggcuuucacucuucauuugacauuuauuagguuuugaugggcuauuaagcagagcuacauagcuuugaaaaguugacagcugauacguacauuguggucuaggaaaaugauuuuuguccacccuauuugauaccuuuuugaucuaucuuuuaucuuuuuuccuguaaggaccaaauccaggguguugcacuugccuagcuaaauaucuagcccuuucccuuuaaaaugaaaaaaugugugucccauauaauucguuauuuacaccugcaguccuaagcacccaggaagcugaucacauaagaccaggagccugagugacauagcaagacccccacuucaaaagcagaaauaaaccugaauuuugauagguugucucuucuugcaccuggguuugaaaaacaguuugaguagaggaaauaauuccagucucuagagggugauuuuugucauugguguugcuaugguuuuaguucaugacuugucauggguaaaauaucugacuuuuaacugcuuuggaaaauugccugcaauuuuauuugcuagguguguaaggugguaaauacgucguuuaaagauaucagaauucccugaaaguuuuuccauaaccaagugccuggauuucaaaugcuuccuccuaccuucaggcuguucccagcaagauucacugucuagcacuacccacuccuggcuugacacuggcugauuuguauccucuaagccuuguuggaagccacugcugcacuuggcugcuuaguguuaacucagggaccagcaagacacauccuacuaaguucacaugguacauuuuucugucauagugggagauacuugggaaccagguagagguaucccaguaaaucuucaugguacauuuucugucacauugggagacagugaaucuuaagugaugacuuggguuacucugugggguuaaucugguacauugccaucaugaauuugggaagaccuugcuuugaaccuuccuuaaauguaggagaacagacugagggaaacuacaauucuauaaauucuguccuuagcauucuuugucagguggaggaagaaucucauuuaugcugggcuggcugcaaacuuuccauguagcuaaggaugaucuugaacuaaacuuuccauguagcuaaggaugaucuugaacucguagucuucuugccucuaccuccugagugcugggcuacaggucuccugcaucugucauucccuguuuaugucgugcuagggaugaaauccagggcauugugcuugaaggcaaguauucuaccaacugagcauaugcccagccugauugcucagcauuauuuuuuaagacagaauggagcaaauauccacagaaaaaaagcaagauguuuuuagaagauagguguagagcaguaaaaacugagggaaccauucacuguguuaugucugucaggauaacauggguuucuccaccucucugucucucugucugucucuguccuucucucugucuuucucucugucugucucucugucucucucccucccccacucucucucuuugugugugugugugugugugugugugugugugugugugucuugcucuggguacuggucucgguagggaggaugaccugacuaggacaaaagcagugggaguucuggcucauguucccaagccucuuugcucagucacaucuccuucaucucacuucccuguucuuuguuaacauaccuaacuucuguagaugcuuuucaguuuucaaaauuuccuaaagucuugcugugacaaagaaagcaggugugauugucaugguguguacaucucagagacauauuguugcuugcuccauagcuguggaccuauugaaugugugggacaaaagcuggugccucggaauucuuguugaccacauguccugguugccuugauuuuguuagucuucuuugugucuaugagucuacucuugaggcuagggaaaggaaauaacugcucaguagucucugcaccaggcccacccaagcgagucauguuacagcuuucuguggaucucccuuuucaaagcagaagggaugcugaguaucauugacucuuuuuuccagcuuauuuaauacuuuuauuuauuuauuuuaaauauuuuauuagauauuuucuuuauuuacauuucaaauguuauccccuuucuugguauuuccuccgaaaaucuccuccccccucucccugcuccccaacccacccacucccauuccugguccuggcauugaccuauacuggggcauagagucuucacaggaccaagggccucucuucccauugaugacugacuagaccauccucagcuacauauacagcucuaaguucuaccauguguuuucuuugauuggugguuuaguaucauugacuuuuaagagaucguucauuuuaagagauguggcucaguuuucauccucacacucauuuuccuauuuuguuucuuagacaucauagggcacccaguuaauggaagaaagaagcauaguuauaguauguugcuuauguucaacauaaauguguguguauauguguguguacauauauguaagaugaaugcuuauuuccucaacuacuuuugauuguguggguaacugacaguguauguaugcauguuguauguaaguaagcauauacaggccagaggaggauguggauuagccugcuguccuuuagacagauucuuucacugaacugggaacuagauuggcugucagcaaacuuguaaucuuccugacuccucucuucacgacucugggauuauaguucauagagcuauaccagacuuuuuguaugagaccuguauauuugaacagcaaguauucuuuucacugaucauucccccaaucccuugacuuauuuuugugugagcuuaugcaagugccuucagaggccaaaagaggcuaccagauuccuugagcuagaguuacaggugauaaugaaccacuugacuugagcacugggaaucugacgucugguccucuggaagagcacuaagagcucuuaacugcggaaccaucuuuucagcaccucuuugacauauuaaaagaaaacuauuaugaugaugaugaugaugugugugggagaggaagagggagugccuguggaggucagagaacaguuugcaguucuuugcuuucaacguguagguccuggggaucuaaguuagguugugaugcucaguggucuuuaucugcucagccaucuaagaaauugcugccacagauuuuuuuaagcaagcauaggcaacuaguuagcucucacaguggucuucauuuuguuuuacuuaaucuauaagcauacauuucuucagucauuugauccuuguuuucaucgcugaggcuuccucauuguguuugguuuuauguuucuuuacucuucuuuguguuggagaaacuccucuccuuucucccaaggcaugggaguuugaugaucccuucguuuuauuauaagagugagauuagaacugcacugcuagccagguggugcaugccuuuaauccccacucuggggaggcagaggcaggcagaucuuugacuuuugagaccaaccuggucuacagagugaguuccuggacaagaaacccugugucuagaaaugagagagauacacacagagagacacacagagagaacugcauagcugacuauuuccauuugaaugaaggugcaucaguagauugcugcuuuuucacauaugucucauuccguaguuaaaaagcaugugcugcucuuacagaggaucaucauuguauuacacauguugagaagggcacauuuggggaacuguggcucuuuguuaucaggauucuaccaguccuauucacauggauguugacaguagcuggguucaugauaaacacaagcaaaguagaauuauugggugggucuacaauguggaaaacauuuuguuugggcaauuucuugagccacaugcuauuaguuaaauacaacaacagcaacaaaaaaugauguuucuaauucuccuauccauuuugcuuauauuagaauacaauauuauuuucuuuuagaucuauuuuuauuuuguguguaugaguguuugccugaauguauguguacuacaugcaugccauggaggccagaaaaggacguuggauucccuggaaguauguaaagacaguuaugagccaccauguugaugcugggaauucaauccugguccucugcaggagaaacagguaacuuaacuacagagccaucucuccaauccccuagucuaaaagagcauucagcugugcuuuuuuagagaagaguugcugugugauuuugauuugauuauuaacuugauaggaucaagacucuucagaccucuaagauaugccuagauaauguucacuccuuugggaagaccuaucguagcugugggugacaccacccuaugggcugguucuagacugaaugaaaaaacugagcugauuuacuucuuugcuccugacugucucuacaauuuguccagcuuccuucaaagguugugcuuuuucuguccugauagacuguucaaacugugagccaaaauaaacccuuucaucuuuaaauggcuuuugucugguaucuuguuagaacaauagaagcaaccaaugcagucauacauucuuuaaaaauguauuauaauccaucauugucauacuuguauuagaugcacaauuugacuaguugggagucuucaaggugagucuuggguuuuuuuguuuuuuguuuguuuguuuuuuggucaaguuccucuauaaccuuuuuaaguguaucuuucuuucuggggaugcaaagcuauugguucccagaguaaauucccaggcccuggccuagaauaagucuuaauuaccauggcaauuagaagcugggagcgguuaaguuugcucuuuguuggugguguuuggaucuuggcucuuucaguaagggggcccuggagguggguauuguuuaccuguuuggcuuccugcugauucucauugucagauguagcugauauggguucuccuacccccccuuuucccucuugcuucagugguuuucuuuuuccuuuguugcccaggccccauccuguguauuuagguuccuagaauuagggcuauugucgugcugauuuacagggaucucuggucuacaccugcugggcccaacuuugcauacuguuuaguuuuagacgcuuucaagcucugaacuuuuaaguaguugaugguggggggaggguggaauuaaaagugguaaagugugugauggguagcucaguuggcaaaaugcuuguucuuacaaaugugaggaacugaguucaaaucuucagcccuuaugugaaaaccuggguauggcagcacuugcucuaacaccagagcuaggcuguggggacagagacauaaucucuagaaauugcuagcuggccaguuuagccuauuagguucaguuugagacucuuucaaaaccuaagguggagagcagcugaggaagggcaucugauguuagcuguagacccucacauaggccugcaagcacccaaaaacaugaaccuuguuuuaugacaugagggacugcuuucaugaaagucagucuuuagccucagagggaagacuggggagggugucaggggaugguggccauagaucaaacuguucugaggauucagagccaaagacacacuuguaugacagcuuacucacuccgagcccacccuggggaauugguuucauuucuaagagccccuucacuugugaguuugguuguguuaaagggaguuacaagccugggauccuagaaauagccugcacaauauucugcaguuaggcucugcuuuguauguggggguagggcauggugauuggaguuggaugaaaguguucauugaaggcaugguuaaagggauaaaagagcuuugauguagacuguuuccagccauccauuuaauucuccguccacaaguggaaagaaaauaaacaaccauucaaaaguaauauuuauguaaccugcagaaaucucggccagccaugggaaagaugaugcgcuuugacgugcaggauggucucccgaguucccccuggccucgggcuucugagcaaagcuaaugagagagagagagagagagagagagagagagagagagagagagagagagagccaaucucuguuucugucggaauuuucugaaucuucuucauaacauagaaacuuuuuuuuuuaauggaaaaauaaguugcacagauuuuacauuuaggucauuuucauagaauguaggucacucaauucaauaggagaguaugcuguuuuuacuuuuuugguguguauauauguuguguguuggggagguauuuguacuaguugguguaugugcgugcauguuugcauguggguguagagaccagauguugggugucuuuccucuauugauauugguugucuucuagugaucucuaccuuuauuuuauuuuuuaaaauuggguuuccaaaaagacuuaucacaugccugugaauguauacuguguauguuuauaugucuauggagccaaaagaagguacuuggugucguccccuagagcuggaguuagagaugguugugagcuggugcugggaacccagcuugggucuuccaggagagaguacaggcuauuaacugccaagccaucuccauccuacauaccuuacuuuugaggaugagauuucucucauccuagaaugagagaugagaacuagaaacacauugauugagcuaggcuaacuagugguugagcuucagguaagagucucucugccuucaaauguugcuuggguuaaaaaucucauguuacgaaucugguguuuuacguggauuugggggaucugaacugaggaccuuaccgcuguguuugcauaggggguucuuuauccacuauggcauuuucccaggcaaugucuuuuagauuccccaaagaagggaaguauggugugauugaaaagaaucuagaaagauagauugagauaguguugaggauggaguaacucaggcuggcugggugugguggcucacuuuuguaaucccagcauucaggagccaaggcagaaagauuauuucaaauuugaugccacacugggcugcauagcaaguucuaggccaguuaggacuacauuacaagagucugucuuaaaaaacaaaacaaguuuggauuguuuuuauacugcaaaguuuugacaaguuaggaugcugguguguguguggguaugugggugggugcacgugugugccuacuugcuugguaugagccuaauaguguuggugugggagggguacuucuggucucugcuagcuggaagccuaggaugcuguugcagaucuauagcgcccuauacuagucuucucuuccuguccccagaauguuuuaccucaugugauuuuaccacuaggcugaaguuugcaacuccaacaagauguuccucugcucucauucuguagccuacauggcaagguuucccuugcuuauggaaguagagauagcuaaagauagagggguugccuuucaggcacaguguccccuguaagcacaaaggguagaguuuuguuggcucagcaccauuguuagacauauugucacuuccaaguguuuuuacauggagguuuuucuccauaaauaaaguuuuagagguggggaauuauucauggugcaaacuucuguguaccuguaacagcagcugcucagccaacucuaagguguagagauguaccuuuccuccucugaagaagcuucaaucaggcuggggagguggaugagaauucugaugccacccucuccacuauagaggacagguguuccagggacacugagcugagcucaggcagggccucuguagagcagguauaaaggagggaacaagugaggcagguacugucaaaaaaugggccaagaucauucuaggcagugcuuggguguucuggcagaagaggagauugggauccaagugaggucaagcaguaauuuugugccauucauguagacacuguguggcauguagcuuugugucuggugccaugugccugugcaguugaggaaugccguucuaccuauuguaugugacuugggagguauaagggagauagaaugagaaucuagagagcucuuuuauuuacuucugaguucaggaucauaucauaauuacuugugcuggcaucuuucucugucuuuauuguucuuuguugcuccaacuguaacuauuaauuuucauaccauuucccauggauucugagguggagaagauggaaugucaauacaaauccaaaagcaaguggggauguauggauuugcugaaagcaaagacaacuauucagaaaauaugaagggaggcaugggcaucuaugugugcauacauacacagcaauguucuuccuaccagcacuguuucuguaguuguaauuucagcuggaaucacaugguaaguagaaucauggccuaaagagagaugugucccuuucucacucccauaaacagugaguuugugcucuaacguggcuaaagggccuuugcagauagaguauaaggauccuaggauguauagauagaugguccauuugcauacagaguaaugacauacaugcucugaguagagguucagaauccaagcccugaaaauugguuuucuuaacaugcuuauguggaauugaaaauuuacuucagaaaggacagauuuggucuuacaauucuuagcuucuaguaauuagacauuguaugguuuuuacuagguucuuucuguuguguuuaacaagacacauugcaugcauuucaguuuucaucacaguuugacugaaaaccuguacuauguacaaauaugacuacauucaauaaaauuuauuguucagauguaauuugaauuagaaaccauucucuguguuucucacuaaaguauacuuuuaugcauuugagaggagugggaaugaauguauguuaaauuaccuuacaucccagaacaaauaaaggguuuucauguuuugagaaauugguagucuugagguuuuugacuguccaguaauaaugcacuaaguaugugguauuugacauuugugcaugcauaauccugacuucagagagcuuggagaacuuuuaauagaagaaaacuaugcuuuguucuuaguuuaaaaacuuaacaguuacuauaguuguauaugugugugugauggauugccuuugugugaauguagcugucacagaacaacuugaggaagucucuccccuucuagcuugugggcucuagguaaugacaagugcuuuaaccauugaaccaucucauccccuuguuuuguuuuguuuguguuugagacagggucuuauuauguaucccauucuggcuugaaagucauggcaauacuccugucuucccaauguggccaauuaccaggcuugugcuccaugccugucuaaaaaugagcuucauuaaguucaacacaaaauucacauaguauaguugaaugauccagugacuuuuuuuuauagguacaauuggguagacauuaauaucuuugaaaccauuaacaacacauugugucccauuccucccuggcagccacugaucuauuuguguuuauggauuucuauauuuucauuuuuuuacacagauguuuaauuagcuuuauuuacagagcagggauuucacccccuacccucccaauuuuccaguggugccuaaccucauuaggcaauaaugccaguuuaaaagaaauuuaugcagaauccuaaaaauuacauguguugguguuccucaagaaaugacaagcuuggccagcaacagcuacucugccuuaaucacucagaaacacaguugcuguuucugcauuccaugauuuugaagaaaaggucacuguuaauacauuucuaucgaauuauauagcacauguguuuucuuuucuuacauguuuuauauuguuuugaggguguauuuuggaguagaaacuugugcuucagcauuugcaugugccuaaaguggggccguaugcuugaccauuucaggauucuguccauugaucuuuuaggaaaaagaaaaaaaaagaaaaauagucuucaguggcagaggaugccguauuuuaugauaaaccagaccuuaggagaugcuucugguguguuugucuuuaguuaaucucuuccuacuucauauggugugucuggggguccugcuauuucuacucuucgaaaaauucuuaucugaagauccacuuuaauuugauuuuugcucaucugucuuuauuucugucaccaucaucccuaaauuauaguuuaaaggaaaauccagauuuuuuauguuagaaaacuauugcuguaugaagaauugacugagucagcugaaaaaaaauuccaagaucaccauuauauggaagcauuccacauggucuagagcaggaucuugauuuguagauaagguuaugagcaggcauagcaugucagugaagcaguagcugagagcuuacauccaaucacuagcucaaggggcgggggagagacagacagagagagagcaugcuauacucauggauguuauuuuaaucaguggguucauauauucuuuuguguuuguccuccuuuauuuuguggaauguuucucccacugcauccauucuugugcuccuucuguccuccuuuccucuauuucuuuaguacugaggauugaacucagagccuugaucguacuagacaagcauuguaccauugaacuauauccccagccuuguuuaugucucacuuugaaacagggucuugccaagcuggcuagaaauucacucuguaguccagacacaucugccuuagucuccugaguaucuggaaugacaagccugcaccaccaggcccagcugcuguaauccaucaagguucauuaacauuguagcauggauggauaguagauagcucacuguacuguuuaaugacaccucauuuuuauacuguaucuuguuuauuugugguuaaaacauaaugcauuuuguuuauucauuguuaaaacauacugcauuuuguuuauccauucuuaaauuggucuugauuauguucuuaggugcagaacuguugggucagauuauauuaugguuugaauauuaauugucugucauagaccaaugagcuagauauuuggucacuugcuccagugcuguuugggaagguuugugcaaccuuuacaagguguagccucacagaaugaacugggguuagauucuggugccuuacuuccaaucugcauugguuuccuaucuagguaagcagugugaccagcugcuucuaucuucaccuucccugugcugauggacuguaucuucuaaagcuuugggccaaaauaaacucuucucugaacuaagguguuugaaacagauguaaaucuuuaccuuuaaaaauuaaaucauuuuauguguauuugugucuugucuacacauauguuuauguacaugccugauguugauggaggccagaagagggcaacagauuugcugaaacuggaauuacagaagauugugagccaccaugcauuugcuagggaucgauucuagguugucuggaagagcagccaguguauucacccccccccccaucauuucucuauuguccucuaccuucuuuaucaggauuggggacucuacuuaaacuuuggagcuugcuggaguuuuuuuuuuuuuuuuucgggagugggggaauggggguuggcugguuacuaagcugcaacaucuaucuaucuccacuguaccugacuuuuuacaugggugucaagaucugaacucaggcuucaugcuuguaugacaagcauuuuuuaccaucuucccagcccuaauucuuuauucuacacuucuaaagcccagaguauaagacuuccuuugauuucaaaggugcaggacaaccaugaggucaacugaacgauacagaaguuuucagaacggaaacuuuaauucaggaaaaaagaagguggcaaggagugaaacucaaauaagauaccaugugugccuaugagggaauaugaacaacauuuucaggaaaguaagaacaaagugaagcuacagugaaaugaguagggacagcaggguguagaaguacaggaggugcucacuaacagccucaucgggccccgagggacagggucacucagucacucaaaccacuuguuugagguacaacaaaggacugcaaauauuauaagcugcuugauguauagaacuggagcuucauaaucauucugaauuccagagccuuauaauacaaaaugcuagcuaaguacuguaaaaugaugugaguguccuguauuuggcaaucagcagcaagagguagguguauuacuugcuacuggcugcugaaacaguauacuuucuauaaacuuagauauauaaaacagcgcagguuuacugucauacaguuuggaggucacaaaucugaagucagcucauuuuguuaaacgcaauaucauguuauuuuuuggauguuauuuucaggggaaacccauccauguuuuagaggcuaccacaucccuuaguccauagccccuuccacucugaaagccagaggagacugaucauauuuuuucuuacaaaggaucacaggcauuggcuuuugcccucuuccucauucaaagaacucuuuugagaacacuuguggauagaauugguuugugugauaugaacugcuuuagaagacuaguagugggagagcggcucuuguguguucuauuuaguauauacucucucauaaaacccagaguguuuucucuuuccuaaaugcugucagcucuuuagcaaccuaacauuuuuuuuuuaugguuuuagagcuuuauuguagaaaggcagggggaaagagacaagguagagaaaaggagggcuagagcguaagaaagaugagagcuuagaguccuuuuaucuguaacuuauauucccccuugccaggaaucauccauaguuccagcuugaggggauugaagugagggaaacucuaguggggaggacauuuuuucccugcuaagaauggaauuugaaguauuguauauaauucuugggaauguuacugguccccaucuccaccccuucugguggcauagaaagcacauguccaggcagcaaauggaaggaacauacuuuguuuguuuuuucucagacagugauuuaacucauggcauguuuuugaaugaugagccauggucugaucucugcuuuaggaagaguuguauauucuugcaggagaaauuaucagguugaccucaauuucuugccacugugcagagacuagagaaccauggaagugacagucuguguagauacaugaaguguuaagaauucuaugugguuauagucauaggacuuaauaucugguggguagaauucugugggugguggguggaggaagagaguccaagaggucaguguuuggaaccuggaggcaaagggcaccaguugguaagucagaagacugaagagaacuuaagguuggaguaaguauaccucugaaauaagaaguucuggauacccaaguaaagcugcaaaugaaggcugcuuuagucacuguucuguugccaugaagaaacaccaugaccauggcaacucuuauaaaaagaaagaauuuaauuuacuuucagagguuuaguccuuuaucaucauggcagggugguugguggcaugcaggcagacaugaugcuggacaaguagcugagauuucuaaauccagauaggaagccggaagagggagcaugggcuuuugaaacuuccaagcuagcacacuuucuccaacaaaggucacaccuacuccaauaaggcuauaugacucccuaauucuucucaaguaguuccacaaugacuaagcauuuaaauauaugaaccuacagggaccauucuuacucaaaccaccacaaagcccauggaggaaauaggagcuucaaaaaaagauuuaguguuaccaccauaacaguuaggguuaagacaaugguagugaaaugaugaugguagugaaaagagggccaaggaccucaccuucaguuuagaaauaugggagaugaagaaguaauccuaaagcaauaugacaacaauuuaaaacaauauaaaacaauugcauuguucccauacugacuuguuuuauacauggugacugggccaaaccccaguguagucagagguugcuuggaauggggaguccacguguaagucuccaagggcucugucuuugaaugcaguggcuauuacauaaggcacaaauggaggcgguucugaaacagcaaugccagaugguucugggaaguaggcaggucgaggcucacuguugcaucuguagaguuuauugagguuauuguuuuaacacaacagauguagaaagcuccuuuggugguucacaugguucuaaucuggggccucuuuuucucaucaauguugucauauuuaagaaguccuagugucuguguagagacauaugcucaggacuugacuuuuccuaguugguucagcaaaaaccuucaccaucuugguuauugaccaaguaaacauauggugacaaugugauccauuauccaaauauagacaguuuugaaauagaaucacuuaauaaugauucuucugucauuaaugucaacuucugaaauggcaaggcuuugugauauuuuuauaguuucuuacaacuguaauauuuugaucagugucugguaugauaaaauauuguuucucuaauaagcugacuuauuugugccucagaggcuaagcucucaagaguguuaaaaaaaaaggugguguuuacuucucagaguuacuacccuuccaacuugcagaauacugaguccauguguuucuacacuaaacuuacuugcuaaaauuuaaguagacuccauauauaccaaaugacuacuccuuaugugcaggacuugagauaauagggggaguccaaacauauccuacugggacuugagauagcucaguggucaagaacauuucuuguucuuccagaggacucagguucacaccauccauaaccgcaguuccaaggcaucugacacccugugcuaacccccguguguacuaggcaugcaugugguguacauacacaugcauacaggcaaaacacucauaugugcuaaauaaaaccuaaaaccaaacaaauuaaagagacagaaagacagagauggaagcuugcuuuauuuuuagccaggaaagcaguagagaagacauuugcugucaagaaaacauugccuuugcuguauuccuuuugucaaaggaaccuaagucacuggguuuuugucugagagaacgggauucaauuagucacucuguucacacagauaagaggaagagcagacacagggaagagccuauucaggcaguuggcucuuguauaaccagaacauacugcaauucaaguuugaggccucugauucucauauuguaaugauuguguuucuagacugaaauguuaggguuuuuccuucugaaauucccaacccaaauucaugacaauguuuuaaugcuagauguuucaaaauuauuucuuaaggaaucuggacaaauuuuaaugaacccaccagauauuguuaacagucuuauguauauagacucaugaaugugacuauuuuguaaauagucagaucuuuguguaauaaauggaaauauuauuuaaacaucgccauagaauacaguuucauuguguaguauggucuugcucuuuagguaugcuuuucugaagcauuagauuaugaaagccaagcuuuggguuuuacuguauagguaauccacacaauguuuugauaccaaaaaaaaauguuauucuuguaggccaggcaugguggcugaugccuauaauuucagcauuuagagguagagauauggggauugcuaggacaauacugaucuacauuucaaguucuggcucaauuagggcuacauaaggagaacccaucucaaaugaauggaaaugaagugaaacaaauuagcaguggauguuuaacuuaguugguggaauacuucccuaagcaugcaggaaacacuggguuuguuccccagcacuacauagagauaugguaguguaugccuuuuaauguuggaacucaguugaaggcaggggauaaggaagucaagaucucucaagcugcuuaaagagucccagaccauuuacauauacauagagucugcuucaaaagaaagacaaagaaagggucuuaagcuggggauguacuucagugguagagcacuugccuagcacaugcaggguuccaggguuuaauuucuagcauugcaauaaacacauuuaaaguauagaugaauaaaaaaauuuaaaaaauguucuagccuucaugcauuauuauuuauaauaaguugaaggcuugagggcaggggugaaugacccugaucgccauaugauagguuauuaaacaacuguuuaaaccaauauuauggauacuuacuuccugguagaggagacaccaugauccugaagguguuuccccgagugugaggcuuauccacugcacucuguauauacuuacuggcaccaaaaugugauugcaagauucagcaaguuuuuucugcaaccucuugugaccagcauguagcucauuugggcuugugagugguucugcauguauccugggaguaagccaggcugcagggaacuguaccauagccacccagauuuuauuuguuaguuauuuuuuaguguugccauuuagccaggauuaagaauuacuaaagaacugucccuguuguuucccccuccuugagaaugcuuucuuucugggacccgcagaagaaauuuuauacacgcauaagaagucuagaagcuggguuuucugaugguuuguuuuuauuauugaauaagcauuagaucugugguacccauccucccaauagaaugcuguguucauuggcaaacuuuggguuaguaguaccuucaugguggcuucagcucuauuucucuuuguuguuaccaucuacuuucucuggcccaucuuguuauuucauuuuuguuauuuuguaugugauugugagaucauuuccccccuccuuuccuggguggggaaagauaaggguuucgcuuacugagacuguugugguuucuuggagguugguagcuggcaguagcuuuugaauucugauguguuagcggcaugcauccuauuuuaaucucgcuuccuguggaagugccucggggacacaauguauuucuaaauuuagugugaugaauacuggaucacacaguuucugccagacccuaggcaaagcuuuggaggucauucaggucugaaugugagagauauaguucuucaaaagugguuuauacaagaaagauuucuaaugauuaacaaaguacccaaauccuugcauuuuacugcaauuaaaaagucuugguggcuagagaaauggcucagugguucagagugcucauuucucuugcagaggaccugagcucuguucccagcaccaagucaguugguucacuacuaccuguaacucugacucuagggacucuuuuucuggccucugugccauauacaugcacauacauauaaacacaaauaaaaaaauaacuuagaaauaaauucuuguaugucagguuuaacacacccaaguuauuuucuaucucuuuaccuguuaaagggugaucuuucucuaaacuccauugaagucugggccuuaaauaggcuucaugagguuuacagaaaaagcagaaaaugaaagugagguauuagagcuagaaauguucaugaagaccagcacucagauccccagcacccauguaaaaguugggugugguugugcccauguuuaacuucauaagcuggguaagaggugcaugcgcaagugugcaugagcgcacacacagacagaaagagaaacagagagagagagagagacauguaugcauucgccuacacccuaaaagcaaagaaaaaguuacaaggaauuagugcaaaaaccauuuuuauuuugauguaaaaaggaaaaguuugaaguaauaauuucuuuuuuuuuuuuuuuuuuuuuuuuuuuuuuuuuuuuuuugagagggagacaggguuucucuguguagcucuggcugucccggaacucacuuuguagaccaggcuguaaacucagagauccaccugccucugucuccugagugcugggauuaaaggcaugugccacuaccacccagcucaaaauacuuuguuuuuauuuccaguguuauuuauuaguugguuuauuuugucacacagucuuacucugcauuccaggcuguccucaaacuagugaugaggugacagguaugugccacgacuuuagcuaacugauaauuuugaugagccaggagcagagaaggaacaugcauuuuuccauauaucuuuaucacucccagcauauggauaacauuaggugccccuugaauguuuuaaggggaagguggaugaugaaaguuacccuacucuaccagguuuuugucuagguagcacaguucugaaugacaagacuauauauauuuugcacgcacuauggaguucaaucccaagaccaauuuuagauaugacauucucugcaugccaggagggauucugugcacucuuuaaugcaugugguagagucuguccuguaacauuguucccaucuuuuauuuacuuuauguaggcaaggagcagaaaguccugagugugugggacccugggauccuaagccagcugguucugccuuagcuucucuggccugggaucugugcucuugauuccuagaaacugcuucacacgcagaaaugaccacucagagaccaggcuccuugagaguacuuagcaauuuuuuaucaaggauccaaaagagcauagucugcaaggaauaacucugauaagacaggccuuacagaauucaggcguggaugugaaagauagagguguugauuuugcugcaggugugaggagaguaaauagauuuucuucaaggucaugagacuagacaaugggaaacuaguuaggaaaccuguucaauaccgcagacaaagagugaagggugggccuaaauggucuggcauucauaaaaugguuaacauauauugcaaagcuauggaugaagcaaauuuaccaguuugaucauggaaaaucauugccuguguugauuuaucucugaguucauugaucucccuaauguacucauauacuaccuauauauuuguguccucucagccccucauacuguucacaguagaauuuaccauuccaguagaacuaaaaauaguugacccucacccauacagcauguggcuuaaggucuccaguagauucuugauaccaauguuuguuugaaauuuuucuuuuucugugccugcauauguguaauaaacugaauauacauuaucacagcaugagauuaaaauaauaauaaauaaaacaguuguaccacuguacuacgauaacuauaugaaugugaauuuccuucaucauuaugugguacccacuauuccugugaugccucugugaugaagugaagaggguaagguuagcaugaagcuuaauauuaaguaaaauaaaaaaaauuugaaugcauaagcauuguagugcuaugacaagucauaugauaaaagagauguuuucuaacugaccaguggagaaguaguguauacaguguagauaugcugaaccaauggacgaaucucccucuagaugagguagaggggaacagcacaauaauucauacuuaaaacagaggaguuuaguugugggauuuugcacuuaauaguuuuaguucacauacagcugaaaucagcagaagucaaacuacagaaaccucaaguaaggaaggacuaguguauuguaacuguaggauuuugaacagcaucccagaugucucuacuauuucaaaccaagaacauccucauccuuaauuguaguagccuaagauguauacagaccuugucacugggugggcauggucacucacaguugggaacagccccuuagaaaacuugggaauaagagcuggagagauggcuccuuguuuuaagagcacuggcugcucuucuagaggaauuggguugcaguccuggcacccagcuuacaacugucuguaacuaguuucaggggaucugauaucaccuucuggccucuguggacacuguauucauguggugcaugcacaugguuugcauguggcagguguagauacauaaaaaauacacagauauucaugcagggaaacauacacauaaaauaaaauuaagaguacaguucacuaugguguggcuuacuuuuuccaccaaagacuuacuucuugaaagucuuauagcuuuuccaaacagcuucaccaguuggggaccaaguauuuaaauacaugagcagguugcagauauuucaaaacugcugcccauguauucugugagccuacacuggcugggcauauaggugccuuuuugcccauuuuuaugucuaaaugguucuguacaccucccuggggucagauggaggcaacacaccagagaguuagaauccccaauuucccuuucucuuuguccuuaucaccuuagccaugaagacaggauuauccuauaugcaaaaagcacagaggaugaguaacgguugcuacuggucucugagacaccauggggguacucaguucaguagacauggcccagcaacagggauccugaaugauaggcacucuuacuugagcuaggcaugacuucuuagcccucugcuccuaccugcauugaagcuaauguaggaauuacaagaucagcuugcauugaagcaugacuugagaugcuuccuauauugguauucaguugacugugcgugugugugugugugugugugugugcgcgcgcgcgcauuuguucacagcuauuugucuucagaaacuaggggcaucacauguucugaucuuucuccucucuucccugcacccagugagggacaucucuucccccuuauguuuuucccaccauauauuccuauacuacaaauucuaaacagggcuguuuguguccuuuaggggugcucucuguaucaggggaacagccucgguugucauggucagggugacuguguaggcuacuauguagcccaggcuagucuuggacuuaagauccuucuguuccugcuuucugaguugggauuacaguuguguaccacugcagucugcccauauaaaauuaucuuaugucauaccuugauuuaagagaacgaucuauauuuucacuuagauugcuuuuggaugacagaggagauuguguuggcagugagaagauugccuggggagauuucuguaacugagaaaugucauuuaugggcugcucaugaacagucugagaucaugcuaaacucugagcagguuugugugaacuguuucucugugugauuuuuuuuuaaaagagauacaaccaucaaguugaucagugacugccugccacuuacaugguucuuaguaguaaagcuacagaauguugugauauaguuauggagcacuucagagggguauauucuaagggaugcauccuuaaauuugcuggugggcacccauagagugcuuauacaggaaguaaccuaguuaugcaggugaugaaagaauauggguacacuaucuuguaggugguccguugcugccagacacaucuacacgaaguacugauugacuagacuuaacuaaaucacuuauuugcccaguuagaagauguugacaauauauacuuuagcauguguugguugacauuuuuaucuuaccuuggguauuguauauuaacagguaauugaagauagaagaaagggcugaaaaaagucaggagggggauuugccuauauuugcuucugaguaagugaaaugguuaaauguuuuuuucccacuauguagagauuuaacacaaccagccuccucauauuuccugagauagauagauagauagauagauagauagauagauagauaugacgguguuggcuuucugcacuggaaauagugauuuaccaacauuuuuuacaauuggcugauuuuacuagcaaaaggcugagaaagaaaaggaaagaauuaugagaaauagcagcaguaguuuaugacaaauaucuuuuacauuuuuuccuuagaugugcugaacucuagaccuugugugugccaggcaaggaugccagcaucuaccugcaucccuaaagccauauauuccuuuuuaaauuuaucuuuaggaagcuggagauuuagaccauucuuuuaaauuuugcaguacuggagauuaacaguccugugcacgccaggcucuaaagcuauacccucaguccuguaucagguuuagaaaacaaacauggagaguugacugcaaugugugugcuuuucaguggagcauagcuguugauaucuaucucuucugccucguacaugugagguucuuaauucaccagccaacccuagcuucuaaaaacaaauugaaaucauuucgcacuuuucuauauccuggguuuucucugucuucuaugccccuccugaaauuaguguagacuuggaagucuguaugucagccagauuauuuccauaaaugucuuuuagccccauucugagacauuuuugaugaucugggugguuuaucagaauagaaggaggcagccucugguagaauaguacuuuuggaggcugacaugcuuucuguucuuugucucucauuuuacaguggggcaugauugagagcauccauuuuaggcccuccuuaggaacagucucucauugcuggcaugguuguuuuugugaucuguuacuucuguccuguuguagagaauacagauauaugguugaguucauuuggagcaaggaaucacagaggugugguacgcaggcuguagugugucugggagugugcccuuugcuaaguacuuuguagcagcucuacugagauagacaguucgccuauucaauguacacaauuuaguguuguuuuuuuuuuuacuaauuucaaggcaucauaucccugccaucaaauuuaaaauacuuuuaucauucccuaaaagaccuuguaccuguuagcagucauuuuucguucucaccuucucuagcuccuauauaccauagaccuauuuccugugcaugcauuugccuggcuguggccuucugugugugcugguuuccacucugcagacuguuuucaaggacuacagugugguuuaguaucaaaguuucauuucuuaguagacgcaaauguuaauccaucaccuacucauucauucaucacauggccaguuuugaaaccucuucuuuuccuguggugauggguaccacacucugggcccugucagcacucuaccaagccuucuuauuuuucuuauaaauaaggcacaaggcuucuuuuuguugcucagacugaccuccaacucacauucuuccuuuuacucucuggaguuucagguauguaccaccauaguugcucaaaacuuuucacuuugaaaacaugauauacucauuggaaauuacagacauauuacuaugauuuccugucaugugacguuuucuaguagucacauuguccuauaggacauucugucaguauacauacauuugugcgugcauguaugagagaggaagacauaaaugcacaugcacacacacaugcagagacaagcauaaacaaacaaauaaaugaacacacaugcacacacauggagacgccaacuucuuagaagucuggccaaaagcauugcauauacagaacaagacuugaauggcugcaguauuggauguacaguacuguaguaagaaaugacaagcccuuagagcuucuaucuaaugugcauguuuucaguguaaauguacauuggaaaaagaaucaccauacuuuguuaguucauucaggcuauuguaacaaaacucuagaaauccauuuucucaccuuucuauagacugaaaguauuucugacuagccacuucuuuuaucuuccaggugacuaucuuucuguuguucucucguauuacaucaccuuuuuugguaugcucccccacccccccuuguugagagccaaggaaaagacgagagagcgagagcaggaauguuuugcuuuucuuagaaugccacuaaaccuuaauagaucaggacccgaagcguaugaacacauuugaauggaauugcuuguccuagaugcccaccagguuguaaagcugugaaugggcuggguagaggguuagaaauuguuccaugagguguccacuuagguuguguauauuuuuggcugcauugagcauggauauuagcugggguguuuuuuuuugguauacugguuucaguuuuuccaguguauaucuaggacuaguacaguuaguugcauuuuaugauaguucucuuucuaaccugauuguguauauuuguuuguauaagaguacuuagguguguaugugcauggggagcacagaggccaacaucagguauuuuccucacuugcucuguaccuuguuuuuuuaauaucagagucucuaauugaaacuuggguuuauugauucugcuggauuggcuagauugguuggcagcaaguccagagaucccuugcucucccagcucuccaucccugggguuacagaggugugcuguucuaccaggcuuauuaacugggugcuagggaucugaacucacgucgucaugcuugcauagcaagcacuuuauccaccaagccaucuccuaagucauaauuuuuauuuuuuguaagaaaaccccacauuguuuuucauaauggugguaaugauuugcauucucucccccucccaacaauauugaagaguucucuuugauuacauccucaccagcacauauuauuuuagucuugcugauuacugggauaaggugauaccucacuaugguuuucauuuguguuucucuggugauuagagguggcuccucaucuucucccuuccucccuuccucccucccucccuccaacccucccucucucccucccucuccccccuuaucaccuuuauuuugguugaaaauauacauauauacauacaauauauucugauuacuauuuccccucuccaguuccucccuacccauccaaaucuauaccuuuuuuucucucaguagaguaccuaugauaucuaacaauuaauaauaagcuaaaauaauaaacuaagggaagaaaaagagcuaaagcaaaagcacaagcaauacccagagacacagagacauacacauuggcucaaauuaccuuaaaaacacaacaccagaaaacaaaauauauauucaaaagaccuguaagggcgggggcgggggggaagaugagcccagucaaagcauuacaugcaaggaaacuccagaaauaccauugaguucauuuuguguuugucaucuacuauuggauguggggccuucacuuaaguaugguuuguauaccagugagauucaguuggacaaaacuaacuuuaccuuuugugugugugugugugugugugugugugugugugugugugugugguucgagacaggguuuuucucuguauagcucuggcuguccuggaacucacccuguagaccaggcuggccuccaacucagaaauccaccugccucugccuccgaagugcugggaguaaaggcaugcgccaucaugccuggcuuaaccuuuuaaagugguuaucaacuuuggagauagcuucuagguuaaggauggggguuugugucacauuucucaguucuaggaccccaucugguaaagacccaugaaaguccugugcaugcugccacaauaucugugaguucauauguuugccaguccuguuguaugucuggaaaacacuguuuccuugguauuuuccaucccgucugguucugacaaucuuucugccucuucuucuguauagcacacuggggcccuaggggaagugauuagauggagacaucccauuuaggacuaaguguuccaggacucuuacucuugcucauugucuagcuguauuuuugucuguguguuguucccaccugcugcaggaagaagcuuauuugaggguggcugagcacugauacugaucuaugaguauagcagaaugucagugggaaucauauugcuaaauuccuuuagcagaagaguaguaguacuuauuuuaccauagguuucuaggcuaucuaguuucagauucuugacuacucaagcagcauuggcuauggguuccauuucaugcacuaggccuuaaauccagucagugcaugcauuuucauggaaaauucuagacugcuuuucucaaaagguucuuucauaauucacuuuccaaauucucugcuacuauuuugggacaagcucuaccuuucuaugcuuuccagguuucaaaggaaaaaacaacaggagaauaaaagcagcagaagcaucuauaauguuucuuuuugucaauauacuacaagcaugauccccaggagcuauguuuaaagagcuguguguaguagaggggagccuguaaucccagugcuggagaaguggaaacaggaugccuaggguuuauaggccagccagucuggccaguggugagauccagguucaaugacagacccuguuuugaaaaaaaaaauggaauguugaggaagauaccaaacaucugucuacuuuugaucucuacaggcauguucacauguguacacacacacacacacacacacacacacacacacacacaguuugcucacacgugugcuaauacauacauaaaauacuuggcuuguagauacgggacagggaucuuggcauguuaguuuguaguaacccggguuucuucugacuguauaggaagcaaauguguagcucauuaaaauaaugaaagugaguagcaggagcugggaagagggcucaggguucaggcacuugcugugcaaacauucgggcuagaguuuggauguucagcccuccagauaaaauaguguauugcagcccaccuguaccacauuguuugggagacagagaugggauucccaagguaaccuagcucccuagaauagacaaauuggcaagcuucaguuucagugagagacuuugucucaauaaauuaaauggguagugaaccaggaagacaccugacacccaccuauugcacauauacacauauaugugcacacacaugaaccacauacauguaagcaugcaugcauaccccacauacacuuuuuuaaaagguaucuggacgaucuguacuaaauuguggagagaauguacuuuaugucauuuucuucaagugcucugcugguguuuuaaaacacacacaugccuccuguuauugugagcuaauuaaaauacagcucugcuacccccuuuuuccuuugaaaaccuaaagagaaguuuucauuuguaaggcauauauucucaaagcaggaguuucuggguuauuuacugggaugcauaaauauuuauuuugcuuuaugucucuaauuaacuuuaaauuuggcuaagaauuuaguuuauacuuuuugaaaacauuaauuggaucaugggcugcuuuuaugguuuuguuuaagaaccucugaauuaaaggcaacguauuugacagcaauugcugauguuuaaacuucuuuacaucuacucuauaaagaaacauuuucuccuaaucuguauaaccaaugcuuaauauauaauauauaugcauacaugucuccaaaauagcagguuuuagcugcacuuaucaccucucgacugugucuuucugcagauuuauuuacauggauauuugauaauuuucacucuguggauauuugucuuugucaguaagugggugggggguguuauuaaucuuguaugaaauucagauaagcaaggaacagauggauuuaaggcucugcaguugaggcuaguugaggaauuaugaauaaagaaauucugggagggcacgagauggcugagccaaugaguaagguacuugugugugaacaugaggacaugaguucuaucuacagaauccacguuaaaaaaagcagguaugauaguguacgcuuauccuagaaauagagguagaaacagguggacccguggcuugcuaggcagcuagcuugaccuacuugugugaucucucuucugagagaucugucuuaauaaacaauguggauagccauucuuaggaaugaaacccaagguuacccuaugacacauaccuuuccuuccuuuuacauaaaauucuugguugucucuguugucucugaugagucuuggacugaccuaccuaauuggccagagaauguauaucaccacguggagugaauuccuugucuuguuuguuuguuuuuuguuuuucgacacaggguuucucugugcaaucuuggcugugcuggaacucacucuguagaccaggcucuccucuaacucuaauccacuugccucugccucucaaguguugggauuaaaaguaugcuccaccacugcccggcuguugugucuucuuguugguuccauggaguugaauugguuucucuuugaguaaagaacuggugaguggggagauaccuucauucugugugagaaucagagaucuuugugugagcaguuucaaguauucuguaucccaagaaugacccuggaauccucaugccaaaaccaauuuuucaauugugauuacucucuggguguugaagaagccuuguuucuaaucccccuguuccauaguuuccaggugagugcccaagagguccagggggggaaaaaaaagagauuguguucuccguuggggcaucuuauaaaauguuauaugggccuacaacuuccuggaaagcaggcaacagguuguggggugcauuguucugugguguuacucuccaaugcaaaagcucaauucuuacauuuaggagggucugaaaaucaucauuauguuuucuggagaguccagcuaggaagguuucauauaaucaguggauucauggacagagaaucuuucuuggaaagguuugauguuggaaaagcaaagcaugccgugugugucagucuuguguucccaagaagaaacaggaagaaggaacuuucuggauggagcacguagagauagcuuuggaaauuauauaucuuuccaccucuuguggcaugaauacuggcaaagcaacuggacgccauccuccucuacuaacauuauuaacuccucuacuaacguuauuaaagugucccaggcaccauuguacuaaaucauacugggcagcuagcuagucuagcugaauuggugagcuccagguuuagugagauacugucaaaagacaagcuagaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaaaaaaagacaagcuagagagugauagagguuuugugcagaacauuauagaugaaguaugcaaggauuuucagauaacuacaguuuuaaaccuguugcugaucuccuaucuccccucauucuuucugaagaguaacauaugggagcuguuuucaucucuggaagguaauggcuuggguuuagaaugcagcaaggaugcccgggugacaguuaacugugcaagaauauggucugucacugaugaaucucuuucucucagugugccugcuguuuuggcauaggacuuuugcaaaugcugggcagucuaggagagcaagcuggggugacauucaucagagaacacccaguugcaugaugagauaaagggauucauuucugccuaaaggguugaauggaggugcuagcucucuuucacuccccuaaagccaucauuuuagacccaccucaguaguuaccaggcucauacuuuuaauuaauugcagagauuauauauguaauuauuagagcggcauauaccuucucucuugacuuucuacuuauuuuuaaaauuaugguucuuaaaaucauaggguccuccaauccuaaguggucaguuuguagaaaaucaguucauagcauuuuuaaaaauuaucuuauuguguaagugugugauuguugguuacauauaugcuacaacauacgaguagaaguuacaggacaacuuuuggaguugguuuucucccuccacugugagcucuaguuaucaaauuccggucaucaugcuugaguagcaugaaggcugugguggcugguuagcagagaggaagaggagggacaaaggucuuuuuuuaucuucuucacaggcacacccccucaaucaccuaaguucuuucuguacacaucuguguuuuaaaaguucuaacuucuuguggaucugcccuagggagcaaaauuuaugaacacaugaaccuuugcaaaauguuccuggugcuauuggcauucagugcacauagaagguauggauaugccaucuuacauugcuacuuggagaaacugcuucguacuggacaggugggaaggaucccuaugacaagauagagacaagcaaccagcccuguuuuauaaacaauaaauccagggacucugaaugaggucagaacucugccagcaugcgcaagguaggcugguaauucuaggguucagacagcaagccaggcauuugauugcucuuuggcuucccauacuauuucuccuuugguguucgcauaaaccacagacugaauguauaauugucuguuguuaaggaguaggggcagggauguugguagaaugauugcauagcauucacaaacucccgaguucauuccuuaguaccucauaaaagugaauauggugguacacacuuagaauucuaucccaucacuugcaggaggcaugaggucauccuugaccacauggcaaguugugggacagcauaggcuacaugaaaaccugcccuuaaacaaaacacagacaacuuggacauagcuugguggauaaagcacuuacacaaaugugaggacuaguauuuggaucuguagaacccacauaaauacuggguaggcucucauagcucucagaaggaagaaauagcaucuuaaagcaaacaggugaacuaaaguagcuuguguuuuagagcucuggguucaauugagagacaccccauccaugaauuagggggagagcaacugaagaagacucguaauaucagucucuggccuccacauucaucagcguccaugugcacauguauccacccccacaguaaccauacauacacacauguaugcacauuaggcacacaaucagguuuuaaaaacuaccaguaagcauuagagguaauauuagaaccaggcccugccagccucugcaauuuguuuuugaauuuagagaucccaggccugguguuacagcuucaugauggucaaguaaggagggauagcuaagcugcaucuguguguccuuaucauuuucuuuaacaaacuucacuuagagagaaacuggaaacuuaacuuggcaugccacucugggcagcaucugacuaggcaauuaauugggaaaucacaaggagauuuugacugacuuguaugcuaagguggaauuuuugaacuuccuauuuguaagccccauccccugcuaaucacacacucuggaagagguuuuggccucuggagagacacaaguuguagguguggucaucgguaaugcaugcauggccuguguguuaggauugacauuccaaauugugccaaacuagaacagacagaaaggagcacaggccuacagaguucugaaacaguacucuguaaaugcuagguacaacuagcacuguaauaaaacaagcaacuccugugcaugagugcacuugggacuucuguagcagagagaccgcugcuagcgcugucacacuaaguccuacguuucuuugagauacugcacaguauuguaauguuucuccucccaacgaaggcaagacagcuugccaaacagccaaaaacugauaauaauuaucauaguaaaagaaaccacaguucuuagaaacgaagccuauuguguacuguuuggcugaaaacgcaaaguaauauaugacaaguaugucagccagagguaguaagaugauuagaugagaauuuaaauugaaaucauuccaaaaauaagcuuucugaaaaccacaagaucccaggagaugugaacauuauugacuucacaguucuugaaacaaaagcuagucccauguguugccuacagguguagacaguuuuauucuuuuccuuuuuucaaaaucaaguuuuucgcuuuuuuuuuuucguaauaaaaaaguugaggggaauagcaagccacaacaaauugaucaaauguuauucuccaaauucaacucuuuuaguaauuuccaaagccuauucagagcugacuucugaagugugcuguaggaggcugauugaugucuccuguuucugcacaugauuugcauuuaguugguauuucacguugccuuggcuuuaagaacuaguucaaguccugguaccccuuuuccagauguaugaucuuuuaccacagucuuaguuucuucaccuguaaauggagaauuacuacccuuuagggcuaugugguguagagugaaaaacacagcagcuguggaagcagaugagugaaugagugaaggauagaccuguuggagggucuuucugcauugggcugggguugaguacacccuaaguggcucugaccaguggagcaauaauacuagggggucccugacucaugguggguuauguagucuuucucugaucccaacuugccugacauaucauacacacaucaucuaucuuucucaggauuccuauuucacaugcaugugagcagcuacaagccugaagaugacccuggagacacacuccugagaucaaaauugccuggaucuuuuauccaaggcuccaucagggaacuugagccaacuuguggaugcaagugcacaugugugcacucacagcauaucuguugagugucaccauaggaauccuuccagagacaacacacaaguguagauuugaaauuugauaugaaaauuuucagccauucaggaacaagguuccuaggauucccaaccuuagaagauagugcuccuaaucaggauagaguccauuuguugucaccacagauuguuucuguaugugagagauuccaaauccugcucuuuuuuccucaagaguccuagguaggaagugaugauugagauaugagugacauuuugcuuuacaauguacauggccaguuacucuuuugggagaguccugagucugcauguuuugucaggagccuuccuguguugauccuguguugaugcugaagaaacucuuuguuuucaccuggugugcuauauggcaacaaagagcuggagugcacgguaugaauuaucggcugcuuaauagugaguuguuuccucaguacacuagucuguucauuugaccaugcugcaugcacagaaauauaacuuuacuagacuuuguauguucuucagccaucucaauacagaaaaggacuagagagguaucacuugaagaaaauaacguacaauuagggaaugguuuuagaagguuuauuuuuuucccuuuuaaaauguagaauguguguguguguaagagugugcauguucauguguguacauuuacacauauguacauauacauuuugaugucagaggucaagcuuggucaggaaugucaauuaccuuuucauauaggguuucucacuguucuggcgcuuuccaagaaggcaucuguguggaugcuggguauaggacucagguucucaugcauauaagguaagaauuuugcaaacugagcuacaagcuccucacccauguauguaguuuugauauguguuaaaaguccugucuagggggcaaagagaugucucaguggguaaaggugccuauugccaaaccugagaaucugaguucugggacccacaugguagaaggagagaaccuacucaugaaaguuguucuuuuauccacacaugcacacucucuccaccaacaaaauaaguaaaauuuaauuuaaaauuguaaacaacccucuuuaggaucugagggauggguaagaauguuugguuguuaaacaagcaugaaacuggaguucugacucuagcacccuaaaaagcuagacauggcugugugugccugaacccugaugcugaggaauuuagagacaggaggauugugggucuugcuggcugccauccuagcucuagguucacugagagauccuaccucaaggaaaugagguagagaaugauagaacaggacccuuggcaucuuucucuggucuuuauguaugcacaacuauaugcgugugcauacaccacauucaagucuuuuugcuccacucaacccuauccuuaaaagcaaaugcgauguugccaaugugucuauggauagguauguacacgugucugcugcugauuguggaagcaagaagagaacaucagauccucuggagcgggaauuaaaggugguugugggcuaccugauguggguucugggaacugcccuuugcaguagugugcuguuaaccgccgagccaucuuacccuauauuaucuacucuaaguauauacccugugaguauucauguuauuauagcuguuaccacuguugagaaauuaagaaccaugaagaacaguugcagcaucgaugugucuaaaaauugcccauaacugagcuaaaucuguuuuuaaaacccuuucauaugcuguauuuguucauaaguaauuucauuuuaccuucuccaaaguucaucugagugaauccaauuuccuugucuauuuguacauucucuucuuauggucuguauguggaugauuuauuguguuucuggaauaaaaaaggaacagaagccugggcuuggugccacaugucuuaguuccagcucuugaggagguggaggcagagaaucaggaacucaaaaccagccucaaauauauagugagucaggccagucaagguuaccagagacacuaucuuaaaaaugaguuagugaaagagcucagggaauccuguggugauuguaaagagccagaggggauggagggcaccaggagaacaaggcccucugaaucaacuagacaagacuuauauggacucacagacugaagcagcaagcacagagccuacacagaucugcgccagauccucugcauauauguuauagcuauuagcuuaguauuuuuauaggacaccugacagaacaaguagggcucugacucuugugucuauucuugggacucauuuuuucccuccuguuguguugccauguucaacuuugauaugauaguuuuugcuucaucuuacuauauuuuauuuugccaugcuuuuuuuuaucucuuagaagaagccuguucuuuuccaaucaaaggaaggagggagggagggagggagggaaggaaggaaggaaggaagaaaggaagaaaagaaagaaagaaagaaagaaagaaagagagaaagaaagaaagagagagaaagaaaggcgguaggccuggagggaagaggaggaagaggggcaggggcaaggacugagaggaguagaggaagggauaguauaaucaggauauaugacauaugagaaaggaauauuauuuucaauaaaaauagcauuucagacacauuaugggauaaggaauacuaaguuuaaaacgcacaucuuuuaaguaacacaauuauggucuuuuaaguaaaaauauucaaaaaugagugagugaauaaauaaaugaauguauagauaaauaaaaacaaauggaaaaugaguuugcauuugguucagauaggucaaaaugguuggccuguacacuaugaggcuucuuaggagugcgacacucaugaagggcaaggccuacaaauauuugugguugucacaucuuaaaggugcuacaggcaucuguuggguaggcucugggucauucuaaacacauucccauacacaagacagacuucaagaacaguggguguucugccaaaugccaagagcaauaauguccugcaguauucuguacuggcuccacguuuuugaaaggcuuaucuguuggaauaucauccuggggaaggccauggcccuagccuggccuggugagcauggagggaacaguagacauugacuauuuuugaagccuaggcaaagaagcucuucccuuuauuauagacuucuuuuauuggugugguuuuugagauccauauugcagucaguguuuaaucauuguuccucuguaucacacauugcuugcucuucuuuuauguguacagaccacuuuuugucuauucauuuuugccugacauuuccaucuacuuuuugauuaauggauauuuauauguguauugguaggggaauuauggggagaaaaaaaugauaggaucauguccuagcauccaccugcugggguggagccaggacagauucccuaaccagaacugauagcaauuuugaccccaggaaucugcuuuguucacaagaaucuuaaguaagauguucuaugaguucucccacccccagagccagaagauaggggaauacugacaaggugaauaauuguuugaaaucauuuuguaaucuuccuucgucuaaauguaaaauauauuucucuuuaaaucaguguacugcccuagugugcuuucucuccucccuucuccuuuuacccacuccucuggucaccccgcccucauucccaacccuacccccaggcuuacuuccuguucagaacagguuuucuucucuccuuuuucuuuucuuguugcuguggauggaaccuagcacuucuuacuuauuagccacacucguaggcccuauuuuauuuuucugucuagaauuauuuguaagcugguuuacuccucuacaaauucagccuuccaaauuccacaguugacauuuaucuucuccuguggugccugcuugcuuuaggaugcacccccuuggauaccacaaccccagguaugugaaaugaugcuguaucuucauaaaacuaugcacaucugccuguaugucuuaauuucucucuaggugccuuacuauuccuaauccugacuguauugaaaaguguuguguagagaguuuuuaacugugcuguuuaugggaauauuugagaguacacaugucuaguagaaauuuuuuuccuguaauguuuucugucuauaguuaacguuuucaguauucuaggaccccucagauagagagguaagaaaacccuuuuaagacagauuuuaggaguucuaacuugaaacucugaaguaugaaaacuuccauuuuauccuugcauucugccaucuaccagcaagggggccuagagucugaaagcuuucauaagguuacaguuuaaaaaaaaaagaaagccauaagaaucccaaguuucaagcuuuuugagccacauuuuaaaaaaagccggcauauuucuuuuuacagccaacccuguucuuaagacagucucccuucuccuuugggcuuccacguuguccuuuccuuugguagaaaaggugguuuaggacuuguuuuguagagcaagcacugcuagcaacaugggaacaggccuucuaaucuuuccaaagaggacaggacugcagcugaaagagcaaucucagaggcuguaagcuggccucugccagcugggcuuugguaauuccuaauucugugugacugaugaagaugguaccaaguauguguguguauuggcucucccaaggacaccauaggauguguggaagcaucuagaaacucaaauaggaaagauauuuuauuuucccuuguaaugugguuaugucaguguguugugugguguauuuggagacagccuaguagacuugaggagacaaaugaucauguuccacaugugaauacaucuuuugccuaaaugcuagucuuguuuagccuuugcaugggaagcagugcucuggaaagacaggaugaaaaggaauccuggcuuggcacauaguggcaguuaaugauucacaccccaugcaaaacagcauagcuuuaaaucuaauucauguuucucuuuaaguggaaaaauauccugaauugguuuguccguagcuaaaccacugagaaacacagcagauuggcauuuccaguacacacugcugacauuugggcaaugauauuaaacaaauaggaaugggugaaauaaaacugaauuucaugcugugguuaauuuuucuaccuuguuugaaagaggaucucuuuuacuauucacuauacugcaagcugcggaguuucagauaauauugaauuaaagguaguucauccaauagcuccuuccuuccaguuacucaggucuacuaggcaaacuaaggagucauaauuaacacugaggucagcccuccuaauuuccuacaaaauaaggggucaaguguauuuaccauucuacaaaaccugaaagcugaucuugccuccucuggaggaaaguuugcucuccaggguacguuugcaaguaucuuagagacauguugggaucaugauucagggaaggguacuuaauggggaaagaccaacaguguuguaaaauguccuacagcauacuggacaguuccuuaugcaaaaugauacccccaccccaagaacauuucauaagcacugugcugucuuucacaugacaaaaaucuuuccagacauuacauaaugcucccucggggagagggaggauaauuaccucgaguuuggaagcaccucucugaacucugaggcuguaaaaucagcuguuaguucccuucuucugaguucagguaaguuuaagcuacacugccaguugcccuggcuuuuuguagggaaagaaaucaaauuccaaagcucucugcuuauucacuuuacaugauauuguccaccauugugacaaaauaccugacacagacaaauucuuucaaaaggagaaaauucagugggggagaaaaugacucuuucauuaaagugcuugcugcuuaaggaauaaaaccugaauuugauccccagcacauauguaaaagccagacaugauggugcccaccugcaauguugagugcuauaggaguguaggcugaagaaccccugggacaugcugaccagacaacucaaauuggcaaucuccagguuuagugaccaauacugucacaaauaagauagugagaaagauugucaagcuauggccuccauaugcacuuaugcacacguaugggaacauacauaagucaaauuggggaggaacauggagacuuuuuggagcucauuguuucagugauuuaagucugugguugucuggucaauugcuuugguguuaggcaggcugaacauugcucauauaaguguguggaggagcagagcugcucaccacaugguggucaggagggagugggaucauaugugcucagggacaaggcacaucuuucagugaccuuccucuagcuaaaccauaccuccuuaagugucuaccaucuccugacaauggugacagccacccacagagucagucaguaaauucuuggugcaguuuguugaacucuggagauguuccaguuaggacccagggaaaccuuucugggucauguuccauuauucuggaucugaauuuaaagcucauaauagcaauuaauggcuguguggugugagugcaaggauaagggguucagaaagaagauagguugcauggucuucaggcuuuaaccagguauugugugguaauuuccucagagauaaaaccuuccaucuuggaggggaagcuccucaagauaauggauauucucaggggaagugaaacaauucguccuguggggaagcaccuuaaccccauaaaguaaaacaacucaaaagcuucaggaacuuccugaaacuauugagaaucacuaggccacucccacuccaagccuauguaagccuuaaggacugcugagagucacuuucaggcuagcugagcugucuagaagagacacugagcuuccuucaacugagcuuccuucaacugagcuuccugcagguuguguaugguauaugcuccagguucucagcuuucaugaacuguugccuaccgacacugagggucaaggggggggguccacuuuuagugaugccgcuguauuuaaaagucauuucugcucuuguaagaaugccuucacccauauucuuauaaguaaucccaauaaaacucauugguucaccaguauagaaguuggaaguauccuuucuuuggucuauuguugguucccuauuuggauugcauagacaucagucaagccuccucaggacuagugucacacuauaccacaaagacaggcuagguaauguuuaggauggcccaaauugucuuuuaaucacauuugcgugugcauguguguguguggggggagaugagcuaugcagaaaagauuuuaugagcaguccugggcuuuggagcacuuacuacuuaagaaugggacguguuugccuggguauuuuuauuaauuucuuucuugcaaugcuguggguaaagcccagguauucauccaugcgugcuaggcaaaaguucaacuguugggcacuaccucuauucuucuuuuuuauuuuagaguguaagguuagugauguguuucaaagccuggaauuguggcccugugauauucuuguugccuuccccugugaauucugcagcauuuuuccucccaaagauauuguuagagcagucuugaaugaccuuuugaaauccuucaacaccucuuccccugccaccucacacacauacccaacuccccacaaggcagaauguauuuuaaaugcugagagauaacagacauggacagaauggcucuuaaggaaagguacgcauggaaucucugaaauguauggaaaguguugacauccagcagucuucaagccaaggguagagugccuuuuguaacacuuacuccuuagggguagagcuucugauaguuuacuuaaguacaagcccuguuuaauuauucaggugcaucaacuuacuguggggcucagauucaauaaguccguuguaaauugaaauauuauaaaggcacaaauguauuuuaguucaccuacccuaccaaauauuaaagcaggaugucuuagucuguuuggacuguuaucauuaaauaccagacuggguagcuuaaacaggaguuucuuuguaggcuggaagucuaguaucacagcauagcagauugauaccuggucauggcugcuuccugguucauugauggcuucuucuuucuguauguucacaagugagguuucagggaguuuucuggagucucuuuuaaagcaaaucagccauacccauacugcuucacaauugugacuucaucacuguccaaagcccaaaucucuuaauaguguaucuaucaucuuucagguggggauuuaacaggaauguggucagguuugggguuuggagagaggaugauuauggcauagggcuucguagauuggaaugaguccccuagugcauaguauuuuuuuuucuuucucaauagaaauacacauaccauucaucuuaagccauacccuuguuaccaaacugaucucauugguaauacuucauuacaaacugguaaaaccuaacagucauuacuaaguauugugugucuagucccauggacaccuaugauaauuucugaaugugugccaauccaggucucauacuauauaggugcuuuacuggauccaggagggaaaaugaugaaugaaacuuguuuucuuuaugguuugagugggaggaaucagccaaagcaccgacaccucucucagcauaacucuacugaauucaucaguguaugaacccagcauuucaggagccagaaggacugagggggaagggcugaaggaaggcggcagcuuuguaguacauccuuuaagaaaacuuggaaucuuacccagggagaaaggcaggaggggagggaaauggcacccagucugccacuaccauuguccuucacagcuaauccuguccuuacaguaugagccaguagggagggguucuuguggccauguggguacccaguagaggucuucagaagaugaagugggcugagaccuggauuuucugcggaggcuauauccccuggacucggguugaccuuguuuguuugugugugugcacacgagcuuguucauaugugugguuauguaugcauacauaugcuugugaagacuuaaggucaaccuuggguaucucagauucuacccacucuuuuuaaaaaggccuuccacacuggccugcaacucagcucacaguugauuagccaugcuggccugccagugaacccaagggauuuaccugucuuggcuuacccagcucugggagagcuucccaucuuuuuaacuugguuucugggaaugaaacucugguucucaugcuugcuuuacucuacacauugaacuauuuacuaucuucccaguccugggcuuggauuuuauuucauuuuaugacugcaaaaaaggaugcuaaagcuauucauccauaggccacuuccacauuuguuuacugcugaaccuuaaaugacaugguuuggaaugguguggggucugcauauacauggauuuuuuuuuuuugagaaaacucacaagcuguacagccuggaaauauccgaaaauuaacuuaaugucuuaaauguaugaaauguacauagauaauggucuauuuuauuauuuauggucauaaaauaauauuauuauauaaaguuagaauuuaaggaaugagguauaacccaguaauagaguguuuguuuagugugugugauaguacuaaauguaaaaauaauacuugaacuuguucauuuugucaaguugacacaagcuuagacguaucugggaagagggaaccucaaauggggaauugcuucucaucagauugguuugcaaccaagucugugaggcauuuucuugauugguugguugauuaauugauugacugacugauuaaugugugagggcacagucugugggcagaagccacuuccaggcaagugguccggcauuguauaacagagcaagccaguaaccaauggcacuucaugggucuuugcuucaguucugccuccagguuccugccuagaguccugcccugaacucucccacuaauggacuuuauaaucaggacauacaagccaaauaaccccuuuaaacagcauuagaaaacagcugggacagcacuaaaauacuguaagaagcauuaaacauuagucuucuuauaucaaacacuguacaacuuuuucuuuuuuuucaaauuuuuauuagauauuuucuucauuuacauuucaaaugcuaucccaaaaguccccuauacccuccuccugcccugcuucccuaccuacccacuccugcuucuugguccugguguugcccuguacuggggcauaugaaguuugcuagaccaaggggccucucuucccaaugauggccaacgaggccaucuucugcuacauaugcagcuagaggcacaagcucuggggcuacugguuaguucauauuguuguuccaccuauaggguugcagaccccuucagcucuuggguacuuucuguagcuccuccauugggggcucuguguuccauccaacugugagcauccacuucuguauuugccaggcacuggcauagccccacaagagacaucuauaucaggguccuuucagcaaaaucuugcuggcauaugcaauagugucugauuaugggauggauucccggguggggcagucucugaaugguccguaauauacuuaacacuuaugauggaauggguuucauaucuuuugaaaaugucagucaaguuuuagucauucugauuguuacacaccuucauauaauugcuucucguuggagaacccagaagcaauagaauccagaaacucaaaccacagacccaggcuugguucuugauucaguacugcaugucugucuugguccauguggccuugguguucuuagagguguucuuguaggugagaagcugcagggcagagcauucugaugcacuggacacgucucccaguuaauggacaucuguucaccuuugaaacaugccaaaaaguggacauaaaggcaggugccuacauuuugcucagggguguaagcugcucaccacucucuauaagucuugcuccuuuagaagucacuucaacuuugcauaguacuuuauuuugauacuucugagcuucaaguccaucccuuugcacaugcuaggcaaguacagaauugugugugugugugugugugugugugugugugugugugugugagaauauggaguuaagagguugguguggaugucuuccuugguuacuguucaucucuuucauugagacagcgucucucaagguugacuagucuagcuagccagguuguccuggagacaucacauaaccaucuuccuaaaugcuaggauugcaaguaagcuucuauaccuuccugguauuuaugugggucugaacauaaauaugggucuguguggcaggcgccuagccauugucaucagaguuucucuuuuguugaucuaaaucccuuuaacaccauuuuuuuaaaaaaagaauaauuuuagaauaauacugauaguaaacugaauacaaagacacacacagcugugcauaguuuucauaggacugaaaacagauauuaaugugcauugaaaucacuaaaauucugaguucaugauuugguaucuugacuuauucccucuccagucccugccagcacacacaguggcucuagaggcucacaaucgaccaugggugagcucauggaacaauaagcauggguacaaggucaaggucaaacccaccacagguucuguuuacuaccugaagagucacugugugaccuuugaagcacacugugugauuauuuuaaaacucuaugguugcugucauaauauagaccagacauauguuagaacacacauugucucuccuuuccagaagccacagguuuaacaucaagaugucauuggauccauaggggacaauaacuuucuaccugagugccugccuuucugugaccauguuaauagaauaccauucacacuagaguguuagcuuuccccuuuacaguugaaccuuaucuuacagauugcuaugcagccuugaggguggccuuuaaggccucuugauucucauaucuacuuccucaaugcuggaauuuuuacaggcauacaccaacaugcccagcagaauucaguuaacauuuauaguguuuuauguguaugauuguuuucccuguauguauaucaugugugugccuaguaccugguguaggucagaagaggugggacugaaguuauggaugguugugagcugccauggugaguacugugaacaagaucugggucugaaagaacaaauauuugucaccaugaacccaaccaugguucuuuuuaaaagaugagaucagaucauguucugggugucugcagauucuucaugucauuuuagggaacucaguccagaccauaauaguaaacauacaccaccccuuuccaccccaccuuuuuugguagauuuccaugcugcccaugaaacacagagcaaucaaaggaauucaggcagguuacauuuuuugccuuugucaagcgaacauguacauaguguaaguuuuucugccaauuaugaugucuccuaaaagaccauuucuauaucuaagcaacaagauucaaagcuaaacacagaagcuggaauugaaguuuguggccuucuuaccccucccaacucaugaguauuuuaggugguauuuuacugacugaagagcagguuuuggguugaugaggcaugaguugaucuguguuguugucauccucuugggcuuuucucagaaaucguccaugguuguaugcacuagguagauuuugguucagguggcuuaaacuaaggaaugcaaugagcuuugguacagguauggucugaguucccacucacaaguacuaaagcagcuugugacaguggcguggaggugcucuuugagucaggugacuuugcacaaagcugugauccucuucucgugauggguacaaaggaagagaaaaagcacuuuugcccuggaucuuuuggugcccagacuccaaaggcccuuccauagaguacugugcaguuuucuucaagagaacugauccuuugagucuugggugcuaagcucaacaucuuucaacacucauagcuauuuucagggaaguguguuauacaaacagauggccugcugagaaguacucuguguuuagaagucucagagcacagcaggggaggccuugaccuuggaguuuccucucaaugguguucguuucaaauguaaacaaggcguuaccuugguaguguaucaccagccaccaagcucaacauuuggcaacagauuggcaagcccuagagaaucagcuuucaguagcaguguuauggguuggggggugcaguuugcauccugcauuaugauuagaaaccucaaagaaagguuagaaaccugcuucauaggagggguacaagguagugggcauguguauaguuauugguuccaugaugcugaaaaccaugaccaaauaguucagaagugugcuuuggagggaaguaucaauuaugauuuaugauacagcaugagucugaaucuuuaaacccacaaaggcagguuuccuuucugggaagucuguucuucugugauguagggcuuccuuaaaucuucaugucaugaguuugcuaugaaauagcaauagauaagaggcugagacuagaagauucuggacuuuaaggcuacauagagauccugucuuaaacaauaaaaugauuuaguaaauaaacuagaugacuuuaagguugacuacaagucaagaacuuugagcaggaccuuuguuaaaaucuuaauaaggcaugucuuuuacaacauuugcaaguugaaaugcuuccuagugagaaacaaguuacuuccuagggauuugagaauaauaaaugcauaauuuggguucccaguuucuaaggcucuguaucuggaaaguaaauagcccaguauacucagaugauaccaaaaacaaaguaauguauugugcuggcuugacguuuuuguuccuuguuguuugcauucuuauuuaaagacaaacacacagagugauguaauacugauuggcuaaggagagaggaugucacaaauugguuuuuaugccugguuuucuugucuacaaaucuccaccaguuucaaccacuguuugaguuaucuuuugaugauuguguaacagauaccuugaaccucuguggguaacugauguucucauguguguccuaagaccuaggaauccugguguauaccagacccaaaagguagaacucacuauacuauauauacuauauacuauauacuauauacucacuguauguuuaguguauguggugaugugugugugguucuguucaugugcuugugccgaggccagaguagaacauuggauaaccuccuuuaucauuaucacucugugccuuauuccuuuggaucccauaggauuucacacugaaccuagaacuaggaugacagcuagcaagcaccagucauccuccuauuuccucucacagugcuaugauuacaggugcacaggcaugugcugcuuuuuauaugggugacagggauucaaaaucaggccuauuugcuuaugcagcagcugcucuuagaccucugauccaucucuucauucuuguggauuuauaucuuccuuguaagaguaauacaccaaucauuuugccauauuccaggccagccaugaugaaugaaaaauuauucaagggguagaaggguaagucuaguuaaguuagagcacuugaugcuuuuuucagaagaccuccauggacacucuacacaugagguacacagacauacaugaaaauuaaacacccauacauguaacauagaauaaauugggagaaaagaauauauauagaaacacgaggaccaguaaguaggggauuuuagggcucuaagacacuauauaucauaacccucuuucuuuuuuuuuuaaaugcccauaaauuagcauugugguuagagaacaacuccuuuggauauguaagcauuauuggaaaaugcuggaaaaguucagucgcuccccuuuuuccacauugcacacugaguuucuaaaaugauugaucgcucauaaucuuccauauaugcuguuuucccucuacaugcauaucggugaagaacuuuaaucuuggcauauagaagaaacaauuuaugcuacuuuuugaccugaguuguuggcaucaauauucuuguacuuugaggccauuauuaaauacaacuuguuacauuaugauggcccacaugguggguuaaguaacugaugggaguagcauguuuaauauggguauguuagauggcagaagaaagaaaugcuuuucuuuugccugcuugccucauucuugcuggcaagaccaucuaucuuguugcugcagcauuacuucaguaauuuagaaccaacuucuuuggcuuuccaacauaggcuggagaccagcaacuauuuaggaaucuucucggucuucagcaccagauuggaacuccugagacauccagcccuguguacagaacaacuacuacuagauuccuagguucuccagugugagacauugugaaauuacccagaccucacucaaucuguaagcuaauauaauaaaucccauguauauauguucuaucaguugaguuccuuuagagaacucugaugaauaagaccauauucacauaugcaucauacauuaggaaaauaagagguggcaauaucuuuguuacauuugggucuuucaacacuaaaaucauuuuguuaauucauucauucaguagaccuuucuggauaccuuuaugucccagucaccuggugagguacuagaaaugggacuaugugggcagagaaaagugauaaggacagacagacaguauuuuaacaccuauuugcaacacaccacaaacucuuucuauuugugcuaauuccauuuuguaaauucugaaaaauugcagugacuuaaugaacauuuugggauggggguuguucuaguuucauuucuguugcugugauaaaaauacucuuaacaaaaagccgcuuggggaaaagggguuuauuuuagugcacaauuaugggguacagucaguccaucauagauagaaauccauaauaacaggaacuuaaaccaauuaguuguaucauacccacagucaagagcagagagaaaugaauguacauguguucucuuguuugugcucagcuagcuuucuaauauguguaguucaggaugcccuguucuaguuucacuucuuaugcuaugaugaaaaauacucuuaacaaaaagccacuuggagagagaggguuuugcagagucccugccgagggacuggugccacucagaguaaacugggccuuuuuuaucaauuaauuuaaggcagucaucugcuggggaggcaaaacucggggagugcuucugacuguguugagccuagcaccaccucugucggguaguggacuuuagggaagggaggagacagagacacugcuuggguggaagaaugcauucuaauauuugggaggccaaggcugggguacccugacucugggacauccauuugcuccuagugugcuguacagaagagucagaaugaaggaucagggguccucaggcucaugacaaggcuguuggaggccagugggugggcugaggauggugacaaaccuggauccagggaaauggaggaucucuagcuuaguuugugauuguccuuaucuuagcagcaguugucuggaagcacagagaggccuucucagugucugggaagggaagcuaauuggcuaaauccuuagguagauaacucauuagcauggagaacucuauccugggguuaugugaccacaggucauguuuccuuaugugggaaguguggcacauguuugaggccaggaaucuggcagggagcugucuauggucucaggagggugauggggugccagggacucugauucuguccaaccuaccaaguuuccuagcgcggucuacugucccacaguccacagacauauucacagacuaaaccaauguggauaagcucucacugaaacucucuucccuucuagguuccugucaaguugacagaaguaaucagcagaccucagggucuguugucuuuuguuuugauuuuaagacagaauagggcuuuaccuugaacucacaggaucuauaccucauucuacucuguagcugaguuacagguguguauauacuacuauacaaggcugaauauuuuguaggauccuaagaucuucaaaucagagggaagcuuugagugcgcauggguaugucauuguaguccacaaaggggaaguggcuccuauuauugagagcuaggucugggaugguacaauauaauacauccugggucaguuccuugcauuuccuauagaaagcauccaucaucacuccaggucuguaagugagaagugaccaguuggcucaauugcaggcuccauugcugcaccuagugucccugaccuuguauucaauauuuugaguugcuuuguucugaaguuucaugacaucaguguuuuuaucugaaggccaacuuguccuugagauucauggcuuugacgccacccuccuccuuuugucuaacuuuuccaugaagaaucuaaauuccccacuuuaaaaaaucugaugugguagccaucauuuccugauguagggaggcaucugggaacaaaauacaaaauggaacauugaagagaugccaucuggaaugaucaagauggggauguuuguaaagacaagcuuguaauaugggagaauuguuuuguuugcuucgggguugcaaagagugauuaacauguguugaaagccucaagcuaugaaacaaaacauuagguacucauugugcccccauggcagcuuuuaacacauuggguuggcugguucuauaugauguacuuguucggggcgggugagccauccuguggaucgcagguggcagugcuucuauaguaacuucuuaagaguuuacuuggaagacagacacagagcaaaacuagauaacaaauaaaugcuggacauaaauguucccuuuaacugucuuuuauuuaaaucuuuaacauuucagauguuuccaucugggaaaauguguagcuugaguucugucucuuacucuguauaucuaugauaguuuuuuagacuugccuugcauguguugaccuugacaguuuugaggcaaccuggucuuacaguuucaucaguugggguuggcuugauguccuucgggugguuaaaaugcgauaguguguucuggggguaugcuggaggugaaguaucuaacagcccucuucuaucaaggagguauauagucagcuuaauauacucuugauauccucaccuuugucuuuuugcugaagucaugggagcuaaaugucuguguuauggaguuuaugcuuuccccuuucuauacauuguucguucaaaguccacacugggcuaggugugauaaauuucgcuuccuagagguauauuguuuaugcuuuacauaaaaauauauucuguucacuaaucucuccauggaaagcauugggcuuccuuuguaaauguugucuuauuggacacaaaugcauuuacaguugcacaugaauacaugaaccugugcuagaggcuagaacucaacuguagguguuguuccucgggcacuacucaccuuguauuguguggcagggucucugucaaugaucuggaacucuacaaauaggcuagacuugcuggccagugaggcacagagaucuaccugucucugcacuuuagcuuguacauauaugcuuugguuaagucuguaagaaacauucagaugggauucauugcaaaacaaaaaccuugugcauugugguagcucauuggauuuauguaauauuuagucugauuuucauagaugcaccaguaaaguaauucugcuuugcaggagcaaguuuggagauagucagcaguugcauguuuguauucaguccuguugaaccaauucaguugaaguucuagggguucuguagcuguugugaaggaagaacucagccggcaugcugugggcaguuagcagacccucugcaaaagaacaucucuguuaauucagcaagaaguuuaagcagaggccucauuaagucuguaucuuucuccucugaguauuuuuagaagcagcaaauaucaaccauaaauauuuaauguuguguuuacagacuuuagcaucacaaaaguacaaaaaggugacugugauggagcuaguugcacagagauuggaaaacaaauauucuagaaccuuccuucauauaaagaauuuaucuccaacuucccauagaauggaggcaaaaagcucaucuuaagaaacucacagagaaaguauuaguaaugaauuuacucuuugcauacuaggcucuuuaagaugcuuuucuaguuguuaaaaaugaaugaaugaaugaauugucagcaauuuggaaaauacaauuaaacacgcaaagauacagacacacccguccauagaaauuuccugccaaccuuugucugucuuuaugggcauaccacuagccauuuuucuagcuuugaaguaugugucuauauuaauuacuuuccuguuucuguaaagagaugccauaacaauuuguaaagaaaagcauuuaauuugggaguugaugguucagaggguuauaguccauaauccucacagcagggagcauaguugcaagcaggcauggcacuggagcuguaucuuugagcucacaucugagccacaaguuuuagagucugagaaagauucaacugggaaugucaugggcuuuuggaaccuccaaagucaaguccuagugauauaccuccuccaauuaguccauaccuccuaaccguccccaaauaguuccaccaaauguagacuaacaauucaaauguauaagccuauggagggggcauuuucauuuagacuggcacaguaucaccccauuaaauuuggagagaaugcauguggacuaaaaauaugcgucaacauaccuccugucaagcacacagucuaugauuuauuuagcacacgcgcuugcauuuagacugcuuccaguuuuugcuuuagggaagauugcuggaaauagaaguguagggcucuugagacauauuaucagauugcucucuucaaaggucaaggaacugguaccauggggaggcagagagguuggaggaauagaguggaaaaggguuacaguuagaugaaacaacuuacauguucacaguuaaccaggccaggcaugccuggaauccuguguuugcauuuuucccuugcauuccuuugauucuuaaagggguggaauuuuggucuucaucuucauuucuuucccuguacuugaaaacucugugggucucuugaucugaacacuauguggguuuucuaucagcugaaagcacccuaccugacauuagucucuggacuugagacagacgcugaguauaagagcuacauauuaaacaaaugcuaaggagaacacauuaacaacuugugugcuaagacuggacacagcaccuguguaguuaauuaugacacuucuuuccuuaagauucagugcuacauacgacuguuacaguuguuugcuuauaggcaauugauaaacuuggagccuccaucuccuagcucuagcaucuaguccugaauugguagauuuuuaaaaaguauuuuuaggggcauagguugguggcuugguugcuaaaauaccuuccauacaaggacaugaguucauaucccugaggcucauauaaaagccaggcucuacaguacacuucuguaacucuagaaguagugagauaggggagaagggugggucucuggagcuuacuggacagauggucuugcaaucaaugagcuucuaguuuauugaaagaucauaucuuuaaaaauaagguagaaaucuauggaggagcacaccuaauacugauugcuggccuccaugcacaucuacacugaugcgcacauacccacaaacauuacuuagcuauacauacacacaaaauaaagaugcuguuuauuuaucgauauaacugauacuguucauuauugguugacauagauugagauauuaggcaauaaaauacuguuuuuaaauuuagguauaguuugacaagcuuguuucugccugucauuagccagaguucaguguuucccaagaaagaguaugaguugaugugucuugaacuacacacgaguuaacugaguauuugauguagcaagcugcacacugucuuagaagcacugugguggcauguaugacaugugguggcauguaugacauggggaguacuugucuucugcauuucucugaaguaauuauucaaaucuguaugucucugugugugugugugugugugugugugugugugcgugugcauguguuuguaaaauuguucacaugguagccauuaagaggcuggaggacaaucuuggguguuaguuuuucucuaccuuguuuaagagagugucucuuauuugcaauuucauauuccaggcaggcagcauuggcaggcagcauuucugauucuccuguaucuaccuccugucuccugguaggggcuaggauuacagaugcuuguguuacuauguccaguuuuaaccugaauucugggggucuaaauuuagguccucuugcuugugugucaucacuucaccaccaagccaucucgccugcacuguuauuuaggcuucaucuaacacaucuccuuuuaugguuuugauacaucacgcucuccaaaagcagaccuaguaucuauuccagccuguucagagcaggguuuucuguaagcuuggucucuuuauuucuuccuaagaaagaauuucagaacuugaaaugaaacagaaguaaggcaaggcaaaugaugauugagaaguuacuguuggauugcucugauaauuuuagaguagaucgucuguguuuuacaguuuaacagauuuaacuuguugauggugcuugcauauuuuugcucaaaaguaugcugacuggguaagccaggcuuugagugaaucauuuccugccagguucaauauaguuugagcuaauccauggaaauguggccagugauucauuuuuuuaucaauaggaauuuggguggugccaccucauguagugagcauagacauuagagaggcauacuaacuuauaccguucuuucagaauuuggcaccuggugcgugcuagugacuuugaacucggaugcauaggguuugugcuaccucagcuaguuucauccaggaacaaacgacucaugaucaggugaaucuaaaagcaaaucucuucuuccuuuuuauuuuguuauuuguuugcuuguuuguucuuuguuuuuucauaaucgggcuaguuuguauaguccuaacuguccuggaacucacucuaaaucaggcuggucagaacucacaaagaucaaccugccucugccucccaaguucugggauggaaggugugcgccaccaccacccggcaaacacauuucuugugcuuuguaauuuccaucucaugacguaaacuacauaauugccacacagauccacaguucaguuuuaaacaauuuccuucgcuggcacaagggcccccgaguaguuugacuugucacuauggauuaaauacagcuguucaacacuacuugccccagcauuugaagacauuuguuccuaugugcuuuuuguuuuaauugaaaauagauuuuuuccauaaauauauucugauuaugguuauccuccccuacuccucccagauccuccccacuuccccacccacucaaaucuacacucuuucucucucucucacuagaaaauaggcuaauaauaauaguaaugauaauaaaugagauaaaauuuaacaagaagauaagacaaaacaaagagucaaagaaaaauaauaaacacauauagaugcagagaugcacacauacacacacauagaacacauagaaauccaauaaaaacgaaaucagaaaccauaguagcuaagcaaaagaccuuuaaggaaaaagaaaaaagaaaagcccagacaaagcauuaugagccuaaaauaccauugcuuccuuucagugcuugccuccccccauugugugcuccuguauguauguguacaugccccaccccaccccaccccacccaaccccaccccaccccaccccacaugugcagaugcaucuaugagugucuuuggggaggccagcaguugguauuggaagucuuccucgguuguucucugcacuauuaauugaggcagucucaguugaacuucuugccuugccuuggggaucauuccccugucucagcucauaaaaccccagaguuagaggcaggccaacccaccuacucagaauuuauaugagaucuggaaaccugaacuccugucuucagguuugcauuucaagcccuuuauccacugagccaucucuguaggccucagaacagcuaaaauuuauaugagucaaagagcucaaaggugcaaggucagcucacugucgacuauuugcucauaacuuuuuauucugacacccacagcuucuaccugcaugcagcuugaucuaguaucuaaggaaacuuagaauaauuuauuauauuaaaaauaacuucaaagaaaacggccuuuuuauuuuuccuuggggaugacuuuucuucugccagaacucugagauuauuaaugcauuucaaacuggucaaagugggagaaagaugcugagagcauagaacuaaaacagggauuauauagccuugaaaacauuuaccuuuggaggcuggagagauggcucaauaugccuguaacaucagaacugugggggcagacauaaaaggauuccaggggauggcuggcugucagccuaacuccgacuucagcgagagacucugucuuaagggaauaagggcgaaaaugauaggacucucaguguccuccccggccuccauguacauuugggggcauacauacacauuuagacauagguuacacacagagauuugaagugcuuugucaucauugccagcuaccauuaacauguuucagagucugaagucuccauuuaugcacaguuuucuucauccaguaggaauuggaaaucagccacaaaugagaaagucgaaagaaacuaguacauuuauauuauaauaucuggcccuagguuaaaugaguacugaagcuuucuuuucacuauauaguaccauccaugauuuuuaacuuuaucuagagacuggagaaauggcucugcagucaagauuauguccuauuuuuacagaggaccugaguuuaauuucuaccaccuaccaugguaacucacacacuguaacuccaguucaggggaucugaugcccucuuucggucucagaaggcacugugcacaucacaugggcauauacaugcaggcgcagcaccauauacagaaaauaaaaguaaaucuuaaaaagaauuaguuagugggacuagagugaacacuuuuuaagaucauuggcugcuccuacugaggaccuauguucuauuacuagaacuuauguggcagcccacaaauuguaacuccaguucuaggcaaugugacaccaucuucuggcaucuacaggcacugcacauacaugaugcacaaacaugcagguaaaaauacacuuacacauaaaagugaaauuuaccugguauauuccaauuaaucuaauuuccauaaaugcccccuuuccuauauauuagccaugugaacaguguuuagauuuugcaugucauuuuuguugugugucuacaguuacagugaugauuuggucuggcuugaaacucucaggcuccuuuuugaaacuaggcaaaccaacucauaaaauggaaaauacuuuucaaauggaaaguuguucuauuuuuaggcagggguuaguguuaaacuaggacaaguuugugguuauuaauggauuuggaagugguucgggaagaaaaaugcuguagacauguaauuuaaaaauuuguuugugaaccaauuagagaagaauuucaugacugaaaaguucgcuuuuucaugugugcauuucaugagcuuccagucauguauuuucagugaaaauuuuacauccaaguugagauuuggugaaugugaaaaaugaagacacauuuguuagucuuggagcuugaguaauaggaaaaagaaaugcaaaaggcauuaauacuauuuuggcuguuucugauguugagaugaggucuuacuauguagcccagacaucuccucaagagcugucugccucagccuucuggaugcuguaauuauaaacuaggcaaacaacuugaauccuacuagguaaagcauauaccuugcaugucacuuggcaugucaugauucucaggacaaaaaccugaucaaagaaaaaacaacaaugugauauuuguguuuuauugugacuguuccccaaagaagcauacagcauaaauguuaaaauauuggugaaacaaggacagaaccuaggaucucaagcauagaauaugaucacuccgcuacugaucuguacucccagcucucucaucauaauuuuaguauuauuuuggagugcuacaauuuugaacuguguaauuuaaaaauuguguagaaugucauuuaucuuugcuugguugaagaaaagaacauucuucaggaucucucugucaguuaaagacaaaaaagagaaauugcuuuuuccuguaguugcuauaaugauuaggcuaugccauguuucuguccacauauuaucucauccuaaauauaacauguuuuuguguguauauauacacauguaugcaugugacaaagaaaagggggcuuucauauuuugaguggggguagucaagggagggauuccagggauggaaacugggaguggcuagagggaaaaagggggagugauccucuauuucaauuaaaaauauuacaaagaauuuaaugcuuuaauccuugcuaaaucuuucagcauuaauuuuccuuugacagagcuuuguaaauaauuuuaacuauuccaacccaguauguccauuuuuuuuuagguauaagaggggggugagggagggagggagggguucuuuacagcaugaaggaaaggucuaauuccacacaaaauggaagacucuuaagauguauccauuaaacuacuaaaaguuaugggacuacaacauuaguccaauuuagaucccuagugucgucucucugugauuacagauccuguagauuuugccuagcuuggaccugaagauccgggaagcuaguucauacucugacgaaaagucaagugggcaggggaggggagcaaucuaaaaugaaagaaaaaucccuaacacuacaguaaauccugaaugauuaguuucaucacaccuauccucuccaccccaaacaaaagacugcucucuguaaaacaggugcuggugggcuaggguaggaacagguugugaucuccauuuccauccaggcuacaauuucucugaaacucagaguuuuuuuguucauaguuaaagucuuacuggaacuaagcucugcaauugauuuuuauauugaauaugacuauuugauccaaaagcagaauuaaggggugauaacagaggcaacauagccuuaggcugguuuugcucuauccucuaagaauaaauuugagccagauguaguugcagcagguccuguaaucucagcacucaggaggcuaaggcaagcaaacccauaguuccaggcuauuucagacugcauaaccaguuuugaggccagccagaacugcauagcaagaccuugucuuagaauagaaauaaaagaugugugaggcagagaggguuaacuggcugagccaaguuugacacucaguacauggcuguuaacugcuacacuugucugcaagaaucaauuguaguuguugaagaccucaggaggauagaugcuuuguuguuuguuuguuuguuuguuuauuuuagguaaagaaaaagucuuaguuuugcucauuucauauguauccccuuuugugcuugggauucaacagcaacuuagcuuccucguauuccuguuaagcagucaauauauucccacugaauuggagguaugucucaaaagugaagguguccaacgugagaaaagucuucaaaauucugauccuuuguucaugcucaauuuuggaacaagauuuguauccaacuaagaggcacugucuuuuuguuuguuuguuuguuuguuuguuuguuuguuuucaauuaaccguguaaaauaauauaaaugccauucuggguauucuaugguugcuucuaaauuagaauauuucacauauucccucugaaugauguccucaauggcauuuuauuuuuaauacuuuuacaauuuuuguguuuguagugucuacaauauguguuugugugaagguaugcaccugccaugguauacaucucaggucaggagacuuccuuggguugguuggucauugucuuccacuuuuuuuuucccuagacagggcuucucugcauagcccuggcuguccuggaacucauucuauagaccaggcuggccucaaacucagaaaucugccugccucugccucccaagugcugggauuaaaggcgugcaccaccacugcccggccacauuuuuuaagauagucugguuguugauagucugcuacauauuccagacuaguuggccggugaucuuccaucucuccaaauaucugguagucugcugggauuauagacauacgcugcagcuggcuuuauguggguccuguggauccaaguuaagcucuuuauggccagugccuuccccaucuuaggaccacacuuuguauuauuuauugucaggagcaucaaccccaaccaucacaccuguaucucuguagcuuacauuuauuuagcauauuguuuuauugaaaucaucgucuuagaaagaaccugagacaaauuuugacaagcuuaaagggaaauaaaguugcaaaauuagcuggcacauuuggaacuuaauuuuuuuaggaaauggggcauguguacuuuuuuucucuuuucugaaaccgcauuuggaaaagauauuuguaugaaagagucuguuugggaaagaggaaaggaguaaaaaagagaaaggugggcagauaaaaucauaugggaaaacagccuggaggaacuguucagagugccacucauguagucagauugguaagacacguacaaauuugagaguuaguaaagauuuuaauguucucuuccagaaggaaagaucugcuagccuuuucuuuuuuuuuucaauuucauucuuuuugccuugcuaaaacccacuugcugcuucuagaaaauuauuauaauaauguuacacaaaggacaaauuuauccccuuuuguggccaguuuaaguacucuuuaaaaggugguguguguguguguguguguguguguguguugcagccuccuguaguuuuagccucccucuaguucuaaugcuuggaaauuggugacagggauacccaggagccaagguagccagcuaaacuagcugaauggggggaggguucuggguucaauagaaagacccugaaaagagaucuaggaagauucaugauaucauccucugccacaugcaugggugccuacauucauagcaaauaugcgcacacacacacacacacacacacacauguauauauacauacaccauacauauuugcaugaaagaaaaucacccaguauucuggugauauaugugcaguuauccuuauugugucuguugucugguaacagccuacguguagcuuuaccuguauuggaguauauaacuugauguaguagaacuugaaagcacuguccccauucauuagcacagcaagcuuagauaauuuccuacaagacgcccaggcuucauaaggaauucugcucaucuaacgacagcuuggaaauaaucuccucuugagaagauuugcuaguuuacauggcuagggagaauguguccuccuagggauauggagugugauuuccaagaaauaaguccucacuggaaugcagagacaggaaaaaaaacccaacaacuucugcugugcauaaauagaaugugauugaaaugaacaaaaaauaauguagucaauaguuuaauuguaaggcaccaagagaauguagucagaauaucccuuuuaagugugugugugugcgugcacgcacaugcgugcaugcacugcacacacugguauacuugugccaugguguguugguaggugagaggaaaauuuuugaguaauccggccuccaccuuguuugaaacagagugucucuuccuguuuugccaugcuugguauucugggcccuuugacccuugagcuaagagcuaauuguccuguuuucucuuuacuucuugccaagagcuguguugggauugcagguguaaauccacacaucugcaucuuauguugguucugggaauggaacuugggaagccaagcuuugcaggacuaguguuuucgccugcugaaccaucuccuugacccucauuaucauuguuaguuauuuuaagcauuuugacacaggccaugugguauaauaaaauguuaguggaaugccaugucagugaccuacauucaggguucccuggguaugauucuaggggucaaauuuucuguucugaaagucuuaaugugauaugugucucuguuucugaguauuuauagcacauggaacuugcaauguuauugauccauucaaaugaacuucauuguauuuguguggcuucaguaccccauauucagacaaguaauccuuaaagguccagcagugaugauaggucaugguaacucugcucccuuacugagaaagaccuuaaauggacaggcauuuaagaauauuuuuaaucccuauuuuaagcuucuuuaagucuuuuagaugagaacaaagcuuaacauuugaaagauguuaugcuuggcccuucuacucuucuagaguuuguuuuccuuuuaauuuacacuuguauuuauuauuguuagagaagagaaguggaaagggcaguaaacacaagugccugaugggugaguauguaugaaugugccacaguauggagauagaggucagaaaaauacuuuacaguagucaguacucuucuuccaaaguagcuccugcaaauugaacucaaguuguguggcaauuaccuuuauccuaacuaccucagugucauuaucucacaugaccuauaucuuaauuuacagcauucauaauacagcauuuguaauaccuggcaccucaugggauuuauguuagcugcuucaucaugaugacccauggcuuuuauuuaagucacagcuugugugaaguguuuguugucccaguggucucacacuguaaaccaucuccuuuguaucugccaccucugagaauacacugguaucccuguucuucauucacaacaaagguaauaugcaaaggaggacuaagaaccaugucacugcaugucuuugcuggguauggggaggaauucugcuuuuuugcuagucuaguguuuucuacacucugaguccauuccagacaguaagaaagggcacuaagggauuaguuccugcaaaauaucugaguguuuauguuaggaacugaaaaauacgugucuucagaauaucuggaagguuuuuuugcaaggcuguuuguguccacauccucaaaaccucaucaaaauaccaaguuugguauucugaaguuaaagaucccagggaccaaaaacugggccaugguccaucuuguguuccuccccucuccacuaauauguuccuuggugacagaaagcagaccuauguuaccuuggagugauguguacucuccaucacuuggagugaugaccucuccaaacaguguguggugccuguguucacuguggugacagcuguagauuaucuauuuucacuuuuccauguguuugcagugcacugauuaaccaggccaugguaauaugcuucaagguagaaguugggaaacuauuuccuauugggccauucagccccaguuaguuuuuguagguaaagaugucuuggaacauaccucaauuguucauuugcuucuuauugaaugcuucucugauccuacuuaagaguauaguacuugccuugauacuguagucacaauaucugugauacucacucuuuggucuuguauauagcagugugcuggccccgaucugucuuccugcagcuuccccuacuguguugcauauguagguuaaauucauuucagaaaguagacugugacaaaauaucugacaggaucaauuuacaaaagggaagcuuuauuuugguuaugaguucuauccccauaucaugccccugugugcuugggcagaaccuaguggucagggaagcaugugguauagaaaaaaauaguuucugucacagcaugacagggucaugguaagaugcagucuguuaccuuuuacuccaucuaugcaccaacuuucaccuucuaccacuuccuaguaaugucaccauguuaugaagucaugaagggaucaauccauuaucuguauggaaacacccucauagacaaaacgagagaugugcuucauuaaucucccaguuagaccucagugcaaccuagucgacacuuaagacaaaccauggcagaggaucauaauuauaguagcugacauaguuugagguugaaaugucuccccuacacuuuguauuaaauguuuguuucccaucccauugaaggcaucauggaaccuguaaguggggccuagagagaagaaguugaguuacugggggugugcacuuggaggggauauugugaccucugccccuucuuuuccuuuauuucaugaggugaacuucuuccauugaaagcugccucacaacagguccaaaggcagcaauuguaagcccagauaaaccuuccuucuuuauaguugacuggcugugacaaaaaguugaugaggguguagccuuauaagauguguugacauugacgauguuguagguuuuuugugugcuuauuuguugguagauguccauaaugcgauccaauaacuauuaaaaagccuaauagaaauccgccugccucugccuccagagugcugggauuaaaggcaugcgccaccacugcccggcucaaacaucagguuuuaagaucagacaucaaacuugauaauggcgugcugaggaaugauguaggaaauuacgaagucuuugccuuucauucacaauuaagcugugcugguucuguaagagcagaagucuguguaccugcaguuuauaacauauaucugucuaaaaccugagcguguggugaagacaugccaguucuuguguuauaguuuuauaagcaaggcuccagugagguuacacaggcagcaugagcaaguccuacugggagccccuuguauucuuuacaaguuugauuuugaauugauucuugguugugcauucagaaaucuugaacuauugccaauuguuuuugguaagcccucaauuuggcuacgugauaccauaugggaucauacccgcagcuuaagaaguuauggucugaaggaaggguauuccaacauaauauauaaaaaaaccaaacaauagaauaguaaggugaucugaagagacaauucauaaauugucaauuuucaccuuccugugaccauugccauaguuucaugaguaaaaagaaaauugaggaugguggccugauuuuaauucccagugaauaaagguucauggagaacuguccuacuucuaggcacuauuauuauacuuauuuuuaagacauaagcaucuuggcauacuucgguuucagucaaguauuaucaaaaaauuucaagcuugcagagcuuauugggaaauacacauuggucuuaauauuucuucuggagaaaacauggacugugugugugugcaugugugcuuuucuuccuguuucaaaaaagaagcgucgcaccuccaccuggucuccccugacauugccugacugucccuggaagggaaauugcucaacuacuaacaacauggugcauggccguaaaaaggaaugagauuagauccuugcugcugaaggaagcaauuuggaaauauagucacugagagaagccggacacagauggucacugugugauguguauuuaugaaauguguugacuaggcaaaucuacaaccguggauauccaacuagcagcucugauauucccaagaggagggguggaaugguugugaauggguggaaaguuuuccuuuauugugaugaaaguguuuuguggguggugguuccuuaagauacuuaagguacuaauaccacacuuucaaagugauuaauucuauguuaaguaauuuuauuuuacuucaacuaaaaccagagaacaaucuugaagaugccggguuauaauuagugauagggagguugaauuggaauguucuuauuguauugaauacaugaguauucaauaaauaguaaauuuauuugugauaaugagucuugaagacagaauuuccucuugugaggaaaaauacuuugaaauuugguaucauguuuaaggagaacuccuuaaauugcuaaugcccuugucauaggcugagaaugugauccccuaagaucccucaagccuuugaaaggaacacuuuuaguuuccauuuauugcuuaucuauauuauuuuuuacaugcaauuuaaaaguugugcauaauaaguggaugauccacuuacuauacaaggauaaggaccagguuuugagccucagaaccuacauuaaaaaguaacuauaagccuggugugcaaaaggcaggaggaaucccuggagcaaguuguccaguuagacuagcucaacuugugagcucucaauucaaugcggggcuaucucaguaaugugcagagcaaucaaggaaguuacccaaugucaaccucuggcuuauacauaugcacacauaugcaaguguugaaaaguuuauaccugggcugcuggugggcuagguguuagggugcaugccuuuaauucuagugcucgcugugcauacaguaccuucaccugaaaucccagauguagccuauggucucuguugcucccagagcucacuuguaauccaaguucacuuaucccaaggacucuuuguagcacgcauuagagaucccagcacuuguccacaaucuguggccucuggucucgaugugucucuaaagucccccauaguucuaguauuugccuguagccaauacccuacagguugaaacaggaagacuguaaauuaaaggccagccuggacuauauaugacauccccaauucaaacaacuaaauaaaacuaaaaauuuuuauaguauuuuucaaauaaggaaauuuguucugaagcacuguaaagugaugaacaagguuuagaguaaagcaggaauggagaaaccuacauguuugacuuuagaauggaccuuaacagaggggguucuugguuuggacauuuggcuacaucugugugacuucucaacaguaaauagaugaagaguuagaggguagaauaguaaauaggugaaugcuggcuccugagcacucaaauaggacauuaguguauugagauguuacaucagggauauagaaggaauaacuauuaaauccugcagucccagcauagagaaggcugaagcagaaggauaucauuuucagggcuagucugcaucauuguacugucccaaaagaaaaauagaacugggcggggaugcuuagccugugcaagucccuggauuccaacccacacaggaagaauuccaaacaaaucuuucugaacucuaguauccuugugaaaauauuuuacuccuucugguguuuugcaauaaagagaaacagaaagaaaacaaguguggcggauuguguaauuacuguguuaacagcuauugcagugcucugugaacauauauggucuaucuccccuccaagcacuuucccuucuucagauuacauuuacuguacacauucuauguccagacauucugugucuagccuagagugcaaaaauuaauaugggauggcauacuucuauuagccagaaacauaaaaaguguaugcuuuggauaacucgagagagggaaauacagauacaguuguggggaggaagggaaggcugggagauaccuuaugccccuggaguuuuguguccaauuuagagcaucagcuaaacaguaaaaaauacaaugagucucuuaguuauuuuuuuauuauucugauaaaaugccaugaccaaggcaaacguguccuuagucuggaacucacugauugagcuagacuggccagugagcuugagugaucugcuuguccuuacccaacaacacugggguuacagauguucacugccaugcccagguuuuauauggguucuggggaccugggcugagguccuagugcuugcaaagcuaucacuuuacccacugaaccaucuccucaggccuacgaauacuaacuauugaugaugguucucuuuuagguacuuacuaaucauggggaaauccaucuaaaauagcuauuggaauguuuaguuucuuguuuugauuuauuguuuucaguaaucagcugauuuauuuuugacagguuguauaaccagaauuaacuaaagucauaauuccccuuuguuggugugugugugugugugugugugugugugucugugugguguugaucacacacagaugauaaagucaauuaggcuuacacaguuucacaacauauauaaaagauagucuucaguuuugaaacucugauuugugaguuaccaucuguuuuggaccaaggaaaauagaaauucauuucuaaauuuuuuuccugaacagcuuguaauaggaacuguuaguauauuaauugcuuauugaauuaugaugggguuuaaucuuuuaauuuacaggcaauuuggagcuuauuguggugacagcugcuuauauuuugauacuuuguagcauuuagcuauuucaucauaaggcuuauccuucuuccaccccauaauuuacagcuuacccuaagcacucauuugcuuccucuucagcuucuuuuaaagaguuuuguccuuuuuccaccauguuuuuccuuuaaaaagacuuauuuuuuauuuaguguauuugaguguuuaccugcauguauauuauagguaucacaugcauggaguaccugaggaagccaguauucucaggaaagggaguuacagauaauuggagcggucaugugugugcuggaaacugacuuaagaccuccgcaagugcaacacaauacuccucacugcugagccaucuccccagccccucuuucccaggggauuuuuuuuuucauaacaaaauuugguuuuauuuuuuaaguauauuccuuugugccugauucuuucugguuuugugacuuuuaauuuccauucagagauuuuguaggugaauuuaguaugggucuuauuuuuauuucuaaaauccuuaugaguucuuuauuuuuuaauaugggaaugaaacuuggaggccugugaacuugccugucaaaucucuuucauuuccuucuguuaaacagcagaaccauaaacaugacuauaggaaugauuugcuugcauuuccugaaaacacuuuaugaugguaauaagcagaaacuuuacccacaguuucacugguggcuuugaguuacaguaaaccugcaccuuuuagcuauuacucaagaugauuaagaacuugagaagcaguaauucaguguccuugguucuuguauuuucugaugguuuuggauagauuaaacucuuccuaagcuggauucauucacaacuaaggaaauuuugcaagguuagaaauacaucacauuaggcaacugcugguucuaugauuuguguuccuaguuacugaaaaaauuaucuguuuuauuuuuucugcaagaucacuucaggguccugcaagauaguuuagaggcuaaagauauccaccagcaagcuuguuggcugacugaccucaguuuacgcccagggagggauacacaugguagaaggagagaacugacuuuggaaaguugucuugugguugcugcaauuacacacacagacacacacuaaauaaguaagcaaguagguuuuuaaaaauuccaggcagaacuuuuugaaauggcaauucaugaaagcacugcucagaagguuagggugggccugggguagaauucuugccuggcuccugaagugcuguagguuuuucccccuagcaccaagggaaagacauauuaguugauggugucuuugcuuuuaaaggagucaaagauaagauauaauuugcaagcaugauauaugugcaggugugccgauuaacaagcaugguagauguacuguaaauguuaugcacgggugucugagguaucucugaacuucauugugcugucuuuaccugaggguguguacacauugucaguugcauaaagcacuguccuaaaaacuaaggugccuucuaggacauuauuauuaaguaauagcagcagcaaaaucugugcaaguauugauuuuugucauuucagaauugcuacaugcauaauaaugccuagccagcuauuuuaaucccuauuccauuuuuauucuuugcaucuagaaccuguaucuucaucuaaaaggugaagacaaaaacgaugagcaaauaaaaugaaaaaauuugacuuaggaugagaagaaugucuaaaggaacaggaggguugagauguggauaugcugccuucauggauuuuuaugacauuuguuugcaaaucuuucuguuucuauguagggugguccuggacuuugugagcaccucucaaguucugugaucggauacuggguagcccacuguuccagaggucuacacaugcacucacugugacgguaaggaaccuccuuccauggggccacucuaccuugugccugaaaauccauuugagaaguaggccugcauucugcaaagcucugcacuuguuuccaaauuacauuuaauaaagaaauugcagguacuucagcugaaauugaaggagagagggaaggcuggaacaucagcagccuacuggggcuuucauacuuacuuuucaccuuagaugacccucuaagaguuuuggauuuuggcugagcuaaaauaaacuucuccaaguguuacugugaggagacaacacucaaaaaucuuucuugucaauaucaugagcuacaaguaaacugccacuuuuacuagaaugggacccaggaguguaucuuuauuuguaucccacaugugaauucacugcuucauuaguuugugaauaugaauuaugucugucugcagacugacuugcugacuaacuuugaaauuuuguagaaaguucaugcagauuccccugcauaaaucuagucacaggccaggauuuaccagacugcagagaguggugugugugccaacugaucacuugaaauacacauccaaaguaugcuaggaagugguuagggguacagcacagcuguaaggcaucugcuuaucguggauguagccccagguuucauccugagcacuguaacagaauaguaaauaaacaagcaaggaaguaaauaauuguuccuuuugauuugagggcuuuguuuuauuugcacauauuuaaauguucagcuacauuuuaauggcuuuuaguaacucugacccacuuuuuaaaaaauaucacaauguuuauuauaucacuuccagaacauaaagcucuuccgaaggacucagguuugauucccauccccgagcuuggcagcucacaagcaucuguaacuccaguuucaggguaucugauggucucuucuaguggacaccaggcaugcauguagcacacagacauacauguagacaaaacacccccacgcauaaaauaauaaaaauuaaagcucccaaaauauugauggauauaguagcugcuuuaaaacggauuaauaguucuucacuaguccagaucuagaacuauuauauggccaaaagucucuacuucaaaauaaauacaccaaagaauaaaaccauguccaugcaaacucuugcaugccaguauucaggguaucauuuuccagagcaggcaguuuuuuagauuuacagaaaaguaaauuuaaaaaugacugaaauauugugggucuuguucuaguaaaaaucaauugcuuucuguuguagaaaugaaaaaaccugccuuagacuaggaaagaccagagagauuugggguggaggugucauugaauuaggcuggguuuuuuuguuacuaaaggaauugugugaggcuggcuacuuacucaaauauagaaguuuguuuaacucaguuuuugagccugaaaguccaaacaucauauauagguaggucuggcucauaugagggcccuguagcuucacucucuucauugucaucacaucgcacugcuaagagggauuacaucacaacacuaggacacagagaagggguaggggccagucugugaccucaggagaccuugccuuuuaaauuucuacuaccacacucaugucaacaugucacuucuugggggacacacucaaacuguuguauucaguccauagugaugagcaagcaucuucuaaugguuuaugucuugugggucagggaaccuauguugaagccauuugaacuugcugaaugccaaucaguuuauguauauaaacucuggugauaggugcuggguugcuaaucucaagcuggugaaacacagugguuucucucucaucuguuguagcuguuuugaauuggagauaaaaucucgacucucagagacaggcuccacaagauaggaccuugauaugauaccuaguaucaggacugagauugagggacccugcucacugcugcuauugccuuuuuauuuuauuuuacauuucagguauuaaucagucuuggggccaggaagauagcucagauggaaaagugccucucgugugaccauaagcgaccugaguggauuccugauacccaaguaaaaauugggugcagugaauacucaauacaacgauuuuaguguguugcccccaaggauucaggugcuagaagcaguugggcaguggauauuuaagaggcauggccuacugagcucacuaaauggcuucucuucuucccuccucugucuucuggucaugugauaguguuauguacucacuuguaaaccuugugcugaggcaggggagaaacuaguagauccuagaaccucacugaccacccagucuaccccaaauggaaacuuucagguucacugagauaaccugcgccaaaaauuaaggcagagaacaagagaccagcaucuauuucuuaccucuggcuuccaaacgugcacacacauacgugccuacacacauacucuacacaaacaccacacaaaguguuaucagucucgaacuagcuauagugauguacuccuuucacccaggacucaggaagcugagauaggaaauugguuuaaggccagccugguguauauaaacaagacccugucucaaaaaacaaacaagcaauaaaauaaaaccacaaaaauguuaucagucuuuugacuguggaauuuaaacugcuaaacacuuaaucaacaaaacuuagugccuguguauacagguauagaaaagaggcuuuccaggguuaggaugugaaugcucccaacagguucauguacuugaauacuugguccccagauaugauauauuuugaaaugugugucacuuuaggcagugaagcugagguaaaggaggcgccaagccucaacaauuagagcugagccugguuccuagauaggcuugguccuguguguugguauuguccaagccaccugauuuaccagucucgggggagaaauuuuaagaaagucuuacugcuuggcuugugcauauccuucacuacugugaaguggacuuccacagcagaugucugcucuuaaccacauaaacauguccaagaauauuuacuucugggucugccuucugcauuccuuuuguguaacauuaccuucugucauggcugugcacacggggucuagcggaaaaccuuaggagggcacauuuuaaucaauccaguaaggcagccaggcacaauacaucccucuuuggcaugccuuuugcugaaaauaaucucauuugaaaaccagaguucuuuuucuaacagaaaacucucuuuucucaacccuguauuuaagucuuugccagauuuuaauuauauuuuaauaaauguaauccaguucauuuuuacaauacaaaaauacaaagugaaaaguucaaaaacacacacagauauauaaaugcaacauaacuguccauauagaccuaguuaugaaugaucaggaggguguaaaaacacaaaacaagauguaguaccaugcgcacaucaccuauuucugcugacugauuugugcaugagaggugaaggaugcauguguguuuagggguguguuugcucauauaagcaggcacauguggaagccagagguccaugucaugugcuccacugcuucuccacauuuauucuuugagucucacugaaccugaaguuugauccuuugaaaggccuacuaaccaucaaaucccaucucugccuaucucugagccacagcccugagguuacacaccacaugccaauccuuuaaauagguacugggaaucugacccgaaguccucauguucacauaguaggcacuuuccccacugagccaucuccccaacccucaccugguuuuucugccuaacgcugucauaggcauuuuucuccuaaguauuguuuuaauggcugcauauuauuccacuguguuauauuucuucccagccuuuacuuauuugcauauuuucacaauugggaucaaacuauaaaaugcacacugaccaucuuuuuguguauuuccuucccuucucccauuguuaauccaauguacaaacaaaggaguaucuauaguagaacaggaaagacauuuacagagagaggaccucaagugucacuguaucagucuguugucaugaggaaauuuccaaggcugacuacuuauuaaugaaaagaauuuugucuuaagguagcuaccaauuaugaaaugaaaauaaauguaacuuagagaccuuauuauggaaaaaaagccagggauuuaugagcugcuaagacuaauucagcagagaaacggacaccuuaugaaaacuuauuuaguauucauauaugcauguaacguuugucuuuccugcucuucauggaagggggguacauugagaccauuuuucauccucugugguuggcuguuuuggguucucauggaaauaggacagaguccugagucucagcagauaauuucuuuuaccucagacucuuccagcauaaaaaacagcaugcuaauagcaggaacaagauacuuucuuaccucucugagaaacacaggcaucuugucauggccauaaaaguucucugaaucaugggacaagcugugaaaggagaauuuuugccauauaaugacgugucagauguauuacccacacuaaaauaugaguaccuuguaccaucgucuucacugcagaacaaaacugcccucuuguggcaaguaaugaauucguucucuguauccuuaaagcagcaccaucucucugaacuagggaagccucagguuuccauuuuuaaagauacugcauagcaauuuagaucuuguugauuuugagcaacccucuuguuuccccaggaauaauagcuauuggauacuguaagcacacaugaaaaccgguaauaaauaagucacuuaaccaucuguggauacugaaucuugaccuguuuugugaaggaaagggaauuucugcaaccuuaaagucuuaaaaagaaaacaaaaacagcagacauaauguucucuuaauuucuugagaucuauaacccaauuauuauuucuguugacacuuauuucuagugcaagagguucagagaugucaucaacuuuuuuuuuuuucaaaagcagggaaggagggaggggggaauugauuuaguuguggcuucaacuccagauagaauuaaguuacuuucauuauuuccauuccuguacagucccaacuucaaagacuucccaucaacuacuugaaggugucuccauuaaaaacuaguucaggcaagaaaauaaacucagaugaaacaucuucccuauucuguuuggggcugagcauuucuaugagcauaacaaaugcucccuuuuauuuguaaccaggaggguugccaaacauuucuuggagacucucagcuucaagcugaagugggugcucuccuacuaauuggucauguguuaaaugagagcuggauuuccacuuguauguggcuagagauggccaguguggcucucugcauugcuguuuccuuugauuggccauuuuucaaauuauuuucuuucugucacuauaauaaugcaauaugacuucugccaucccauaacaaguuguugauagaaaaaucagauguuuguagcugugugggauguagagaaacccugagacuguaagccugucacugcagcuaggacuuucaucauuaugacauuacucagccuuaccaagucugcugguaugcucagguaccguuuuuuuuuuuuucuacacauauguuugcauuuucuaacuucuuuaaguuauauuuuuguuagcuuucaaugugaauuuauagcuauuuacugagucuauuucuucccucuaagguaccaaguagaaaucgcaggucauaguuuuguggcaauguuugcacaaauacauuaguaucaacaaaggaagauaagcauuuuuauauauguauuuuauuaguuucuugaaagauuuauacauguaugcaauguauuuucuucucacucauucaucagucuuaacugguugguguagcauagucauuuccaugagaucucuguccccccauguuuccugcaucucuuucuuuacuuggagcccugacacagaaguaaugucaaggugacauguguagcuacuugaccccacaccuguucaccacccuuggggcuucucauauccuguauauagagugaccuuuaaguuuauggugaagaccccuuuaaacuucuccaagagaugacacugugaugcauauuuccccaggaccacacuugucauucuuccaaggaagacuugacaucacuaccagucugcucaggugucuucuguaugguaaaguacugauccagccacaucugcccacgucgguucaggguuccauguguguagguuccauuaccaugcacauucugaauuauaaugcacugugguuucacugacuaaauacaaaaucagcugauuguacucuauguugaccuugaaucuggcuucccugguaugguucauauccugacccuaaaauauaugccagcuuuucucuuuuugggaaaacauuuugccuggaagauagaaacacacacgcgcguguguguguguguguguguguguguguguguguguguacauacacacacauacacaaccagcuuaagagagaaaggguuuguuuugcuuagaauuucaugauauagcccaucauugaggagaaaucaagacaagaacuugaagcagauaguucaaaggaaagagccaaagagaaugugaaugugugcauguguucagcuugcuuuuuuuauauucauccacucaggaccccgcuccaccagcgugccaaucaagugggcugggcuuucucuuaucaauuaacacuaucaagaaauuugaggucugugguuuaugcuguggcaggaugccgaguugaugucagugaucccagcuacaucgcagggcugugguccauggcucuacugcaacccaggaacccuguuugugguguguugauauuacaaaccaugucaaagcccauaaucuauguccucauggucuuuuuaaacaaauaagccacuuugacagauauugaugacuagaggcaguugagaaagagggcauagaagauaaccccccccaauagugauagccuagacaggaagccaugaggagaacucuuaaaacuaugauaggaugcugagguguugcccuccacaauagauaacuucuggcagggaugccagaagguaaggacucacuugucuccauuuagugaccaggccacugaggcuuugaccacgcucuacugaaucuagagauaauacaaauuccauuuuuuuuuggcuggggguguaacagggaugggggguggacagggaaagacuagaaaaugaaugugauagugguauaugauucaaaaucuccaaauagucaauaaaaauauguuggaaaaaaaagauacuccuucucagacauggccauaggccagcuugaucuagaugguucuucauugagucucuucucaggccacucucgauugugucaacuuucauauacacacauauuuauauguucauguguauauacacauacaucuaucugucuaguuauaauacaauaugaugguaauuggucaacccauaauaaguaugugauacuguauuuaaaucaucucaaagggguauagcuaaaguaguagagcacuuggccuaauaaggcccugaaucugucccuagcacacacgccacccccuccccacugcaaugcacacacauucagaagacaaauacauacaacauauucaaaacaauguuucugauguuuuucuaacagaggguggcucacacuugaucgagacgaagaccucaucgccgaaaggugaggcuaagaugagcauuaccagcgacgaggugaacuuucugguauaucgcuaccuccaggaaucagguaaccagcuuucuuuacuugcuuuuuuuuuuuuaagauuuauuuauuuauuuauuuauuauauguaagugcacuguagcugucuucagauaccccagaagagggcaucaggucucauuauggguggcugugagccaccaugugguuacugggauuugaacucaggaccuucagaagggcaguuggugcucuuacccgcuaagccaucucaccagccccaguaaccagcuuucuuuucuggaggaaguucauuuuaaauauguuuuggacaaaacaguugaccaccaguacaagccagacuaucggaucaucaaaaagaccuaagaauacucuauauaauagaguguuaaagggacagagaagugguuuggaaggcacuucauuccuccguuggaguguggggagagcauggucuuucuucucaugacaggaaaucagucaagagcaguugagccaggugugaugacauucaccuuuaaugcuagcacuuggaagacagagagaggcauaucucuuaaguuuaaggcugcccuagucuacagagugagugggaccuugccaaaauguugcuucaagguauauaguuaaaaggcuagacacauaugucuccuguuggcaaaauaguccuuguggguagcucuuggguucagagagccucaggugggacaaaaugcuauuuugucauggucuaaugugauuucuccaaugagcgauuuuaguucucaaguaaaacauuuuuuaauucucacaaccugaagauauuuaaaaucuacaaaaugauacuaauuguaccuacccaugcaacaagccacuucaguccaauagggagugcccuauguucacuucucugguagaaaauugaaaucucugguaaagcuguuggcaaguauuucuuucuguaggcuguggggagucaguucuaugccuccccuagcuuuggugaucuguuagcaaccuuugacauuucuuggcuuaaagcugcaucaccuugguccugauguccaaauguguccacauuuccuuuuacaaagaaaagacuauaucagcccagggucucagcacacuuauuuuaauaaauuauaucugccauaaaccuauuuucaaguggucauacuuugagauauaauuuguuuccaucuucuggaguugcauguguaguucuuuuaguuaacuuuauuucacugugaccaaauaccucaagcaaaugaaauuaaaggaggaaauggauuuuucuggcuuucagaaauccaugguugcuuuguuccuguucuuuugggucuguggugugggagaacaucaugguguaguauguggcacaguauuugcuugccuuaggaagcaaagagaggaaaauggaaaggggugggggggucuccaauauccccuuuaaggucacaucguuggugaccugauuucuuccuauuaggccucucuucuuaaaggcuuuaucaccacucugcuguaccacuggcuugucacucaagucuuuagcauaugggucuuuggggggcacauugcagcuaaacuacuauacucaguguaauguuugagucaacuccuauuaaacccaucuuauguuggaaaugguagucaaaaauauaucuacgggcuguggagauuuucugauagguaaagugcuugcucugcaaggauaugaaucuauguucaauuccccaccucccauguaaaagccaggcuuugccaucaaaguguuucugauuauauauuagcacuauuccuuacuucuguguuccuucuguuuucccugccugcucgacccuaaccagaacccgaacuuccauucuacagccuuccccaagcccauagcucuauguucacaucucuaacccacauuucccucccuacuuggcucacaccugucucugcuucccucuuccugcagguuuuucccacucugccuucacguuugggaucgaaagucacauuagccaguccaacaucaaugguacacuagugccaccggcugcccuaaucuccauucuucagaaaggacugcaguauguggaggcggagaucagcaucaacgagguauguucauuccugaggauauggcagaauuccagacuaccccuagcagaucucagaagaauguguauaugaucccugaauacaggucuggcaugcauucuaagguauuuggggaaaaguggaagcuacaaacaggucacugcaccaucaguaagcuuuggaugccuccuugugcagguuugaaaaaucacaagguguugacugaugaaaacaaccaauucauucuuacaaacagacuuucaucuacuuuguuacagggcuuugcaugagcagacaagcccucuuucugauuucccagggcagaaugcccaaagcaggaccuuacuagaugcucauagagagucuuuauuuucugucaaacugacagggcauaacuagaaggaaauuugaagagcauuucacacucaaaccauuucucugacuccuacauucucucucuguccuccccuuccugcauguguccugacugagccuuggagcaaguugcccauuuacagcugcaauucaauagucguucauuucuagcacuuuuaacuacuuauaagucucuguggugaguaccacacagcaaagaaaaagcuucucugaccaaagcuaauagcaguacuaaucugugggcuuaaacauggauauuuagaauuugauaggcacaccauguccauuuagcaaaaccauagcaguaucuucccccaaccaccugcuuuuagccagguuuacagaaccagauaugaauucccacuuauggaucaguucuuaaauccaaucagaaagcagcuuuuaauuaccuucaacauccaggccacuguucuaucaguggacacaucuuacuugacagagauugguaguacaaacauguggaguucacagcuaaguguugauuccuucucagcagcacuaacuuuuuuuuauagucuauggcuuuagcuauacaugcaagauauuucuguucauacuuugauuuuuuuaucuuacaaaauaacaaguuuccuuacugcuuuuuuauacauacuucaguugacccacuccaguacauaccaucccucuccuuccaugaaccugauccaccauuugaaauaucuuacagacuguuuucuugcuauauucucuuuuaacuuuaaaaauuauccuucuaagcacaagaauagugucugauuucuauuucucuuaucauccaauacgguuuuguuugucuagggguaaauucucuuuguuauguguuuccaaaaauuaaaaaagaauucagauguggcaguauuuuuuauuguguugacagugaccuaccucuuuuucuaguucauuuguuaaguuuuaucuuauguguauguuugcuuugccuauaugcauguccauguaccacugggauucuggugccugcaacagccagaauaggguaugaguuugcccaaaauuggaguuacuggugcuucuaugccacuguaaggaugcugagaacugaauccacgucaucuagaaaagcaacuaguacucuuaauugcugagacaucucuucagccacauggccauguuuugugacacuguuugcuuaucucucuaugaaagagaaaaaugacacaaaaagaucaagauuuaucaucaacucuggccacucaaggccagaauccagggccaaauggcugaugagugauacugaauguacuaugucguauuuauuuccuuuuuuuuuacauuguauuauaauuuaaaaagaaaaaccaaaagaaaaaaauccacguggggcaaaguguuguuuagauaauauucagccaaaacuugugccucuucauuucugagaguuuagagcauaugagaacgugguuuuucauccagcagacagccuggaggcauguggagauucaugauucaaauauuuggaguguuuccugaggaaagaacuuccuguguuuuuuaaagauauguggauauguuuucauggacaacguacaguuuuguaaugcauuuuagaaucaagacacccuauugccugguugcaucauguuguauuucaucuccacacugagcccagggagucauauauagcacauucagguagacccaggugcuggaguccuauucugaauggugcaguugucuuuauauugggcucauucuuccuucauuguuaaugauagucauugaaaagaugccugaucugguaauagcauccagucaggguugccauccaucucagcacuacaccuuuguggcugggugauucucagaggaaggauuuccgguacaccugaagauggugaacagcaugaccugccucugcuccauggaugacaauauaaaucuaugcucccaauguugacaacugaaaaugccucugucacauugcgacuuguccuucaaggaggcaauucuacccuauuggucgaauaaucaccacauugaugguagcaaguuuugucauaggauaaaaguaacccuguucagauacccauaaugcccaaauuuagcuagacaucuaugaaauuacuaaggaugaucuucuacugcuagcucuccaugaaugguccuccucauccacuuccccaucccucuuugacaucuaaccuugucccaccacaaaccuuguaccuuauuccuaguucauuccagcuucucugguccaugguagcugauggguaacccuggccuugcuuuccuaggauggcacgguauuugaugggcgucccauugagucccuaucguuaauugaugcugugaugcccgaugugguacagacaagacagcaagcuuuucgggagaaacuugcccagcagcaagccaaugcagcagcugcagcagcagcagcugcagccacagccacaagcacagcggcuacaacaccagcagcugcugcucagcaaaacccaccaaagaauggagaagccaccgugaauggggaagaaaauggagcccaugcaauaaguaagugcagagugcucuggucuucaaggggucauguuuuugguuuuuugguuuuuuuuuccuuucuucuccugaaucuauguauaguugaagggaugcuuaaaguguggccugcugucaaucucuuuaauugguuucugggcuuuguuuccugucuguccacaagaucuucaucuuugacuucacuggccucccuugguuucaggaaauuuuacaccugugcgaguguccauaucacaagggaagcuuccauaaguguaucaguugugaugcccuucaaucccaguacuucacuagugucccauccucagguucuuaagcucaauuuugcuguagccagcaagccaagguaaugucaagggcaucagccccagauauggggcauuguauuacuuuaucauugcaaacuaccagaacguuagcuccuauuggguaacuccagagucagagcaaguaagaccauguccacauuagcccugcaccuggacagagcagaggugaacacauaccuuaauguauauuggcagcucacaugcaaagaggguuuguuguguguacauccacagcucuugcaguuguucauggugcuuccuaaaggcuuaacccaugcugcuaccuacugagguuuaugauuuucacacuguuacucgagccuggugcaguugggguuccaacccucgacuucacagucugcuacugcaaaguagcuucuccuuauugcugcugcaaugccuaagcauucuguggucagaagacaacauucaggaguuaguucuuuuucacucaggucaucagucuuccaggacuggcugaaccaccucauugggcuccuugugugauucucuugaggguggcaguagaguuagcuuuuuuucauaccugaagcaacuaguuuauaagggaaaagggcauauuccuucagcucacaggcaaugcauacacaugggcaugaccauguggacguugagauggaaaugcaaaguagagggcaucaugggagaaaaagaagucaaagcagacuacaaauaacuaacaagugacuucccacuaggaaccacuucuuaaaggucccaucaccugcugucauauuccccauguggacaccaagcuuccagaacacuuugggaacaaauguacaacauagcacugucaaaacaaaaacacaaaauguguaccaaacugcagaaaugccccuuuuuuuuuaaccaucaucagguguagcgugacuuugauacuaacaguauuuuuaaaacaguagugccugaagcuguuuuuuuuuaauguguugguggaccauguaaauuuucauguuggcuuggcagauaaucacucaaagccaauggaaauagauggagacguugaaauuccaccgaguaaagccacaguccuucgaggccaugagucugaggucuucauuugugccuggaauccuguuagugaccuacuugcuucuggguaagaauuugggacuggaaagcaccugggucugcauucuucuccggaguacugccuugaggaaagugcacugguuuguuggacuucccuaauaaauaaagacagaggaacaggcugcuuugugcauccuauacugugggaaagacaguggucccagccauuucucuauuugguggggaguaaggcagguaaguggaagggaugggugaggaaagaaacugagcaaaagaaguggaaaagacacaugcuaaugaugugagaccuagccccgcaucagucacauuuucccauugaaccagagucaaaugcuccauguugauucugcagaucuggagacuccacugcgaggauauggaaccuuaaugagaacagcaacgggggcuccacacagcuugugcugaggcacuguauacgugaagguggacaugauguucccaguaauaaggaugucacuucauuggacuggaauguaaguuucuaccaucaguguguucagaugaagcacaugcaaacucaaaguggcagauaguucuuugucuuagcucccacauuggggugcugguaucaagugcucauaaucagauccuaguggaaagacagcagccugggaauggaaaguuguccccauugucaugaacuuguguuccaucugucacacagacccauguaagaaugaggcucaggaaagcacccagauacuaauguguuuugccuuuuucuauccccaagagcgauggaacacuguuggcaacagguuccuaugaugguuuugcaagaauauggacagaagaugguaaguuuugcauuccucauauguguuaagaaggacuugcugugugauccuagagugaacagugaguaacugugaagucaccaugucuguguuuucccaucucagguaaccuagccagcaccuuaggucaacauaaaggucccaucuuugcuuugaaguggaacaaaaaggggaauuauauuuugagugcugguguagacaaggugaguggaugucaacuuaaaaaccaucccuuuuauauguggauguguguuugcuuguuuauuuauuuagucuguugacuuccuugguaaaauaacucauuuaggcuguuuauuucucugguuugaucuuacugcugacuuuugaacaaggaaucacucauacauuuuauuuaccucuguagaccuucaugcagaauguacucucagucucguuauggaaagaggagaaaucuccaaauggaguuuauaaaaaguauucaguuguggauguuucuggguugacuuuuauccauuaagcaauuuuuagucacagacucuuuuuuccuccccuagcuccaccuuuucucaccugauaaaccacugcuucccacuguagauggcagaauucucugagaccugauacagggcaaacuucacagaaacucauggagcugacuuacaguuugauuuuuuucaauccauacuuuggauuuuugggcuguuccaccugcucucccaguucauagaguggcaggggauuguuggaaaugcucauuucuauagcucuucuuuuagaacaauauccaaagggcaagcagaugagcuuucuuaccuguuacuuaaugguuuucugggcuugggagcuaagggggaauuuugguagauuucccacauauauuggugaaggcugcuguguaccaauuguugucauuaauguggcauccauauuacugccugugaaaugcacaguguacauggacuuagaucagaaauauagaagugacauguuguaugaauauuuuauacuauugcauguauaaaugauauagguuuagcuauauauaggcauaaaauauguuguuaaauuaauuuuuagaaggaaagggggcugguugucuuuucugguacaagacauuguucuagauaauaguucuuugaggagaauaacuuucccucuguuugcggaauacagacaacaauaauuugggacgcucacacaggagaagccaaacaacaguuuccuuuucauucagguagguuuacuguugugguuaugcagagguagccccaggauuuuuuuuuuacuuaagauugugugauagugucugagagcagagaagugucaagacauugggacuucggacaacugugaaacaaaguaucggaaguaagaaaauagguggccuagcaaaaauaacugguaccuccccuuuauccauaacugggccuguccuugagggcuuuuucauuacauagaaagguggcagucucucuccaggagcaucuuacaaauuggaaggagacaaucucuaaggucuuucaaggaugguuuucauggugucaguauagcugauugacacuggggggugguauucauggucaccagacuccuggggaugcuuuggucugcaucacugagcucaguuaaucaggcaaauguccuuccucucuuuccuccugcuuugcagcaccugcccuugauguggacuggcagaacaacacuaccuuugccucaugcagcacagacaugugcauucaugugugcaggcuuggcugugaucgcccagucaaaaccuuccaaggacauacuguaaguggccguucugaugcucacucagacuuggggguugugagagugugguguguaucuuuucagugccagcauuaaaaauuaacugugcaggagagacuacuuguucagcagcacuuugcuauugagagcuacuguggcugcccuggugguggaauuaaccuagcuauggucagugguccugggacuaucucagaguagcuaccagcugauccuguccuuguucuguccugaacucguuucucuucuaacccuagucuauuucccagcuuuuaauaggggcauauguuuuaaguuugauauuucuugcuccugcuuagacuuuaccucucucauagccugccucccgguuccauaaaugauucucaccaauucugauugcucugagcagaggucuacguacauggcucugaaccugcugcuuccugaaaccuguguguagauucugguugcuuuucuggaaguuuggcaaauggaugagaagggagaaaauucugcucccaggaaggaauuuggugaccuagcagaugggucagcuaggucauggagaggucuaccuaugaguuuucucuacaucuacaguuggagauauauauauauacacuaccucauuuacacuugagcucacagauaggcaugcacacgcccuuugucucuucuuugaucuagucacagaaaaccaugcuccuuggauucccagcuucuuccauuuucacacuuuucaauacuugguguccuuacaaaugggaauagccacagcauugagaagugugaaauuuagaauauaaucuggugugugaagcuguuuguuaggcgaagacagcuggcuucauagaguuagcaguaauagcaguaguauuuccaagacuccuccaaggaagucccucuauccuucccucugcccuugcucugcaugcugucccugucaguauggcagagcugcagguaguucuuuauauaaacacauccccuucuuccuuccccacccaaagucuuucuccuccagucuuggagucucugguacucagaaagcaggaaaaccuggcaguuuccuuuuuguauggucccccaaaucuaggaauuugggugagggguuacuuauagaaguaaaaaugagucaaagaguacugagucaccaaagcucaccucaccaugggugacagacagcucauaaaagcuggaaaccuagagcacacuguacagccaugggcccuuuucugugugguucaguugguuagguaguuugucuuaucuuuguuucucuagaaaguucagcugcccucuacuucuucuaggcaacuguguuugucugagagugacucggcagucuuuucugcuuauacacacauuugagguaggaguuggguuauuagugaaucugaucaguuuuagggacuuucugaagguuuuuugaguuucucacuuccuguuuuaaugagauucucuauacuauuucaucucacaacucccugaaaacauccuacuuuaagaagguuccuuucaaaauggaagcuuuuaauuucagaggaaacugcuacucagcacagauccacaagaggauggauuuuauuuuucaaugccuuuuccuaacuauaguuccugauguaauuucccugcacaaaugaauugcuuguguauguuuuugugccuuuggauggcuuuaccuauuaucuaucucugccauuguucuaucuaaaccuuuaucuuuaccucauccaauaagguacauguauuucaacagaauguagagaaacuguuauauuaaaagcacauaggaaagagauguucgaagucuacuuuuaaaaacuuguuuuagcucugcucaaugucacauauauguaguuauaauacucaggagucuaacagaauaguuucaggccauccugggauacauaaagagcuccuggcuuuccugggcuacauagugagaccaugucuuaagcagcaauggauaguaacugauuugauuagcucuguugauuguaugcaaauucuucauuuggcuuccuuaguaaguaauuuuuucccuaaagaaguauggaugagaguguggcuguuccuuuguaauauauggcaguguuuuucaugaaugaaaagcaaagugaggagagcauacucauguguggguucuugugcuguggucuuugauauccuaugaacucucagaagggccucugcacugcagcacuggcagcaugucacugcuccuugguagagccagccuuucccaaaugaaagcuaugauuucuuucugaaacugugcucucuugcagaaugaggucaaugcuaucaaaugggauccuucuggaauguuacuagccuccugcucugaugacaugacauuaaagguaguguugguaucuaaaggaaugaauugccuaauccuagacaaggcccuauacagacacacaacccauccaaccauuaucaucuggaacauuacuuuggacugucuuuucuccaugacuuuccuggucucuaaacuuugguucuuccaugagcuuuugacauauugaggccgagguucccacugagagaccuuacggccuguccaccagcauccuuccucacagucaccuaguggacuccuugcuggcuuugugagccucucccauaucuaccaccuaaggagugcucccuuaggugcaacagaaugaaaggugcugagccauucucaguuaggccauaauauuaguucacacuguuaccaaugccucuuccagaucuggaguaugaagcaggaugcauguguccaugaccuccaggcucacagcaaagagauauauaccaucaaguggagucccacaggaccagccaccagcaacccgaacuccaacaucauguuagcaagguaaagcaggguaaccucccagcucugaauccuuccugagcacagcuuuguucucugccuagugauuaacucaaaucuagagacagcaguguugaaguucuuccaaacugaaagaaaaauggugguucccuuugaauggaggcaagaggaaguguaucuccucccuccauauccauggagaugguuccaggaaccccuuuggacaccaaaguucauaguuguuuaauuuuguuugccuacaaccucugaauaccugcuuguacguuaaaucaugucuaaaugacuuauaauauccauagaauaagaaugcuguacagauaguuuagguaacaaugugaagcaaaggaucuguauauguucaguacaguuguguggggguggaggguagggguugguuugguucuuuucauuuugagacagucugauuauguagcccugacugaccgggaacuugucauguaaaucaggcuagauuagagcuauaccuuccacuuccaccaaagugcuaggauuauaggccugccuaacaugcauuuuuucccuucgcucucaaugguuuccuauuugcaguuugauaaaaccaugaaccuaagcagcaggguggggggauggcuuaaucuagugaaaguuuuuagcacaaagaaaggaagacaguuuagcuuggagcucagaguuuguucuuaaggcuccauucaggguugccuuacuaagauuuugacuagagauaaaagauucccugccucagccaaagauaaccugaaucucuuaauauugacuuaaaaugccagucaaccaagucccagaaccaaagugccagagauagcucauccaaaacaaguaacucuggguuuuuuguguacggauagagccuauggccuugugcaugcugggcaaguauguacucugucaucgaguacccucuacccccacucuugguaguuuaaugaaaacauuagacagaugcacuaagccagaaugaucggaaaaccaugauauggccacuuggaguuuauauucaugcacugugguuguuuaaucuggaugaaaccagaccccaaaggaauauuuguuuuccaagaagcaguggagagcuuggucuauguuguuuuagaggauuuuggagaaaguaacagguagguaguucucuucuaaggaaggaagcaccuaguaguagagugagcagccuuuucuggaaauuaaaaacagcuucguagaaaguguucaauccaaggcugccuucaagaacagauuauaaguaguucuuggguauacaucacuugccuggcauacacaucaccaccagaaacugaaaugaaaaggagccuaagucacacacaaaaguaaucuaaacacugaguggcuaaacuagaagaaccccaaggucuuaacucuccuuuuuuaauuauuauccaaacaccuaguuacacauaguuguccuggaaucacacgguacauaccaggaacagauaggcauuauccucuagcucacaagaaaaaaaggacacacugagccuugugauacccuguggauaaacaaaaagccaggugaugacagcccuuugauaugugcuguuuuuuuuuuaauucuaaaaauaauuaaacuuuguaguccuugccaauguaauugcauaugcacauguucaugcacauguagguuuagaauuucucauguauaaaugcaucucacucaauuugucuuuauuuuuuccagucauggcuggguggacuuaguuauucaaguggaaguauaaaacaaugaugguguuuuagaaaaguugguugaauggucuacaaagcauuuugugauaagaaauauggaacuggagaaagaagugugagcacagugguaaagugggaaaaucugacuuggcuugugcaagguccuggguuuugccugggggcagcuuuacuuuuuucuggagagaaaggcuuaauaggauauucucuuaaaacaaguucaaguauguuucaaauacaauggaaagacaguucacaugagauacaucauagagauuuugaaaaaccaacuuauuucagugguuguuuuuucugucaucuuucuagugcuucauuugacucuacgguucgacugugggauguggagcgagguguuugcauccacacucugaccaagcaucaggagccugucuauaguguagcguucagccccgacgggaaguauuuggccaguggaucuuuugacaaguguguccauaucuggaauacucagguaaugucuugacuucuggcugaauccuuccugaaagccacgcucucagguccuggacugucaggagggcuggggaaugaguuaucucagauagccucccuguggagauugcagguucuguguggucugcucuguggaccccaaugauauagggucuuccccacuuacaauccuggaguguauccucuagacucuuuccaucugaccuuaagccagaacuucagcuugucgucuucggagcauucucccuuagagaaaccacuaucuucaguugucuuauccuggcagggaccaccuaugucacacugaaggaaaaacauuaccuaguacugucugucacuuuagaaaugcugcccuuuguggaaagguccuguggguuuucauaaaacuuuuccagggggacacugugggacaaccaacuucacacacacacacacaccccguccacuguggagcaacuuggagcacaaaggaauacaaggcuuggaguuuccacauuugcaaauaucucauuuguuuaauacaggaucugugaguacuggauugucauuucagcagggauugaaaaggggagggguuagagucaguauguccacugcgggaaucucuggccuuacaugaauaagcaaauucugaauaucaagaguagaaauggaugagaacuagugugguagacugagggugggggaaguucuuuauuuucuuuuuggugcuggggauagaaccuagugccuugcagguggucugcccugagcuacauuucagcccuugguuaucauuccaguuuaaaaaaaauaguuuggcuauguuacugaaaauagguaaggaaucaauuuggccucaggaaagauccagugcuucacauucauguaauucaccuuucucauuucuuuuuugguuggucaacauuuagaaggauuugaauucuuaaguucaugcucccuugugucaagagaggcaauacauaagucaugcucuaggaucccaggcuuuucagggacauacccucaaauuuggcaacauaucucuggggugugccuagguauagaagccugucauccuaggacuggaucaggaggaauugaagccagccuggccuguguuaccaagaaguaaaacagaacaaaaaguagaaacauacauaggaugacuuacucauauagagagaauagauuuugcuagugguaauucaccuugauggugccaagaggaugaaaacacaggugccucuauggagcccaauucacuucuauaagauggcauagcauauuuuuacuaggugauucacaacacccaguacaauacagugugacuauuaaggaauacugguuagacuuuuuuggguuucuuuuuuccucccccuaaccucuuucuuucuuuuuuuuuuuuuuuaauacuggcaauugaauccaggguccuagaauucacuuuguauagcccacguuggcuucaaacuuggaauccuuucccagcuuuuggaguagcugggauugcaagccuguuucacugaaacuugaauuauuauacagugaguguguguguguguguguguguguguguguguguguguguguguguguuuugagaggaugcugaaacaguugaaaguuauuagauucauauugaagggagcagugaguuauuuugagacaucuaaagagccuguuuuaauccuuuuguuauaaacauauauaauacuguuggccugauguucuucauagucacaauguauacuacacuuuguuuuucuauguaaauacaaacuaauauuuaucuaaaugcauuuugcuuugcuaaugcuuucuauagcuggauaaugguaaauauauauuuuauaacaaguaaauauauguaugacaaggacacuuuauugcuauggguaagaagugaugaguagguggcugacacugguuagggacuguauuagucaagguucuuuagaggaauacaacagauagaauacaucuauaucaaaaggauguuuguaagaauaacuuacaggccauggucuggcuauuccaacaaugguugucuggucacaaaagaagggccaagaaucugguaguuuuaaaguucacaaagcuguaugucucaacuggucuucaguauacauuagaauccuaaaaauguaggcucuaguccuauuagccaagucaugucuuagcagcaggauagaugaacuugcuggugaaacugaaagcaagcaggccaacagcaaaagcuuccuucugugucuuuuuaugugagcugccacuagaaaguauggccuagauuuaaggugggucuucccaguuuaaaguuuaaaugaucgaaucaagaaaaugcuucacaggugugucccaaaugcuuggguuuuaguugaccccagauauaaucaauugacaaccaagguuggcuaucacagugaccuuucaugccaugucuuauaaagacauuuagacauucaagucuagagaaagcaaggcuuccugcaucuugugaugcaugccaacccaaccacuaacaaauaccacaguacaauugcguauguucauucuuacaaacuagauccgaaacugagugggagggguccuucgugcuuacucaagugcuuugaggaggagacaggagaauaagaugaaguuugaugauaaucagagcuggaacuagguaguggcuggagcagguacaaagaccucagcccaggaggcugauccaagcccuaggacggagacaagaaaggauggcuuaauaagggacacucauaccuaagcaccauagaggcuuaagaacgaacaucuuggcagagccacuggggaaagcaaggaauaugcuccagauuucaaauccagcacugaagggugggaagaaagaauaaggucaaagaggucauuagucuaagguccauaucuaacaagugugccucucaauggaaaccugcuggcuuggcauagccuuggcuuuaacugaaaugugguggcaguucuguguguggcaguagauugauuuuuaugguaauuucuuuaacuucaguaugcuugaaagcuucuugaucaaauagauguuuauggaggaacaguguacacccuuuuacugcugucguuuuugggagcucaucugaguuaccaugacaaauguuuugcuuuucagaguggaagucucguccacagcuaccgaggaacaggcggcauauuugaggugugcuggaaugcucgaggagacaaagugggugccagcgcaucugauggcuccguaaguggcgccucuggucuacuagaaguuaaggggugccgggcugcugaucccugauccaagaugaggugcuuccaaaggucuugugaggcuucuugguccugcugagccuuaccacauaacggccgcucguuacauaugcacaugcuugcaugcauugcaaaggaggcuucuguuuggguuaaaaacauccuucucuuugucccugaaugucagugaacuugauuguucuuaccugcagugacucuguacacauguguauaccccagggcauaggggauaucuggagucuuagucaguugucacuacuuuggugcagggugccauugacauuucacugauggaguccagggaugcugauaagucucuuauaaugcucuggaccccucacuagugccaagaaauaucuggccacaaauaguguuaguauguagacuaagaaacuuguuccuauucugucgccauguacauguucuggccaagcagugucaugagaagauaauuuucagacaagccucuugguuuccauggaucucauugugguccacuagcauauauaaaguuuaauuugucucugaacuugagguugcauucuggcuaauggacugagugguugguguggccugagaucuuuuguuaucugcuccaccauauaggauccagucugugaccucuugaguuucugggaaugguccuuggucuggcuuuucucuugccugauccuugcuagaguuuggucauucugauguuuagaaacuauccuguuucuagaguuuuuccucucuucuuaacuuaguucuaguaaaauuuuacaagcauaaaguugguggcuaggcuuaacccugccagcacauguuugaaggcacuugaugcuaucgcucagacuaauagacacuuuuucuuucuuuccaggucuguguuuuagaucuccgaaaguaaacacaaaauguagaaaacaaaaccauucuaauggagcagcagugaaugugugggauugcagcacccuuccuaugaugggcuccaaacugugugaacuugacuuguucgagucuacuuggaaaucaccugucccuggccacaggauuauuuucccccuccccuaaucuccauccagaaguuuaaaacacaaacaaauacaaagucauacgcaugguuguaucacaggaauaugguuuccaccuagaaugcucagcuggggaaggaugaagccaucagcuacauggugcaugguugguuuccauccagaacaggcucuaaugacugaacagggaaggagaaacacaaagcugugccaaaaaauaaagaaaagguuaaaaacaaugaaaaagaaaaaaugcugugauaaaccaaaagggaggaaaaaccugccccuuaugguguuucccuccuaucaauuuggauacuacaguugcuuuccaaaaagaccaguuuguaccaaugaaaaugugugacuuuguaaucccaacgcuguauuuucuagaaccuucuuuggugguuuuucuaucugcuaaaauucuguggucugggggccucccaccucagaugcaaacuguuuuuggcuuauuccuucugucuucccuuguuguugcccgccccuuccucugauguccuugcucugguguggucucacuuguaaugaaauccugcauagauaauggccacaugcacacaguggaucuuuguuggacagcacucuccuucccucuugccccacucccaccuauugcuuacucugucccuuucucauaguugcuucacauuaggucccaaaggcacuuucagagcauaguaagugcuuuauguaagaaggcagggauggggacuuuuuacagaaaaaaaaaaaagacuuacuuauaagagaaagaaccuggaguauuuuuugaaaaaaauauuuuuauguuaaaaugacuuuaaauccuaaaauggccaucagacauagagaguuuugugaaauucauauuuaaaagacuaagaagacacuggcagagucugaggugucuaauuaccccuucccuucagcuucacgaaaggcaguuaggaaagccguggauugggaaacguccuauggaagaacaaggcgauugcuuuggcagcugguggggaagaaggagcccacuaguuaggcaucaagcagaaugcucaacuguuugguacacauuuacuucagcagccaaugggaacacagugaagaagccacccugaccaaguguggcucauggcacuugccagcuacaucuuucucacaacaguguagcuaccgaugggcacuuuuaucaagagcaugcuuggugaaucuugcaaaaccuaagacccaaaggccucagugucccucagucuugugaagacagugagucucaagggagaauuucaauccuaaaaaagaauuaagacccagguagaaugucacugaucauuucugcccacuuuccaauuugucuuacagaagauuaggacaaagcuuucuaaaaaaugagaaaauaauaggaaagagaaguuuggcuauuuuuuaaaaacaaaauaaggcauagugugccugguaaaguuugccaucacuaaaucagguggccuuuguuuguuucuugucauaacuugacacugacuuguuguuucuuuaauuaguaaugggggacagaccagaaggggguugcaagagacagugugcaggguucagccugcagcugaggcaaguguuacuuagagaaaaguauacauauaugaagccaaaaaucaaccagcaaggaaggucaagugcucccuacacaacaaacaaauguuagcaccaaaacauguauuggccuccucuuugacauguaaauuaugugagcccucaaaaucuaaguguugugguauugaguugaguggugaguuuggauucugucaccuaaacgcuuaacaaagaaagcccaaguucuguggaaauuuuaaucauagcagaugucucugugucaaaggauaugaaguuuccugcccagagacugcuuuaguuuuaggauauaauuguggaaguccuaucauuguuccccaaauacauuucuguucaucucuacagacgaucagcuguuagaugccagccuauuguaaaguuaugacuuucauuugacaaguuccacauugcuauauggugguaauggguagaugacacauaaggaguucaucagacaaucucuggguguccaggcuacacccccuagaugaaucuaagccacauaagaauuauuauuuuggagucaauggcugugagacuaggacaaaaagguucaaucuacacaagaagaaaccuaaagaccauucacuucccuggccuuacagcuaaacauggacaggaaguuagugcuggccacacgaggaccaagcagaagaaugcagcccacaccccugaaguucacccccauaagacagcucagucugcagcuguuuggaagcguccaguauuuggacgcuaucauuugccugcugucauagagcaggugcaucaucuuuguggucaagggguggcccauguauuaugcuguuaccuaacauuguuuauaacuccuaaaacauugugaggaaugguuagucuugugaccaaauucaaccuugaaagcaguguagucacauagcagccuuuccagguauuuuuuccuugaguuugaaguaaccauauaccauucccagcacauccaggaugcugccuguagaggaccgaagggccagauggaccuuacaaaguucaacucucugaccccacucaacaccauaggacuugacuuuuuguucugucugacuaagaaauagaccauggagccaagugaagugcacuuugucacauguaaggaucugcuuuguuccuuguugcuuuucccuuuuuaaaccuuuguuauaucuuuccauucuguuucuugucaaaugcauaaauguuuguucugcaacucacugaaguuuugaacucuggcuugugcaguuuuuauugucugugucagacguacagccagacaugguccucuuucaacauuuuccacauucuguuaagcaccaucaaaacuccccucccccucuguccucuaccccccacucccauucacccaacacgcucuucgagaagaaaaaaaaucaccuuguguguuguagcucauuuguuucaagagagaaucaacagaucauauucagugucuugaauaaauugcucuauuuugauauuagag

SEQ ID NO: 9597 - RNA, 641 nt, Mus musculus
cauguuguugcucagcaaaagugccaacugccaagucggagguuuugcuuuggcauccauagcauggguacucugcagcaucucuacaggccucccacaguggcgagucugguacuuaaaugaaacaauguuuacugagccuaccacagucuuuauaggaauguggcgagucugcauuuaucaccaaaacagcaaauuuggcagugccagagugugccauggauacaccuacgaugacagcuuuaucccuuuggauguucauauuguucaacacuuguuacugaucuccagcaugcucggauugauuggaacaguugccaccauuuuugcucuucgaaagguguaugcagggaaaguacagaagaauaccacccacaauccauuuguccuuucagccauucuuaacaucauugccaguaucuuucuccuccuugcugucuuauucaacuacuuaucugucguucacaaagcaggaauugccuucccaccaucuuuccaucugccauuauauccaccuagucagagaauuggaauugcuaguauaauagccagucuaugugcucucauguuuuuaggcaguggcaucauuuucauuucuuacacuucucccguagaaaaacaaguguuuccugagauuugaa

SEQ ID NO: 9598 - RNA, 3334 nt, Mus musculus
auauauauaaaauucugauccagggaggggagggauggcugccuguaguccagaaguguuuggcuuuccuguccccagaggaagcugcugaaaacugcagcccaggaggucaccugggagaagugaggauggaggcagaagggugaggccagccccugcaugccugaagcucuuaaguuacacagaguugguguccccugcucagugcugaucugucagucuguccguggagacucuauucuggaaggagcugguucagucugguggggagguugggacucagccucaucuucaucuuguguguggcuucuuuuccagcugagaaacuuuuuuuucuuuuuuaauuuuuaaaaagaaucacagccaaaacaagacauugacuggaaaauccaaaauggcugcgcuuacccuaaucuuuauaaaaacaugaagagucuacuccaagaaugagcugggccacuacauuuucccggggaucuuggcccgcuugcgagcgauggcuuccucaaccuucuugagcuguuuaaggagcuccucucgccgugacaaugugcuggccuucccugacuuggugccugcuguggcaguaucuguggcuuugccaggcacgauggugaccuugcuggagcccuuagacuggggugacaguggacgcuuccuguccgcuggggcagcaggagcuuuagcguucuggccucucugcaucucugguuuuggggagcccauucuuccaccugauuuccggucuccagaaccucggucuggggacaaguuggccuucuuagcaggagggcucugccggugguccuugucugauggcucauagcgcuuccggcuuccuuuaucagccgccuuguucagcagugucagcuuuaucuccuugugggcaacaaaggagcccuguuggggcuguccgggggccgccggcugaggugccgcugccugcugggaggccuucccaccugcuggagcuuuagaggacuuggguggcugcguggauggaucccgcuuccgcuuuuccucucucacuccgucuucuuucuuggauuucccucucuccuucuuggucugggcaggaguuggggaucgagagcuggcugaggacacaggacuggccaggucugcauacaugucaucugaguccacacugugcacugagcugcuacucgagguggcgcuggacacugaggaaaggcuacucacacucagagaccuggaucuggaacuggagccacuguagcugcuaccacugccgcuaccacugcugcugggcguccuccuccuugggggaguccugguuugccucuccuuucuccuggcuucuuggagaucuccagguuuggcaggcucaggaccaggagcaguacuuuugguggccugugauggggcugggggaguggcuggcuucuuuauugacuucucccuugcuuugcuggaagguggggucggcucccccuugguucugacuggaggucuguguggggaaggugugggagacggggauggggacgagaaggaccgggaccuggaucggcugccugagaaggagcugugucugaaagagcggcuagaauaggagcuguaggaggaggaucgggaccgggaccaggacgagccagaguaggaugaagaccgugaagaugaccuggaggaauuggaagcagaggcugaggaggcggagguuuugugacgucuucgugcccagcuuggggagacugacacgccaugcuucuucuugggagacuuggaucggcgccagggguccuuccacucauaggcucgcuucaccuggggccccacagaggugcucuucuuugguaguucagcuugacggcuugguggcuguggggaccgggacuucagcuucuccuuguccuucucccgguccuucucgucucgcuuggcucucucucuuucccacucuuuccuccgcugccgcuccuugucccgcucucuuuccuguuuucgcucccgcucucucugccugcgcucccgcucucggucacgcucucguuccugcucgcguucuaguugucuguuuucucgcucucguucccucucucguucgcgauaguuaugauauggcucugcuucuguauacugcacccugaaauucucguacuguccaccacgccaaaacugcucuaucucauaguaauaauaagggucugcauaaggcucaaguguugugucucugacaucucucgggacucgagaauuccaaucucggaagacuucauucuccuucucaaacuccuggucaucuucaccaaugguuacugugaacuuuuuuucuucaaaguccggcuccuguucuuuccgaaugguugcuuuuuucaaaaccucuuuugcaugucggaguccacguucccaggcgcucucuguugggggcucuggaggggguggaggcaaaauuucaucaaccacuggcccacgccaaggguuggcaggcaucagugggugagguccaagaggcggggcaccguuuguuggaaaagguuccgcuuuggugaugagggaguaguugcccuugucauucacuccaggguggauaaaccuacagcucauuccccacgugcaguuuccuuuaaccuggccucugagugguauggaauuugguauugguggaagaagaguggauaauggugucacaacaucuuucaugaagaaucggcagguggggcgaggccucacguucuggucacugggguccuucacuucgccuucuuccaagucaucaucgucuaucucgccaucaucaaucuccccgucgucauccucuuucuucuucuccuuggcagcuucuguggguucuuguucucccacacuuuggacaucaggcuucccuuccucuccgggagccccuucccccuucuccuccuucuccucagccccagccuucucagccuccuccuccugggcagcaggagcuggcuccucaaggacccccucaucauagucuaguuuaugcucauccaguucccgggucacugaggaggcuucgucccugaggucacuugucccaucuucuucaacaucaucccccuccucgcauggggaucccucugggccccugcucagcucaugagccucugaauccugaucuugggacuugggcucacuggcucggucuuucucauccgagcaaguuuccuccuggcuuuguacccugguugcauuuuccuccuccuccaaaucagaagcccuuuccccagcuccauccaaaucuuguucagauccacuuucucucagaaugucaucaucugagagugccggcugcucuucauccucuggggagugaggauccaguucagggcucucggccacauucauc

SEQ ID NO: 9599 - RNA, 1308 nt, Mus musculus
uauagguagauauugguuaguuuuuuuuuuuuguuuuuuuuuuguuuugugggugcagcgaacuuuauugaugguauucaagagaguagggagggcucccuaggccccuccuguuauuaugggggucugggauggaaauugugagggagaugcucaguguugggggccgaguugggauagggccucucucuugcucaguguccuugcuggggugggugguccaggguuucuuacuccuuggaggccauguaggccaugagguccaccacccuguugcuguagccguauucauugucauaccaggaaaugagcuugacaaaguugucauugagagcaaugccagccccggcaucgaagguggaagagugggaguugcuguugaagucgcaggagacaaccugguccucaguguagcccaagaugcccuucagugggcccucagaugccugcuucaccaccuucuugaugucaucauccuuggcagguuucuccaggcggcacgucagauccacgacggacacauuggggguaggaacacggaaggccaugccagugagcuucccguucagcucugggaugaccuugcccacagccuuggcagcaccaguggaugcagggaugauguucugggcagccccacggccaucacgccacagcuuuccagaggggccauccacagucuucuggguggcagugauggcauggacuguggucaugagcccuuccacaaugccaaaguugucauggaugaccuuggccaggggggcuaagcaguugguggugcaggaugcauugcugacaaucuugagugaguugucauauuucucgugguucacacccaucacaaacaugggggcaucggcagaaggggcggagaugaugacccuuuuggcuccacccuucaagugggccccggccuucuccaugguggugaagacaccaguagacuccacgacauacucagcaccggccucaccccauuugauguuaguggggucucgcuccuggaagauggugaugggcuucccguugaugacaagcuucccauucucggccuugacugugccguugaauuugccgugaguggagucauacuggaacauguagaccauguaguugaggucaaugaaggggucguugauggcaacaaucuccacuuugccacugcaaauggcagcccuggugaccaggcgcccaauacggccaaauccguucacaccgaccuucaccauuuugucuacgggacgaggcuggcacugcacaagaagaugcggcugucucuggaacagggaggagcagagagccuag

SEQ ID NO: 9600 - RNA, 2536 nt, Mus musculus
gaaggguaauucaauuuuaauuuauugucaucacuuuuucuuuaugauccagauauuugaaaaugcaaagaaaaccaacuuuucaugauaugucagggacuggcacuaaaaaaaauucagacugcaaaugaguuauacaaaugaaauaucaaauggagauccaguuaucaaaaugaaagcacucaacauauuaaaaguucacaauuauuuguacagagcacauaaaaagucagcuugcuauccaaccgcuguguuuuuaaagagcuacugcagaaucugaagaaaauagacguauuaguuaacuuauaaagagaucaaagagccugaaacaaguaguaaaaauaaauuuuuugccuuuauuagaauggcauuaggccuuaaauaugccaauuuugguaaucacaguauuguuuuaauaagaaacgacucuacagaauugcaauauugguccaacagucuuggccuucuuuuaaagcaagaaacagaauguaaguaaccagaaagcagggcaggcaucggcuaacccaggagacuagcuucuuagauccaagcauuugcagagagaaccguugggcuggggagggguggagcagcucgagauaacuggaacccagagugugugccaagucccaugaggcugcuuguugaacucaucuuuuccuuggucacauuguuucccuccaauacuacaguuuuucuuugacuuuuuucccucaaaguauaaaaaaguaugaaauauaaacaagcucaggcacuacccacucagcagugcccaaucaggcauuacagagcucucuacacacccacugagcccagcacacuggguaagucaauaauauacaaaauaucagggcacagaaagaacuaaaacccauuucuuuuuugauacacauaagauucaaauauucaaccuaaaggaaaacaaucgucuuggcucucuucuacaucugcauguugacacacucauuaaauauuccuguaugaucauguuugguuaaaaaccucagaaccauccauucagacaaaaacaggucaucagaaagauuaucucauuuccaucucccugaccccaauaaacaagaagucaacuuuaggacaugacuccaaacacuggauugugacgacaaaugcuagguccaauuucuucauaauccuuuuugguguggcauacuugguagaacucaggcguggaagccagcauugacccuccaaaccagacugcauaccacugcauaugguguguaauaacuuguacaucaauaggcuugggcuucaaucuaccaccacucagcuccucgcuuaacuucagccuggcaucuacaguucucuucaaaucucuuugcaaacgauguccaaagucccugaacauaguugaaccaccagagaggacaauguucuuguagagaggacaccagacaucaauggggcaauucugaaugacuucaucuacaucuucugagauagguuguuguaaaaucuggauuagcaaacucuggauggaaaaagaucucgggucccaggaaucgcucauagccaacaucaauagaaaacucuuucuuugagauggcguugacuccgguguacuguucgauccacuuugacccauuggugucauacuuguuaaacucuuuuacuaaaucugggcagacauaacuguagcguuccuucacugcuuucgcaguuuccaaggacugcucaggaggaauuccuacuucucagucucgcagcaguugcugaauaaaauauguuauaucucuuccugcgauuggaauguguuuaauacagcugcugauaacauauccuucagccacaggaaugacaugagugacuccgucuccacugucuauuacuguauccgucagcguccgcucuccuacuugucuugagguccaggaugcagcuaaggcaagaacagccugcacagcaauguacaagccuggaacauugaaggacucaaacauuauuucagcaguauauucccuguuuucuggaguauucaguggagguucagucaaaagaaaguaaugaucuucagguucugcccuuaaauauuuaaaaaucacuugcuccauaaaccuuuccauuaagucccagucuucaacuauaccauggcgaauuggccacuuuguugcauaugugggcuuuucuauuguuucaucaccaaugaagaagucuaggucauccacgccuuucaucacccuccucugggcuuggucacccacuuuugcagacucuuuaauggcaauacaugaugggaugauaaacuguggcucuguauuuccagcauauccuaguuuuguauaucccgugccacaguccaccacacaggccggcagccgucccgccaucuuccuccucgcccgccgcugccgucccuuccgugcugcugagaggccggggagcuagagaugggagcuggcugaccaugcacuggccagggccgcccucgguccggagggagggaggaagggagggagugccuuuccgcggggagccaagauggccaccgcugccgacgccccugccaggccaggcc

SEQ ID NO: 9601 - RNA, 1168 nt, Mus musculus
uuuagaagcauauucuuguuacuugucuucacaugcccaugaucucuaacucccucuggugucuaucagcuacacugcaguuucauugaaacaaaugcacacuauacacccaguuccuuuauuucccagcagguuauaagcuggaauauaggccaaacccugaccacauccugagacagacaagacagacucccguuuaucaacaagucucugaaaaacucaaaugcuggacauauguauauuccacucuuccuuuuccugcagaagaagaacucacuaaauucuauauggucuguuauaccaugguuccuuggaaauaauaagaugccaucugauaacuuuuggcuuuuaacaaaacccaggaauguggaauauucuaggucuuaugaauauuacgcuggugaugagaaggagaacaaucuaaugggcaaucucccuauauuuuggacaguguuuucuuucuuuuccuaacgaaaguccuggagcucauuauuuuucugccacauggagaaauaaucaagggugaaaauaaugaugugcuugacuucauaguguucugaggugaagaagcuacuuaucauuucugaacuucucaggaaauuuauauucuauuauccaauucaugucuaaguguaagauauaagggucuggaccaucuuagucugugaucuugauuuuaucucuguauuccuuucaauuuuauccugcaucagauguaauuauacgagaaaaauauuaauaacauuaauaacauauaauaaaauuaauaauuaacaauaguaauuauauaugugguucuuguuuauuuuggauggggauaugugaguaguaucccuaaugaacuuauaaaugaaaggcacaaugagcaaauucagaaauacagagaauauaguaaugaaaugacucuuaaggacauucuguuguacucacagaucagaaugucacacacccaucaucuuaugagcuucauuuuguuguagauagucaugagcacagauacucacaacuggaaaauguauaaagaaugagaaacuuugaaguacuuagaccuaaaugggagauauguauaaauauguauauguauaaucaaacuccauuucuaaagacuccgggauccaugcagaugaagaagugggaaacucuaaggauaaaauuacuuuaaugaaac

SEQ ID NO: 9602 - RNA, 1982 nt, Mus musculus
ucccagggcugaacuaaucacuaugcaccaauauuaaaaaaaaaaguagccuucucuggcguuuuacuugggauuagggucuaguuucauauaugaucuggaacacacacauacacacacacacacaaacaaacacauucacacacacacauacagauuuccauuuaaucuggggaucagacacuuucuagaggagccuuggcauuugcaugcugaauuguugaacuuggcuaguacugcuggaacacuggcaggguggggaugggaaaacagauuuagaaguuucugcuacuguggggaagggacuucaguggcuaugugucaaucuaagccccagcagucugauuuuuguucccaugucucgcucucagagacaguuaacauuucauucuguuugggugaacucggggcaaagaugauggccuugguggcuguuccagcuguuacuuguccucccagcucuauuuguuuuucaaggcuuaccucccacccacccucaacuuuggccaaggcaauuucauuucagggucauguccaaugcaugaucaaacacugacgacugaaagcaauuccacacugcucaagggucagaaaccuuucauauagccauguuguuuccuuugccccucucacuucuuuaagagcaaggguauccuccccagguuuggaacgaggaaauaaaauuaucuaggcacacacacacacacacacacacacacacacacacacacacaaugauggguuggcaaggacagacagggagaguuaacucaggaaccaggaagaacauuugcuaaagaaagaauguugauuucacuuaaagacuuuacuuugacuuaaaccagaagauggaucccccccccacacacacacacacuugggauuaaaguguuuuauaauuaauacuauggcucccuuggacaauuaaccccauucaauuuaaguuucaaacuuaacuucacauuuaagugagauaagcagugucuugcccuuuccauugugaucagauuaagaaucacaaacuuugcuuaaggacuuagcagacacccggagaacagagaacgcacucugaaaugacuccacacugaaccucaaaaacccaauaagcacauuaauaauaauacuacaaauaauaacaguacauagaaaaucucaaacccuuaagccccccuuucuuuucucagucaauuccuugacuuucuaggcuuuaauugcccguguuuucucuauuucuccaaguccugcagcauggaauaagcacaggagaaaacacagggagggaaaugucaguuggaauccucggaagaaaucaggcagaaaguugaccuuuuggcacuuagcagugcaaugcaagguagaaccgcgugcgugcgccccuuuuuccugccagguccaaugacgguuucggggaacaguccgccugguuccuguccaaacugggagccccacaaaggagcaaaaagcuccccgggcccgauccccgcaggaggaaaccagcugucccucucugggcaaagcgagaaauccgcuuuagcucuccgagccgucccagcagccaggaaggagcuggcuggcaagcacuggcgccgggguggaagccccagggacgcaccugcagaggcucccaggacaggcggggagaccugcccggaagccccggucuagcugauaccagccgccaccagcuagcacugcuucugguccaaguuuugccuuccccuggcagcugcucgugccacaagugcacgaauugcggggauaagaggggguccagggcugcgauccacuuacccuuugagguguucccucaugguuguaaggguuucacaggcagugaggggcggacgcuuagagcggaggaguaagcuugcccaagccacggggcuccccgaaagucaagcgccgccgcccaggcucgcagccgaaagcacugcggaggagccgccgcuggcuggcgggcuggcgggcgggcgggacaggga

SEQ ID NO: 9603 - RNA, 60451 nt, Mus musculus
ggcggcucacaccggaucugcccucggcacggcgcgcagucaaggggguucggccggggaagccgugcccgcccggaccccccgugggagccugcggacggaccgagggccgggcggaggagcccggagcggccgcgggggcucggugagugguggcggggaggcccggcaccugcccgaggcuaggacuucggaggugcccuggggucguccuagugaccccgcgaccacgacguugggcgugggcgagacugcgggugucggcggggcucgucccggccucuggcucucagccggcccggguaaguaccuggcugcgggagguuugcgcagggccugucguggcggcugcgcccgccaggacgccccgaacgccccgaggccgaggggagagggaguggcugcggguuggggguggaggggcuugaucgcuaucagcccucgcgggagaggcgaggaugccuuuccuccugggcuccuggacauccugcagaacgcaccucuauggacagguuugaaguccggguuaaggcguucgagggauuaggacucgcagaacuaaggcugauucuuuuaaagguguugggaccugugcgcaagguuaguagugguagaaaugauugucguggaagugguuugcaaauaauuguuggcagguguugaggaaagcuaagauacugucgucuuuuaaagaugacacugaacagccgcccucugagguccaacaacagauuagaguugguccuaguuggagguuuauaguuuacuaccgcguaucugcuuauaaaguggauuaaguaggauaggaggagggaagauguaggcaaggugaaggagaaaguaagcugcacaguaaagaaccaaaaguucagauucaagacacguugaaguauaaaaaacugccuguucugaagcauaacauuuagaauuugguuguugcuggggaaauugccuguuaguggugcaaggcagggcucuuugguugugggcuucaguaaccuuugucaauuuuuaucauuuauaauguauuuaggaguuuguaaacggaaaggaaggagcaguguaaaagaacaacuugaugaacccggcuugcucuguacuuuguuagugggugggggucgggggcuuacuuuuugcuuuaugagugauuuauaggacuauaaaagaacacacuuagaaaggacgcaugguugagaaguuuuuggauuuuuuuaaauggagauuuaacuauaauauucaauuacaaaguacacuaucuucuaugguaacuuuucucaaugaacacuggaagucagcaagcacgucuucaauucuacauauacguaauuuguaaucaguggguuauguaauuuuuacaaacguacagucccccuccccuuucuccuagaacuuguuuaaucaagacaaaguuggcuuuagggaagguagauaauaaauauaugauuccugacguuacaucugacaaggcauaaugaauguccagucgcccugacuuuucuucuguuaugugacauauucuuuaauugcaggcaacccugugcaguuuguguuggagcaaagugagcugaguaucugcagucacuggacuugguaggcaguaugcauuuuaauugaauccuaaguguuucucgauguuagagacaaugucuauugcacagauaacagcauaaaacuucaguauucuucuguagcuugcuuacauagcugagguuauauagugcguaaacugcaaagcuagaacucagauucuuguauaucuaaguuuagagcauguguucuuucuagauacgcuguauguguuuaugugcuggcaucaauuuauugaaaguggaaauuuuuuauuguaaagaaaccauucaauucuguugaagguuuucgugugucuuaaaagauaaucucaaguauuuuuuuuuuauuuuggauguguccauuuuuuagacggagguaugguuugagcuaauguguaaagauucuaaauaguuagcagugaccuauaccugaaauucaugguuuugguaacuucaccuuaguguacccaagauacuucaaagaauaaauguuuuguuuacucugaucuugaauuauauuuauaauuguacuacuaaaguaaauagcaaguguucacaggggccuuggguugugauaguguccacagguccuucuuagaccucagaacaguacuuguuaggcaauuuugcuguucuucuuuacauuuagucccaaaguuuuagaguuagauugcauuuugcaaaauauacggccaauauuagggcaagcagcagcaucucuuaugggccuagggguggacagauuuuagaucuuccagagcagcgaguuuccgagccuuuagugaagucacagggacacuuugcagagguguuagguugggaaaggcauggcuuuuggcucccacugcucucugcuguugggucucuugacgugcuguugagcucguccucguccuagcucuuaucucuguugaagagacaggccccacaucuggguagaguucagcuggaagaaaagcuagagcaguagggggugggguggggaggaagaugacaccuaagugguguucauccuccagcaggucauucggccagaguuaauuaugugguuaauuaucuuuggcuggaaauucuagaaauguuuugcaguuugggaucuuuuuuuuuuuuuuuuucuaaagauguaaauuguuuuagaagucuuccuggaauggcccugucucacagacauggagaaaagauuucugaguuucucagucuggguauguguucuauggaguauggggcugguuuaaauaacaccuuguaaucuugacggacaaucuuuggguugaaggagcaaguuuuuaauuauaguuguacucccaagaaagaguuaaauauacuuuacuugggaagguaauuacuccugguauuuggccuauuagaguggaaaauauugacaaaugagaaaaccuaccuagaaguaaacagaaagccuuucugacauauuuuauaucaucacuauauaaaaaagcacaccgggaaaguguauguauguagaagcuuauuuucauuccuuuggcauaacccuauauuaauauuauaaucaugaauauuugucuaaaacugaaauagauguaaugaaauacuuggaacuauccaacugaauccuaaauauugaacaacauuuuuauaauuuaguuaauugaaagcucuauuugcuuacuauccuauccaacaguccacaaucucacuuuucuucuugcuuaaagucucucagcuuguauuccuuccuuucuugaugcuauccugucaucaccuggaucuuuccuuuaauucucaguuaacccuggggucuuuugcaaguuguaugaaaagugaagaggccuacaaagccuuuaagcccauccccuggucugaauucuuuugcccuagcaagucaagaggaaugcaguuaagacccuauaacccaccagauugugucuuuaaaaggagaaugagaauaacagauugagggaggcaguguccagacucuugcuaugguuuccugucucccuucuccugaagagucaagaagcuaaguuuguagaagccagugugcugcagaagugggcguuguucccuccuucucuucaccacccaccuuacucucagacgguccacuccuuccuuuaagcagucauccucaauuucuguccuucuccuaacuagguuuagccuucauccucuuugaucucuccccuacccccagcucugacuuuuguccuuuuucaugcccuuucuccugcucugcuuugaucagaauuuaaguaagcucagacuguuuucuuagugagggaagauuuccuucuacuugcagaacuuaauagggcagugauaguuggugugcuacugaguugcaaugcuaaauguguuuucccauagaaccauugcucacagaacuugguguuuuguauacuucuguuaccuucuggauguuuaggcuuucauggauugguuuagaaaugcagcacauuuauuauuguuuccugggaagccuaugccaauauaugauuuuaaaaauacugcaaguggaaauuucugguuucuuuggagacucaguugugucauaugauguuuucauggaaauucuaccuuuccuuuccacuaccucuggugggugguaggcuagaagggaggcuaaaacauuuaaguaccauuauuaaaaauagguuuugaaaaauauaagccuauacagcuguacauaugaauucaaagugcucucagcuguaugcauaagacuuguacaaguucaagacagaacaaagcccaguguaaagaugggaguugggcacaaaaaguauuggcaguuguuuuagcuuuuuagagaggcagaguucguuuucucuaacaauuaauggacccugauaaguuaaccacacuccaguggaaggcagaauuuaauagggcagugauauccaggaguauuugggaagcacaaauggguuuugauaggauuuucuuuuaaaggacaugaaguugggaaggguagggaaucugggaagagaugguagagggaaagugaauaugaucaaaacauauuauuuuaaaaaucucagaacacuaguuaaauauuaaaagugccuuguguuccagaaauuguuggagguugcuugcuuuuugugagaauaguagauagcccgucugugacuauccaacgucaguguaguuaugcugaugggauggcucuucuaggaaauaagcugauaaaagguuuuuuuaaagugucuagucuuugaaaauguuuauuuuauacauauggguguuuugccagcauguauaucugugcaccaccugcccaaguugaccagaagacauuagaucuccugggaccgaaguuacagaaaguuaucagaugccauguggaacugggaauuggacuuugguccccugaaagaguagccuaugcucuuaaccacugauuuggucuuuuaggaugucagugaaaguuuucugaauuaggguacacauuuugaaauaaaaagcaucuuuguuccaucucaaguuaauguuugucauuaaagcauaucuuauggugguguuaaaacaaccaaguuccaguuugucauggaaaugcuaucuugcuugcacuauuucuuguugauguuuugaaacuuuucaaaggcccuggccaucuugguguuauuuacucauuuuuacuuacugauaaaugaggaugguguuuguuaccugaaaguuuuaauauaaagguuuauuaggcugcugugauauaugcuguaaaugguugugguaaugagaugauucagugagagauuucaaagugagaaaagcaaagccaaacuuacugugcacuuguuugccauaaguguauugaaccuuagcuugcuggaaggaaauaauccaguaaaagucaagaugaggcugcaaggguugcuccaggccguucuugugugaaaacugaauuucaccuuacacccucuguucauuuuaaguuuaccaaauucucuaaauuauauacagaaugugauggcugaaaaacaucucugugggcaaaauucucaaacaacuagaucuuuugacacacacuagcucuguguuuuggggcaaauugcuuaaucucugaccuguuuccucaguuuugaaaugaggauaaugugguauuuaccucacgaggauuaaaugggccagaggauauauuauauuuaaagcauggcuagcaauagucaaugcacaaaagaauuguuuuuguuacuaacauugucauuguuguuaauacuugaucuuccuuucuauugugauaggaguagcuauaaaagaugccuuuacuuacuugauaguaacccuugaagcuaaagcuuaugaagggggcccaggcuagauguauaacugcuagaucuacucacaacuagucauaguucaggaaacccauagaauauuaagauuuuuuuccuauagccccaacucuauuaugucuaguauaaagacugccuauaugagcaaaauaggauugaguaacuguaguuucuuuauuaaaaauuaaugauauuggcaucuguaaagcuagagucuguagaaagggagccucaauuucuauaaggucuauaaauacauuuuuuaaaaaacuugaagugcacuccacuuucccacaggaaaaaaaaaaacuuacaugguguucugcuucucaggccaguucagcauaucugaaauugaauauugauaguacuguuaaaaacuaacuuucucuaugacaauguaucagcaaaaacaugcaugcagaacaucagguacuaaaagauuaugaauguaacuuuguagaaaacacagugggcuccucccucugugcaugaagagccuugaggaagagcuuucuuuucugguggaggaugagaauaggguaaugaugagagccauuuuuuuuucuggcuuguauuucaaaagacuauacugccuaauaaagugacuaugacuaccaacuguguauccagagugccugccuucacaucucuguuccacuauugaaaugguacucuccuuacaagguuuguggaaggauuacguguauugguaauggaugaaauacauaaaaccguaucuugcugguuuguaagaaauguuguauauucaucuuuguuaagcuuuacuauuuuagaacgucuagaauacccugcucuacuuaguugucuacugccuuucucugguguaccuucaauaggauucuucuuucccacguaagaguaguuuucuugucuucuuuccacagaggaguggguuuagauuucucauuuuuauuuccauucagauugaggugaguuuuuauuuguuugggccuuuuggguuugaugguauaauguuagaaaaguagcuagcauuuaaagacuccuuccugggggcuugcuguuagagcuccaccuuccugccaucucacugcccugcccguggcugguuuauaaagggccagaucaccucagauguaccucagcacccaucuacagcacaguagcacugcauauauccguuuccuuccuuaucuaguagccagagaucucacagcaauauuuuuaacuguuuuaggauacacaguuaaagggauggaucucccuauugcaaacaaacaaaaaauucucuuugagucccaggccagccuagacuacagggagcuucuauuuaacaaacaaacaaaaauaacaguauggaccagagagauggcucaguagggaaagccuuugcugugccagugugagggaggaccugacuuccaauuucaaacccacauaaagcuggguaucaaacuagcaagauaaacucaguggguaaaagcucuugcuaugcaagcccgaccaucugaguuugauacucuggacccauguaaagguggaaggaaaaaccaaacuauacaaaguggguuuugauacuuccaagcaugcuguggcaugcacauacacuccccauaguaaacaaaccaauaaauaaaugcuuuacaaucuuuuaaaagucugguuuauagucuccccuccccuccauuaggugauugaggaaacuugcuugugcucaguugagguauacauuucucagguuuuaguagcuuuuacaaaaccauuuauuuauuuauuuauuuauuccuucauucauuuauugcuuuggaacaacuuuagacuuaaauuuacagaaauaaauuacccacauacucuucucccaauccugucauacuuguaaaaacuaagacuguauuacccaaguugcaaaguuuaauuuuuauuauuucccccccacuacaacccuuuuucuguuccaagauggcauguugcauuuagucaugaaauaggcuacuuuuuuuuaacauguauuuguguguguguguguguguguguguguguaugacacauaauggcauuuguguggggaucagaggacauguggaacuccauacucuccuucgauauaugagucuccagguuugaauacagaucauuaggugugguagaagugcucuuuuuuuuuuuugcuuuuuguuuuuuuuuuuaacuucacuggaccauuucacugggaccauuuuuaauuuuuugcauuuauaucauugguaucuccauuuuauuagaaaaauauugccauaaaagcauucugugauuuauucuucaguuucaugcagguucugaaaggccagguguuuccucuaugguuggcaaaccagagauuuaucuuagcacugaacuuuaugcucugagauaaaagguaagagucgugugagagugaggagagccuuguuggauuuguaguugcgacuaagcacuuuuauaauuuaaaacuaucuccacaagauuacaugggcaauuuguauuguugguauuugaucauuuuagcuucagagugacacaacauucuuuuaaaauuuuaaguaugcuuauuuguugacauagauauaaauugggaugaacuggaaauuuaacuuuuaagggaauuaugauuuaguaagaaacuaguauaaucauuuaaggucagcaagguaacacauuugauugauuguuuauauaagcuuuuagaaaacccuagguuucaaucaaugauugauuuaguuuuaaauuaaacauuucuuuagggauuccauauguggagauuccacuauucugaauuuucauaaaugcuuuaaauuugccgucaaaagucaucaugguguaaacagaguuaucuaguaggcugcacaucacagacuuuacaaagucuuaucuuuccugccacagaaauaacuuucagcuguaaguuauggauggcaaagaaaauaguuuuggguugguuggguggaaauguuucaaauaaauauggugcauauugagagacacucccaguaaacccucuuuuauguagaaaugaacuuagaaaauugggaaggauggcuauaagucaguaaguaauuccagguguuuuauacuuacucauaucuuuucaugaccuuggacaaaucaucuaccuucauaggagcuuuguuucuuuauuuguaacauuaagggaugguuguuucucuuagugcugagauuauaggaggaaugagagguguuuccuugaaauaugagcauuuaaucacuuucuuacuucggagacaggcucuuacuuacuccguucguaccucuggcugucuugaacuuaggucgguccacuucccccugcuucccagugcuggcauuguagaugaguaacagcaugcccggcucaacacaguccuaacacaucuuuacaacuugauuaugcaaaucucagggagaggcucaauaaauauagcuaaauguuauaauucgagguuugugcuuucauaacuuucguguacaauuccuucaaaaagugucauauacaccuugucccuugucacuugcucauauguaguuauuaugugcuggaaauaagcucuugcugguuacaaguacauucugccacugugugauauguucuuccauuuuucacgagucucuucagaaauaaaaguuucucauuuuuaauauaguuauuuuuucucacagauuucaauuuaaaccauuuuccuaccccaugauuuuaaagauuauccgcucacaucuggaagcuuuguggcuuuggugaucacacgaauauccagugauuaccuaaaauugauuguuuucuguccuuuucuccauauggauaggcagcugucccugcacauaaguuuccauacuagugagaagaauuaaauauguauaugcaccaagguuuuguuucuguguucucuguucccuuuguaucaccuuguucugacagcacacuguguuguuuguuagagcuucauucuacgucuccguauucaguagaacaaguucuuccaccuuguccucaaaacaucuuggcuguucucagcccuucacacauucauaugaauuuuaguaucauguuacauagacagacaugcauaugcauacagucugucaaugcuuugauuaugauugaggauucuaaacauuugguggagaagugacaucuuuguuuuuaacuucguuaacauugaacauuacucuauuuuuuucucugugguauuuauaaucucuagaaacuuuuauucuuauguauuugguauuuucauguuacuguauguaagugcuuauagacuuuauuuuguuuacauuuuuaugcugaccuuauauaugaucauugaguuaaacuuuuauuacccuuaguacuuaucuuuggaauuauuuacuagguaguuagucaucuuaucagccaauaaagaaaauuuuauuucuuccuuucaaaauguuauauauaguuuuuguguuacugcauggacuaauucucuaauacugacuagaaguaguauucgugggaaccgguuuuguuccauuugucaaagaaaaguauuuaccauuucuguacuaauuaagauauuuguguuuaauuuuuuccuagcuuuuuuuuugagaauaaugaagcuuugguuuauucuuaggaucucaccagguguucuuccuggcaaaauaaccauaucauuauguucuucaaaucaaauguauugauuacuagucaguaaaucccaacccagcccggucaacaaaacaguuuucuuuuacauuacgugggaauuucagaacuuuguucaugaguaagauugucuugaauuacacguuuugguuuuuuuuuuuuuuuuguauucuugucaaauuuuaagaguuuuauaugcugggccgugguggugcacaccuuuaaucccagcacuugggaggcagaggcaggcggauuucugaguguucaaggccagccuggucuacagagugaguuccaggacagccagggcuacacagagaaacccugucucgaaaaaccaaaaaaaaaaaaaaguuuuauaauaggguuuuugguguauguacaugcuaacauucaguagagaagcuauuuagauacaggguuuucuuugugggaaacuucagucacaaaaccugggaaccugacuugguagaauguuuugaguaauaaacauuaagcccuccauucaaucacuagccgaauauaaacgugaaugguacuucaugccuggaaucccucacauaggaaguggagucaggaacugucuagaggucagggucauucugacuauauaaugagugccaagucacugagggcuacaugucacaauccuguuugaaacaaaagaaagagugaaugaaugaaaauuagaaaauauauuguuuuaguauguauucuucaggcucguuucuuuccacuguuuuggcagauuauuuugauaagcuuuucaacuucauuuaaaaaucauuuaaaauauuauuauaugagguaaacacucauacaucucuuaaaaagcaagcauuuuuacaaauuaaauacaaugccagucuguuuuaaauaccaugugcaugccugguacccaugcaggccagaagaggauguugaguccccuggaacuggaguuacagauaugccaagugaauguuggauaucgaaacagugaccccugcaagaacaacaagugcucuuuaaacacugagccagcucuccagcccuuugcauuauauuuagaaccucauugggcacuccuacaauccuuucuccuccucugccauagguuucccuaaguucugccuaauguuccuaucaguugcuggaugaagccuuccuggugacaguuaugcuccugucuaccaguauagcagaauaucauuagguaucauuucauugacuuuuuuuuucugguugucuuugguucuauccuaggugucuggguccuggcccuccagaccaggggugggcucccucuaguggcuugggucucaaguuggacuaguuaucaguuggccacucacagguuuuguuccauucuuaccucaguacaucuuguaggcaggacagauuguaggucaaagguuuuaugucugggucaguguccuagucccuccacuggaaacuuugucugguuacagauaauggccaguucaggcucuauaucccccauuacuaagaguauucgauagggaccuagggucacccuuguagauucuagggaguuuccguugcccuagguaucuaccucaucccagaaauguguuccaguuccagcuauuucucccagugcucucccccuccacuccccgcaaccuaaucccuccuguucccaucucuacccaccugcagucuacccacaaaaucuguuccauuucccuuucccccuucccagggagauacauguguccacccuugagcccuucuuggcacuucacuucuuugggucuguaguuuguagcaugauuauacuauauuuuacagcuaauauccacuuauaagugaguacauaccauguuuaacuuucugagucuggcuuaucucacuuaggaugaguuuuuuuuuuuuuuuucuacuuccauauauuugacugagauuuucauuuuuggcuuuguauauaacauuuucccccuuuaugaccuuucuggcccagggcuuauuuugguggggggagggaaauuuuaaugacugcauagauuuccuuagugguuauaggacuauucagauaguuuaccugaucuugauuuagcuuugguaauggguaucugucuagaaaaaucauccauuucauuucgauuuuccuuuuuuauuugauuuuuuauuuuuguuuuuguuuuuggagacaggguuucucuguauagcccuggcuguccuggaacucagccugcagaccaggcuggccucgaacucagaaauccgccugccuccccccccccccccccccggcugggauuaaaggcgugcgccaccauuuuguggaguacaggcuuuugaaguaagaccuaaugagucuuugaauuuccucaguacccauuguaauacuggguuuuaguugggucucuugacaauaccauauauguguggcuuuuuuuuuugaaucuagccugacaaacaccaucuguguuugaaauauuccauuuaaauuuaacguaauugcuggaauauaagggauuaagaaaauuguugcuagcuuuuccuauagcucuauuuuuucucuuccuuugcuucuuauuaguuuucuuuuuauucuaauaucacguacucauuucuauuccuccugaaauuacuauagcauuuccaauguaugucuaaugauacuuuuaccuugcuaauauuuggaacaaauacacuuuacacuucaguucuguuuauuaucuaucuccuggaauguaugcaguugguguccuguaauucuuuauacauuuguaacuguggguacuaauuguuuugugacaucaguguucuuuaaauuuuuuuucacaugcuuauguacacuucauagcuccuucuuggcucaguuuuguuuagccuuaugacuuaguuuggauugccuggcuguguuuucuauuuuuauuuaugaauguuuuuuauuuucauucuuaaagaguauuauaugaauauaugggguaugagugugugcauaugugugcgugcaugcaaucuugacaacuuuuaguucuuuccuuuuacuguggaccucaggaaucaaacuaaacucagguugucagucuugugcugcaaacacuuuuacccaguugagccauuucacuugggcccuaaaauuucauguuuuuaaaaauuuuauucuuggguacuauauauacaaccacugaaauucauuauuuguauuuuuaauuugauacauggguaccguguuuccagucccuaagauuucauucuugagcgacauuuuuccgagugggauuguaaucugcugcuuauugucuguuuuuaugguuucccacccccuuuuuuucaagagugaagccuucagccuaccauuuguuucuuugaaagcagccucuuccucguaaggaugcucuuaaaauuucuuuccauuguggguuuucaaccaguaauuuauugaaauuuuuaaguaugagguuugacaucuuucaucauuuuuggaaucuuuucaaucauacacauaaugcugcuucauuuuuuuccuuauuccuuggauuucaaugaccuguggacuauuagaacauccaacgcuaugcuagucauauugccuaccccuucucuuuguucugaaacccuuccccaagucuuugaguuuacauuugugauaauauccaucacccauuaaauggucuuucauuaauuaauuuaaauucuugcaguuuuaguaacaguugcuuuucauuuaaaaaucuauaaucauuuggugcaugucauuauuugugacaaccaagcuccauccacagucgaugcagucgauacccccaagauuauauuccauaacaacgccauagacuuguuaccuugcacauuaugaugucugcacagugauuuauuucuuaaaaucucuccuuguuagguguaacauaauggcuauacuuugcuacuuuuuaugguucucagguuuggugcugagauauuaaacauagcaagcauaauucaaaacuuguaaccugauaaagcucuaauaacuguagccccuaugaaucuauuuuggaugauuuuguuauugccguggugaugcugaugauagugguugugguuguuaugguuugcucauauccucugguaguuuucuuucauuuuauucuggacauuguauuugaaaagcaauuuuagaaaucauuugagggcuggagagauggcucagugguuaagaacacugacugcucuuccaaagguccugaguucaaaucccaacaaccacaugguggcucacaaccauucauaaugagauuugacacccucuucuggugugucugaagacagcugcaguguacuuacauaaaauagugaaugaaucuuuggggcugagcaagcgggacuggagugagcagagguccugaguucaauucccagcaaccacauggugccucacaaccaucuguacagcuauagugugcucauauacauaaaaauaaauaaauaaaccuuuuuuaaaaaagaauuuaaaaaaagaaaucauuugaaaccaaaggugauucauuucagaaauauguguguguguguguguauacguguguguauacguacacacacacacacacacacacacacacacacacacacauauacagacaugcauacuggugagguugcagggagaauuugcuuuugccaguccagguauugcuuaauaaaauuucagguagggcuuuuguugcuucuuuuggugguagugguaguauuaggaauugaaccuaaggacuauacaugcuaggcaagcauuuuaaugcucagucaguuagaugacucaagaccacauuauauucagugauugauuacugaguuacauuuauuucuaaaaugcugguucuaagcugaaggugggaaaagaguacucacaacccuuguggauguggccugucagguaaacuuuaaauuuccuacuuuccuagaucucaaaguacuuuccugauagaucuuugacccuuuaagaaaaagacuuuuuaaaauguccugucaaacucuguuacuugucuguggugggaggguugauuuaaauuacucagcauccuauagauaaaaaggcuuuugauauauaugagucuucauugacagaauuuccuuaugaaugucaguugacucuuuucuuggagacuuaggcuauuuuauaguuguauauaagcuuuguuuuagauaguuguacauacauguguaauuauguaauuuuuacucaaaguuuaccauauucuguguauauauaaaugugaguaaguucuuuccugaccauucagcaagaguuuugaguccuuuuaacucuagcaauuccuaguccuuggcaauagauaaguuuauuguauuaauguuguagcuaaaugcagugucugaaaugauuaucuuuggaaugugaaauucuucuggauugcuguugaaauuggagugcguaauagcaacuaauuuuuauuacuuuuauggagacuaguauccuaguuucccauugcccaugacuuguuaguguaccuauauguaggaauuauagacaucuguugguaaaaacaaaacacaggagucuuagauuugcuacuauuucagcacuuaagagagugaauaaguaugacacauccagugaauaaauauaucauaacucuuuuucuuuuauguauauuaauuccugcaguagccuuugaagugaguaucuaguuacaugugauuuuaaucaaauaacuugucuguggcccaaugccuggaaaaugaauauuuuuuaucaguacacauuuuauuucaagucuuauggucuagagaugcacaccgacuuuucaguuuuaucucuuuaugcuuuuccccauguaaacccucauacuaagaccccaugacucauguccuaagguuagagauaguuaagagaugagccuuugcuauccuauuguuacugaccuuccacuacccuauuucuagagcauuauuuuccuggcucugagauuuacugagcugugugcccuguuagaaagcuugcuggguuauucuucccucccgucccugucccagcacacauuacuccuuucccuugucuaguucuaaagaaguuguuucucugcuucccauuauauuuuucaccuuuacaguuaaacucagacuucccuccuuucugucuucaagaaugucuucuguaaaccuuccuuguuugcuucuuuagccaaucuugauggaaucauagccaaaauccuguuuguucuauccuucugaauguuaacagccaaaagcugagcuguuucaggccuguccuagccauaaucagcacuuguguauguguggacuugcacugggaaguaucccucacaucucauuuucacucugugugcugugguccccuuggaaaacuagcagauuaccccugcaaacauuggugcuuuuauucaguuguaauauauccaacugcaugacagucaguucuaaguccugcacuucuaagauaugaauaugcugucuccucuaauuuuguauuaauguguuuuuucaugaauuuuuuuuucauuuauaacuguuuaaggauucuuuuggggagaaugcaaauuaaguaguggucucccauguuuuacucacaaaaauuacuuacacuuuuaaaaguguugaaggaacucuugacuuguaccaaaucccuuugaauauacuauacugguuuguuccccuuuuuuucuuuuaauuauccauacuuuuuguggucugcuuugggguuauuuuccuucaauaaacuuacuuuucugaauccauuucucccuuguauaaccuucauucugagcauacaaagugugcauacuucacuagcucaagacaauaaggguauggaguuuaugcugugugcuucaucacuuacugcaacucuguuugagaauuccaugcagaaauacacuuaguuucaucauucccaccccucccucugcccuuucaacuccuccaucaauuucuugaccucuuuuacaauuauugcugugcuuuggggcugaccaccuaggauugggggcucauucuuaaaucucauucugcuuccuucagcagccauugacugccuggagcagcaguucaucuuggggugcguuugcagauuuuacacaggcaaccauauuguuggaaguuuguagguaccacuccaucccugcccuguccaaaagacacuuaucuuguagcagagucauccuggguccccaagcucuuagaguuucuuucucucucucuucuucaguauucccugagcuguagguguagaugugcuaaagguauuucacuuggggcuggguaccaauuuuugccagauuuuggaucacuaacauagccucugccuacuaaauucaaaaaagcuuuaaugagagcuguucuuaucuaggaaagaggauaaguguuuagaaggcaguugaaaacuagagaaccuaaguaguaguagguucuccucuagggccugggaacucugugcuugacagucccauacuugaguuucuucccauugaguagguuugggauacaguuagacaguuguugauuacuccgaagagacaaaggacucccuucauuucuaauaaauauauaaagguacuagcuuguuuuuuuuuucugcuuuuagcuuuuuucuauauucugaacgagaaaauaauccuuuuucuuccaacauuacucuuuucuuuacugauugagucaaggucuuucuauguggcccaggcuggucucgaacgugauuuuaucccuucuauaaccucccacguacuugaauuguaagugugaaccacaacacgcaauuaaaaucauuaucuuucagguauuacuugaaauauguuacuuuuuucuugacuauagugauucuuaguugauuucauuuaacuuuaugaacauuuccaaauguauauaaauaaaaaguucagcacacuucuaauugcuguagcugacaacauacugccgaauuuguuuucuccauuuuuuuucuuuuuucuacaaaaacugaaagcauaaauaagaugucauugcacuccaaagugaaugugccucauacuacauuuucuuaucuaaaugcgauggcauuaucauacaaccuacuaauacccuagcagcaaaggcaacauuugguucaucugaaaguuuccgcgguuaagccucuucacgauuugcuugagaucucuaucagcucucuuaucccauccuggugaaagguucgucuguuauuuauccuucguauuucaaauggacuagaaauuaucuaucugcuuaauuugguucagcuuauaucuuuggauguguggcaagaacacuugcugucauuucguguugcgucauaccugagagcacauaauaaaucauuuggucacuucugucauuauuagguauuuuuuuccucugggggacauccuuauucugcuucacaggugcuaguugcuuaacccaaaaucucuugucagcuguguauuguuaagaaacaauccuaguuuagagaucgaaagagucugcuuuccuguuuaacacuuuguauuguuucacugaaguuuaugauaaaguaaucuucuuccuucugaaagaaguuaaaagucauccccagaaugguagauuagugacuuuguggguuacacaggaguaucuagucuccuagcucugggugaguuagccuauuuguugagauugaauggcagaaaaaccaaaccagaaagaagacuuuauaccuacuuccugcugcugccuuguaguuaggguauggugcucacuggagcugugggaaugcacaaagucuuguagguuacuggaaacuaaaucaggcucacuauggagucauuuaaauuuuaaagacccagggccuuaaaagagccccagcacaguuuuguaaucaaaugcauuaaauuuuaaugacuacuuuaucuugggaagcugcagggacccccugaugguuuacucuucuugcuagguuuuucugaagccaaaagcucagcaaagcauugugccuuugcaauuuggaccugugccuuaggcccuagaggugacugaugggaacagccuaucucaggcagccaagggagcgguuuucuucuguguugauuaaauguaaacuuaauucaaugaaauguagucaaaugaccauuuacauuuucaugaccuuucauuucauuguacaugguuaucauuuauucaugaucccuuuuaagccuuucacuguuuuuaaucuuaccucuuuggucauucuuuuuucuauaggacaguggugccagcauuuucuucaaguuauucacccugaauuauagugugucuaacuuugcaaugugucuuagcugaaguauuagcaauugagacguugacgguaagacauuucuauaacuuuguugagagugcacuggucuuuauagcucuuaccauguuucuuuuuuacacugauccccauaaguaauccuuccccguuaugcauuuaaaggauaaauaagcuaggugaugugugccuauaguuccagcuacuugagauacucaguauccuuugaauguacaagaugagacagcacaucaaaacuaagccaaaccaagcaaccugcagagcaaggauaacaaaagaaaaagaagaccaugugauuuauuuuauuuaaauucggcccuuauacccuaagcagcuguuacugccuguuuaacagaaauuuaaguucuuuggauaauucauuuaguguuagauacuaaucuggcccauggcucagaucucuauugguuggagcuauuagaauauugaaguccuaccccaaacauuaacuuuaucuaauuuaucucuccauauauacauauauauguguguguguguguaugugucuguauauauauauguauauauauauauauauauauacacacaaauauacauacauacauucauacacacacacacauauauauucuggauucucacauucuuguucuauaacaaaauugaacaaacaguaaugccaauauccuuaacaaacaaggguaucaauuuuuagcuggaugguagccuuaauucuggcuucgaaccugguagaucugaaucaauugauuauauaaugcuaucagcuuugauuauugcauaucuuaucuuuuuaccuuuaagaauuucccugcccuuuuaaaugcauuucucauuauaacuguauguguguguguuuguguguguguguguguaugaauguauuaucucuugcaaauuaaacacugaagccuauuuaauacauacugucuuuuuuagccaguuuuuuuuuucuuuuuuuuuccauuuauuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccaugaguguuuuguucccucuucuaaggaggggcauaguguccacacuucagucuucauucuucuugaguuucauguguuuagcaaauuauaucuuauaucuuggguauccuagguuuggggcuaauauccacuuaucagugaguacauauugugugaguuucuuugugaauguguuaccucacucaggaugaugcccuccagguccauccauuuguuuagccaguuuuaaacccuucuucccuucaguuauuuuuaguaaaccaggagauaggauugggcuugggcucaggaacucucucucagcuucaguauuaugauauugagguagauggucccuugacaucagggguuguccuguauacugugggauguucaggagcacgccuggccucugccugacagauuccaguacacuccucguuaugacaacuaaagguagcucuagauaucaaaugucucuauaaugaaagucuuuuagauacaugugugcacauguaaaugucugaaugccauggaguacauacagaggccagaaaacaaguuucaggaaucaguugucuccuguggguaccaggcuugugugagaagagcuucuuuuaacuacugagacaucucagcagccuuccaaauggcuuuugcagggagaccagcugguauauaugaugugguagagccuuuuagcuuuaugauuauguucuuuuuauuuaaaagagagcagggccuacucuuuguaggugcagcuucaaugccauuucuuccaugaaguuuucugcggcucuccuuuucuuugucuuaccacaagcaacauuuucucauuuauaucuuccgguguguuguuuuuaauuugaggguaugggcuuucuuuauuuucaauuucaguuuuucuugaaugaacaacuauuugggaauaucagauuagaaacuguuaaaugaaugguuuuaaauacucuuuuuguugacuuuucaaauccaucuacuagaagaaccccucagaacuugaauuucuggauuaagaagaccaauauaggucaucuaaaucauuugucgauguagucuaagauagaaaccucuuuauguauaugugaaauagcuauauaggaauacuuggaggcuauauuugaaagacacagaaauuaauagcuuaagcuguuugaguuuucauauagacauuuuaucacguuuauauugugugcaugugugccaaagcaugcauguggaaggugagaguacaacuugcagaaguuuguuuucuuauuuugccauguggguccuagggauugaacauggguugccaggcuugaugccaagcacuuuugauugcugagccaaucucacagguccaaagacuuuuuucuuaaaucaaauagaaagcuucuagguuauuaaaaaaaguaaacagggauagcaguaaauauuuuauuuaaguaaccuagaauauuuaccacacuuuaagccagguaucaacuccuccaacaauaagaaacacauuuuaauuauaucuuauauauauacacacauacuagaaaccaguuuuucacuuaguauuuuucuguauacauugaacuucguuauuuuucaguuaucuuuguuuuaucuuaaagaauagccauugccuaguacauuugucuaauacaggaauuggucacgacccuaggauuugaaaagcacuaguaauaaauaucgagauuaucugccucuagaguaugucacuaauagguuguguugucauucuuuugaaauaaugucauuuaggaauugagccaacaaagacauuaggauaccuuaaccagagcauuuuaaauuuccaacuacuuugaauuccuauaucuugacauuucuacuaaguauuuauaaauucuacuaaguauguauaaauuauuguacccaaaagagcuuuucuuuauuuguauucaagaauuauauuaauaaaacuuaggagagaauaaaaacuuaacagauauauuaugugagguucagaaagugguaucaaacacuccaugcuuuuauaggcauguaaagggggagaaaacuguauuuauagaaguuccugguagaugaggacuggauuuuguguuauaucagagguuauugcacgugguagaaauagcaauaaguuggaugaugaauacuuguaccugauacuuaaagaucauuuuuauucaagauaaagugagagguuuuaaaauuagauauuaaaguucuggcaguguaaaugagauacaguacuuuaguucuguguuuaugaacugcaguguauucaggagauuaaucagaaacuuguguguaugauagcuaugauagacccugacacucuaacaugaggauguuaaccuuggguuacuagguuuacugagagugcagauaaugucuaaacuacagaaaguagucaccaucaaaauacgugaauacaguuaugcucaauauaaacccuucuuuguagaacaaaaacaugcaauagcauuuucaaaauaaauauuuuacuuacacaauuaaaaacuauuuguauaucauaggcccagguguaauccuuucuugucuaaauagaaugagagcucaggauguuaaguuacagccaggcgccacaaagccucaaaguaagcauagacuauggcuuugucuuuuuaaacugcagcuucuucuauggaacaacguagaauuuaauuacuguagaaaaaaaauuaucuaaaaagauaagucagcuugugaugauacuuggcaaagagccacaugcccuagucaaguauuaugucugccagucuucuaagucaccagaagucucauagaugucauacauuuucaguugagaaaagagcaaaaggguaucuuuaaauuuucucggauuccuagacaacugaaaagaaggucauuucagagcuggagaugugaguaaaaaucuccuguucccaggacacauagaccauauugagauacauuuuuuccuccaauuuuaaauagacuugaauuuuuuaaauuuuucauuggauauuuuauuuauuuacacuucaaauguuaccccuuuuccuggauuccccucugcaacccccuagcccauccccccuuacccugcuucuaugaaggugcuugcccacugcccgcccacucccacucaccgcauucccuacacuggggcauugagccuucacaggaggaucuucuuccucccguugaugacagacaaggcuauccucuguagacuuucauacuuaagaacagauuuaguucgcagaagaauugagaauauaguacagaguuuccaauaccuuguacucagcuucugcucuuauuaauagcauauauuagcaugguguuuuuguuauaacauguaccuguaguuugcacuuuauucacuuuuccuuggguuuuaaccaggucugguuuuuuuccuuguguuuuaagcuuccauacaggaaaauauguaacuuuugguuguuaugucuccuuuuucagagucuucuuuuuccuuuugaggccaugacaauuuugaggugaacauggcgaucggguucuuuguagagcauuccucagauguguugcucguagcugggcugggguuauggaugguuuuagaggaaggcuauaaacaaaguaccguuugaugcucuuuucaaauauccagagugcugucaauauggcuuaucauugcucauauugaccuugauucaccugggagaggaaguguuugccauguuucucuucuauaaggccaaccuuuugucuucaucuuguucuguauuuuugggagauguaucucccccuccccaauuauuuuagcauuuccuuuuaccagugugggcuuauuuaguuuauacucugguucauaaucuaacacuacuuuauuuugauguccugguucuuucaguuuucuccuguguuacuuugauaugacccuaucauuaugggucgucuuuuuuuugaauacuucuuuacuuucuggcacuacaagaugcuucaagcugagcaggugaguugacucagugguuaagagcauggaccucucuuccagagguccugaguucaauucccagcaaccacaugguggcuuacaaccaucuguaaugggaucugaugcccuuuucugcuaugucugaagauagcuacaguguacuaauauacauaaaacaaauaaauaaaucuuuuuuuuuuuuaaaaagaugccucaagcccaucauguauaauccuugaccuaguucuagaaucauccauuccucuauagggcugugauucauucuguuagagaauacuacuagaaacuuagcuuguuucuagauguucuagauguggucauuccaucuagauacaugacuuuccaccuucguaguacugagacccuuuaaagcaguucuuuggguuuuauugacccccuccaaccauaaaauuauuuuguuacugcuucauaacuguaacuuugcuauuguuaugaaucauaacguauauaucuguguuuucuaauagauuugaaagggcuguuggacacccaaaggagugcaagcaacccucugguugagaacuccuguucuagauucuccuggcuaggauuuuguggauauauuuuaccauacacacacacugaagcuuauguuccaauauuucagcauauagguuauagauaacaaauacauaaucucuuugaaauguuuuagaauuaaauuuaacauggauaugcuuuuauuuguuucuaggguuauauuuaacuugaaauguuuuucuugaucauuuaaauggaaaugcuauuuggguuuuauuucuuuugagaauauaauaaaauaugggcuauaugccagaaaucugugacuauuugaaauuaguuuuuacuauaaugaaaauccuauaggaugcuuauuucagaaauuaucagaggauccuuuuaggagaaacaagugaucauuuucuuuaucuguuuuuacauaugugugcaaaaaguccugaaauuggaaauaugucuuugaaagaucugcuuuuuaaaaauuccuccaauaguguacacuuccuguuuccauuuaguaugaaaaguucagucuagugcaaguauuccuguuuaaacaaaauuuauuuuaaauuucccuuuaagaguuaaggcaucaucagaaucuugccagcuagcagaacaggaaaccacuggcuaagagcauagacuucuauuuacauccuuugugacuuguuaacacuaugcauuugccuuugugccucaauuuucaaaagaccuuaaaaguccucucacaacaaagcauauuuuccuuuaaaccuaggaaaugcuugccucaccagucaauaucgucagccaggguauucuccaguggucuuuuacugcuacugagauuuguucaugggauaggccacugugcugaauagcucuccuaucccaagacagucuugauauaaugaauuacugauccucagauuauaauauaccauuagacaugcuaaacugauucugucuuuauaacacauuucaguuaccacaacuccagaagguaugcaaauaaaugaaccaaagacagaacucuuuuauuuguggcuucuaguggguagaauuggaguggauuaaaguggcuucaggcaguuauuuccuauaguugccagauagucuaacuuugaaaaguuuaauguugaccuucuuguaugaguuauccuauuuuaaaauguaauuuacccuuaaaaaucauugucaagaccaaaucaaggauaucuauaagcuagauuuggccucucagaccauugguuugcaaccucuaguguaauuauuuuagguagugaacuaacguuuuagcagagguagaacacugagccauaaugguauaaucuuguaucuuugcugagcuuacaaaagccuguagaaaccaaacacuuagguaucaaugccauuuucuagacuguagggaauugugguucgacagagccuucggggcgcuuuuucagaacagaagucacuguaggugugggcaaggccaguccuccugauuagggagauggcuaugcaaccagagaaccuuucuaugaugccacugcuaggcauaguuucuguccuccuaaucuuccaucaaaaauuaggagucccagucacauguagcauauaucaauaauuccagcacuugggauguuucgacagagagaccauuguuagucauaguccaguuuauuagucauagucuaguuuaggcuaaaaugagaaccccugucuuuaaaauaaacagggcuagagaaauggcucaguggaugaagcacuugccucagcauguggugacugauguuuggauaucuagaaccaacgacauaaaagcugcuuguaaucucagcacugaggagacuagacagaauuuccgaggcaagcuagauagcuagacuaccuggaauggguaaguuauggguucggcaagaaaucauguuaaucaaaaaggaagcacaaucaaggaagacgugugacaucagcuccaagccuccauacauguguacauacacauagcacacucauuuaggaguuuacaaaacccaacaagaaauaaaggcucaacaaccuuagaaagucuucugguccaugugauccuaucuguuggauuaacuuuuuagugaacaaaauggaaauuauuuuaaacauuauauaguauucaagaaaguauuauauuugaguguuuuaugccacuaugaaacacuaaacaguaccauuuugguacuuauguaagggaaugccuaaggcagaauagcaagcauuauuaagaguacaugagcuugcugaccagagucauaucugugaguauagcagaaccuuguuaguuguuuaauugcuguguuucuuuagcagaacaguaguacuugguuuucccuaaucccauguucugucuagugucagguccuugguuguauuguacugucaggcaugcguuccaucucauggccuugaauuuaaucacguagugguuggugacucccuugucuuuugugcuguuacugugccagcauauuaugcagacagcuaaccauuguagagcaaaggguucauagcuguuuugauguuuaccugucugcuuggguaacaugcagaguaccuucuaguaccaugaacacuagucaguaggagugaaggcucuagauagguaccagcucaacuucucugucguauucagugaguuauauaacuguugucgucagcaauagggcuuuacuguugguuuguggagagcaaccaauaauagccuuggcaauugccugcguuauuuugggguuggggcgucugugaggcccuggaggcagaaagaguguaaaagucaguggggauggaaaacaccaaggaaacaagccuucuagauacaggaagacuggugcacauaggaacucacagagacuguggcagcauacaaaguuucaagcuaaugggguccacagcccugaaagaggaaguggaugcagucuccccccauccuuagccagaaguuaucuuuaccugacaaccacucacaaaagaaaaguaaguuuucuccagcagagucucaccaauuauagaaaccacauuuaaauacagacaggaucuguccagcaguagauggccaacacaacugagugaugugcuuggcaugcuuuugguuuuguugguuguuauugcuguuguuuugggugguggcacacaccuuuaagcuuagcagaggcaaagauagguaaaucucuguggguuaaaggccagccuggucuacagagcacauuuuuuuuucuaauaaugcuuuuucuggguauauuuccuuuaaccuugcaggccucuuacuuccauauuacgguuucugguuuuguguucuuauugcuauaugugcaaguguguguacaucuguauguuucucgucccuuuucuuuggcucuuuuuuucuugcuuuuuuuuuucaaguuaccuauucguguucuaaugagaauauuaaaggauuauagauuuugcuggauggggagggggaaaggaauugggggaugggaaacuuugaucagaauagaguguaugaaaaaucuguuuuuaauagaauagugaauaaaauauaagcacuggaaaaaaaaaaagacaugaagaaucccaguacaaaagggcaucuucucuagcgcugcaguucauauaaccuguaaaaucaacuaauuacuuuguucaagaauucuuucuuugcuuccagcguucuaccuccccacaugcccagaacucccuguuuggaugaguaaccaaugaaaguucacucucauuuuugucccagccauagagagacagaaagucaucucugaguauguacacuggaauuguaaaagauaucuaccagggacaguguguaaaacagacuuuguagaaugcagauuuuagauuugaguuaggauuuuacccuaaguauauucucugaauucauuuuguuauuugcaaaguggagguaauuauaguuacccuugagggcauaguuguuuaguaaaugagaucuaauaauagugauaaauugaauggaaaguuugugcugacagagcacucuaacucugaacaugcauggagccugugcuguggcacuugaaaccaauucucgucuucuuucucauaauaagaaaacugugcggacuuugcauugugagaacgucuaaguagggucaggaaauuauuuaaaaguggucuuuuugagcuauuaugaaaucuuaaacaauuggaugcuuaagaaguucuucauuaaaauuucaguuaaauauucaugacuuguuuuggauauggcagucccucaaugguuagaaaguuguuccuauuucuguaaauacaaauuugauuaaacucauuaaauuuguuccauuccucuuaauuucacuuauaaucuccuaaacaccuagucucugcuaggcuuuguaccuagucaauaguaaacauugaaaaguuuuacagguugaaucucuuuaaccccaaaugcuuaggaccagaaaauuuucuggauucuaguuuuucuucauuuuuguauuguuugcacagaauuuauguucugcuuuaauaaucucaauuggaaaaucugaaacuugaaaaguuuuaaugccugaaacugaugauuuuguugcugcuaaaaaaguuucaguauauucacacaaucacaacacacaguauguauauauauuuucugagaguagguugcauguccuuuacugccaagaaguuuuacgguacaauuuauaaaccuaaguauuuuuuugugcaaccacaguagaguuauugguguaaaauguuucucuuuucaaccaauaagcuuaaggagauacuuggaagaugauauagauauagauauagaucccacuuuucucucaaauuuucccugaaauuagcauucauuagugauacaucaaucaauccuaugauggacgaaaguguucccagcucuaacauuagccuguauguuuaccauuuggauucuccugugaguauauguguguguauuuagcuuuucaucaucugugugaauuucaggugcuucauuucuauaggccuauaauucauuugugucccuccucccaucuuucccuucuaaucagagagacuagagccccauucccuggcauccccccacucuggcacaucaagucucugcaagucuaggcaguucuucuccaacugaagccaaacaagacagccagaguuaguggaauggauucacagacaggcaacggcuuuugagauagcuccccauucuaguuguucaggaccuacaugaagaccaagcuacacaucugcuacauacaugcaugggaggccuagguccagcccguguaugcucuuugguugguguuucagucucagccccaaggguccaggcuaguugacucuuggcuuuccuagggagauccuuuccccuucagagcccucagucuauccccuaacucuuccauaagaguacccaagcuccauccacuguuugguugugagucuuuguauaagccugagugagcuccucuguggagccucucacaggacagccaugcuagauuuaugucugcaagcauaacagaguauuguuaauagugucagggauuggugcuugaccaugagaugggucucuaguuggaccauucccucagucucugcuccaucuccccucuuuccauuucuuguaggcugaauaaauuuuggaucgaaaguuguggguagguuggugucucuguagcuccacugggguuccugcauggcuacaagagguggccucuuuagguuccauaucuccacuuggucucagcuaaugucacccucauugauucuuaggagccuuccauaucccaggauucuuugcauguccuugagacgcuucccaccccccacccccuccaggcuguagauuuccauucauucucauggccaucuggccaucuccccugucucuccccacaucugauccugaaaccuccccauccccucucccacccacuuuucucccuccaucugccuccuaugacuauuuuguucccccuucucagugagauucaaacuauuuuguccuaauggcaauguccuuugccugguccucgguguucuguucaggaauuugucuccuguauuaaagaauucaaagcuauucucacuuucuguucuauuagauuuaguguaucggauuuuauuuugaggucuuuaguccacuuggacuugaguuuugcgcagggugauagauacagaucuauuugcauucuucugcaugcaaacauccaguuagaccagcaccauuugaagaugcuuucuuuguuuacauuguaugguuuugccuuugucaaaaaucaaguguucaugaauaugugaguucaugucagggucuuugauuaaauuacauugauccaccccucuguuucuguaccaauacuaugcaguguuuauuacuauugcucuguaguauagcuugaguugagggauggugauuccucccaaagaucuggauuguuuuagcuauccuggguuuuuguuuuuccauaugaaguugagaauugcuuugucaaggucuauaaaacauuuuguuggauuuuucuuuuuaauggaaauuguauugaauguguagauugcuuuugguaaaagggccauuuuuacuauguuaauccugccaauccaugaacaugggagaucuuuccaucuucugagaucuuccucaguuucuuucuucagcagcuugaaguucuugucauauaggucuuucacuuguuugguuagaguuacaccaagacauuuuauauaguauuuguggcuauugggaaugguauuguuuccauaauuucuuucucaaagaaccagcucuuggguuuguuaauucuauguauuguuuucuuuguuucuaauugauuguuuuuaggccugauuuugauuauuuccugccuuuuaccccucuucaguuugcuuacuuuuuuuguaaauugcugguaugaguacuuucuaauuucuuuauggggcauuuagugcuuugaccuuuccucuuaguacuacuuucauugugucauauaauuugggguauguugugccuuuuauuuucauugaauuauagacaguuucuuucuuucuucccugacacacagaucauucauugaguagagaauuguucaguuuccuugaguguguaggcuuucugguguuucuguucuuguugaagucuggcuuuaaucucugguagucugauaagauacaaggccaagguguuauuuaaauuuucuuguauuuguugaagcuugcuuugugacagacuaucuugucaguauuggagaaggcucccugaggugcagaggaagggauauucuuuuguguuuuggugggaauauucuucuuugguuuuuugagacaggguuucucuguauagcccuggcuguccuggaacucacuuuguagaucagucuggccucgaacucagaaauccgccugccucugccuccugagugcugggauuaaaggcaugcgccaccauacccuguuuggugggaauauuauguagauaucuguuagguccaucaauucagaauaucucuuaauuucauuauuucuccauucaguuuuugucuggaugaccuaucaguugguaagagugggauguugaagacaccuaguauuaaugugugggauuugauguaugcuuuaagcuuuagcaauguuuuucuuucccuuauaaauaugggugcauuuguguuuggggcauagauugucauaauugagauauuaucuuaauaguuuuuuugaugaguaugaacugucuuucccuuucucuuuugauugauguugguugaaagucuauuuucuuacauauuaaaaugaguauugcagcuugcuuuuugggcccauuugcuugggaaacuuuuuuccagcccuuuacucugagguagugucugucuuucuugcuuauguguguuucuucuauguaguggaaugcuggauccuguuugcuuauccagccuguuacccuguaucuuuguauuggggaauugaggccauugauguugagagguauuaaagaccagugauuuuaacuuccugccauuuuuauguuguuguuguuuguauguaugugcgugcauguguguguguguguguguguguguguguguguguguguguaugugugugugugcuuguuuccuuguuuucgcugguauggauuuacuuauguauuuucuugaauguaguuaucuuccuuagguugauguuuuccuucuaguacuuucucuugggcugaauuuaagaauagauauuguuuaacuuugauguugucuugaaauaccuaauuuucuccaccuauggugacugagaguucuucuggguaucguagucuagguuggcauaugugcuuaucuagagguugcaagguacacccuucuagauaggagauccuuuguugagaagucaggugaaauucugauuagguaggccuuuauauguuaacuggccuuuuucccuuauuuucuuuaauauuguuuauuaguucuauagauuuuguguuuugauuauuauguggugagaggauuuacuuuuucugguucaaucuaacugguguucuauaagcuuguuaaauguguauaaguguuuccuuaguuuugagaaguuuucuuuuauuuuguugaaaauauuuuuugggccuuggaggugggagucuucaccuucuuuuauuccuguuauucuuaggguacgucuuuucauaaugucccagauuuccaauauguuuuguaucaggaacuuuuuagauuuaacauuuucuuugacugaugucuuuaaucauaucuucuacacuugagauucuugcuuccaucuccuguauucuguuggcagugcuugcaucuguugucccuguccucuucccuagguuuucuaucuccaggguuaccucaguuugugugguuuguuuuguuuuuuuuuuuuauugcuucuauuuucauuuucaggucuuugaacaguuuuauuauuuccuucgccugcuuaauuauauuuuccuguauuauuuugaucaguuuauuuguuuucucuuuaauuaaaggcuuuuacuuguuugauuguauuuuccuguauuucuuaaagggauuuauucauuucuucuuaaaggacucuaucaucuuuauaagauugguuuuaaggucauuuucuuguagcuuugguuguguugagauauccaggguuugcuguaguaggguagcuguacucugaagguaucauauugccuuuuguugauuguaggcucaacuggauggcuuuggucccuggauguucuguuguaguagguauuggaaggggccuaagcucgaugauccugguguggcagaccucugauguguaugcuugggcugugagguuccugaucagcaguucugaugaugguggccugacacgugucaggagaauggggauucaguggagauggcaagcugcucaggggagcuagggugucccagaggacucaguaggccgggaaaguggauguggauggaauccaacguguauuuuugcagaucaucaggucugaugaagauggguggagagguggugggaugcuguguuauuaucuuuuuaaaaauacuaauauuguuggcuauuuuacaucaaaagaaauaaacugaauguaucuguuuucuaacauugguuccagguauaauuauuucauuuucuugauuuuaauaauugauggugucuuaaguaaaauauggaauuagacuuaacuaaacuuuuauuuauuuuagaagaaaaugacagaguguuuggaagauuauuacuuuuggaaguccugcuaauauccauuuccuaagagauaguugaccaacauugacucuggcauggcgcaaaacaguccacagcuugauauucagguucuccaugaucuucgacaacguuuuccugaaauuccagagggugugguaucccagugcauguuacagguacguuuccugaaagugauguuagaguuggcauguuagaguacuuguuagaguacuacaugugcuagugcauguuuuauaggauuucucagacuuaguggugguguugauauuguggggcagguaacucugacuguaagcucuuucucaucuuuccugagcccuacccacuguauaacaguaggguuuuuacaguuuugacgauggaaaaugucuuucugaauugcuaaauauuccacaaaagguacaaucucacccacuuaaaauccuccuaaauugggaagaauaaucacauguagaaagaaaaauuccccagcaagaagaaguaguggggaaagguguuugcugccaagucugaugguaugaguuugagcucugaaaaccacaugauaaaaaaagaaccuauccccacaaauuccucugaccuccacaugcacacuccacucuccaaggaggaaaucauuuuuaaacagguugccaauaauccuugaauccuuagaguucaacuuuucuuugauuugcuccuagguuguauguauucugaggaagcucucuaccucagaacuaugccccuauuccccagagaugcauuuuaaaucccaaauguaaccuuaaauucuguagaaaaacuccuuacucccucuuuucaguuuuuaguucauaaguccuuacuagguauaaauuugagacaacuuucuuuuguucagaaacauucccuuugucuuguucucaacacugaaaucuuuuauuucuuaguuuuggacuguauuuuuacucaggagacaacagauaaaacaaccauuacugaugagucaguuaccuuggcaugguaucucugcuuuagauugugacauaucccuguuugguugacauggggagcaagcaguacaugauacacagucuguauucauguucacagucccuuacuacagugugagaagcugaagaugcagcagaacucuguagacagggaugguuaauuacaaguagagaccagacaacccaagcaaggauuuccauuguuuacaaauucuuuacuaaauguaggccuuugggcccaagguuauugugcuauaugugguugcuaacaucugcgcacuccuaaucucagcucuuuagguccacuuauguuuauggguuaagaaaaagcuacuuccuaggacaggaaaacgaagccagaguugaaucuucuaguuggaaccguuuucuagaauugacuuucuuuacuugucuuaggaccccuuuuagcuccaacaugguuguaacuuaaauuuggccuuuccuuauuugugcuaucguggccuuuaacuaagggaauaaaauguaaaauucagcucagugaacacuguccuaaaucuuuuccuccuccuccuuuuuuuucucuuuuuuuuuuuacuucaaucuuuuacauuaacagaaucuuaguguggacauugauaccuacuggcuccaggaaguaccuacauuaaccuucuaugugaugguacaugccugugaucaggaggcucaugcaggaggagugcugcaaauugugguuagcuugggcuauauaucaagacuuuguuuuaacuccuaccauccaaaaagcauuuguauauacagugauguacaugagccuaguaguuugcaucugaaacacaggccuuaaauccucuggacuaucuucccuuaauuuacaucauuuagagagguaugaaacauuguuccuuuaguuuuuuuuaagaaguguuuaugucuuuaaaaagauuaugugugcauaugcagaggccacaaaaggacauuauuugcccgagucuaucacuuuucacuuuauuccuuuaagucagggucucucuuuaaaucuggaacugagcugauagucagcaugccucagcaauucuccugucugcuucuucuggcccaggcguuacaagcacagcauagccacacacagcuugcuaugcggguacuaggaucucaacucggguucucauacucucacugagccauauaguucccuucuuaaauauuuuuaccuguuacuaagccagucgcccagggauguaauccccacuuuuugggagaaugaaacaaaagaguugcaaguuagaggacagccaggggaacuuaaugagacugguucaaaaaugaagaagauggugggggcuauaacuuagugguagaauauguauaaaggucuagguucagugucuaguucugcauagaaaauuaugacccuuguauccaacuaaacaacuuggaacucugauuacucuuugacauuuuuauucuuuuuuuaucaagacauuuagcaagucaaguaugacauuugagucuccucuguaguguuguuucuauaauaguucuauaacaauacuauuuccauaguuuguauuugugguuuaaauuugucuguauagaauuuacucauauauuuuuacuuuaggcaugccugugaauauguugacagacuaacuuucuauuguuuguauuaggguccuuuuuguaagauuacuauuaggcuuacagauuuguuauguaaagaauaagguuucaggguuauucacaaaaauaccaaauacuaaaguauguucuccccuaauuuuauacauuuauugaaguuuugaaauaguuuauuuuuauauauauuuuucuuuccaguaucuguuacugccccauucuaguuaucagucuaccugaauucuuuggcugcagauuugcuucauuuuuauuuuuuaaauuacuuuuauuuuauguuuaugaguauuuuuguacaugugugucuuauaccauguacauaccuggugccuacggaggccagaggagagccuucaguccuugggacuggacuuggauagcugugagcuaccauguaagugcuuggaauugaaccuggguccucuggaagagcagccaguguuuuuuccugcugagccaucuucccaggcauuccagacuugguuuuaauagguagcuucucgcccuugcucagcaugauucaagaagagaaaauaaauuuugcauuauuaauuuauccuaaacuucaauuaguacuuuuuucuauaguacuuggcacguacuuuauuuaaggcaaauaaaguuaccuauguuuuucaugaagcaaauucuuuaaauuacuagauuuaauuuugcaaauguuugcuugacuaugggguuuuuuuuuuuauuagcuuccuaaauuuccaguuuaguaaugucuuugauaacacauccuuuccuuugaaguuacuguguagaaggacacuggaacuugagaguaggaacuagaauugguuacaugguuagcuuguucagugccucuuaugaaguaugccacuuagcacucuucuuucucagcaucuggaaaugggaaugggauuguagaugaacucugaauuugucucaacacuaaacaucacuucauugcguguccugugguaggcuuaauaucuuacuugggucacugcagaaguaaaguauuucccuucauuuuuaguaaaaugaacuuauguauaauaacauauguuucaguuacagagaaauucauguuuguuaagaauucguuaaucauuucaaaaguggugauaauauguguuuuacucuaauagaugagaguucuguauuuuaguggaaccuuacaauguuugaaaauuuuuuaaaacuaagaauuugauuauuguccauugaaacuucaguugcaguuacuaucugcauaacuaaaaagcuauuucaaauauauuaaaucacuguucagcugguacaaacuuggcauagugaauuucauuaaggcagucugaauaugguugcuuguaaauucucauuaacucuggcaaaaucaugaaggcaugagucaaacuauagaauuuugcuuguugcucauuuuucuuuguuuaaaucuuugcuaaugauauacacuaauguuauaugaugauaaauuuggaugaaagaaaggaaaagaguaacauuguuuaaaaucuucaggaauauuacuuuuuucauuuugugauuuugguacuuuuugaaacuaaaggaugguuauuuucauuuucauaggguuaaacaguaaugauggauguuaccgcaagugugaauccaagaguagcacaacauuuuaagguguugagcugcagcaaguguagaaugaguccuggauuuggaaugagaaaacuugggguugagucacaauguucauuacauuucuguagcaguagugguagagcuaguaaugcgagcuaaauguuuauacuuuggauuguuuaacaucccuuuuguaggacagaugccaauggugggcuuuaugguuaaaauaccacucuugacuuauucugugacaguauuuauguaacugacuuccauucuuaagcuuuguuaauuuucccaauguuguuuguaccauuucucccauagaauaacaacaaucuagaagccuguugucgagcccuuucccaggagagcagcaaauacuuguauauggaauaccauaguccagaagacaauagaaugaauagaaaucgccuuuugcauauuaauuuggguauucauucuccuaguagcuaccacccaggagauggagcucaccuuaaugguggucggacacugguacauagcucaagugauggacauauugauccucagcauacagcaggcaaacagcugauauguuuaguucaggaaccacacucagcuccagcuguuguggcugcuacucccaacuauaauccguuuuuuaugaaugagcagaacagaagugcagcuaccccgccuucacagccaccucagcagccaucuuccaugcaaacaggaaugaauccaucugcuaugcaagguccuucaccaccaccaccaccuccguccuacaugcacauaccucgguauaguacaaauccaauuacuguuacagugucccaaaaccuuccuucuggacagacugugccaagagcuuuacagauucuuccacaaauuccaagcaaucucuauggaucuccugggucuauuuuuauuagacagacaucucagaguucaucaggaagacagacuccucagaaugcuccauggcaguccucaccacaaggcccagugccucauuacagccagcguccuuuaccuguuuauccacaucaacagaacuaucaaccuucucaguauucucccaaacaacagcagauuccucagucaguuuaccauucaccaccuccuucucaguguccuucccccuuuagcucuccacagcaucaaguacaaccaccccagcugggucacccaagcucucauguguuuaugccacccaguccuucaacuacuccaccccaccuauaucaacaaggaccuccuaguuaucagaaaccaggaagucauucgguagccuaucucccuuacacagcaucuagcuuacccaaagguuccaugaagaagauagaaauuacaguugaaccuucucaaagaccugggacagcaauaacuagaaguccgucaccuaucaguaaucaaccaucuccaaggaaccagcauucacuguacacagccaccacaccaccuucaaguuccccuucaagagggaucucuagucaaccaaaaccuccauuuaguguuaauccuguguauauuacguauacacagccaacuggaccuucaugugcuccaucaccaucuccucgggugauaccaaauccaacuacaguuuuuaaaauuacuguaggccgagcaacaacugaaaaccuuuuaaauuuaguggaccaagaagaacgcucugcagcaccagaaccuauucagcccauuucagugauaccaggcucugggggagaaaagggaaaccacaaguaucaaaggagcucuaguucuggaucagaugacuaugccuauacccaagguaaacuuuacacugauggaauuuuauauuuauagucgugugauaaaugauugaaaauagaauugaacauauuuacuuucaauuaaaugcuuuauauaguaagugaugacugguaauguuaccaagaguaaaauuauuguuucagagucaucuguucacucuuuuaaaauauaaagcugcaaauaugaucauugaaaucuuguaaccuaauaagacuuuauucacagauaucauucauuggcaaaaaauauagacaaguauaauaaguauugugaaaaggauacauguacuuuggacugguuugucaaagaauuugagucuuuauaauguuauauauaagugauauuauaggaaguagaauuaaugaaauaauuuguauugucuagguaaaucaaaguuuacaaagucuauucaaauuuuuucaaauuguaccagaauauaugagaguuuaggauacuuucaauauuugagaagggaacugacuauaauugugauucagaaugcuuaauguuaagccuucauuucuuaauuuuguguguguggguguguuuaugaauaugaaugcaaauguaagccugcugugacacauguggagucagagguaccauucucaggagccaguucucuccuaucaaauuguggaauuuggagcugcaacucgggccugcaugcugcugagccaucucugauccuuaagcauuuaacaaguacagauaagcaggcucucaggaaaacuaaguggugcacaacaagagcuaugaacagaugaugccauuuuggcuaaauuaaagcagaaaugguuguggcccagcauuacuaagaccuuaagguaaaugcugaugcccaggucagaugagucuuauguucauuaacagugcauguagaauucuccuauaauuuguuuggugguguuuucugcaaugacuuuaucugucaugcuguagccuugcuguuacaucagcgagcaagaauggagagguuagcaaagcaauugaaacuugaaaaagaggagcuagagcgguugaaagcugaaguuaacaguauggagcaugaccugaugcagagacggcuuagaagagucagcugcaccacugcaauucccacgguaagucagcuguugcaauauauacugauaggaagauauggacauucucuguuaaagccauuugauuuucuuucaaguucuaguccuggaugaauuuuuaaaacaguagugaaugcaagagauuugcccccaacaguucuugucagaguaacuaaauuuuuuuuauuuacauuugcacuugcacgggauuauagcuauuuucaaagacugacaguuagaauauaguguuuauugcaagaauauaugauaacaaaagguuucauaaauuauucuucuaagcauagacuguacuuuuuucuaauuguuuaaagugaguuuaaauaaguuaauuacuaauuuugagaaaguauugguagaauuucugaaggcaugguaguuucauuguguguaauuguagaaauuaagauguucagcguggacccuuaaugaucuuaaaagaaauuacugugguaaagaguuuuuauauuuuuagccuauugguuaauguaguugauucuaauaaugucaaauaacuuugaaaaucauuaagucuaucuccuuugagaugucaccuuuucugugauauaaucaaucuuuucacuauucaguguucauguauucaguguuuaugaauaugauacuguguuaggugcuuaguacuuaucugccagugaaaagauguagacuucaauggcaguugcuuuauuugcucacauguaaugaaggaaauuuuccaguaacugcuuuaugaauguagucaguacauauguccucuuuuuuacaucauccuggaaugacugccaaagcuucaaguguguagauccugucuguuuucaagggucuucauugucuuucccucucuaaagcuggggugaccuggcucuugaacauauaugcaaagcuucuuguccucacgguuacugcagcuacuuucuuggagacuucauccuacauuauagaaagaaaggaaaaaggaaggauuuuuugaagggaaaagaauauaagguaauuaaggcuugaauuccaggcagucuuuuaagacacaguaaguaaagcuuucguacuuaggccugaaauuucuaaugaguuuauagagguuaaugagcauagagugccguguagaccuugaacacugugucaaggugcgugaguuuuauccugcucuuacagggaacaaauagaaccauuugagaagaagacuguugaggaagaggcauauucaagaaauuaacgacuuuuucugcuauugccuauguuccucaguuuaggcauuguuacaaaggagacuuuaauuacauaaagcacugagaacauuacaaaguaaaaucaaacaguuauguuaauggaauuaaguauccuuucugauuuucucuauuuaaaaucuugacugauuccucucaguuaggaaguuagcaaaggguaguuaggcaacuuguaaucauuuaggugucaguaagguguuuguuuguuuguuuguuugguaaggcuuuguuuugaaacaccugguccauuauagguccugcuaaauaaaccuuaguuuuaauuagaaguaaaaaacucucugguguggcauuaauuagugcuucaaauacaagcacccacaguuuauauaagaguuuuuauuacggagucauuguuuucuuuuaaaaagaaagguaaaccuuccugggacuguaguuuaugauuuauaauuuaaaaauuaaaaaugaaauagaaaaaauaguuuacuaaaccaagugugaucaucccucaccuagagaaauuagaguuucuuucaaugccuaucuuuagacugcaaucaaggacaguagggcauggcugaggggguggcuacuguggccaugaagguuaagucagcaaguggcuuugcaagcccaaauuugguuauugcuuucacugcuugugucagucgcauagccucggauauguaacaucuggacuuauuuucucaucucuaaaauauauaugcuagaauauccaugguaagggauuuucuuuagaauuacauaaggcuuguuaagcaauuuauacaauauccaacaaauagcaagaaucuuuauaaacuagcuugguaacaaaaaugcugaaaguuuuugcuugaaauagauaacacaaaucugaagcauuuuauaaaaccaauuuuguuuuaagcaauaagguaacauauuuacagcuaauuugguaaaaacaaaaccaaaauaacaaaauaaaaccaauuaaucuagucagaauuuucagguuguuaauugagucucauuugaaggaauacccauaugggauuuggaauuggauuaccuuugcuauuuacuagcuguauugacugcuuaguuaacagaggugcuagagcugugguauaauauuggccacauaaggaagcaauguuuguagugugccuugggugucauuaaguacccagcaaauauacaagaauaccaaagagcugacacuuuuccuaacaugcaugcauugcuacuuucagauuuccaagaaacuucuuaccaaguuuuacaucaaaauaggagagaaaugcuugcuuaaugagacuagagugugcauuguauacuugcagaaauuuugaggagccaugaaaugauauuuuucaaaugauagcaaaaguauuuugauagugucauuuuucuuuagcuugcucuuuaucacauuuuaugaaauauuuccuaauaugucaucucucaaaaagguauaaauaugagaaagaaauguuaaucuuuuguuaauaauauucauagaggaggcagaguuuuaaaguuuaccuugaaagauaaaaaagauuuuaguauggagagagccacccucccccaaguuaguuaguuauccggauccauccuguucuaauugaauuugggggcuacugcacugcuuuauguccuacauguauaauuggggccaaagcaccaagaaccaacagugcucuucaauauugguguuuauaacacuaguuuuuaagguuccaaguugacuuaagggauuucuacuaccuuuucaaaauagcauagaaacuauuauuugaaaaugucagcuauaaguauucuauuggccuacauauaagucuagauuauaaaucaucaugaauaccaaucuucuguguaaacaugguguacuuuugauaaaucaccgacucaaaaacagcuacucaccucccccuugcuugaauauaacaugugucauuaguauauucgugcuugguuacaaaguaucacuauuugggcccacuguggcuacaacuuucaauugcaaaauauauaggaaggauaaguccuuagguacugaacucacaaaguaggggucacuucuguguuucuaggaggaugaaaucauccauguugaugcucaagcauguguuuuauaccauuuuaauaucacuuggcaagcauuuuacauauuaacaucacauacuuuguccauaggaaugaagagagaagagcaguucguacuaaauguuuccagaugguucuuguugauccacuagcauucugagggccuagagcuuuuuauuuucuaaguuaaaauucaguuugauauuuuucuucaaaauauuugagacugaauaaugauaguuaucuauaaaguccugagauaaaugggcacaaaacgcauguaaaauuagcagucuucaaaugcucuuaaauaaguaggacguguaccaauaauauccagaaauugcuuuuuacguguugaacuuuuggucccuucuuguuuguggacauugccauuuauucuguuagaaucucccaacagcauaagacauccuaucugcuuuuuuagugcccgguuaaccugguuagucuucgacagaauacauguuuuuuaacagaagcaaucuuucucaaucucuuugucucuaucugccuguguguaucuauuugucucugucucucucuguaucucugucuuugucucuaucccccccucuccuucccucccucccucucccuuauuccaccccucuuucuguuaguagguaauuuaacauucuacuuuguguaguuaaaauuacccuaguaauuaagcuuauaccugggcuaugugggaaacacuucaguauccauaccauuagaguguaggcacagaaauucuaaagaaauuaagaaugguaugggagaauuggagagauggcucagugguuaagagcacugacugcucuuccagagguccugaguucaaaucccagcaaccacauggugccucacaaccaucuauaaugggaucugaugcccucuucuggugugucugaagacagcuacaguguacucauauacauaaaacaaauaauaauacuuaaaaaaauaaugguauggggauuacaggcucaucagaaaaagaucuuuucaguuacugaaaagacccuaaggauuggaauggccuggacagacuaacguagaagaaacaaaggaguguauugaugccugauauuucucuguguuaaaguguuucuuuugaucuagaaaaauaagucuauaaauugauauaaauuuguauaaguucugcuucuaccaccuaggagcuuuauacccguaggaaauuuaaccucucugauguuuucucaucaggaaauuugugcaauacucccuaccuuaaagcuccuuuuagcagaaggagugagagaauucugguaaaccugguacccaaagcuaaguaagcacuaacuuguaccagguuagacaagauuaaaaucaugaacaaugcuaauuucaaagguugguuguugcacuuuaccacaaaaacauaaguaagguauuuucugugcccuguuauugcagugaacauagauagauuuaugauagaacagaguucacucuguacccggcuaccacacgugguuuuguuauuauguggccacaucgaugucuucaguguacuuuugacuucaaaagcauacacagacauguuauauaauccaucuuauagacaaggcuggauuaguuaucccccaucagaucaauuaacaugaaagacaguacuuaaauguugggcuugauaaugacuuucccacaauugcuauuuugggugcuuucuuacuagccugaggaaaugacaagauugagaagcacgaacagacaacuccagauaaauguugacuguacacugaaagaaguugaccuccuucaaucuagagguauagacuugauuauuugguaaaccauaagucauggugugguguuuuaaccugcuuagauggcaauacuuuuggguucauagauuuaaggacagguuuuuguauaacuguuguaagaauggcuuuaaagagauucccacacuucauggaucaaagugucaaacaaugauguuacuucagcaguuucaucauuuuuccucauuguuuuauauuguuacauugcauuuuugucauugaauguauuucauaaauugaugaguauuauuucuaagacacaguuuauauuauaugauagucuucgaaaauacugugacagaaagggaguccggaguaggauaucugaguucuugguuuuaaaagaaguucucuauguuacaguaaaagcucucuuucagguagccagcucaucaaaugacagaaggacuugcuuucccguauccugcggcucccauugauuacaugugcugcauaugcuaguuagcuaugcuucugcaguuaaaauuaguaguucacaacuaaaaagaauucaggaggaugcuucucuuuuaaaaacugucuuuggcuuuuauagagagucaagcauaaaaugauagaacccguaauuagauuugaaugaacacaaguagaaaggggaaagcuuuguaagaaaguguccuuaguauaucacaugcugcauucagaagacaccaaaacgcaaaauuauaaaucaagguucagcaaacuagggcccuacugccuguuuuuagaaaaaaaaaguuuuagcggaaacagacaugcacauuuauuuaccuagugucuguggcuucuuuguguuucaaggacagaguugaauacuuguaacagauugcauugcaagucuacaaaaccucaguaucugcucuuugacagagaguuuacugacacuuggcuuuagcuuaucaugaacauaguuuguauacggcaauaugaaguauccuuguucagcaucaaaauacaacuauugaagaugcaguguagugauagaauguuugcauagcauauauaaucccugggcauuucagucuucaacacuuucauaagaaaaauagaaaaacgcugcuauauuuauguuacauaaaggugauguguaauuuuacuuaacaauccuuucuuugaguccaccuacucccaaacuguaguagucuuaauuacggcaguuaagagagcuucuacaguacuuuaagaguaguauauaauaacagugucaaacaauugaacuaaagauaauaacgauacagaaccaucugaacaugaaaguugagcuaucaagccagguucucauuuucaaaagccgcauuacucuuuuuuuuuuuuuuuuugucaucgagacaggguuucucuguguagccccggcuguccuggaacucacucuguagaccaggcuggccucgaacucagaaauccgccugccucugccucuuaagugcugggauuaaaggcgugagccaccaccgcccagcaccacauuacucuuauacuagcuuuaugcuaguaguaaaagaaucacuauguauaauaugcaggguaugucaaccacuguuacuauaugauuauaucaauuuuuaaaaaaacugauauaguuucuggagcaaaguaaaaaucaauaacauuugauuagaauaauuagaacaugaacuguaacauuagugccugacaaagaauaugugcagcacuucauaugucaaguagcauuguaccuuucaggagcuauaagaauuuuuuaaaaauucucuuuaaaauagccuauucaaguggaugaaacuuugaauaauaggaucaauuaagguuuuuuuuaaggaaggagcuguguuuuuugguaugaauugaacaaaugagguauuguuguacuuaagauuuagaaaugcuuaaggugcccaaauauugcauucuuuuccuaaacuguuuuuggcaguaggggaggcacuuucaaguagaugcaaauaaaccauugcaugacuugaugaaaagcagcuuaauauuugauuugcaggaaggaaauuuuucauuaggggaaacaucaauacuuaaaaagaggaaacuugguagaguacagaauccucaguauccaagcucagguggauuuggguacagcgggcagagucggcagugaagaugagaaucagaacuggcaccuaaugcaaucugaccuugaaggagucacaggguauaucacugauauaaacauaucugccagagagugagcagauccaaggaaaguuuaguaucagcaauucuccgggcuuguuuacucuaaaauuuacauaauaccaucauggauaagcccauaggguuauguaacauauacauuuggcuucuuccuuagauggcuuuaugauaaauuaugaaaagaagugucacaaucuucuuucauguuguuuuuucauuagaccaaacaggucaaccauuccuuguuucucauacacugaaucuugcuuacggaugcuagcccugcaauuagaaauauuccuuuagguaauauauuauagacaaacaguguucuccuggucugcuuggaucuuuucucacaaccauaaagaaaagaggauaguuuaaugacauuugaaaccauagaaaacauguucuuuuccuacauuucaucaauguauuuucuucuuaaaagaucaaauaacaaaagaacaauuccuaaauaccugucguuuccucuuuccuuuguaggaaacuuugauccaaaagccaucaauaauuuuuaugaccacauagaaccuggcccaguuguaccaccgaagccaucuaaaaaaggugaguggaggucauagcacgaauacuguagaaguugaauagauuucugaagaaguuucuauuugaacuauucacuagaguauguuccucauaaaguuaucuauauuaauaugacaguaguaaaauaguccccaaacuuuaauuuuuuuuacuaaacauugaaagugauguuaggauuauuguaagacauaauagugauuuuuuuuaucauaauaaaaacuauacuccugaaagaaaauuguucuagaacaaugaggaucuugaaaaauccucaguagacuuuguacauaagaauucuuuugcugcuugauaaacaggguguaagcuggagugauggggacaugaguguuuugucaucaagaacaaagcaaguccuaaguuguuuucaguaucuuacaguaaguguagauuggaagguguggauugaucacucauuuucacccauauacuuacaggccuuauuguuuuauguucucaauauacagcuaauguuuaaaguucauauuuuaauccuuuuucauuaagcaguucaagacaguuugguuaugaagacauauugaauaguagagagugcauaaauuguaguucauuuauagauggcagcuuaggaguuggucuuuuuauuguuuuauacuacuguggauguuucaucugaccuacauuugaaauaguauagugauuucuaaaaaugacucaaaaugaguuuuaguggauaacugccaaguacuaaauuuggcacuguggcaauguuacauguaguuucaagcugaaagccucuagauuauauaucauugaucacuuuuagccuuuuagguucauaaaauacacaucuuuaaacuugauuuugccuuaguaccuucuaaggugauuuuucuuacagauagccuagcagaugagcuacaguuaaaugacucaagagcuggcauagaauaacugacuaaauucauaagaaaugaccaaaaauccgagcagucgaccacauguaaaucuugaaauuucuugaauaguggcaucuccaaggagcuagauacaaagccauaaguuccccuguucaaggacaaugaacuaucuaucaucuugguacuaggaaugaggcuagggcuuuacauauacuaagaagacccuuagcugagucguucuggccccuaauuguuagguacuuggaaggaaauuugauguuuguuuuugguaguggaauucuauaucaaaguagagaaaaaugaaacaaaauuaguaaacuucaagguagacugauguacagagacgaaaaaaaugcaggauaccaugaauagaaauaaaagauggguuauccauuauaaaugguaauaaaggcaugugacuaauagcuuagucaggucaguaaacuguguaaccuagauaaacacauuucuugaaaaauaaaaguauaaaaggccagauuuuuuaaauaggugaaaggaaauguuaauagcuguucauauuauauuaaaacugaguacauuguuaaaaaaaaguuccaugaacauaguuucagaacaacauucugcuagucggcgaguucuucuaaauauuuuaaaaagauaggaaacaauuuugaacauaauuuaaaaaaaauaagaaaagggaagaguguuucacauuuguuucccuaaccuugcaaaugaauccuaacucuccagccccuguucacuacauucuccagccaagcaguguguuugcuaauguugauggacuuaucacccucuguauccaaagccugauucaucuuaggacucuuuguugcauuuuaucugaagcuagcagagccugauuccaaaaccuuacccauaaagauccuauuaacccauuccuacagaaggaaaagugacaaaugcauguaaagggcucugcuccucggccagcucacugcaaaugaaacucacuaaugcugauggggggaaucuuugaagucauaaugaguccaguuuucagcaauuucuuaaauagucaccaaaugcauaauuguacauaaauguaugauccuauuauuacuccugccccaaggaauuuauacccaacaugcaaagucuuaccuauccuuaugaauaaguuucuacuuuaaaaauuuaauugagccagggagugacggugugugccuuuaaucccaucacuuaggaggcagaggcaggcagauuucugaguuucaggccagccggggcuacacagagaaacccugucucaaaaaaaaauuucauugagaugagcuuaaaguauaacuugcauauuauuggugagaguguaaaaugguacuauuauuugccaaguuauuuuaagccuuuaaucacagauuaguaaaaagcuuuugaguuugaaaucagauauauuuucuguuaagcacuuuauuccauuuugaagauggucucauaaacuaugcuaccuacuagguuuacagauaugcaaccccacaccuagcaucauuuuucuaaaaacacuucuaaaauuagugcaaauuggcuugcaauacuguuugcuuaaaaacaaaacaguaaacugcuuguaugcugcaaaucuaaguagacucuauaauacuaucugagugaugagugggcuagagaauuagaggacaaaggaagagaggcaacagaaaccuuugggauuggcaugugcaguuaauaagcaacauaagucuugagguaacucagcaaaucuuccuguauccucauugcaagaacagugaaugaccugggugucaugugaccugaacaguggccuagcucacugucuucagaucuaaucuguguaccacagagaggugaucuauucaaauccugaccuguguacuuuccaagauguucgugugagucagugaaaugaaggcauguaccuuucaagucuaagacagagcuccagcauuuucuuugcagccuaaggaaacaguuacucuggucuuucuuauugugcuauuagaauuccaguuaagcuuaaccaccauccuuagaacccuggggcagcgcuuuccaaagguggacuuuacugagagaucagauacagucaggacugauuagaaaaugcaaggucauucuuuugcucuuuaagguaaacaauauguagugugcuagucauuauuaucuaauacaaggguugcucacuaauaaacuguaaauucauaacaaauacgaacaguauuguaacaugaaguugaaauuccugaaauguguggggagcccacguuuguaacuacauaguauucuuuugaguugcuuccauuuuucaagaacuaauguuuucuaugaauucuaguguguucucugccuccuaaaugcugggauuacaacaguguacuacugucgucauuaccguuaucucuguugucuucuuccuuccucuuuauucuuccuucuuauuucuucaucuucuuucuuucuucaucuucuuuuuauuuuuaauuguugguccuuugagacagguucccacauaacccagacauucaacuuguguguguguguauguauguauauauuuaguugcugucacugacuuuuuacuccaaguauauuuuuccgccacgacucacuauuugagaugaguguuugguguagcuuguaaagaagcauucauuauguuuauauuaaccucagagacaaaggaaagcuccugugaaggcaggaaggguaaauucucucagcugagugaguagcaggaacgguccuugggagcgcagucuuccugacagaugaugcuguccccucucaguacuuuugccuuuucuucugcagacuccucagacuccugugcaauugagagaaaagcccgaagaauuagugugacuuccaaagcgccaguagauauccaugacgcccaggcagcagcugcagaugguuuguaccugugucccugggguguguuaacccauccaaguuagcauaacuagagccugccuucagguuucccuuugaagauuacaguucaugugcauaugcuaaguguuuaguagauccucagugcuugcuaaagauuguuuuaaaagauauuuuucuuaauuucuucaugcuuuauaugcacaccuugauuugcauauagccacauauagcucauguucagcagcuauaucugaacaccuuauuggaaaggccagcucucuagaaguagaauguagaaagcaagacaaaguacuuuucaaaugaguugcaauuucuggauuugauaaagcuuuucacacaagugucuaagacuucuuuagcuuggucugcugccauccaauugaaagcaggucucuaaaauaguauauguuauacuggauuacuauuauaguauacauaauaauagcuaaaccacccuuauuuugcaaaugaaaaggcaccaugauaagaagaaacaagauacauggaaguaccuuguacauuuuuucuuuuaucauuagaauauguuuguaaaaguaacuuuuucauuuaccauugaaacccuuucuauucaguauuuuuaauugugugccuuuugagcacuuuuugucuuuuauauuauauuauacaagcaauauugauuaagguauuuuugaagcuuuucauuuuuaugaaaauauaaacuauuauauaacuggaaaccuaauuuagcccuuuauacaguuuuuaguguaugggcuacaaaauaguguuuccugcacacccuuugaucuggauagaaauacuccuuuuugaauaaauauuuucuacaagguggucugcaaacugcuuuuaagugugcuauaaaaaagauuguucaugcaaaucaaaguaaauauucuaaaauaguacuuugaaaugaauugaauagauuuuuauacucacaaaguuguuuggucauuuaccucauagugauucaugacuucaaauuaagucagcaugauauuuaacagggaauagagucaucaauaagagucaucagauagacugaauugaccuaagaauguaagaacaguuuugauuuguuaaccuuaaaagucaacuguccuaaggguaaaauugugcauuguggagccagucuauaaaaacaacucuaaagcaguaauuuauaucuaguaagauggcuaaagguggcaaaugaaacaagucuagcucuccuguuugugguuacaggaaccccccuagagaacacuugaaacccuuuuccccagugagcuuucuucugaauagggaaucuuccaacaaagcagaguugccagaugaauucuaggaguacagcccuuuuaagccuaagaccagagagaauuaagaccuaacaggaauacaaguuuugaguuuuuauuuccaugugaaaggcuugcuuucuuaaacugcuaguuugauguaccugguaacacagacuugagucuauauuuuauauuucacuccuuuguaaaauuggauuuugauauugccagguauaggcaguuuucaaaaaguaauauaugcacaacuuuuuuggcaagggggaauaacuuugagaacaaaagaaacauguauauagaaugauucuuagcuuuauaacuagcuguagagucgucuuuuuucacucuucugggaacaccuuuguuuugaauuuuaccugccauugauggagcauuaauauaaaacacacaugucuuccuggaagcagauguccuauagaagagauaucuauuuacuagucuauggcagagaggaaagucagagagaguucucugaauaugcugucacauacaucucaauguuuuaccccuauuuggcuggaauauagcuuaauuaucuauucuuuauggguaauaaacuagaaaggucaucuaauucuggaccucucuucuuagagcacaaaaaucaauguguuuagaacaaaguggagcauguaucuagcuucugugcagcuaugguuuuccagugguaugguuacuaauuagcuuauucaauggguaagauagggaguccuuccuuuguuuugugguaguuugucauuucaguuuuggucaguuuguguguugcuuggagaaacaguugaucuagcuuccuuucuuuuaaauccccucuuuccucagaacauuuaaguaucugcaaacagagugcucggacacaaccccgagaugaggauuaugaaggggcuccguggaauugugacagcuguaccuuucucaaccacccugcacugaaucgcugugagcagugugagaugccacgguacacuugaauucagaagaguugacaccagguugagagugaaacuuugagcacucaccaaaagaaaaggaaacuuugggauuguguucaucugcccagccuuuucauuucuugauugcacagggggaggugggggaauggugcccuggcucaggaaaggaaaaguggggaggucuuucuuuuuuccuuucuuaacucauuacagagugagagguagaaggggauacuugaauucacuccuguaagaauguacacagagauguuaagggcucuucuauggaauccaaauuguuacaguuacugcugaguggcucuucauuucuaaaggugaacuuuggauuaugguaggacauguuacaguuuaugcagacaaacugugaauuccagagcagacuuacuuggucacagcucucuggaaaccaaggcucccugugccucuuccugcugcuuccugugaagagauggacaggaaaaagcacccaggauaugcuuuauuuucuuuugugcaaaauaaugaguuuauuuguaauugcugcuuuuuucagggguaauuucaaacacacauucauacgcagacaggauacuuuuaaaaugugauuuguaguagucaggaauuaggcauauugugcccuuugugaggaaguacaaucagagguaguauuaucucuuuugcuugaacaaugguucaucaagcugcauugacacugguaacuaagaccuacuuauaccacauaaauuauuguauauuuucuuagguuauugauuuugaaaguaaugaaguaugguuuuauaaaaugccauucucauaaaacugugcuuugccaguagcacacugaauguaugccaaaugcaaguccauuccaaaaccauuggaaauucuaagcucaguugugguucuuaagaaaugcuugcaguauacagggcccccuacuucugguuuguaaugaauacaugauguuuacagcacagaaaauacuuugugccguaguccuaauuuagcugaaaaaaaaucaauaugagcuauuuauuugcacauuuguuaacuagccaaugagagggaaagcgaaguuggccaacaucauaaaguugcauuaaugaaggagugagacgagacuacucaagaaauaccauugggcuggggauauauagcucaguggaagcacgguagccuggcauuaacaaggugcuauagguggaaaagaaaaaaacuacugucaaaagaaugauguauacagggaguuugaauuuuuuuuuuuaguugaauagacagaucauacugaauuucaacaguucagggaauacuaaagcacuacuuaugaaacaaugcagguguggauacacugaaaaagauaacaaaucaggccacuugcugugauguauaaugagaaaauuaaugauaguauauuuaaguagguucuuugccuuaaauuuccuucuugguucagaauugaauuuuggaauuuuuccccauuccagugaacauagacagcaauaaaauugcuagguuucuccauccugaagaauuucaccugagguuauaaccuuaggaauacuaggucuguccccaacuccuguauacacaaccacuuuguacugucacuguauucucauuaagcagaaaucgcugccagaccuggaaaaagaagcugcacucaauagcauauugaaaccaaaggcauagcucauuguaguuuucuaucagucauaaucuucuacaucgcaucuagccuucauauguggauacacugaaaaagauaacaauaaucaugucucaagaagagcaugauuauguaacuaucucucacacaacugcgacaaaacugugaaaaucguaauggugggaaaacaggcgcaaacccauggacuuggaaagggugaaaggcuuguaagguggguuuccugucgauccccagaagcagucuagcaguccuacuguucuuaaaggugcccuugccuuuguguaguuuuugucucccuuagagauggacaacuccacuugcuauuaugagacaaguuaggaggaacauauacacuacuugacauaucugacuaaaggugucccaguguucguaauaagaugcugaaauaccgacagcaugacacuugucaguugaccaugaaagaagcaugugugaaaagucugaugcuuuauuaaaacuauugcaugaaaacucaccaaggucaauaagcuguuaacauacaguagaugcaugguucaggccuucgaugauguaucuagucacucauggcuuucaucugccaggaaaaaggaggccccaguucauuugcuugcuauggaaguuagguaugagacaucaggggccauuaagaaagcuuuggacgugguaagguuugaaugcccacauacauuuuauucaguuccuaaaaacaaucaaaacaacuugacacugaugaacuugauacauuugacuguaucauauauagacccauauauagacugcuccuuaucuaugaccacuuugaauaagaauucauugagccguccaggugguuuuguuucuuuuuuccagaauguucuccugcucagauuggcauccauaagcagguggcauaugguggauacuacuauggaaguugcuggauacugauguggagguguccaugcccuuugggucaguuaguguacgcuuauguucgugugagaggcuugcuuucuuaaacugcuaguuugauguacugauaaggcagaccugacucuacauuuuacauuucuuuuuguaaacugggucuuuagaaagcauguuagccauuguguuaaaagaacauuguucccguaaaauuuagaggucuuaaaguuuaaaauggaaagaaaggagccacaaacuucuaaggauuguaaaauguuuggauugauucugaucuaguuugggaaacaguggaggcaggggauauuaaagaaacaaaagaaaugcauuguacaaauauguaguuuuagugcagguuaaugaugguggaggaaaguguugcuaauuuguuuauuucccaggauggaaugggaagugugauaugcaguuuaauuuuuaaggagcuggucucaauuuuaguacucucuaauuauaaaagaaaucaauguuucguuaaauuuugucauugguuugucacaauuaucuagggguucauauccaacucucuguggcaacucaauuuuauauaaucuuuuaauuguuuauguauuucugacaguaugaagagaaagcauaugaggcauagaacugucuuuuagaaauauggaugauguauccuggaaugugaaggugucccucuaagaugaaaaauggaauuauuuuacuguuguaccauuguuagaccuugaaugaauccauguugcagugugugucuguauauuuguagagaaagggaaaugacaauugaaagguuacuuuaaaauuuucaaauugggcacugccuguguugcagcacuacuguaucuuuguugagcgaccuaacaguauuucccuguugugaaaguuaauucugaugauguuucacauucaccagcuuuuuuucuguacuauuugcauccccaaauacuuaguacaaguagaauugugcauggcuugggcauucaaagauaagcgagcgaugagucagucugaguuucuaaagccaugaaaacuugcuuugagacugaauaguucugaguuauuuacaacagcaccaauuguccaaguuucuuucccuacuguaaaagaauugaucaguuucuucauuaaagcagcaagaaauuaauuaaauuuguacauaccaugucucuuagauuucuguguauguugugaaggacauuauuuugagaagaaauguacaaaggcauauuacaaggcuaugcaugcaccguccaagcaguacauauucagaaagucaaagauuccugcaaaauaaauuaauaaacuaaaaacaagcucuaca

SEQ ID NO: 9604 - RNA, 1043 nt, Mus musculus
cuuagacaucacuaacauguguagggaggcuggacuuggcuuuagaacguuucuuggccuuagauuuagugcuucucugggcuucaucuccagcuugggcucuagcuuucuccuucaaagauucuucaugauuguauagauagguagaggagccaggcucauugauguggcccaaaaauuccaucaccuuuacccggcucgauucagcauaagcuuuuggaccccacaggaacugauagcauggaggaucacuaucaggaaccuggcgguauucuagguaguuuuccugcacuagaucuucagugaugagcuuccuugcauccccaaagaugaggugugggaccccaucauagacuccuaacuuacucaggaagugccagaccucuuccucugggacacaguaaccauucaaauagaucacacuuaggagagggaucagaaugccucuaguaggaagacccagcucacugcucucacuuccaucauccuggaaaucuagcuuacugacaagaauguagguuugaccauggggcuggacuucuuucaucucaaggccaaaaaccagauccacgcgguuggaggcuuucuuaaggaucuccgggaacugcuccuugaaacuuuuagugacaacauucagcauuucuucccucagcaggggcuccuucuguuuguacuugcugagcauguacuccaucagcaucccagucuuccuugucagaagaucuugcugugggcucuucuuggauugcugggccgcagaggaacucacguauuucuuucgucggcucguggcaccccuaucagugcuuuugcaggcaaugcaaauacuaaaaguggugguaccagacauuucuugaaacaacuuggcaaggguuucagaagaaguacuugccgcagcgucuccagagggcaaagcagaggaagagcauggcucuuccuccucuggugccaugguuucaguauccucaagguucuggaacuuaguuuugcucuggcggcguuucucacgagcccggaccuuacucuucuguccccugggcaug

SEQ ID NO: 9605 - RNA, 1067 nt, Mus musculus
ccaagggccucucucuugcuuucaguguccuugcuggggugggugguccaggguuucuuacuccuuggaggccauguaugccaugagguccaccacccuguugcuacagccauauucauugucauaccagcaaaugagcuuggcaaaguugucauugagagcaaugccagccccgacaucgaagguggaagagugggaguugcuguugaagucacaggagacaaccugguccucaguguaguucaagaugcccuucagugggcccucagaugccugcuucaccaccuucuugaugucaucauacuuggcagguuuccccaggcagcacgucagauccaccgauggacacauuggggguaggaacacgaaaggccaugccagugagcuucccguucagcucugggaugaccuugcccacagccuuggcagcaccaguggaugcagggauaauguucugggcagucccacguccaucacuccacagcuuuccagaggggccauccacagucuucugaguggcagugauggcauggacuguggucaugagcccuuccacgaugccaaaguugucauggaugaccuuggccaggggugcuaagcaguugguggugcaggaugcauugcugacaaucuugagugaguugucauaguucucgugguucacacccaucacaaacaugggggcaucggcagaaggggcggagaugaugacccuuuuggcucaaccuuucaagugggccccggccuucuccaugguggugaagauaccaguagacuccacaacauacucagcacuggcaucaccccauuugauguuagcggggucucgcuccugcaagaugguguugggcuucccauugaugacaagcuucccauucucggccuugacugugcaguugaacuugccguggguggagucauacuggaacauguagaccauguaguugaggucaaugaaggggucguugauggcagcaaccuccacuuugucauguggagagcagaaggcagcccuggugaccaggcgcccaauacggccaaauccguucacaccaaccuucaccauu

SEQ ID NO: 9606 - RNA, 4758 nt, Mus musculus
agacagaagacgaagagcuggaauagagcucgccucggcucugcuggccuuggcugcagcucuuccagaaacccggggcgcccacagaagaaucucuuaccuggcucucucuucagggaugacaucaucggcucacaccagucuuccaggaccaccuucuggaugccaaagcugcugcucgaguaccugcugugcaccucuaccuccugguaccccagccacucccucaaguugccugcauguuauauggccuagccaaggagcacggauuccaggaacccacuaccauacagagcaacuccuuguggaccccccugggaucaggacagcgagggacaagcgacaaagaggaucaucaguggccagcuaguuucucugggguucaaaccuugaaccagugcccuagugagggggcacuggccauggcccuugaccuuugcucugcuugugucuugagucugagcccuuuccuguacaucugugcucguguucaucugcuagugaacuggagugcugcccuccccgaggagggucgucccuugugacugaucaugcuguccuaacaauguccugagcaaaagggucccuuugggaaccucucaggagggggacccgggucaggggcgaccagcaucuugcuggcaacuccguggguggggugggguggggugcuuccuucuggaaugagcacguggcugaccccccaaggcauguccccucccccuccuccacccaccuucucggagaugucccuuuugggguaguggggacauuaggagcaaccuccuaggguuguugugagaauuaaaugaacugcagcagccugaggcagggcugggcagagaccucaaaaaaaaaaaaaaaaaaaaaaagaaaaauaaucaaauauauauucuauuugauuuaaggcccacuccaugaugccaagagcauuugacuaaguagauuauagugguuagaggaaaauucuuuuacuauuaauuuaauaaaugaguacaguaauaaaaagaaccuuaauaauguauuucuauacccauggaucaguguaauguucaaauuucaucagagaaacuucuuaaaauagauuguuauuaacacggagacuuacaaauggguaacauagaucagacagugggagauuuuugagugcuuagcccuuagugugauauucauaucuuuaucacaccugaaugcauagaucacugaauguuaggggaaacccuaacauucaggaaucuaugcagaagauuuuaagagcuagaguugucaggcaauguuaaguaaauaguguuuucagauauaacagggcagaugcacaucauaagugaucucacugaguuugugagagcauaaagaagcucaggcagacaaaaucaaagcauggaggagagaaggggggcauaaagcaaugcuccuaaacaaaaaguuauuugcuacagauagcugcuaugacaaagaaaaucaguuuucuucacuggagugacacuggguauaucaaccacauuuguguacuguauccaugcucaaaaguaauuugccaaaccaaauuugacucccuguuuugugguauuuuuugugguaauuuuuuaagagacagagcaugaaauuggguuuguagggagaguaagaauaucugggaggaauuugaaguuuugaaauguuaugacaaaaauauauucucuguauuauuaaggaacauuuaaaagaagaagaagaagaagaggaagaagaagaagaagaagaagaagaagaagaagaagaagaagaagaagaagaagaagaagaagaagaagaagaagaagaagaaaauaguacaaugaugcacucucaaguggugauuaaggauacgacuauuucauugugagacuuaugagaaauuauggcuauugcaaacuuucacagauuuuccuuauaacuuauacauuuuaaaugaauaaaagcacuuaguauguuuaaaauaauuuuaaaggcucgaauucauaguuuaggaauagcaaucugcuauaauaaauggaaaagcuuuugcaaucauauuagaaauuagucauguauauaguugaggaauaaucccaauacucaucaaaauggaauuauuuaucaauguacuauaaucacuaugugucaaaaucuaaacaucucacauuauuggucauuaucucccugagauucauacacuuguuauuucaagcaaacuauuugacuucugcuuacuuguuauuaaauguuagaauauaaauggaguaauuaaauguaaucuuuuguuuaaaaggaggaaaggcuuaauacaaaugacaauucauacccagguucaaaccuuauaaaacagggacuguaaaaaugucauagcauaucauagugcugaaagccaugaccuacggauguguuuucuuagaguauuuucuuuucucuacuuuuuaugguggcaccuaucccugcccucuagaaggaucuuuugugcuuguuuauauauguauucuuuauuuacauuucaaauguuauccucuuuccuaguuuucccucugaaaaucccuuaucaccucccccccuuccccugcuccacaacucauccacucccucuuccuggcccuggcauuccucuauaccagggcauagaaucuuuaaaggaccaagggccucuccucccauugaugaccaacuaggcuauccucugcuacauaugcagcuagagacacgaaaaacaacaugaacuaaccaguacuccaagaacucucugguacuaaaccaccaaucaaagaaaucuuuugugcuuguuaucaucuaugcaauauuugaagcuuaugagcaaaaguuuuccaccuuuauuuuucauggcauagcuucaaauggcuagaguugcuuuaaugguuacacauucauauauuuuuuaguauuggcuuaaauauaguugguguaugguuuugugaguguuuuuguuaugacaaguuuccaaucuuauauuacucaauuagaggguuauguucugagagauacaacuucaagugauguugauuuugucauuauguaaacaauauagugucuuuauacgaacuaauaugacuguacugucauuauacaaugcgauauuauguaacauauguaguugguaguuauguaaaauauguuuaugcaguacaggacuaaacccuauuuuuucccaauuuguuucaggcuuacuuuauauacagaaaaauaauuaugcuuuuaagauucugaucauuaauuuccaugcccuuaucuuguaaucaaggaccaaaauguggcucuacaagaguagcaugagcuguuaagcacugagccaauucuccagccucaacuuauucauuuuuuuaaacuuuuuauuagauauuuucuuuauuuacauuucaaauguuauccccuuuucuuguuuacucuccaaaaacucccaucauaauguaaauguucaaggauuuucuuccaugucacccaaggauuaguuccauaagauaacauuacuccaccuuugaguuuacuauuaaaacuguugcuucugagaagagaacaugaaucuuuuuaaaauguaaacauuguaagcuauggauaauuuggaauaaaugcucauaccucaaugaauuuugauaucuguuauccaucuuuacaaauauagcgccaggcagaauuacuagagaagugaaugcaggaaauugaggacaggaagaaagagucuggcccugggcaaaaaaagaccuaacaagcaagaagaaucagaguccuguugaaagacccuugacagagaacccacccaauaaaaugacccaagagaaacuugaagaggcaaauuccauuggccaggaccagacacucacggagcauguuggagaggguggugcgccagagauuaauuguaauggagugauuggaaucauuaauuacccagagaacacuaauaaugagacacugagucuuaaagaggaucugcauaaugcuaaugacugugauguacacacuuugaagcaggaaacuaguuuccuaaacucuucaaauggagacagcaguccgucucaagacccagacuugcacacccacggccucugaggugucugagaccauggugugccaguccucuguagaacagucacucacugaacaggacaucacccaccuccaggagagcauucagggagauacaccuucuggggaugagcaggagcacaauggagcacuggaaagcaaaggaaaauucucugcuggaaauuuucuuauuaauccccuugagccaaaaaauacagagaagcucaaagugaagauugcugaccuugggagugccugcuaggugcacaaguauuucacagaagauuuccagacaaggcaguuuuggucuuugaaaguccuaauaggaucuggcuacaauaccccugcugacaucuggagcacagcaugcauggccuuugaauuaggcacaggggacuauuuguuugagccucauucaggagaggauuuauacaugagaugaagaccacaucgccuggaucauagaacuucuagggaaggugccucccaagcucauuguggcaggaaaauacuccaaagaauuuuucaccaaaaaaggugaccugaaacacaucaccaaguugaagccuuggggucuucuggagguucugguggagaaauaugaguggccucaggaggcugccggcuucacagauuuccugcugcccauguugcagcuuaugucugagaagagagccacugaugcugagugucccggcacccuuggcuaaacuccuaagccaguccugc

SEQ ID NO: 9607 - RNA, 452 nt, Mus musculus
gcgaguucucuccugagcuacgugucuguacgcucucaaaccgccauccaacaaacauggaucagguaaugcaguuuguagagcccagccggcaguuuguaaaggaaucaauucggcugguuaaaagaugcaccaaacccgacagaaaagaauuccagaagauugccauggcuacagcuauaggauuugcuauuaugggauucauuggcuucuucgugaaacugauccauauacccauuaauaacauuauuguggguggcugaguccuucucaucacaggacgagugagccagagcggggggacaagggcaugaaguaaagcguugccuguaugcugugugguguuuguuucuuccuccuuccuaugagguuuucuacuucucaauuaaaauaauuucaaaauaaauacuuuuuccauaacagaaaaaaaagaaagaaaaauaaaagcauga

SEQ ID NO: 9608 - RNA, 452 nt, Mus musculus
ucaugcuuuuauuuuucuuucuuuuuuuucuguuauggaaaaaguauuuauuuugaaauuauuuuaauugagaaguagaaaaccucauaggaaggaggaagaaacaaacaccacacagcauacaggcaacgcuuuacuucaugcccuuguccccccgcucuggcucacucguccugugaugagaaggacucagccacccacaauaauguuauuaauggguauauggaucaguuucacgaagaagccaaugaaucccauaauagcaaauccuauagcuguagccauggcaaucuucuggaauucuuuucugucggguuuggugcaucuuuuaaccagccgaauugauuccuuuacaaacugccggcugggcucuacaaacugcauuaccugauccauguuuguuggauggcgguuugagagcguacagacacguagcucaggagagaacucgc

SEQ ID NO: 9609 - RNA, 478 nt, Mus musculus
uuuucagcguccuucgcagcauuuucuuguucuacaugguaggcaccuggaaguucaacagagaaaggugacaagggcauaugagucuuccaaaagcuggaauacaugaagggguuuguagaagggcuauggguugagaggggaguaaauaccaggccaaguaaggguuaggagugcugggggaggggaaaucaacagagaaaagacugugcuuaccuuggcccuucuuauagucuugcuacauuuggacugggacugaugaccgcaaaucacugucuuugguucagcagucgagguugauagcucaagaucuggugugaggcaagugucccaugucuuggguucagaaguccagguugauggcacaauaucuguuaugaggcagaucgucacucucuuggguuuggaugucaagguugacggcucaacauccuguaacagauugugagucuucucaguuccuuucaccauccucaug

SEQ ID NO: 9610 - RNA, 327392 nt, Mus musculus
gccaguuucaggcugguuggcgcggaauagagagacuaucggaccauggcgcccaugcacgaagaggacuguaaacuggaggcaagcggugagggaggaucccaugcuuagggcacgugguugggaaugugggggucgcgguaugaucgagggggagcggaaggucucugcuuuuuauccuuaagaagguggcgcgcuccuagaccgccccuuaggucuguuugaccgccaaccuuaaucauucugggcggagacccuaggggugugggacggggcuuccugauggggucacuugcugaagguauuuuggcuugagcgguuucuuucucuuaugacaggcuucacagucguuggcucuuuucauuuucuuugaugagucgcaagcacguguggguuacaacuuccauggcaaccugccucggcagggauugcucucuccugccugaaacuguuucuaugcucccuuggcaggucucgguuugaggguuuggagcaugccugugccuccguuucuaggaagucccaggaaaauuguuagcauugucauugaagugagagauggaagugcugucaccagauauagaugcauuucguuaagauuuuuuuagguucuacgggaaguucuucaagugcuacauagaaauacuguucaggucuagucauuuugggugagguuugaaaaaaaguaucaguugaguagcauuucggaugcccuauauaucaggcauuuugugaguaguaauuuuuuauuuccagaaguagaguucaaaaaugcagauggccuugucugauucugauuuuaaacgguguucagcuaaaguaugacuuaacuucaguucuaacuuaaaaucagauacuuucuuaaccaagugucacauguccugccauucacugugcauugccauuaaugagaucuugcuucguaaucaguuucuuuugcauucagcuaguuuuaaaaucacagguuucucucucucucucucucucucucucucucucuccucucucagacaaauuauuuuggagaguugacuagcuuggauuacaaaugggcugugggauguaaguacaugaacagucugcagccucuaucagucauuugcuucuaaguccuuuuuucacccuaaaaaacuguacgccaucugugcacaucaagaaaucacucuuuggaggauacugugcaaucuugagaccccucuuaagucacaguguugauuaaguauuuucuggggacuugugacuggaauuuuucuuuaaagcaugccaaaagauuguuauguggaagaccgcuucagguuacugucccugccugcuuugggggaggguagaaguacucccaaguggugauuugaaaacauuauuucaaucuuuguguuuucccccauugucuugugucugugugugugugguguuuuuuuuuuuguuguuguuuguuuuuguuuguuuuuuuuguuuuguuuuguuuuuuuuuuuuuuuuuuugcuaauucacacagcguuaaagacauugcuuuaaaaaaaaauuccaggcuuuuuauguuggaaggugggacaccuggacagugucagcaaaauguagcaaggcguguaauuagcugccauuguguauagaaagucauuggaggcuuuaaugauaaaaaaaucugguauauugguuuguucagcaaacauuuauuaugcaaguacaaggcauaggcauucugccaggcucuggcauuagcaugcuggguagaaugguguggcuucugucuucaugaguggagaaaguaaacagucauauauaguaccacauggaaucuucccugaggaaauugcuuuaguuuugcuuucugaagcuagaccaaaguguugacuaggugccauguguggaauguaugcaugugcauauguuugauuauccuacaaccuuacacaacucacacaugugugugcacacacacgugcacaugcaugcacaugcauuucccauacaguuguagucacacaugcacacccaauuucucuuguauugcuaaguacauaauaagauagccauucuuauuuaauucuuaauggggaagauguauuuucuccuuuucaugaguguaaaagggucuuaaaaggucuauaaguagcucuuacaaguaguguaugaaaagagauugggaauuuaaugaccaaaaaaaggcauucagaggcucagucaggaaccacuacaacuacuggaaccaacucuaguugcuuuaaacaaaagaaauugauuaggguacuaugcaguuugcagagauccuguaggacugggaagccacucugggggcugcuuagccagaaauggugauuucugcugugccagagaacugagccagagaggucauugucaccuauggcaaaauauucagauguuacagcuuauaccuuaagauauauuuauuggacucagccgggcaugguggcgcaugccuuuaaucccagcacucgggaggcagaggcagguggauuucugaguucaaggccagccuggucuacaaagugaguuccaggacagccauggcuaugcagagaaacccugucucaacccccuccccccccaaaaaaaaguucuguaacaguugccuuuuuuuuuuuuuuuuaaacacaaacuuucuuaguacuggucuggucuacucccuuggaacauuagucuccaauuuaaaaucugagccccuguuugucauugguagagacuauuuugcaugcucauagccuagcuacaaaguaucugugaagaaagacucaguugcagaaacacccacuguagcaggucaaaugggcucugaaagaauuucuguuucaaauacugggcaacuuaacaaggugaaccugucauugaggcacauaccuacaguccuaccauguugaaggcugggguuggacgauuauaauuuaaugauagccuaguuaccugucucagaaaaaaaauuaaaauaaaacaagguagcugacugguagucucaugucacccacuaaaaauggccaaauugggcaucuguuccauaaugucuagaaucuagacuuuagauuguccuacuugcuguguauucuuacaaggaaaugagcuuccacacuggcuuugucuaaguuuccggauagauuuugcauuuuuauuucuuuguaauguggcuuaggucucuuccuugguuucugcaacuuuuuauccuguuuugugauguugagauucuccauuuucuaggcuuguuuggagacaucuccugugaaacccuuuucaguuuccuggacaaaauaaugguuuucuccauuugcacugcauuuuuacuucuuauauggaaccauuuuuauauuuugauccuagccuuagguccuuuuguguuacuugacugugauaaacuuggagacaagaaaaccgucuuauuuguauuuguaucucaaacuuuguguagugguacaguugcuuguggaguaaaucuauuuuaauaucuagagaauuugugggguugucaaggucuugaauacacugaauuuauuuuuaaggacugugcccauuuucauguaggcugacugaagaucuuuuaaaucauuugaaugacacucaggauuuugugacugucaucaaauaucugcauucuuuaauuuucuauuagugccuuucugagaaauguauuuuaaugucaaaugugaauguaaaaaguaaacugaggugcuacagagauuacauuuccagagagcuagagagaaaauaggaccucuaauuacacuuuacuuuuaagauacagcuuucagcggguuauugccaacauugggcacacauucuuuagaucuuauuuucugauucauucagacacuuagucaaacagcuuaaugucacaaauguuucagugguguuuuaaggaugcuucuuaucaauucucccuuuuuugugauuacuccuuuuaguaaauuaaucaguauagaauaagauaaacauucaauuucacagacauauguggcagucaugcugagcuuaaacucauggcugccaggaagucuuaauucuguggaugaaguguguguguguguguguguguguguguguauguauguauguauguguguguguguguguauuggccaucuugugaugaucaaaagcacagaugggucaaaaacugaguaaacaccaagauucucugguauuucaguaauuuugacaaagggcauuucaaccauugugaacuuuuccuacagucuuauacugucaugauccucugaacucuauuuugaaauuucuuuagccagucuguuucucuaacauuccaggugcuuccuguaaucucaguacagcguaugcuacuuaaccuuguuuuagagcuccguguuauucaucuuccauguuagaguguacauuucuaugaguuuagggacuguaugcuuuugaucugucucauagcgucuuauacuuugcaaagaauggaugcuauuuaaauccuuuugauuauuagaacaccaaauaaauugucuuuuuaugacucacuggauugcucaaggcccguuuauguuuuuuuguuuuuuuguauuuugguuuuucgagacaggguuucucuguauagcucuggcuguccuggaacucacuuuguagaccaggcugaccuugaacucagaaauccgccugccucugccucccgagcgcugggauuaaaggcgugcgccaccacgcccggcagggccuguuuuuuucugauggaaauguuaagucugauucccaucuuucauguuuuucuauaugauuuugagauuuuguuccuuuuaggggaagacuagaacuggugugcugcuuaguuuuagcacaaaguaggaucaucugugaagaggaaaccuccaguugagaaaaugccuuccuaucagcuuggccuguaggcaagacuauggaggcguuuucuugaugcccagucaacugugggaggugccaccauggguagacaccgggagauauaagaaaaguagcugaauuuugagaggaaaucaguaagcacauucauuccauuauuuuuuuuuuuuaaauauucuugacucaagauuccuuuucuuucccaaguuguuuguggccauauuuauuaauuguuauuaucuuguuuuuuuguuuuuguuuuuguuuuuuuuuuguuuuuguuuuuuuuuuuuuguuuuuguuuuuguuuuuuuuuuugggagagacagggucucauuguguagcucuggcuguccuggaacucacuauguaaaccaaggcuggccucaaacucagaaugauccagcugccucuaccuccccagcacugggauuaaaggagugcaccguuguacccggcuuugugcacaguguuuuuucacaacuacagagacgugaaucaagauaauuggcuuuagguguuuuaacuggaaguuagaggaaauuucuggagagucacaggaucgucauauugggccaugcuuugugaauuacuuuguauucuaaaaauacucauuugguuauuauugccuagaaacaaucuuucgguucugagggaagauggcugguaauuuucuaguaucugauaaacucgacuuuuuuccagcugugucagauucagggaguuuugcagcuucccgagcucggcgagaaaagaaaucaaagaaaggacgucaagaagcuuuagagagacugaaaaaggcuaaagcuggggagaaguauaaauacgaaguaaguaacguuuuaacccugugcuuuauuauucacauucugcagucaguucugugucccuuucaucaccccauuagaaauguuaguauguuuuaaggguuuuuuggaggggggaaauagauguccuagauucuauccuugaccucccuaguagguagaauaacaggcuccucucacuggaucuggcucaugcuucuuacagcauaacagugaacaaacgugggcacgagguagaugugcaggguauggagaaugcuagacccuuuaaaguuguuguaaggagcuuugcauaccauuguaagugagaguaguugguagauuuucccuuaguuaguauacugcaugucccuuugcauaagggaaaugaguaguguuuuuaauuucaugauauuaaguaguuuagcuaagcaccuucuuauaauuguucuuaaauucacuugcuaggggaguguuaauggaaauuugggcuguacuuccuguugguaagauugaaugggauaguccugacuguucuuuucguuuuuaaugaccuguaggccaaaucagaauggacagcauugccuagcuuccucacucuguauuuuaacugucaacgccagaaagagauaagcacuagaagauaguagcagcuaauauacuuucugaguucacauaccauucuacguacuuuuauaaauaugcuuuucauuucaucuucucagugaccauaugagauagguaguaugauuaacaacacuucgcaggugagguagcuaggcacuggaaaguuagugagauccuaguggcagauccuuauucgaaccuaggugaccuugcuugggaacauucacauuuuacacuggccuguacuauauuguggggauuagguaacuagaaaggauuuuccuauuugacaccauucaaguuaaauagggcuccaggaacauaaagaguugccagaaagacuacagucaagcaagcaggaguaaagcauuuuuaauuuuuuuuuucaagacaggguuucucuguguagcgcuggcuguccuggaacucaguguguaugccaggcuggccuugaacucacagagauccaccugucucugccucccaagugcugggauuaaaagcaugugcuaccaugcagaguagugcauuuuuuauguaggcauuucuacaagggaguucucuggggccuuucagauguuuauguuuaguggcugagucccuuuaugcauaguauuauuaaucuuauauaucucucuaaaaacguucugaguaguagcagcauuccuuuuuuuuucuuuuaaagauagucuacuauauuggggauauggcucacugguagauugcuugccuaacaagagcugagcccaggguuuuauucucaggaaccccaugugcagaggauagaguaaaauauuuccucaugucuuuuaaaaaauauuauguauaugugugugugccuauguguuuuuacacacaugcaugcagaagccccuggaggccacaagaggguguuagagcccuugcagcuagaguuauaggugguucucaaccauccuuuguuguacugggaacucaaugaucuuaagcacugaucaucucucuuuaacuccauuuuagaguuauucuguauaguggaaaucaaguuagcuguuuacugcuagacucucaaguguuuguguugaaguuuuuuuucccuaagaucuuaccuuuucggguacaguugguugcuuuuccuuuaaaaaggcagacucccaaggaggggacaauuuuaaaugagguaucuauaaacuauugauaaccagucuccauauacucaguuuggcaggucaguggccugucaccauggguagcugcaacaguggugugcaucuguuccauuuauuacuuuuccuguguggagguggucugcuacuuucauauuugugggucagguugcucaggccuucuagcagucagguauccagugugauuugagaacucacugcaugcacuuuuacaaccucagguucagggaagauucguggcaagacaaacagaugacuuaaaaaccuucccuucuuugccgacagaauauagagugaauuuuguuuugcucauuuuuagaggggaugacuaagguauuucuuuugaauuuuauuuaguuaauugaaccauuacuaaaauuagugucuuugcagggcauucaucagcuaguggugaauaggugugguaugccuuaugaauuuguuaacuauaggaaaaaccagucuagaaauuaugugaacaauccucaaagcagcuaaugaagaguuggcuauaauucaguuuguuuuuuaugggauagaugaguaauugaugguaugacaaguauauuaugcuaauggagucauuuaauaucuuauguuaacacccaccuaaaaggaauacuaaguuaauugaugucuauuuaaggaaaacccugcggugguguugaaugucagaacucaugauuugguugcagcuauuccaucaggcugccauuccaguuucaaucugauaauuuuuuucaucagaauuguuuaacacuuucacuccauuugaagcuuuuccauaaacuuugcaauggcagguugaggaccucacaaguguuuaugaagaaguugaugaagagcaguauucgaaacugguucaggcccgucaggaugaugacuggauuguggaugacgguaugugggaggaaauugccugccaggcacugugcuacuuccugauugucauuuagggcaguugcuaugccugaggagacauuuucauuaguuaccuuucucuuugcugugauaaaaaccuuaaugaaaacagcuuaaggaaggaaagguuuauuuaaaucauaguuggaggcuauauauaguccaucauucuugugcaggaaugguggcagaagugacauuguaucuauagccaggaaguaaagaagaaugauuugcgcuccauuugcuuccuuccacuuauucaguccauggucccugccgcuggaauggugcugcccacacuuaagaugggucugcuugggcuggugagauggcucaguggguaagagcacacccgacugcucuuccaaagguccagaguucaaaucccagcaaccacaugguggcucacaaccauccuuaacgagaucugacucccucuucuggagugucugaagacagcuacaauguacuuacauauaauaaauaaauaaaucuuuaaaaaaaaauagcugcagugccuaucuaacuuuaaagauuuccuggcaagguggcugggcgugguggcacacaccuuuaaucccagcacucaggagacagacgcagguggauuucugaguucaaggccagccuggucuacaaagugaguuccagaacagccagggcuacacagagaaacccaccaaaaaaaaaaaaaaaaagagagagagaagaaaagaggggaaaaaaaaaaagaugggucugcucaccuucguuagccuugauagacaaccucucagaggguuguccacuuagcugcuucuggacccugucaguuugcucgacagucaguauacacgcuuagaguguugcuagaggcauauuuaugguuagauuuuucuuaguuauuugaagaugaagcauuaaaaauaggaaguugauuugagaauccuuuagaacaacaguucucaaccuguggggcaaggccccuuuggggucucaucagauauucuguaucucagauguuuauauuauaguucauaacaguagcaaaauuacaguuaugaaguagcagugaaaguaauuuugugguuuagggggcacuacaacaaacgugaggaauuguauuaaaguguugcagcauuaggaagguugagaaccacuguuuuagaaaaugcagguacauacccaagaauaaaucccucagaacaugacugaucaugaaggaauugagagggaaugcuuggguacuagguugaaucaucagugccccucuaaaagaggaauagugaggaacagucgcauagcugguggaauucagggauaaacuuuagguucuaucuuuuccacuuugcaacuagccuuggguaaguuaguuaauaucauuaagccacaaguuuucugccuaugauauggagauagagacuaucuuccagaguugcucugaagaguugcuuuggcaccagaggguaaacugaggcaggcagacauugaggagucaguguugagagcagcugacaagggugaauccagauaccuacaggggcugcugccaaaggcagccagugauuagagaaguuaacucuuggggccagcgagaaagaugaagaaaaagagaaaauucgggugcgugcguacacacacaccacacacacacacacacacacacacacacacacacacacugaguggauaaaacaaaagucucagucuaauagcgucauguacacaaacaugcauguauacacauguacauacauucauacagaccuauagucaaacauacauauucacaauagaaugguuagagcaaagcaagcaggcuccaaacauuucacacacacacacacacacacacacacacacacauacacuaguggauggaccaagcuccaacauauacccagaaaagcucuacauguaaacauacauacagaugauggauggaaggaacaauguugcagcccccauucauacaaaccuuagacacauacauacacauagcugauagauggaaggaacaaugcuccaaccaccacaaacacaaaccucacacacacacauaguugaugggugcuccaaccgucauucauacaaacuacacuuacacacauaguugauggaugggagaaacaguguuccagccacucauacucuauucuuucuucuauagcuuauauaucccagcaaaaccuuucaagcuauauaaaauuacaaugugacgacauuuuaguuuucuucuaguaaaugauuauaaaaaagaaauuaguguguuucccaauaccguuacaagaaguacugauaaagaaaacaaaauuuccccccaaacucauauauauuuguaaccaagcaacuuguuauagauuaacaaaguguaagcaagcaagauaguuuucucggccaguuucucuuauuggcaggcagcaauuuucaguuacaaaggaguaauuauuauuuaucuuuaaaaguaaucuuguaagaaucuuaaaagaaugacaaaucugaacuuuuauauaaaaaucaguuauaucuaccuuaaauccacaaaaugcauuaucuacucauuagcaauucuuaauccucucaggaagcugaggauacaaaugaauauaagaagucaaucagcaccaguccagccucagggagagucaggucagccagugcugccauuguuucccccuaaaauaaaaaacacacugucaacagcaacaacaacaacaaaaacaaagcacagaaaacaucuuaucguggaagcuguagugugucacaguaugucccacaguacaugccucuguccacacauguucacuugcaaauguucacugcaguguguugagcugguucagaucucuggcuuuugugacacuaccaauauuggguccucaacaauuaaccuccugguuauccuguuguugcccugugugagagagaucuugcagcuuuggauuagcaggacuggccauagacaugccaagagcuuuaucuucuagguacuuuuggauccugucaguuuuggugacaguuaaauacacugucuuauuguuauuuuuuguuacuuugaggcaguuuuucauucuguagcccaggcugcccccccccacuucauuuuguaacucuaacuggacucaaacuuguaauucuccuaccuuaguucuuugagugcugauuacagacacacccagcuuuuggcuacuuuaggaccuugauuccaauauuuaacuuuguucuuucagaugggauaggcuauguggaagauggcagagagauuuuugaugaugaccuugaggaugaugcacuugacaccuguggaaaagguaccuauauuuuguuuugaaaaaugucauuuugagacuuagagaacugucuaaaauugaaaugauuugguauucugaaucagucugucuucaagaauauguucuaauagagaaaaaguuguuuuuuuuuuuuguuuuuuauuuuuuguuuguuuguuuuucgagacaggguuucucuguagcccuggcuauccuggaacucccuuuguagaccaggcuggccuggaacucaggaauccgccugccucugccucccaagugcugggauuaaaggcaugugccaucacgccuggcgaaaaaguugguuuugauauuaccuguaagaagcaaaaauuuuagcaggaaauaaaaaguuucaaguccccauuacugaggacuuugaucuuuuacuuauguuaaaauauuucaguucuuuaguuauuuuagaauugcagauuuugauggaugcaacaauaauaucuuucaauuccuacugaguugauaugccuagaguauuaaugcuuuaauaauuguuuaguagaaaaacaaaguuuagcuuguccaacaugucuuccaggguagcaaugaagacaucccaauacuaaaauguaaacuuccuuaaaacaugaugcuuuuguuguuauuaacuugagagagugguuaucaauagcaaauuuuguggauuauaacaucuuguagguugcugucccaagagacugaaugagccuucugaggaaccaauuugcuuuaacugaaauuuuacauggaauaacucucacuuugguuuaaccuuugguuccuuucccuuuucguaaccucauaaacaaacuuaaaugguuagguucuugaacuucaacaguggcuuccuaagaguaaggaugcuugucugcuuaacuauagcaccauguucaugguauuaucuaauauguugucuauagggaaaaaaauuccacuuagcucagcaacgucuuuuguaauuaaaaguaucuagauauuuguuuacuucgugugugaggggagagggggggagggauagaaagagaggguugcacuggcauaucuggugugcuacaguguguguguguguguguguguguguguguguguauuguguguaggucagaggaguucuuuccaccuugcuuugaggugggggucuuucuuguucuguugaugcacugcugugaaaguccaggcuagcugaacuugagcacaguugauucuccuaucuuagccucccuucugguuguaggagcacuagaauuacagaugcaugccaccccaccacacagcuuuuuuuuaaaaccuggauuccaaggaccaaacucaggaugucaggcuugcucagcaagugcuguuacuuccugagccaucuccguggcucccauaacuuuuuaagaugcagaaucuacuuuaguuuuuauguccuuucacucuuuggucuuauuuuguguugaacaguucuucuucccuucuucccauucuuucgucuuucaugguauuaaaacuuuuaaagggcuaguuguuuaauugaaugucucaaaaucuuggauuuuccuaauugcuucuuugugccuacuagguucagguuauuggcaacaguaaaaaaggguuuuagaauaaauagggaauggaaaccuucucaugucuuuuauuccauuauuauugauaauaaguuugauuucuugguuaagaugauaaugucagauuacaugcaaaacuucauuucucccuuuggaugauacaggguaauuuuaagccauguauauuuuauauauccuguuucuucccaaaaguucacccaaugcuuugaguggguauuggugguccuauuauucuuuuaauuacuuuuaauaaggucuugccauguugcucagacugcuauugaacucuugaacuucaaugauccuucugcuuuauuuagccucauguguucauuaagcauuaaacauaucacuguacccagcuucucuauuuuuuucauauuaucacuuugaagcuguguauuccuuuuucaaaaaagauuuauuuauuauuauauguaaguacacuguagcugucuucggacacaccagaagagggugucagaucucacuauggaugguugugagccagcaugugguugcugggguuugaacucaggaccuucguucggaagagcagucagugcccuuaaccacucccugaaccaucucuccauccccgaagcuguguauuccuaagaaccucacuauuaaagaucaguggccauuaguauguuuccuuuuguuuaugugggcugcugagcauaugugagugugccaauggccagagaacaacauuggggauuucccuuuucccuuuucgccaaauuuuuuuagacagggucugaagucugcugauuugggcuaugcuggccauucaguagacucccugaauccagucaucuguccaucagaacuuggguuacaggcaugcaaggcuauaccugguuauuacuagggugcuggagauuuaagcucagaucaucuugcuugcauagcaaguggucuuacuaggucauuuccccaaccucucauuuuuccuuuugagguucagacuuguucaguggagucccuuuaagcauccuuuucauacgauccuaccagucuuugagcauucccuagcauuuagggccaaaaugguguuucaggcuuaucuuguacuucuguuauagaccuggaauuggcuguuucucccuagaauguuaauuucuuucuuucuuuuuuuuuuuucuucaugagacaggguuuuucuguguagccuuggcuguccuggaacucacuuuguagaccaggcuggccuggaacucagaaauccgccugccucugccucccgagugcugggaucaaaggcgugcgccaccacgcccggcuuauguuaguuucuuuuaaguggggaauugaauucagaucuggggaauggauaugcucuuguugcuaagguguagagacugugcuugaguuauggcaguguuguuaauuguaucgucuugaccugaucuuaucaccugaucuuaguuuugccaccugcauaguaggaaguuggaauggacaggaaacaucucagagaaaagagaauccaguugcuccaguguugaucacaccaguagccacuucaaagaauguaugcaauauuucuuaaaugaaggagccaucgucacuguguuuccaugguugugguuuucucucuuuuugauuagauaucaguguagagaagauuugacauucuagaaaucagcuagucuuagaaauuuucauguuuugccccccccaugccuacagcucaccauugucuuuugccagaagccugguaagaucacaagagcauauaaagggaaauagaauccaauuuacaaaacaguuacagaauuuuggcuagaaguaaaaggucaacucuauuugaaaaaaccuuauuauggauuggcuuguguacaauaaguagaaaaauauaucagcuacuuugcugugaaaagaaacagugagaaaucacaguaaaacaaagccagcacuaagcuggaagaauuccgcaucaauauuuacuuacacuccuuuucuucccguuuuucuguauaaaucucacuaaccuuuagugaugagauuaaaggcuucucaugaagccuuucuuuuuuuauuuacaccucuauugacgucucuguauuaaccuuuuuuguuuuguuuguuuucaagacagguuuccuuuguguagccuugacuguccuacaacucacucuguagauccaggcugggcuugaacucacagagaccugccugccucugccuccagagugcugagauuaaaguugugcuccaccaccaccuguugucuuauacucagucuuaaagcaugaggcauuuaaacauugcuccaaaugaugucaauaaaaauuuaacgaucuucauguaacucuauugucuuaaaguuuucacaagugucuacaguuuucacaguucaggcacauggaaaaugaaaaaugaaaaauguauuuaugguccaugacuuuuaguaaauuugcaauguauauagcuguuuccacuauguaauuucagaauagcuucauguuagguguaagcucaauacucaauaagcagucacuucccaguauuccuucagugcuugacaaccauuggcuuacuuuaugucauuggauuucaucucauauaaauggaaucauauaauugaccauuugagucuggcuucuuugacuuagcauaagauuguuaauuucauucauguuagagcauaugcuauuacuuuccuuuuuuuuuuuuuuuugcuuuucaagacagggcuucucucuguagcccuggcuguuauggaacucacucuguacagcaggcuggccuugaacucugaaauccaccugucacugccucccaagugccgggauuaaaggcuugcgcuaccaccgcccggcuuauuacuuacuuacuuucuuucuuucucucuuucuuuuuauuauuagauauuuauuucauuuacauuuccaaugcuaucccaaaagucccccacaccaucccacgcccauucccccacccacccacucccaccucuuggcccuggcuuuccucuguacugaggcauauaaggucugcacaaccaaugggccucucuuuccacugauggccgacuaggccaucuucugauucauaugcagcuagagucaagagcuccggguacugguuaguucauaauguuguuccaccuauaggguugcagaucccuuuagcuccuuggguacuuuucucuagcuccuccauugggggcccugugauucauccaauagcugacugugagcauccacuucuguguuuacuaggccccggcauagucucacaagagacagcuauaucaggguccuuucagcaaaaucuugcuaguguaugcaauggugucagcguuuggagacugauuaugggauggauccccggguauggcagucucuagaugguccauccuuucgucucagcuccaaacucugucucuguagcuccuuccaugggugccuugcucccaauuccaagaaggggcaaaguauccacacuuuggucuucauucuucccgagcuucauguguuuuggaaauuguauuuuauaucuuggguauucuaaguuucugggcuaauauccacuuaucagugaguacauaucaugugacuucuuuugugauugaguuaccucacucaggaugaugcccuccagguccauccauuugccgaggaauuucauaaauucauucuuuuuaauagcugaguaguacuccauuguguaaauguaccacauuuucuguauucauuccucuguugaggggcaucuggguucuuuccagcuucuggcuauuauaaauaaggcugcuauggacauaguggagcauguguccucauuaccaguggaacaucuucuggauauaugcccaggagagguauugcgggauccuucgguaguacuauguccaauuuuuugaggaacugccagacugauuuccagagugguuguacaagcuugcaaucccaccagcaauggaggaguguuccucuuucuccacauccacgccagcaucugcugucaccugaauuuuugaucuuagccauucugacuggugugagauggaaucucaggguuguuuggauuugcauuucccugaugauuaaggauguugaacauuuuuuucaggugcuucucagccauucgguacuccuuaggugagaauucuuuguuuagcucugagccccauuuuuuaaugggguuauuuguuuuucuggaguccaccuucuugaguucuuuauauauauuugauauuaguccccuaucugauuuaggauagguaaagauccuuucccaaucuguucauggccuuuuugucuuauugacgguguccuuugccuuacagaagcuuugcaauuuuaugaggucccauuuguugauucucgaucuuacaggacaagccauugcuguucuauucaggaauuuuuccucugugcccauaucuuagaggcuuuuccccacuuucuccuuuuuaagauucagugucucugguuuuauguggaguuccuuaauccacuuagauuugaccuugguacaaggagguaggaauggaucaauucacauucuucugcauguucacaacuaguugugccagcaccauuuguugaaaaugcugucuuuuuuuccacuggaugguuuuagcucccuugucaaagaucaagugaccauagguguguggguucauuucugggucuucaauucuauuccauuggucuacuuaucugucgcuauaccagugccauacaguuuuuaucacaauugcucucuaguacagcuuuaggucaggcauggugauuccaccagagguucuuuuauccuuaagaguuuuugcuauccuagguuuuuuauuauuccagaugaauuuggagauugcccuuuccaauucguugaagaauugaauuggaauuuugauggggauugcauugaaucuguagauugcuuuuggcaagauagccauuuuuccaauguugauccugccaauccaugagcaugggagaucuuucugucuucugagaucuucuuuaauuucuuucuucagggacuugaaguucuuaucauacagaucuuucacuuccuuaguuagagucacgccaagguauuuuauauuauuugugacuauugugaaggguguuguuucccuaauuucuuucucagccuguuuauccuuuauguacagaaaggccauugacuuguuugaguuaauuuuauauccagcuacuucacugaagcuguuuaucaggcuuaggaguuaucugguggaauuuuuagggucacuuauauauacuaucaucaucugccaaaagugauaauuugacuucuuccuuuccaauuuguauccccuugaucuccuuuuguugucgaauugcucuggcuagaauuucaaguacuauauugaauagguagggagaaagugggcagccuugucuagucccugauuuuagugggauugcuuccagcuucuuaccauuuacuuugauguuggcuacuguuuugcuguagauugcuuuuaucauguuuagguaugggccuugaauuccugaucuuuccaagacuuuuaucaugaauggcugcuggguuuugucaagugcuuucucagcaucuaaugagaugaucaugugguuuuugucuuggaguuuguuuauauaauggauuacauugauggauuuccauauauuaaaccaucccugcaucccuggaaugaaacguauuuggucaggauggaugauuguuuugauguguucuaggauucaguuagggagaauuuuauugaguauuuuugcaucgauauucauaagggaaauuggucugaaguuuucuaucuuuguugggucuuucugugguuuugguaucagaguaauuguggauucauagaaugaguuggguagaguacauucugcuucuauuuuguggaauaguuugugcagaacuggaauuagaucuucuuugaaggucugauagaacucugcacuaaacccaucugguccugggcuuuuuuugguugggagacuauuaaugagugcuucuauuucuuuagggaauauaggacuguuuagaucauuaaccugauccugauuuaacuuugguaccugguaucugucuagaaauuuguccauuucauccagguucuccaguuuuguugaguauagccuuuuguagaaggaucuggugguguuuuggauuucuucaggaucuguuguuaugucucccuuuucauuucugauuuuguuaauuaggaugcugucccugugcccuuuagugagucuggcuaagauuuaucuaucuuguugauuuucucaaagaaccagcuccucguuugguuaauucuuugaauaguacuucuuguuuccacuugguugauuuugccccugaguuugauuauuuccugcagccuacuccucuugggugaauuugcuuccuuuuguucuagagcuuuuagguguguuguuaagcugcuagugugugcucucuuuaguuucuuuuuggaggcacucagagcuaugaguuuuccucuuaggaaugcuuucauuaugucccauaaguuuggguauguuguugcuucauuuucauuaaacucuaaaaaguccuuaauuucuuucuuuauuccuuccuugaccaagguauuauugagaagaguguuguuuaguuuccacgugaauuuuggcuuucuauuauuuauguuguuauugaagaucagcuugaauccauggugaucugauaggaugcaugggacaauuucaauauuuuuguaucuuuugaggccuguuuuuguguccaguuauauggucaguuuuggagaagguaccaugaggugcugagaagaagguauauccuuuuguuuuaggauaaaguguucuguagauaucuguuagauccauuuguuucauaacuucuguuaguuucacugugucccuguuuaguuuuuguuuccaugaucuguccauuggugaaagugguguguugaagucucccacuauuauugugugagguacaaugugugcuuugagcuuuacuaaauuuucuuuaaugaauaugguuacccuuguauuuggagcauagauauucugaauugagaguuccucuuggaagauuuuaccuuugaugaguaugaagugucccuccuugucuuuuuugaugacuuugggcuggaagucgauuuuauuagauauuagaauggcuacuccagcuugcuucuucagaccuuuugcuuggaaaauuguuuuccagccuuucauauugagguagugucgcucuuuuucccugagauggguuuccuguaagcagcagaauguuggguccuguuuguguagccagucuguuagucugucuuuuuauuggggaguugaguccauugcuauuaggagauauuaaagaaaaguaguuguugcuuccuauuauuuuuguuuauagaguuggcauucuguucuuguggcugucuucuuauagguuuguugaaggauuacuuucuugcuuuuucuaggacgugguuuccauccuuguacugguuuuuuuuuucuuuuauuaccuuugaagggcuggauucguggaaagauaaugugugaauuugguuuugucauggaauaguuugguuucuccaucuugguaauugagaguuugucuggguauaguagccugggcuggaauuuguguucuguuagugucuguauaacaucuguccaggcucuucuggcuuucauagucucuggugaaaaaucugguauaauucugauaggacugccuuuauauguuccuugaccuuuuucccuuacugcuuuuaauauucuaucuuuauuuagugcuuuuguuguucugauuauuaugugucaggagaauuucuuuucugguucaaucuauuuggcguucuguagguuucuuguucaugggcaccucuuucuuuagguuugggaaguuuucuucuauaauuuuguugaagauauuugcuggcccuuuaaguugaaaaucuucauucucaucuacuccuauuauccguagguuuggucuucucauuguguccuggauuuccuggauguuuugaguuaggaucuuuuugcauuuugcauuuucuuugauuguugugcccauguucucuauggaaucuucuguaccugagauucucucuuccauuucuuguauucuguugcugaugcucucaucuaugguuccagauuucuuugcuaggguuucuaucuccaguguugccucacuuuggguuuucuuuauugugucuacuuccauuuuuaggucuaguaugguuuuguuuauuuccauuaccuguuuggauguguuuuccucuuuuucuuuaaggacuuguaacucuuuagcaguguucuccuguauuucuuuaagugaguuauuaaaguccuucuugauguccucuaccaucaucaugagauaugccuuuaaaucugggucuagcuuuucggguguguugggcuacacaggacuggcugagguuggaguuuugcguucuuaugacagugagugaucuugguuucuguuaguaagauucuuaugucugccuuuugccaucugguaaucucuggagucaguuguuauaguugucucugguuagagcuuguuccuuuugugauucuguuagccucuaccagcagaccugggagacuagcucucuccugaguuucagugguuagagcacucuuugcagguaagauguccucuugcagagaaggugcacagauaucuguuuuucggacuugcuuccuggcagaagaugaaggcccgaaauagggucugucccagaagcuguuagcuucuguuguccacacucucaccugugcagacuagucuuggcaggaucuggaacaaagauggcuccugcagauguuccagcaaagcacccccccccacccggggcuggguggacaccucuccucuggcagggaaggugcccagaugucuguagccugaaaugggaucugccacagaagcucuguggcucccacuugucccagaagcuguuagcuucuguaauccucacucuuaaucugugcagacuagucuuuucgggauccgggaaggaagaugucucccacagauguucuggcaacggcuuccccguuacuuucuuuuuaugaaugaauaauauacuguucuguaguuguauauacuauauuuuguuuaucucuucauuaguuggguaucuguuguuuccauauuuuguuuauuguccuuacugaacucuaaacauuguguucauguuuuugcuucaacaauuuuauuuggggagcuauuuaccaagaauuguguguauguguuuugauuuauuuuuguuaaauaaaugauaauguguauaguuuuuuuuuuuuuuuuuuuuuuuuuuuugcuuagccaaguacucugaaaaucauucuagugugguacauagaguguauagaaaucuuucuuuuguguuuauguguauguagcugugaaaagucauguggaugcuucagaauauaaguuuucacuaauuauaaugaacuucuuggaagaacacuuauguucaauaauuuauuacaaauaguacaacauccaguaucugugccuuccucagggaaaauuccuaggugugagguugcugucuuggagaguaaguguacaugaaaacuuuuuuuuaaauaaucuuaauuuuuuaaaaaagauuuauuucaagugucugaguauuuuugcuugcauguauguauguguaccaugugcauaccugaugcccauggaaaucagagcagacaucagagucccuggaauuggaguuaugaaugguuucgagcuaccauguaaaugcugggaacugaacugggucuucugcaagagagugacaaguguuccuaaccucuaagccaucucuccagccccuaucuuuguuuucauuuuuuauguuuguuuguguuuugucuacauguacaugugucuaauggccugaauauguaucaaauaugugacauaaauaugugucagaggccugaagaggccaucugauucccuggaacuagacuuauacagaaggcugugagccaucauguaagugcuggaaauugaacgugaguccuuugaaagaacagcuaguaccuuuaauccaucucuuaaccucuguuuguuugcuuuuuuuuuuaaauacuuaggcaugcauuagguagcacagaguauuauuauuauuauuauuuuuuuccgagacaggguuucucgguguagcccuggcuguccuggaacucacucuguagaccaggcuggccuugaacucagaaauccaccugccucugccuccccagugcugggauuaaaggugugcgccaccacugccuggcagcacagacuauuuuugaacucaagauccucuucucucagguucuugaaucuuccagucccagcuucuugaguauuaggguucuaucccugagccauuaugcccaacuuacgcucuucauacgaauuauacauuuucauuaacaugguacaaaugucugccuccccaaugucuugcuaacaauguauugucaaguuuuuugagauuuugguacucggaucugugagaagugauaacuccgaaauuuucauuuacaguuuuacauaugaaguugaggauuuuuaaguaaaauuuaauuuguguucauugauaacuuucucuugcauuuuggccuuaaguucauuuauccuuuauuuaugauacauuuuaaagaaaucuuuucuguuuuuuaaaauguuacuucucauguaguugaauuuauuagucuuuuuuuuccccuacaaguggauuuuugcauuacaguguuuacaauauguagguuacaaauaauuaaggucuccuuugggucccaaccccagagaagagggggaaagauuguaggagucaguggggauugaggaccaggaaaacauggucuacugaaucaccuaagcaggacucacaugggcucccaaagacugaagcgggaagcacaaggcuugcaugggucuccacagguuguguacauauauguuauggcucuuagcuugguguucucaugggacuccuaacaguaggagcugcuguaucucugacugcucuugggacucuuccuucuguugggcugccuuggucagcuucuauaggagggacuuugccaugucuuauugaauccucuuuuguccuauuuggcuguuaucucuuggaaggcuguucuuuucugaagaggaaaggagggggaauggaucugagggagaggggagguaauaggaguuggagggaguggagguaggaaacuaugauugggauuuauuauaugagggaagaaucuauuuucaauaaagaaaacaaacaaacaaaaaaaaccccaaaaaacccaaacuaccacuaacagcaaaaccuuucaaaacuacucuaccccuaacugaagagcuauuggcaguugauaagugcuaagggagggagacucacuuucuuugguaaauagcuacugguagguugucugcuccaacggauggucucauacugaugcacauauaggcagcacuaauuggacucaauggugauaguagaaaaagacaggaaauucggggaguuguauuggaggagcugggggacaguugaggcaagggaguugagacguagaugucaucaaaguauauuguauacauaggaaaauuuugccuggguguggugguuuaugccuuuaaacugagcaccgggcaggcagaggaauuuggaucucugaguuugaggccagccuggucuauagagugaguuccaagacagccagaguuauacauagaaaccccaucuugaaaaacaacaacaacaaaaaaaacaaaaacaaaaaaaacccccaaaaaacgccaggcgugguggugcacaucuuuaaucccagcacucgggaggcagaggcaggcggauuucuaaguuagaggccagccuggucuacaaagugaguucuaggacagccagggcuacacagagaaacccugucucgaaaaacaaacaaaaaaaaacaaaaaacaaaaaaacaaaaaaagaaaccacaaaaaacacccccaaagagccaagaaaacccccacaaaaucagaaacccaaaaaaguucaaaaaauuuaaaaauaaaauauuauuaaaaauuuugagcaauuccuaaaaauacuuguguaauuuuauuuuuaaauuugucauguugguguuaauacuguuuacugcuuuaaaaugguuagugggcacugcuuauuuacaaaugaaguaauuugaaaauaaaauuaauuugaaaauagaguaaccuuuauuauacaguaaauuuucauaagugauugaguucuuuagaccuuucuuuuuaugaaguagagauuauuaaaagaaaaauuuauuauuaagaccaaggauugguagaaagcaagguacuuggaaauacuaagacauauucaacuguguauaugggcuucucauaggagaaucucaccuuucuuuugacauuucuaguaauuuagucuguauauuacuacuguauuguuuuaauuagucauucuaguuucucuuaagauuuacauuauuuuggaaugaaccagaaagugauauuaaaauggacaguauuaggaaagcucauaggugauuuagucaugcccacaaaggaagacaggaggcaaaaguucucuuggaaugagcaagugagcuugugccauucaguuugauagagcauagagcauguguccaguuguuaaugguugcagacuaguuguaggaaacaagaaaacaacuauuacuucaauuuucaaaagcuuugaauucacguugacaacuagucacacccaauucuccaugauacuuaauucauuauauuucauugcuuuuuuuuauaacuuaaugcugaaauuuuuuucaauuugucccauuuaaaagauucuuugcuauguaccuugugcaguauuuuccaauuuuguauuucgaauucuuaauuuauucucuucuuaaauuuucauauauucgcaguuuaugaguagguuuuaguuuuccauucagugcauguuccuaaauacuuucuuuuucaauaggaagugauggcaaagcacacagaaaggacaggaaggauguaaagaaaccuucagugacaaaaccaaacaauaucaaggcaauguucauugcuagugccgggaagaaaacuacagaugugaguuucauguuuccuuauauaaagagguuuuucccucugugaaaugaauuuauuauuuuguugcacaaguuguauguguugaauugaauacauauuugaguaacauucuaugaauugcacuuaguaagaugaauuuaggcuuuauaugaauauagguacuucagugguuugaacuuaggagauaaaagaaaauugaauauaaaagcugaaaugucacuauguuuaauuuuagugacaagcaagaaaaucacagaguaaagaugaaaauagaggcugagaguauaaauuuaaaugaauaugcacaagugauuguuaaagucugaaggacugauaggguuaagugcuuccuuucagagauggguguauggucuacaugaacguucaaucuagaaugugcucauuugagcuuuuuucuuuuuaauaauauacagaaagcaguagacuuguccaaggaugaucugcuaggugacauucuacaggaucuaaacacugagguaagugaauuucuuggaguaguaaaauacacagggaauauaggcuaaagaaacaguucacuaacuguacaaagaagacuaucacuggaaagaaaaguacugggaugucaccacacaugcacacacacaacccacccccccaaccucacacaaaacaaaaggccuuacauuaguuucuucucacugagguuucuucucaccauuuuaggugaggaguuuccaacuguuaugcucuaagauuaaguagauggguuguguggguguguauuggaaguaguaagaauacacccacgagucaguucugugacuauucauugcuuguauucaguugcuauaguguauguucuguaaauggcuugaagccugucaaucugcacacuugggcaugagaaucccgcucugaauucugagugggagugaaggaagaguaagugagcugccuuugauagaacucaaacaggcuccguuacacugaauuugagauuuggccauauaucauaaagacuaagcuuuuauuuagagguauacuuucuaagugacuauggauuaaucggcuaauaccaacacuaugcaguucuauuuuguugggugguaaauguaauaccugaaaggauaaguaaagaaaguauguuaaauucuugaacgaaaaaauuaggaauggauuaaauaucuauucuggcuuucuaguguugcuauaguaacugcagugcaugagcauggauccugcuuugggguugggggggggggaggaaaaugcuuuacuuauuggguaugagaggagaaauguacuuuuugucuauuauguggaaaaccaggcacgacagugaaugugucuuccccuucccuuuuagacagcucaaauaacuccaccaccuguauugauaccaaagaaaaaaagaucuacuggggcuuugcucaacccuuuuucagugcacaccccuaagguaaagaaauacccuccuugauugguuguucugcuugaaauuuauuugcauauaugaaggagaugcuuuugaauuuguuuuguuucuuuuaaauuagaauugccauucaauauauaguuucauguauuucaaaaauagcgugugccugcuuuuucauaguaaauuuuguaguaacuaguacauguuuauuauagguauuacaacuguguuaaaugcaauaauuuucuuccuggaaacaaguauuuuuuuguauaaauccagguaacaguaaaauaauugaagccauuacauuaauaauacauaaaaucuuuuuauaagugcgaacugucauuaucuuuggucagggcaggacaguuaaguauuuuuaguaugcaguucuaacugacuaaacacuuaaaaacauuuacaggcaauuccuucaggaaaaccugcuuccccuguccucaggaaugagccucuguuaacucccauuccucuuaaacgugcugaacuugcugguaagucucauguuaggcaaaagugcaaguuguugagcaacaacugccacacauggaagcuuggugauacaggguaauguugaagguggcaaucuaagcaugaaagguugaauuuauaguaguaaaaguugaaagcauccaagaugaagaguaaagagaaauacaauauaauguaggaaagggcuguuauuucaauguuggaccagcuuuguaacaugugaugggaauauauggugaugucuacaggagagcuggcucagccagaauguccagaagaugagcaggagcuagggguaauggaguuugaagacggugacuuugaugaguccauggacacagagaagguagaugagaagccugugacugcuaagacuugggaccaagagacugagccaguagaaaggguggaacaugaggcagauccugagaggggaaccacaucuuacuuguaagugcguuuuaugauuguucugaaauauaguacucuaaauauucuguuggcuuuuauaaaguuuuugaaaaugugauuucuacagagaaaauuuucugccagaugucucuuguugggacauugaucaggaugaugaaagcauaccucaggaaguucaaguggauuccaguaaucucccauugguaaaaggggcagaugaugaacaaguguuucaguuuuauuggcuggaugcuuaugaagauccauacaaccaaccagguaaucauaccuaagguaaucuuagacuuuuauuacacaguguagugccuguucccuuaaauacguuagugauaccgauugccuuuguuuuucuaauagaaucagacauuaauuugucucuuuuaaaguuaauuaacaguuucggggugguuguuguuuguuugagacagagccucucuauuauguagcuuugguuguccuggaacuugauacaggccucuugaacucauaagauccaccugccucugucuucugccagcaugcuuggucuaauuugucuucuuauucaacagagaacagccauugugugcuagacacugagguggggugagcaagcuagacaaauuccuuauauagaaguuuaacauucucagugaggugagaguuggugguaguuaagagggugggcgaccaguugacucuuaagcauugaacacucuugggagaacaugguucccaggaucaacuaagcaggucucaugggcacucacagagacugacguggcaaucauggagccugcguaggucuguccuagguugucuguauauaugcuauaguuguuggcuugauguuuugaggaguccugacagugggaauaucucugauccuuuugccugcucuugggccucuuucccuccuacuggguugccuuauccagccuugaugucaggguuuguguuuggucguugcuuggucuuacuguaucuugugcuauguucuguugauaucccuggguggccugcucuuuucugaagugaaacaggagaguggaucuaggggagagaggaaguagaggggaacuaagaggaggagaggggaaguugugguugggauguauuguuugagagaaaaaaagaugaacccuggauugaaagcugaggcaccuaaaagcuaagguaaaggcacuuuagcuuaaggaaacaauaagggcaaagguguaaaagagggaggaggauuaaggaggcuugugugauuauaagacuauuggaaaugacaaaauugauacauaauggauaaugaaguuguuaaagggcaaaaacuagcaucuuaguugcaguuucuauugcugugauaaagcaccaugaccaaaagcaacuuggagagaaaaggguuuauucccuuuuauaguuuguagucuaucaucuagggaagucagagugggagcucaagguaggauguaaaggcaggaacugauacagaggccaugaaggacugcugcuuuuugcuacuugugguuugcucagucugcuuucuuguagcacccaggaccaucaggucagggugccaccauccccagugaacugacccuuacacaucaauuacuaaguguaccauaggccaaucuggugggggcauuuucucacuuuagguucccucuuccuaacugauucuaguuugugucaaguugacauaaaaguaaccagcacagcuacauacugaaggaccauaaaagccuucucaaggaauuucagccuucagucuuauuuaaagaauauuggaaaaaugucagaagguuuaauuguagugugcuauggccuccuaguugacuuuacguuuuaauaggaaugcucuggcauaugcagagaaguguguguguguguguguguguguguguguguguguguguauguguguguguguguaucuguguguaucugucugucuguguugugucucucucuguguauacaugcauggaagcuggaguuggguagcagggaaauguggaaguccugauaaucagccagaguacaaguaagugcuggguaauuggacccuggguacuggguagaaauaaaaaaguaaauaguuuuuuuuaaacuauauuuugaccuguuguagauuguaugagggcaggugacuguaaauuggagauaggagucaagacugacuucuuggucuuuuguuuuguuuuguuuuucaugacagggguucuuuguauagucuagacuguccuagaccaggcuggccuagcccucacaaccucccaaguucugugucuuaguuaggguuuuacugcuaugaacagacaccaugaccaaggcaagucuuauaaaggacaacauuucauuggggcuggcuuacaggucagcuguucaguccaguaucaucuuuaaaguaucaacuuuaaaguaucuuggggauacuguaaaacauauccccaaauggaguaguggaaauguauuuuuucuuuuuuuccauuuuuguggcuuuuauuuauuuauuuacacuccagauuuuauccccccauccaccuuccaaauguuucacaucccauacuuccuccccacccccaccccccugucuccacgaggaugucccuaccaaccaccucugcccaaccagaccucuaaacuuccugguguccccagucucuugaggguuaggugcuucaucucugaaugaacacagaccuggaaguccucuacuguauguguguuuggggccucaucagcugguguuugcugucuauuuggugguccauugcuugagagaucucgggggguccagguuaauugagacuauugguccuccuacagggucgcccuucuccucagcuucuuucagccuucccuaauucaacaacaggggucagcagcuucuguccauugguugggugcaaauaucugccucugacucuuucagcugcuuguugggucuucaggaaugcagucaugauguucuacucauaaauaggagggaaaauaacuuucgacaugcuagaauucacuaagugaaucuuggccuuuggcucaagugacuuagcuguggauauaauaacugcauuugaguagcuuacugcccuuguuagccccauggcuuaugcccccucuguauuuucucuuaugaucuguugggaaauuuagcuuuguggaauugagguguuauagguagcauaaggauacuguccucaaaguugucuguguacagcggcuggugaaauggcuuagcagguaaagacugcuaagccuguugacaugacagaaccucauggugaaaggagaaacucaugcaaguuguccucuggcaucuaccuccucccaauauguaaauguuaaaaaagauuuguauacuggcaucugcaaaacagauucuagauuugauuaagagauaagaauuuccugugggcccaguauaauccauuaaucuuuguuaaugggucagagucaguauagucagagucagugugguuugucugauuaauauaaaacgcuggaaguagaauugucuguauuuagaucuccuggaaucugugguggauacaagcuguauuuuucaaagugguuuccuggagacugaauccaauaaaacuagagcgcguaacuauauauugguaaaggaaguguauaagaaggaugacuagccauccauuugacuuggagaccugauuuaaauaaagauaacuggguaucacaaagaaaaaugucagggguuucugggcugacuugucagaccauuaauauacuuccucuuaacaaauauuuauaugcucuugcagaaucacuuauagcacauggcccuaucuuaauuuuuuaggcaguuaaagucaagcucagaaaugguauguuacccaacgcauuuuagcuagggcaggaugauuugguuauagaucuuauuaucuacagacuuuugggccaauacuggaaacguuucuggucaugcuggagauugaacucaggcacaugcucugucacugagcuacauugcaagggacauauuuugcaguuauuuuuuugagaucaguguuguucaagcugaccucaaaaguucugggcucaacagaccuuccagcucagcuucucaaguagcuaaaacuauacacucaugccaccuuaccuacuuucauucaccauuauuuuaaacagugggagaaucuguuacugcuccauuauccaaaugcugagguaggaggaaauuucugguucacaagaaggccucagacaucuagacuauucacuuagaaaaccgagguuccaaaaacaaaguacccuuaguccuuuccugccgaagaucuuggcuuaucauucucaguccacuuucuucuucuguggcacuucucaaaauguguccucugcaguggcauauuuuucuguuuaugccaauggguuaaauaaaauagcuuuuaaaagcuuuaaucuuagggguuugagcaguuucgaagagauaguugguaaugaucacugagcuuucgugaagucaaugcugcuaauaagaacagaccccguuauuguugcuuacuuucuuccagauucuaagucagucgguuauugcugaaugaaccauaauuaugaaaagaaucuuacucuuugcauaucggaacauauccugucuucauuaugacuuuuucaagguugaauaauccugacugcaccugguuucagcuaguaacuuugggggaauguaaucuuuguuuaccaugaucuuuuuguggcaaaugaggcauaaacagugucaaauguguuacaugaagugugauauuaguuugacuguaaaaugagcuauuugaaucuuugaauccaauauuagggucuuuauuuuucuuugcaugaaauuuuguuuuuucaucuuuaacuguugugaggaugacuucuaauuuucugugcuacucugaauuuuuuucuugaaaucauccucaacacccccuucccucuccuuauauuccucacuuaguccccccaccuccuugcugaaaaucacacaacucuuuuaaucaucuguagaaaugaaaauccuuaagacugucuuauuucuuucugcuggaaucagugacaagagaaaacacugaugagccaucuugugaaacuaggguaauuggccuugugaacaauaaaguaaccuuuugaauguuucagaauuuccuuaguaucuaagaucaauggcugugugaguggcuguguugauugcuccuaauucauggagucuggaauuuugcagaguugaccaucucuugaguugacuaucaagucuuuggaguucuucuaugauggccaguuuucaugaacagugauuugaugucugcaaaggcaugcuuuaccaccauaguguucauuaccuggugaucuagauuuccuggugaauagaaaggaacacaagcgccgggcguguugguguauaccuuuaaucccagcacuugggaggcaggggcaggugaauuucugaguucaaggccagccuggucuagacagugaguuccaggacagccagggcuacacagagaaaccaagucucaaaaaaaaaaaaaaaaaaaaaaaaacaaaaccagaaaaaaaacccaaaaagaaaggaauacaaauaugaacuaguuagauuuuguuuuaauagcuuguaagguagauaagcauaaaauagauuauagaacaguauccugagacuaauguuaucuagaauaagagguaggaaauauaaacuacuuucccuaaauauaauuuuauauguggaaaaauacuaauauacuuguucuuaugcacaaauaauacuuuuucagcaguaaauuuaagugcuaaacaaucuagauuacuauauucaggcuucuaaguuuucauuagagguuuuaaggagauuuauuggaaaauacuuuguuucuuucaguuuggguauucuggcucuaguggaaguauucauaccaaguuagagaguuauuuugcuaccuucuccuguagccacagcuuguaccauuauguugguguauaugccauagguacagaacaaugaacuagucuuugggagugggaagcagguauagcuuuugggugaaaauuaguuacagaaagguguaaacaugugaacacauucauugggccuuuguaauagccucuuuaacuugaccuacuugaaagcuuuuuauuuccuguuuuucuuuuuuuuucaggugugguuuuucuguuuggcaaaguguggauugaaucagucaaaacccaugugagcuguuguguuauggugaaaaauauugagcgaacacucuacuuccuuccccgugaaaugguaaacguuagugauuaccuuuuacucucagcaguuguguaugauacacauucuguguucugcuauccuaccuuucugcaggguaggauuucucuacagucccuaauuguuuuaguucuaucuacugaccauucacauaaugcugggggcuggaaagguggcuuuuagaggugaagagcuguuacuguuguucuggagaacucaguugaguuccuggcacccacauccaguagucuguaagucccagagaucugacacucuuacuagacugcccuggaaccuucauauacauagucacauacauaaacauaacuuuuuuugugguuuguuuucaagaugggguuucacuguguagcucuggcugucauggaacucacuuuguagaccaggcuguagauccaucugccccugcaucuggaguaccaggauuaaagaugugugcuauuacaccuggcuuaauagacauaguuuuaaaaauaauaaaugcuuaaaauauaugugaugcuuucauguuucuuacucugaaacgugacauggcauuugacucaguuuuuaugcuuuugcuccauaggcagcaguaacaucuccauggccaucuagcggaacaguuucccuuuccuucccccucuuugucugagcuuuuaacaucuccaaucccucuaagccccaccgcuugccaccuccaucucaauugagcugugaagcuucugggccagaauuuaaaacauuuguuuucuccaucuuggaggaucggucaucuuuauuccaauuaacuuuuccaaugcacugggggaaguuggcauuggauuuaguauacuucuuagguuugugucuucacauucauuuguaauauuaugccagucaaaguuuaaaugaguggaggugacaguugauuuaggcuucuguguuuuugugguugagaagacuuuuuauacucuuuucccuuuauuauacucuuuucccuucuucucuucaugggagaauagaaauuugaccuaaacacagggaaagaaacagcaauuccaguuacaaugaaggauguuuaugaagaauuugauucaaaaauuucagcaaaauauaaaauaaugaaguucaaguccaaggucuguauucaauacuguauuguuuucugguucuucuuuauuuccugauuuggcaaauagcuauugcacauucauguagaauaucuuuugcauaguuauaacccauuaaauggaaauuucauagcuaugaaugaaaaagcugcauguuagauuuauaaaaauacuuuaaaaaaucacuuaugaaauagugcucaugaauuugaauagaaagaucauuuguagcaaguuaguugccccaauggcuugcagaauaucggcuugcagaauaccauguuucuauucugaaauggagaagaaacuauucugauuuguuuauacuaguuauugccaaugcauucuuuuaagaggauugaguaauguuuuugccuuuaaaguuccaugccuaugauacuguuccuaauagaauggaaauguucuauuccugugacuuguaugguauauugucuugauuuugguaugcuauugauggguuuggcuauaaugugacuguaguccauucaaaaauacuggcuauaaaaaauuguaguaaagguaggauugaguugcuacagaggcuaucauuguuaauuauuuuagcuugaaauugagaguaauaucuuuaaaauuccagaaauaguauauaaggccucagguuugaucacugucacuacagauagacaguaacaaacuccaaaacaaaaaacuugagaggaagucuauuaugauggugaagacuguagguaaauauaggugcuggagcuagcuugcuugugcucucgggcuugcacuguuguauacuaguguguaacgggggaaguaugcucacuguugugcugagaaaggggcccuauuguaagaguugcagaaagaguuaaaacacuuaauucauauuagcugauaauucauacuggaguagucuuggacagauagccgaucgauacucacugaauaggaacugaacuuaucauuucaauuucauuuuuccauuaagaugcaguugcuuaauaucaaaaguagcaauguaagacauuaauuuuucugguuccccugaaugcaacuauguucucuaauguucaagagguguucuuuacguuuuuuuuuuuuuuuucccacuagguguuuuaguaucaguugaaaggagaaaagauaccucuuuguuuuguuuauauuguuaggaugcuagauuccuggugauuaaauauggggacauuuguuauacauagaccauacuggcugauaauuuuugcaaauuucuuaaaauuauuuuuuaaauaucuacuuacccagauaguggaaaagaacuaugcuuuugagauaccugauguuccagaaaaaucugaguaccuggaaguuagauacucgguaagucaaagaaaacuaugggguuugguuuagaauuacauuuuuucagucuuugagccuucaacugacuuucaguucugaauauugguaggguuccugaaucccacaguucaugaauaauugaaauggauaaaauuaaguaauagagcauagguuauacugccuuucaaguauacaucuucaaauaaguaagcugcaacaguacaacuguuugucaaguagacuagaugguagaguggaacaucauuuaguuuccugaagugucuugugagcagcggaaaaugugagugcuagcacgcacuucggcagugcuguucuugcuccucugagaggugaagucaucgcuguggauauugauuaacuggaccauaacccuuuuaccucuguucugguguuuugagucuaauguuggagaagggaaacuuuuccuaaauuuuuggacaguggugaugaaaaacaauauagaagccuuuucagugagucccacucuauugcuuucauucuucuaauggcguggugcuugcuugguuauucuuuaucagugaggcagaacagcucuggacagaaauucucuuuugggggaguucuuguccuauuuuuuucuucuaaugggugucaucaagaugcauuauuuugucaugaauuguuuuucuuucccacugugaauuguuucagauuucauuuguagcaaaugacauuucauauauaucgaagggguucuucuguugcuccauagagccuuuguuuauuucaaauauagacuggaaaaugugaaguaguaguuuuaaacaaaaaaagguuuuuuuucuucuuuaggcagaagugccacagcuuccacagaauuuaaaaggagaaacauuuucucauguguuuggaacuaacacgucuagcuuggaacuguucuugaugaauaggaagaucaaaggaccuuguuggcuugaaguaaaaaauccacguaaggaaaaaugcuaaguagaauccugacauuucuuuucacuuuccuccuuuuagugaaaauagaaucuuuucucauauaauauauccugguuaccugguuauaguuuccccuccuucuacuuccccaguuucuccucuucucucuucuccagauccauucccucucugucuuauuaggaaagaauaugcuucuaagagauaacaaugaaacaugacaaaauaaaaugaaaauaaaauaaaugaaaauaagacgaacuaucauugacguugggacacgaggaagugucccaagagcaggcacaagaaucaaagacccacucauuuuucaacagucaggaguuccauaaaaauacuaagcuaaaugcuguaauauauacacagaggacccagugcagaccuauguagacccugugcuuauugccucugucucugagcucaugugccuugcuuaauugauucagaagggcuucuacugugucuucuauccccucuggcuguuaaagucuccauaggauuuccuguggucugagaggaggguuuugaugaagacuacccauuuaggcucuguccacauaaugucuggcggugggccucugcacuuguucccaucugcugcugaaggaagcccaugaugaugaccagauuaggagucauuuuaguaauacuuuuuuuuuuuuuaaauacaccugugguguuugguuuuauccuaggucucuaggguaucuagucucugauucuugguuccugaagcaauguugguguggagugagccuuaaggcaaaucagacauugguuggcuacuccuacaagucugugcuaccguugcaguagcauauuuugcaggcaggacagauuguaagucaaagguuuuaugguuggguugguuuucaucguuuuuuuuuguuguuguuguuguuguugguuuuuguuuuuguuuuuuuuuuguuuuuuuuuuuugguagcuuguagaguaccuuccugcaccaaagucacuacaaugaguaggguggguguugucuuugccagaguccacccccccaaaccaauuugcagagagcaacccuuugucuuaguaacagcuuggguuguuuagggauuuccaugagacccuguugcaguagccaauuaacuguacucagaucuauccagcgccgauggguauguucuuugcuacccaucccaauguucuggguucccgaaugaaagacacacucaaaaauagccuuauauuuuaauaugccuuaaacagcucaguggcugggcaacuucuuaaccuccaugcagguuucccaccucagaaaggaguagaugccaggccugagagaugcuggacagagaaccuagccaugauguaggugcuggggaacucaacuugagagcacugcaugccugugucucgggcagccaagaugaaauauaaguuuuaguaaguaauaauucaggaguaucagagggagaguguguuagcuauguggagguuaagaaguggcccagcuauugagcuguuuaaggaauaaggcugucucucucucucucucucucucucucucucucucucuccuccccccugugugucuuucauucaggaacccagaacauuggggccgguagggaagaaugugcugcugacaccggguugauuugaguagagauuaauuggcuacuacaacaggaccgccuuuagauuuuuuaaaagggaaguuaaagaauugguuuauuuauuuuaauguuucuucuuuuuuauguuuguuucuugaagguuuuccuuguaugauuauagguaauacacuugguuggaucucuuucuuucuaauacccgccaauuuaguccaaagaaggccacagugcaggcaguugcauggggaacugcugaccuuuggagggagaaaaucacagccuaauguaguggcgguuacccgaucuuuuuuagcacuuguaucuaggauacuguuuugucuucaucucuuaaaaauguuuuuaguuccuccaaaacaguuauuuuuaaagcugaucuuggauucuuuaaaaaauuuuauuaaagauauugaccucucauuccccuccccauguacauaaguauauucacaaacacaaagauuagcauacuaccgcccacuaauguggcuuauauuuaguuagauuuuacaauaucucauucuuauuagaugauagcuuugaagaauagcucuguuaaucaaaaaugucauaguuucuuuuucaguaaguuauuuauauguuuuaucuauucuuucucagaacucuugaaucagccaaucaguugguguaaauuugagguaauggcuuugaaaccagaccuggugaauguaauuaaggaugucaguccuccuccacuuguggugaugucuuucagcaugaagacaaugcagaauguacagaaccaucaacaugagguaaagaaaaaaggacagauuuuguucuuaugcuuuagauacacuaaauacuugccugaauuuguacagcuuuccuacaaaaggaaguuguucuuuuuggaggggaaaggauacuaacuuggcauuaagcuauguuuuagagagugacuugaauuuuuuaaaaggauuuaaauuacuggauauauuuugauuuuuguuuuucaaguagagauagagaaaauaauauaaugagcuccuuaugccagucacguuagcaguuagcaauguuuuugugacacguuuauauuucucuuuccuuucauuuuuaaaaagugucauuuuaccccaguauacguugguauacuucucucaaaguauucacauuuucuuuauguguguuugcaguguauguauuuguuuguaaggcuguguacaaguaugcaugcauguuugugcucgugacgguugaaggccgacggccgacgcugcgugccuuugacuugauuacuuuguugagaacaagucucccugagccugaagcucaucaaucuuguuaacuccggcugccagggagggccaggggccugccuagcacugagguugcggaugcgugccccacaccuggcuuuuccuauggguguuuggguaaacucaaguccucacacuugccugccaggaacuuaauugacugacaucucucuagcccuuacuuaaugcacauuuucuucuauaacaccauuagcacaauaacauuaacuuaugauuccuugauacauuuaccauuucuagaacauacuggaaagagucugcuucaugauguuuuuuaaagaugauuuauuugaauucagauuuacacaauggauucauagauguguguuuaauuuuuauaccucuugaaucucuuuuuaagugacaauagcuuccaccuauuucccuugaguguuuuccaaugauaaggaguaauuaaacaaccacagacaaugaucccauaggaagucccauuuucuguuucuguuuguugugcuaccguuaggaaucuauaccuggugcugacauaaaguagccugugagcuaaauucagcuuaccaccuguuuuugcaaauaaaauuuuauuuaaaauuuuauuaagacacagaaugaaugguuucagguuuauacuacaauaacauucagguaguuaugacaggucaugugaucugaaagggccuaaaauacuuucuugccaaacuuaguucugcccuuugugcugcagugugucagucacauuaacuaaaggaucaaauacauucaaguuuaacuuuuuuugaacagaauccuucauggcuagguggucgguguauuuuauauuggaucauuucagaaggcacauaugccugguuaaacugcggagaggcugguauugcuuaguggcuucaaauagugggcuuuccaaaguuuauugacccuggcacuuuaaauguuuucggcuggaugguucuuuguugccaagcacuauccugugcaucacaagauauuuaauagcaccucuggccucuaccuauuagaugcaaguagcacuauuuuuccuaguuguagcaaccaaaauauuucuccagccauugcuagaggccacucagggaaaagaaggugguacauuuaucccaggagaaagccacugacccaauguuuuuuuaaauguggauuauuucugccugaguuucuuacuucacuaggggcuguaaagugguggcuuucuaauucugaccauauauauaauauguauaauauauauauauauaauauauauauauauauauauuuuuuuuuuuuuuugguuuuucgagacaggguuucucuguguagcccuggcuguccuggaacucacuuuguagaccaggcuggccucgaacucagaaauccaccugcuucugugcugggauuaaaggugugcgccaccacugccaggccuaagguuuugguuuuuuguuuuuuguuuuuuuuauacuuauauaggcauugcuuucuuuuaguauauaguuugaucauuuauuuauguauuucuguauucaugcauuuauuuauuguaguguugaggauugacucaagagugcacgugauaaguuccguuaccacucagcucuacccuccacccuugaucuuucacgucacaaucaauacuguagauagccagaguuaauaaguauugaggaaaaguuuaacuaguacuugguuaauauuaagagaacuauucccagagugaugcuucuacauaccauuucuucacaaaggaacuagggcuuuguggagaacaggcugauucgcagcagggaauauguaagauaagcccggaacaucuugguacaucuaaagcaauauugcuuuaacugaagauacauuugacucaggcaauaaaaugaaaagucucucucugguaaaguauggcacaguaucaguaucaggagaauaauuccugaaaguaucagaaacauaaauuucuaauguuguugucaaauaauuucaugucccuuuaugagggaagcuagggaacaaacucauuugaaaacauaaaaauaaaugaaucaguauuuguccugacuuuucagggauaaguaguucuggaagccagcuaauugaaaugugaaauugcucuucuuagacguuucuaguacaugaugaacaaaaauuaccaauuugaaauuccuagugaaaugggucuaagugguucucaaccugugggucauaaccccguuggggauagcauaucagauauccugcauaucagauguuuauauuaugauucuaacagcagaauugcaguuauuaaguagcaacaaaauaaauuuaugguugggggugaccacaacaugaggaauguauuaaagaguugcaguauuaggaagguuggaaacuacuggucucaguacuaaucaccagcaaccacuaauauaccugaaaaagaaagaaacagauaguacaugcuuguguaccuucuaauagaaauaauuaguauacaucuauaguagccccaggaauuggaaccugguuagaucaaguucuuugaucuaacugaauuuguagacauuauagagagaggagaagguguucaauaacccuguugagauacaaacugggcugacaagggugcucuggagagauggccagugauuaagaguacuggaugcucuuccagagguccuagguucaauuuccaacacccacauggcagcucacaacgcucuguaacuccagucucagggaacuggacccucacuucuggccucugugcuauuagcuucuggguucacagcuggguaagaguguuuaauacuuuucuuuuccaguggcauaaauagaaccucuggcauuauuaaagcuagccuguauggaugaaaaguuuguaccaguuugguuucuucguguucugacucagcuaugugguguuuuuuguaauaggaucucacugucaaguucuggaauauauacgagaucacugcuaauaauaaguguaauguuuggggugagguaugggauuccacugaccaauacagugaaaagagucaacccguaucugacacugggcuuuguauuugauagucugugauaucugggagaggcacuguucccuucaaauagaauaacuccauuugaacuccuuauguguauguguauguguauuauaggaagcuucuacaguauugguuuuucuaaugacuuuaguguuaguuaauuuccucuaccuagccucccauuccccaccacauuugauccuuccuguuugguuauuccccuuuucucuuucaucaccugacugaguucuauucugcuuuccuugaaaucgucgaacccauagcugcuaacuaguuuccuguuuucuaugguuacuccaccugaaacacacauucuaaagagucaaagcuagcacccgcaaaugagagaacaugugguauuuguuuuucuagguuugugcuauuucguucauuauuuccagcuccgaccauuuggcugagaauuuuauaauauucaauuguguauauggaccauugauggacaucauaguuuuaauuugcauuucccauguaguuaaggauguagagcauuugaaaacauacuucuuagcuauuuguauuacuucuucugagaguuuuauuuaguuucaugccccaacuuuuaguuauguuauuuuuuuuucuuggcauuuagauuuucuauauuguagauacuaacucuaugucagagcuuuaaaaauguucuuaaaaaaaguuaaaagaauuuguauguauuaaaauguuuuagcauucucaguaguucuuaugguaauguagaccauccaguagguaucugauuuuccccacucuuucuuugcagauuauugcuauggcggcuuugguucaucacaguuuugcauuagauaaagcaccuccagagccucccuuucagacacauuucugugguauguauuuuuaaaagaugauuugcuaagaauuugguuuauucuuuuuugguuugacuuucuuugugguuggaucaguaacuugucuuuugaaacuuguuuuugagaguaguuagggcauuuuaguaaagauacuuaguuucaauuguggaaacuugaguuuuauugagcaaaauaaucugugugauaaggcaaaaugccaaggaauaaaugcaucuuuaccuauuugugagauaucuuagucauauuaaacuggaauugaguuauguuaugcauaaaguuuagugggugcaacaauuccauagaaugauguauguguguuuugugaguuggucuucaaggaagaguuugacauuccauguugagagauugguugauuaaauaaguauuuuguuuaaaaagacagugggaaguaagcuuugauguuucauauuuccugggaauuuuuuuucuaguccagaacuagcaauucuuuuggacaguucuuaugucugacuuccuggguauugggaaagugguaucaggaaauauucagagaggacaguaugcagcauuaucauugugaaguuuuaucucuuaaaugagaaaccaaauagagauagcagccuggaaaauacacggaacauaacgguuuuuagaucauuucagcaaacacuuauuuacccucucugugaacgucacugugaaugccugcuauauaugggacaagccuucagcuuccccuuacugggaaggaagccuuggucuacuguacagcuuagcuuugagaaaguggaacuaauuucuucuguuguguugugguugaagcuuuggugguaauuggauuuccuuugggaaaacuuaucaugaucuuucauucuaacuuggaaggcaaguuuuugauuaaagcauucuguacauuuguagauguauaaggaucucggcuugacuguuguuuugagauccagcaacacggcugauugaagaucuaggccuucuuaacuuuuuagggcucacaagaaauuuauauuuaaagcaauuucuauuuagaagcauguagacucugcaauuggacuaagaugagugauagaaucucauuuuuccuuccuauaguugugucuaaaccaaaggacuguauuuucccaugugauuucaaagaagugauuucgaaaaagguaaauacucauucccuuuaaauauugaauaucuguuuggaaagagaauaggagaauggaauggacuaguagaaacaaucuauucuguauuuuaauaaaaucuauucuugguacauuaaauugauaaaaugcauuaggaauauaagauuagaccuguaauaauucuuaaguuaguuucugaagauaaugaaauuaugacauggauacauucaaauuucccuucaguuagcuuauauggaagcuuuuccaaagugaucauguauuuugggaccauauuggguagagcucuuacccaacuugagggaaaccauauagggcugggaauacuguggguguuaaagggccauguaaugacaggguugauauuugcugaccuaaaugccucaauauuuuuuuuuaaacuccaaauaaguucugugaaguugguaucauaaucccuuaacaaauagcagaggaaacaguauaaugaacucaguucuucacaaaaaguaaauguauuugcucuaaagaauguaguuuuugaauagcauauuguucauuuuuaaaaaugauaauguugaaacaauuguagguuuauuucguuaauaucuucacuugacaauuaaauggugcaguuugucagguuucacuuaauauuacuucaauuggcuuuuuauagguagggguuacuauuguguuacugucauguguaaccuguccugaccuaggaaaauucccuuaaugucaaacugccacuuuuuaaaccuuaaguuuguuauaggaaacauacaugccaucaccuuuuguuuucagagugguuugauauuagcaguuuugaguacccgauauuauauaguaaaguaccucauguuuuugaaagguacucuaauuuauaugguuucaaauguguccaguguacaaacaugucucuguggaaggacauuucugcucuagauguugauuagcacuuugauuuuuuuguuugauuuacauguauauuacuacagugagguucuuagagauuuuguacaguuauuauucgaaaccuggagucaugaauuuucuugcuauguccgcuuuugaagugaaugguuacuccuaagaaaucucacucugcuugggcaagcagggaaggcaucuaguauuuaaaauacugacucucguauuucuuucuuuuaaaucuuaacagaauaugaagguugagaucgcugcaacagaaagaaccuugauaggauuuuuccuugcaaaaguucacaaaauugacccugacauucuuguggugaguugauguuggaucaugucaugggaaaguguuugauuuuuuucauucuuuuuggugugacuuuguuaaucauuuacuuuuuauugguuaucuacucuugaguaucaaagaauguuuuuagaaugagaugacccuguggcuuggugagauuucuuuagauuggaaggaaaauuguagcccaugcaggauaguuuuuccugguguaaaagcagcccuugaauuaguagucagcucaggauaacucaguuaccuacauuuagaaaauagcacauuagugaguggauguguauaaauugcuaguaucuuauggcacauuaauaagugaauauguauaaauuaccaguaucuucagaauucuaauugguuagcuugauuuggaucaaauuacaaauacaaaguaaauauuuuaauuuuaggagcucagugaaucuccaugaucuuugagagcuccuggguagggauuuuuuuucucucuugacaguuugcuggugaagcuaguaauuuccuguugguuugcgccuuuuccucgcaguaaaggagcgcuuuccuuuuguguauccucugaccuuccuggaucagaaugaaugccuccucuuucgucuggguuaauggaucaaucaaauuauauucuuuuugcucuuuucagcagaagucagugccuauauuucaaaagcaauauuagcaauuugguuacaucaaagucuugugcugucaaauuagagauaaguagacauuugagaaaaaauggaggggcuggggauguugcuucauaguagagugcuugcuuaccaugugggaggcucagguccuagguucuaucaucaguacggauaagaagaaaaagagaaggaaauguuaacugggucaucagccucauuuuuccuauugaauaccuuaucugguagugguguagcuaauguccuaagagccuauguuuggauuguugcugaagucuguauacccuuaugauauuucaggauuugucuuuaaaguaccaagaaaauucaguaguccuuuauucucauucauccuuucaaaacaguuuuuugaaucccaaguagauguuacagagugugggauacauaguccagggaauuagggacaagucuaugacaaacgcagauguaagaugggauccugugugagaccccaaccaugauaauugggaaauaaguuucccuuaugcccuucuggucuuuuauuauuagaaaaacugccauaaauauauagauauguauauguauguuuauagguucauugguacuauaugcauuuauaacauacuguuguuaucaccucuauuacuaccauguugcugucucugcagcucuucauauuuuaaaauuaaaacucuagaccagugguuuucaaccugugggucgugaccccuuugguaaacuugucucaaauauuuacauuaugauucauuacaguaagcauauuacaguuaugaaguagcagugaaaauaauuuucugguugggucccacuacaacaugaggaacuauaguagagcauugcagcauuggagagguugagaacugcuccucuagaccauuauuuccccauuucuccagacccuggcuacuaguucuaccugguaguauauauauuuugaaucaaaacuaaucuacauauucaucugaauuauuugaaacuaucucuuuuucuuauuaaaccuagcuuugugaaaaauauuauucagaggauauuaauuagaaauuauagaaauaaaaauucugauugugucaaguaauuuuuauaguuuuguuuccuuuuuuuaacuuuagcaaaccauucacuaguguuuauauuuuguagcauauugauuaaagguccaacucacuacuguucaugcucaguuuuuuuaaaauuuauuuuuauuuuucgagacaggguuucucuguauagcucuggcuguccuggaacucacuuuguagaccaggcuggccucgaacucagaaauccgccugccucugccucccaagugcugggauuaaagaugugcgccaccaugcccggguucaugcucaguuuuuaaagaaacuggauagaauuccuaagaaguccuauguaaauuuauacaccauagguuuucuguuuuuaaggaugcuuuuauugaucauguaaaugguaugggacauuaaaauuugcauuugccuucaacauuauaagacuuaagcaguaaagauaccguauaaaccucaaaucaauuaguauaaaauaaaguuuauuccagcaaucuccuuagcagccuaguuaaugucaagacuaaugaaugcugcugcugaauacauuccugaagaagaggggacuccaaucggaggugagcucuugaugucuucaauuagagaccagagaaagaaagggcaacgaaauucugugcguuugaagacaaauccucuaauuuguguucauuaugugauuagcugccucuuuuucugacuagggucauaauauuuguaguuuugaacuggaagugcugcugcaaagaauuaaugagugcaagguuccuuacugguccaagauaggucggcugaggagauccaacaugccaaaacuugggguaaugaucucaaaguuucacuucuuuuuuuuuuuuuuuugccuuuaaauauggaguagcuacuguuuuuuugaauaggcauuuguuguuuaauauaccauguucuaugaagaggaaaaauuaaaaguaacaccaggaagcucucaaacaagcaaacaaacaaacaauaaaacaaacaaaaaaacaaacauaaaacaacuaaagagagaauuaggagggagagagaacagagaaagaggggaacauggacuuuaaaauagauaguccuuggguucugaccucaaaucucaguucuuuccuuuucuaguuaaaugaucucaagucacagaacccccucugagaaagucuaaauaaaaccaaauaaaaguugcuaugggagauagcucccacagaaaauacuuagcucccuuccacuacauuuuccaccugaaugauaaucagcagugauuucagagccuaccaaaccugcccaaggucuaguccuuuaggaaugccaaaguaaagguaauaugcaucuaacauggacuaucuuuuacuacuagauuucguccuuuagauuuaaaugucgacuuuugaaaaguaccuguggcuuuuauaaauaaaaugcuggauucaagagagacauucacugccaaaguuaaaauaacacucacuuuagaagaagggguagaaucagcuguagaggcaagucgcugacauaacaguuucauaucuuaaucauuuuugccucaguuagucacuucauuagaagcuauaaaauguuuuuuucuaguucuguccaugucuauuagguuuugguuauaauugucuguaaaauuaucuuuccuccauuacccagcaguacuugguuaugcaguaacagguuacaggaaaggcaggguaaauauuaacuuccugcucacuaccaauuuucuguguaggacauugaaagccaucauguuuuauucacugugauaaacagagugcuuagaacagcaucagauauauaguagguguucagaaguacguagaaggagaauuucaguauuguaauuuugggggcaguuacaaaauagguuagaacaaauuguucuuaguacuuguugcuucaugggauuugguuuuuguuccugacuuguagagccggaguggauuuggugaaagaaaugcuaccuguggccgaaugauaugugauguggaaauuucagcaaaagaauugauucauuguaaaagcuaccauuugucugaacuuguucagcagauucugaaaacugagaggauuguaauuccaacagaaaauauacgaaacauguauagguaugauacuggauucuucagaguucauuuuucuugaagugagcaauaguagggugcuacugucacugucccugcuguccuuaggcuagagguacacuagccagccaguuacuggugucguggagcagacaguuaaacucuuuauaccaauuacccuacauccuuuacuuuuauacuugaauccuaagugauuggauuacagaucugaagagcuaaaccaccaaguccaugcuuuuuuuuuuuuuuuuugagacauggucuugcuguauuuauagcucuaucuauccugaaacuuucuauguagaucuugaacucuuagagaucugccugcuucugcuccucgagugcuuugacuagaggugugugucacuauaucuagcuaugauuacuuuuuuaaaaaaauauuuauuuuauguauauugguguuuugacugaauguaugucugucugaggguguuggauccccuggaacaggaguuacagauaguugugagcugccaugugagugcugggaauugaaccuggguccucuggaagagcagcagugcuuuuaaccacugagccaucuccacagcacugauuacuuauuuuuaaaacagguuucuuuuuccuguugagucucuuuuaaaaccuauuucuccugaccccuucagcuauuucucuuuuaauuauauuuccucucuagguuaucuguaguacaaguuccauguuggggcuaaugcuaccugccuguguaucuuugcuuuaauccuuaggucgaauuuuagguuuucccuauauuuaauauucuuaaaaaaccgaaguacuguuuuuuuuguaguuuuccuguaggcuuucauagcuguaucaaugacaguuauggauguuuagugcuauuggaagccuucaaagucaucuaccccauacuuucuuagacauccuugauucuucugugugacaccccacacgguagauucaucaagggacuuuuuccagcucuguauuuuuuuguuuguuuguuuguuuucgagacaggguuucucuguguagcccagccuguucuggaauucacucuguagaccaggcuggccucaaacucaguaauuugccugccucugccucccaagugcugggauuaaaggcguucgccaccacgcccgacagcucugucuuuuuaauaaagcuccuagcacuucauuaaccuucacugagcauacccuaguacaagccaccauacucuucccugaugugucuuaguccauuuucuguuggcaacagcacaaugccacauauuggauaagauaaaaaggaaagagguuuguguaugauucuggacguccaagauugauaaaucucuucugauaagaguuauaucguugcaucucuaucauaagucugaaaagugcauguaugucuauaucuacaaagacaccaguuuucagccaugcagucucaaaggcuucaucuuuaaauaccuuuguauuuuuguuuuuagccuuauaguauuuuauaggcuaaaauagcuguuggugcuaauaacaccaagcaaggucugagguucaaucuccauaugccccauaguacuucauagugggaauuaaauccuacucaguuuuaggagagacaaacuaugucaaacuguaagguggguuuauguacuaauuuuguugccuucuucaggucucuuuauaauuuaggaccggaguaauccugcuaaaauuaagucuaaucagaauuucucgguagugauagauaguguuuuauucagaguaaaguccauauauuagcuuacuagguuguauacacugucuuugcacuauugauuuucugcuauucuacugcucucuccauuauucugugaucuagccauaucaacuuccauuguguuucugcaaaagcuagauugcuaccucacucagagucuuugugcuuuuauuuguaaucuucuucccuaaaauacccaugcucugucacuucuuggucuuuauuuucagugacauuaaccuugcucucuaaguaaaaacucaguuucuccuccugauaguuuauauuuucuuuguuuccugccccuuuguuuguauucaauacuuaccauuguauaaauauuaccuauuuaauuuucuuuuuuauacucugucucucucagaaagacuggaauuugugucuuugguuauagccagugagugccucggauacaguaggcauauaauauauaauuacuugauugaaugaauaaaauaauuuagauaguuuuagguuacaauuaacacuagaucaaucuuugauuauaguuaacacauaauuucaugguauauauauauuuuuuuuuguuguuguugagaaggguacuaggauugaugguaucaaugcauuucuaauuauauagugaccuuauuuuaaauaguuuccaaagccaagguuccauugcucugaaguuacuuacaccaaaaaauuccuuguaauauuuuaaguucucauuauaaucauuguuucuuuuaacuacuugauucuguuucauucuuacuuuucuguacagugaaucuucuuaucuguuguaccuguuggaacauaucuggaaagaugccagauucauuuugcagaucaugugugagcuaaauguucuuccauuagcauugcagaucacuaacaucgcugggaacauuaugguaaauuuaacuuagaaauggggaaaaagcauuuccuguuggauucaguguuugcuugggguaguuguuauaugauaaugagucuaaaugcaugcuuauaaaaugaggaacugggauucugaaagggcuucuuuuguaaaaggaaaaaugguugggagaaagggaggaaugccaggugcaguauguggagauuuggguuaacauaaggacuuuaucucuaacaucuggauguuucuggugcagugauaucguuuggacuaagaaaauaaucacacuugucaguauuugaagcuccuuuuacccccuaaaugcuuaaagagaaaguuagaaauaauuuaguaaaagcaaccuugguuauugugaguugcugaaggaggugccaugguuaaauuaacugacucaaagcugauuuuguuugugguuguuuugaguucaaaaauuuaaaaauucuguuuaauagucuaggacacugauggguggacgaucugagcgaaaugaguuuuuguugcuucaugcauuuuaugaaaacaacuauauugugccugacaagcagauuuucagaaaaccucagcaaaaacugguggguucaaaaucauauaguaccuugccuuuucuuuucccuuuuuuuuuuauuaccuagauagccuuuagaaauauugcuuuaacauaugcuucuaaaauaauuaauccccucuaaacuaugaccauucucaaguuugcugcauugugucuguaugguuguuuuugucucuacuuucucuguaaugucaauauuauuugugaaaugucuuugaggacuuuaauagacuucuuugaugaauuaccauauauggaaaauauuugccuccacucagauuuacccaaagguaaauguuaauuaagucuuuuguaguuuuaaccuuugagcuuuuauguuuauuuuguacuaucuguaugcauauguauguauguugaauaucccuaauacauaauguuuggaauuggaagugcuucagauuuacuuauuuuauuuugaaagauuuguauauauguagugggaaaucuuggggugaggauguguguccaaacacuaaauucacuuguauuucacauauguacauauguuuguaucuauguguguauuaccugaagguagucuucauaauauuuuaaucaaccgucacauauggucacaugugcgaaauuuugcuuguagacuggacacuuaaaaaguuucagauuuuagacuucauuuuggggcauacaaccuguuccuaguaugguuaugaccacaccaaucagguuccuggaguagcuucugugacucugaaacuaaaaguuuuuuguuuuucuauuuuccauuuuaucagcacugauaguuaauuaagaauuuggauugaauguuaaaaugugacuugauuucuuauaguuuguuuuaugcacauuauugacuaugguacaguaaacuuuaauuuagaucuguugaacuucugcagugguauugaauguuggcuguuaguaaacuacuuggaaauggauuuuucauuuuguggguuuacuauuuuaaugaauccauacuaauaaugacaauaaaccaugcaugaggauacuuacugagucccagcuacuugggagguugagacaagaggauugcuuuuauaucaugaauauuagaguagugaauuuaauaaaacuccuuuauaauuccaaauucuguguaaugcgaaaaguuuuaauaucuauugauuucaaaaugaaauuuuccuuuccaccuuaaaaaaaagacacaguccaauauagcuuagacuauccuuuaacuucuuauauagcugaggaugcccuugaauuuauaauccuccuggcucaaccuucgaaguacugggauuacagguaugugucaucacaccugguuuuaugugguaaugguaauggaaaccaggguugguuuuguaagcgcuaggcuaaccuauauccuuaacacccaaaugacauuucuaggauuuuagagaccuuuaaauauagaaaucaggaaagcaauuauuuacuuaagaaacuaccaugcuugguauccauuuggauccacgaacacauugugauaauaauaauaguuuuucccuguagguaggaaagcuaaaguaaaaguaacuauuuuuguaacccaguauuguaauucauuaacuaguugcuagcuggugaugcucucuuuccguuugaaauagggagaugaagaugaggaaauugauggggacaccaauaaauacaagaaagggcguaagaaagcaacuuacgcuggaggcuugguuuuggaccccaaaguugguaagacuuuguagcagauugguuugcaccugguauugacagugguucucaaccuuucuaauugucugacucuuaauauaguugaucauguggugacccccaacccaaccauaugauuauuuuuguugcuacuuuauaacuguaauuuugcuacugcuaugaaucaugacuuaaauaucuguguuuuccaauggucuuaagcaccccuugaaaaggggucauuugaccuccaaaggguuucgacugauggauugagauccacuguuuuaagaaauaacuuuauauagagcuggacuuaagaaacuagaucuuaguuuuaucuuggagguaagcaaacuagucucuuaaugacuuuauuuuuaucuuuuaugcaugugaaacaugaauauaguaugaauucuuugcuguuugucaauacagauuuaguuauagaccuuguaauuuaaauuucuuauauuuuaauauaugacuauauauagacauauauauuacuuuuuucuauuauucagcuuuuauuuuuuuauuagauauuuuccuuauauacauuucaaaugcuaucgcgaaaguucccuauauccucccucugcccuguuccccuacccacccacuccagcuucuuggcccuggcauuccccuguacuggggcauauaaaguuugcaauaccaaggggccucucuucccagugauggccaacuaggccaucaucugcugcauaugaagcuagagauacgagcucugggaguacugguuaguucauauuguuguuccaccuauaggguuacagaccccuucagcuccuuggguacuuucucuagcuucuccauuggggacccuguguuccaucuuauugacugugagcauccacuucuguauuugccaggcucugacauagccucacaagagacagcuauaucagggucccuucagcaaaaucuuucuggcauaugcaauagugucuggguuugguggcugauuaugggauggauccccagguggggcagucucuggaugguucauccuuucgucuuagcuccaaacuuugucucuguaacuccuuucauggguauuuuguucccuauucugaggacgaaugaaguauccacccauuggucuucccucuucuugauuuucuuguguuuugcaaauuguaucuuggguguucuauguuucugggcuaauauccacuuaccagugagugcauaucuaaugacuucuuuugugauuggguuaccucacuaaggaugauauccuccagauaaauccauuuguccaagauauauuaguuuuucuagcuauuuagaaaacucuuagcuuauaggugauagaaaaauacggaguagcucaaauuugguuucagucccugcugcaauaugcagguggcuguuugucuuguaguagaaguaccuauuuuccuuucuugaugugagagugaccucaguauuugccccauacaugccagggcuggguaauuuggaaagcaguguuaaaacaaaugaaauaaccauugaauuaaaauuuagcaggagaguaccuuuacuuuguuauccagaagggaaagaggauuugcgauauuuagaguuucaucuuuguuuuucauaccaucuuaguuucgaaguguguauagcucaauaguauagucaugacuagguacaugugagcuuuaucaaguaacacaggagaagacauuuuuaaagaaaagcaauuuuauuaguugcaaugaggagugauauauuuggucuuagauauugguuuggguguugccuauuuaaugucuuuugaccuaagcuuccuuuucuaugaaaaggacacgauaguauuuacuagagaagcagaagaaaugaguuggauugugugguauagagaugagaaguaagcuacuaaugcauguuugcaguuaguacugugucaguggacauuuauauuggcagauucuucuugaggugaagauaauguuuuuuuuuuuuuaaugaauguccuagagaaauaaaauagcuuuguguucauccuuuuugagaagagagggugaaucauaccucuacugacauucauauaucuuuuucuuggcugaauuuaagcaguuuugguauaggcaaaugggcuguuuuauuccuugaaagugagauuguaaaaauaugaaugaaugaaaauacaccccccccagacacccacccaucuaaccacucacugaguuuuuauuuguguugaggugagagaguagugggaaagaaugcuuaacuguagcuuaggacaugaacaugauauauuuuuauaacaauugacauuggaaggugcuugcagauaauaaugggugcuuuggaacugcuggggaacaggcugguugucacugguucccaagucuuuucacccuuucuuuugugauauuguuuuuagugugauugaagucauuggaugauuucuaguugacuucucacuuuuccugcuuugcagcacgggaugguauauguuuccuauguaugguaccuucuaauaagauauuuggauggcacuuugacuuuuuugacauuauguggcuuuuuuguuucagguuuuuaugacaaguucauuuugcuccuggauuucaacaguuuauauccuuccaucauucaggaauuuaacauuuguuuuacaacagugcaaagaguuacuucagaggugcagaaagcuacagagguuuguauucaacuaggggcucuugaggucaauguuaaaaguauuccuuaaggaaagaaaagagccaaaggggucaggaccaguuuuuccucuuuccucuuacuggauguuuguauguaugucucuguauguguauguguacuuguagaggcugacuucaauuaucuuccccaucuccuuauuugagacaggaucucucacugaaccuggagcuugucauuuuugcuggagcggcuggcuagugagcuccugggaucugccuuagucucucaucucccaccuggggcauuagggguguagcaccauguugccuuuauaaaauauucagucuuuguguuugugugccaauguaaauguguguguggagguuagagaauaacuuucaugaguuaccccucuuuucauuguguucugguaaucaagcucaggcugugaggcuucuacaucaugaacuuuuaacucagugcugguggcacaaacuuuucauccuagcacuugggaggcacaggcaggcaggucucugaggccaggcuggucugcugcugagcaaguuccagaacagccaggaauacacagaaaaucccugucucaauuccucuucccuccaaaacuuuuaccugcugaauaauuuugcuggccuuauuuuugcuugcuugcuugcuugcuugcuugcuugcuuuauuuauuuauuuauuuauuuauuuauuuauuuauuuauuaucagauauuuccaggggacccuguguuccaucuuauagaugacugugagcauccacuucuguauuugccaggcacugguauagccucauacaagacagcuauaccagggucccuucagcaaaaucuuucuggcauaugcaauagugucuggguuugguggcugauuauaggauggauccccgggugggguauucucuggauaguccauccauucgucuuagcuccaaacuuugucucuaacucuuuucauggguauuuuuuuccuuauucuuuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauacaaaguuugcguguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguucuuucucuagcuccuccauugggagcccugugauccauccauuagcugacugugagcauccacuucuguguuugcuaggccccggcauagucucacaagagauagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaccuuauaucuugggaauccuagguuuggggcuaauauccacuuaucagugaguacauauugugugaguuccuuugugaauguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauaaaugcccaggagagguauugcuggauccuccgguaguacuauguccaauuuucugaggaaucgccagacugauuuccagagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucucaauagucacaaauaauauaaaauaccuuggcaugaccuuaacuaaggaagugaaagaucuguaugauaaaaacuucaacuccuuauucuaaggaggaaugagguauccacccauuggucuucccucuucuugauuuucuuguguuuugcaaauuguaucuuggguguucuauguucacacuaaggaugauauccuccagauaaauccauuugucuaagaauuucauaaauccauuguuuuuaauagcugaguaguacuccauuguguaaauggaccacguuuucuguauccauucuucuguugagggacaucuggucucuuuccagcuucuggcuauuauaaauaaggcugcugugaacauaguggagcauguguucuuauuaccaauuugaacuucuucuggguauaugcccaggagagguacugcuggaucuucuuguaguauuauguccaauuuucugaggaaccucuagacugacuuccagagugguuguacaacuugcaaucccaccagcaauggaggauccacauccucaccagcaucugcugucaccugaauuuuugaucuuagccauucugacugguguaagguggaaucucaggguuguuuuaauuugcauuucccugaucauuaaggauguugaacauuuuuucaggugcuucucaaccauucggcauuccucaguugagaauucuuuguuuagcucugaaacccauuuuuuaaugggguuauuugaauuucuggaguucagcuucuugagcucuuuguauauauuggauguuaguccccuaucagauuuaggauugguaaaaauucuuucccaaucuguucauggccauuuugucuuauugacggugucuuuuggcuuucagaagcuuugcaauuuuaugaggucccauuugucaauucuucaucuuacagugcaagccauugcuguucuguuugggaauuuuccccugugcccauaucuuugaggcuuuucccuacuuucuccucuauuaauuucagugucucugaucuuauguggaggucuuugauucacuuagacuugagcuuaguacaaggagauaagaauggaucaauucgcauucuucuacgugauaaccaccaguugugccagcaccauuuguugaaaaugcugucuuuuuuccacuggaugguuuuagccccuuugucacaaaucuagugaccauagcuguguggauucauuucuggguccucaguucuauuccauuggucuaccugucugucacuguaucaguacuuugcaguuuuuaucucaauugcucuguaguacagcuuaauguuaggcauggugauuccaccagagguucuuuuauuguugagaauaguuuuugcuauccuagguuuuuuguuguuccagaugaauuugcagauugcccuuucuaauucguugaagaauugaguuggaauuuugauggggauugcauugaaucuguagauugcuuuuggcaagauagccauuuuuccaauguugauccugccaguccaugagcaugggagaucuuucuaucuucugagaucuucuuuaauuucuuucuucagagacuugaaguucuugucauacagaucuuucacuuccuuaguuagagucacgccaagguauuuuauauuauuugugacuauugugaaggguguuguuucccuaauuucuuucucaguccguuuauucuuuguguagagaaaggccauugauuuauuugaguuaauuuuauauccagguacugcauugaaccuguuuaucagguuuagggguucucugguggaauuuuuggggucacuuauuauauacuaucauaucaucuacaaauagugauauuuugaccucuuccuuuccaauuuguauccccaugauguucuuuuguugucgaauugcucuggcuagaauuucaaguucuauauugaauagguagggagaaagugggcagccuugucuagucccugauucuagugggauugcuucaaguuucucucuauuuaguuugauuuuggcuacugguuugcuguagguugcuuuuaucauguuuagguauuagccuugaauuccugaucuuuccaaaacuuuuaucaugaagggguguuggauuuugucaaaugcuuucucagcaucuaaugagaugauuaugugguuuuugucuuugaguuuguuuauauaguggauuauguugauggauuuccguauauuaaaccaucccugcaucccuguguugaagccuacuuggucaagauggaugauuguuuugauguguucuuggauucaguuagugagaauuuuauugaguauuuuugcauugauauucauaagggaaauuggucugaaguucucuuucuauguuggaucuuugugugguuuagguaucagaguaauuguggcuucauagaaugaauuggguauaguaacuuauguuucaauuuuguggaauaguuugagaagauuuggaauuaggucuucuuugauggucugauagaacucugcacuaaacccaucugguccugggcuuuuuuugauugggagacuauugaugacugcuccuauuucuuaggggaaaugggacugauuagaucguuaaucugauccugauuuaacuuugguaccugguaucugucuaggaagcuguccauuucauccagguuuuuuaguuuuguugaauauagccuuuuguagaaggauguggugguguuuuggauuucuucaggaucuguuguuaugucucccuuuucauuucugauuuuguuaauuaguaugcugucccugugcccuuuagugagucuggcuaaggguuuaucuaucuuguugauuuucucaaagaaccagcuccuguuuugguugauucuuuguauaguucuuuuuguuuccacuugguugauuucaguccugaguuugauuauuuccugcggucuacucuucuugggugaauuugcuuccuuuaguucuagaacuucuaggugugcugucagacugcuaguguaugcucuuucuaguuucuuuuuggaggcacucagggcuaugaguuuuccucuuaggacugccuucauugugucccacaaguuuggguaucuuguggcuucauuuuaaacucuaaaaagucuuuauuuugucucuuuauuuuauccuugaccaaggaaucauugaguggauuguuguucaguuuccacgugaauguuggcuuucuauuauucauguuguuauugaagaucagccuuagucuguggugaucagauaggaugcaugggacaguuucaauauuuuuguguuuguugaggccuguuuugugauacagucaguuuugcaggacauaccauguggcgcugagaagaagguauauccuuuuguuuuaagauaaaauguucuguagauaucaauuaaauacauuuguuucauaacuucuguuaguguccaugugucucuguuuagggucuguuuccaggaucuguccauuagugagagugggguguugaagucucccacuauuauugugugaggugcaaugugugcuuucaacuuuacuaaauuuucuuuaaugaauguggcugcccuuguauuuggagcauagauauuuagaauugagaguucaucuugguagaugcuaccugugaugaguaugaagugucccuccuugucuuuuuugauaacuuuggguuggaagucaauuuuauuugauauaagaauguuuacuccagcuuguuucuucagaccauuugcuuggaaaguuguuuuccagccuuucacucugagguaucgucuguccuuuucccugagguggguuuccuguaagaaacaaaauguuggguccuguuuguguagcuaguccguuagucuaugucuuuuuauuggggaauugaggccauugauguuaagagaaauuaaaaaaaaguaauuguugcuuccugucauuuuuguuuuuaaaguugggauuuuguucuugggcugucuucuuuuagguuuguugaaggauuacuuucuugauuuuccuaggguguaguuccguccuugucuugguauuuucccuuuauuacccuuugaagggcuggauucguggaaagauauugugcgaauuuaguuuuaucauggaauacuuugguuucuccaucuaugguaauugagaguuuugcuggguauaguagccugggcuggcauuuguguucucuuagggucugugugugaacuauccaggaucuucugguuuucauagucccuggugagaagucuguuaauuccaauaggccugccuuuauaucuuacuugaccucuuccccuuacugcuuuuaauauucuaucuuuauuuaguucauuuguuguucugauuauuauguguuaggaggaaugucuuuucugguccagucuauuuggaguucuguaggcuucuuguauguucaugggcaucucuuucuuuacguuugggaaguuuucuuuuauaguuuuguugaauauauuugcuggcccuuuaaguugaacaucuccauucucaucuacucccauuauccguagguuuggucuucucauuguguccuggauuuccuggauguuuugaguuaggaucuuuuugcauuuugcauuuucuuugaugauuguguccauguucucuauggaaucuucugcaccugagauucucucuuccaucucuuguauucuguugcugaugcucgcaucugugguuccagauuucuuuccuaggguuuccuguauugugucugcuucccuuuuuaggucuuguaugguuuugcucaauuccaucaccaguuuguuuguguuuuccuguauuucuuuaaggacuucuacccuuuagcaguguucuccuguauuucuuuuaaaguuuuucuugauguccucuaccaccaucaagagacaugauuuuaaaucugagucuugcuuuucggguguguugggguacccaggucuggcugaggugggaguuuugcguucugaugaaggugaguagucuugguuucugauauuaagauucguagguucccuuucgccaucugguaaucucuugucuuagauguucuagcugucucuggcuggagcuuguucuuccuaugauucuguuagccucugucagcagaccugggaguguagcucucuccugaguuucagugaucagaguauacuaugcaggcaagcucuccucuugcagggaaggugcacagauauucgaaguucggaccugccuccuggcugaagaugaaggccugaaacagggcuugucuaagaagcugaauagcuucuguagucugcauacucacuugugcagacuagucauugauccuuguuuuugcucuuuuccaagguuuuggugauacaaacucagguugucaugguugcucaguaagcauuuuuauccauugaauuacuucuccagcccuaauuauguacuuuuuuauucauccaaaaugagggcugauaaaaaagaaacuuagauggguucuguaucuuugcuaaagcaauguaguagagguuuaguuuacuuacuauacagucuaccuauuuauagugugucauuuuuaguuucuuuuuuuguauagaaauauaacuuuauuacuuuguaugguaaaguuaaauggacuacuuggcaaguaugauagggauaggagacggcaauuaauagcccuaaaugucaaagguuuauuagaaccuguagucaugcuaaaacacuugaacucaacagugaaaaaugcauauaugcacacacaaacacacacacuacacauaugcacacaguuagauauacacaauacacauacacacaaguauccauauacacguacagacauacacacauauauacacacacagauauauauguauauauauuauacagccauagcaaugaaaacacuaaaauggauuuaaccaaaauuuacagacaacucuacgcuggagcuuaauagagaaaauccucauaaacuguggaaugacacaaguggcaaagucuucaaguuaaaaaugaauaguuuuccaacauuuaacaguagaaagcugaaguggguauacagucagucauuuauuuauaucaggacaagagagugauacaaggcucugcaugugcuggucaaguucuguaucauugacuguauccccaguuuuaguuucuuuauagaguuuguaaacaauuacuucauucagggugauuauuccacaaaagcaaagaaacacaaaacuaaaauguuuagcugucaccucuaucaacuuccuuuaugguccuagcuguaguuagccauuaauccuccuuauaaacuaaagcuauuuuaauaauucuuugguaguauaugaugcauuguuaacucucauccucaccuucccuuauuuccuuucucccuacaaaccuccuuuccacaaugaugccuuuuuguuuuucuaucuauugagcuuaaucaaggcagugugugaccuugaguuuggaacugucuauuggagcuugguuuucucaccagaagccaccaagcuuucugacuguguauaguugccugcucuggacagucuguguaauuggaauccuacagcaugugaaguuugcucauguguggcuuguuucacuuagcauacuguuuuaucugugcuuguagcuucuucugcacugauaagaaauucugacucaguauaggacagaauuauuacucaucacauuuuauuuguuuuacccccuuguccucuucuucccucuuccugcuucccucugagaccccauuugcccuacagguucugaauuuaucuacccuuuauuuucagcaugucuggauuuguuuuuuuuuuccaguuccaauuucagauucccagaagagaguagacuugacugaguucgucaucaucucuggucccauuacuucuguucacaaggaugguuucacuuucuaaaaaccuguuugcuaagaguagaccuaucugagggacuacaagauaauuuuaaaaagaaauuauuacacaaacaaccccuaaaaguagcagccgcuguugauaaauacucuuuggcucuguccugcuauuuuuuaagcacagucacaguuaucauuguucuuccacaacugaugcccaccaguguuuugccuauuugaaauuuuuauuuuggguucuaaguauauaauagaguggaaagacccaagaggucaucuuaagaaguacugccgggcgugguggcgcacgccuuuaaucccagcacucgggaggcagaggcagacggauuucugaguuugaggccagccugaucuacagagugagguccaggacagccagggauauacagagaaacccugucuagaaaaaaccaaaaaaaaaagaaaaaaaaaagaagcacuaugcaugaggcaguuugugauucugcauuauaucaaagggagggagcaguuagugucacgcuggaaguguuguuaggguuucagaggaauucuaaauguccugacccaagaaucuuucaguuuccuuuuugucuuuuguuuuuuguauuauagaauacacuuuauucaggccuggggagaggagcugagcugagagguaauauagagagagacagagaaaaagagacagagugagagaccgagccagagacagagagagcgagcacgcagaggaguggaggccagccgugacuggaaagagauaggggguagugggauagggggaggggagcuggaggagaggacagagcuagagcacgaagacaagagcucaguuuaccuuuugugugacuucucuaggugcuguaaauacaguggauguucucuuuaauaaguucacaucauguucuauauugcaaaacaauaguucccuauaaguguucauuuuaugauauugaucauuauaaaaucagguacauuguaaaggcuggguuaucaaauugcauugacuugacaugcuuuaagccaaaagguuuauuuuuaauuuugaaucuuucaaaggguaacuaugccuggcuguucuuugcagccuguuaauagaauuaauggaggcuugagaaaaaaaggccuaaugcuuucccugcuuuuuccugcuauaaauuuuaauauaaguugacugcugauugccuuucuaaaauguugcuauucuucuggugauugcaaagcaauuuauagguaaaagguacucaauaaaugcuaaggaauauuauguaugugugugugugcgugugugugcgugcacgcauuauguacauuaaguuuuagaaaugucaugaccuauagaacuucuauauuuuuaacagcauuuacaguaguuguugugaaacauucuguagcauuuuguuugguuauacaaaugcuauaaaacaagaauuuugcugcuuuuuuuuuaauauuagaagucuaucagcauuuguauuuuaaaaacaauuuucccagacauguugcuccauguuugugaacuccauccuuuuacauuaaauugaaauguguaaguaacaagugugagcaguagagacagcagcacaagcugauagaauugcaggcagggggucagugguuuaugaccacacagaucuuuuucuuguuuggguucuuuugugguuucuguuguuguuuugguuuuugaggcagugauuuacucuguaacccguagugaucugggacauguuauguggcccaggcuggccuugaccuuaugaucugucugccucaaccucccuaguauuggggcuacagguugguaccaccacacuuagaucagcaccuuuuaaaaccgcucauguauuauugauuuccucauacaggaaagacucauaauuuauuugacauuucuaucguauguuuuucaggaugaggaacaagaacagaucccugaguugccagauccaaacuuagagaugggcauuuugcccagagagauucggaaacugguagagcggagaaaacaagucaaacagcuaaugaaacagcaagauuuaaauccagaccuuguucuucagguacgucuuuucucugcaagguguuaggagacaguuucagcuucuaacacuugauuauugaggaguagaaugaauagaaugguguuggcaaguguaugugcuuauuuuauuuuggauaauauccauuccgaagugcuagacugcuugagaauggaaggauucucuagcuguaaaaucuuaguaagaucucacagaaucuugggaaauuagggaucugucugcuugcuucucggaggauaaggcaacagcaguaagugcccccccccccccccaccacgcaggauugaucgguucuccucacugugaucuaaaaggauauccaauguaauguuuaagcauuuacagguauuguauaucuuuugucuuuguugaccugcaguaugacauccgacagaaggcuuugaagcucacagcaaacaguauguaugguugccugggauuuucguacagcagauuuuaugcuaaaccacuggcugccuuggugacauacaaaggaagggagguaaauugcaaaauaaaauugccaucuguaaauauaugcuacaauaugggagagauaaguuuuuuuaccuaguuuuuacaguuucaaauauuucuucuuuagaguaaguuugagacaaauaggcauuugaauaagaauucacuugucaguccugccucuccccgucucucucucucucucucucucucucucucucucucucucucucucucucucucucucucucucccugugagaacacacacauguagucuuugaaugucuauaugccaggcuugcuguaagcaauaaagaaugugaaguauuauguacagcuuauauuugaccuagacuggugggggaacauaguuugggaaaacagcugaauaagaauaaaaaugccuaggauggggcuggaaagaugguucagugguuaagagcacugacugcucuucuggaggucccgaggucaauucccagcaaccacauaguggcucacaccaucugcaaugugaucugacgcccucuucuggugugucugaagacaaaacaacuacaguguacuuaaauacauuaaauaaauaaauaaaucuuuuaaaaaaaugccuaggaugguguuagaaguaaauguucuucauauaauuaaggugguguugaccuuaacugucuggaggcuagcuuaggcuuagauuggauuaguuaugcuaacauaauggagcuaauuuuuauguguuuaacugauaacuuuaauguguuauaugagagaaagguagaauuaggagaauagcuaauggaaccuuuuauuuuuacuaagggagaaaacagggaucaagaguuccaguuucuauguguugucuuugugguaacagauuucuaugcauuuucaacauguuuuugggcauaugaguucacaauucuagggccaugucauggcuggaguuauauauuuacauacuugaggaugauagaccaauuaccauuaaauacuaacacuuuaugaacauuuuaaguucaucuacuuuaaugcuuuguguagagguuuuuauuuuuauaaucuguaaagguaugguuauauuaaauauugaauucagucaaguacauuaagauacuguuuucuuuuagugaacuuaaugcuacuuaauuuuaagcauaguauacaguggugauauugauugucuggacucaucuuuagcaugcuggcuuauaggccaaaucuaaccuguucuguguuauauaacuaagguuuuauugaaguggagccaagcuucuucauuuauguuauagacuugaguagucaggauaaagucuuauguggccugcaaagccacacuuggcacuuucaggacaauguuggcuuuagcaacucuguccagcagaacuuuuaaagauagagaagcgauuuuuaucuauacuaucuauaugcaauagccucuugccacaaguggguggggaacgcuucauacuugguuauuaugaauagaugaggacuuugguuuuuagauuuauguaauuuuaauuaaaaugaauuuaaauuugaauggguaacguguagagugacuauuguauucaucaguauacaucuacuugugacaugaaacaaaugucaugauauuucaagucacuuuucuuuugcagccuuaucucagauauguggcuuaagacauagaaggguacuccauguauugaauaaagauggcauguuaagagcucuuuuaugcauuaucauaucaaaacuacacccgaguccuuuggcauguaguaguauucuguuuuguaaaugaagaagcuaagauucaaggagguaaaggauagugaagggcuaguuugaacugaaccuguaucuuucugauuguaaaucuuuuacugcauuaggcuucaccauuagagaauggcuuuugcaagugcaguuuugccuuauaaucuaucuuauuacuagaccccuuuucaacauaugacauggacccuauuuuuuuuuaaaaugacaaauguauagaugauuuuagaggcuagcugaaguaagaucagauucuuaggcuaaguuuaccucaaaauuauuuaaauuuuguuucuauauauauauauaucuccaguggguucugauagaauaccaucuuauuuuuguauuaggaaaugcacucacuaugccccaacugggugauaauacauagguugacuauugagauuggaucaagguuacucuuaaguuucuuacgagaggcaauaguugacaauuuacucccuuggagagugccucuugcuguugagaaaucccuguuguuacauuuucugcauuggcuuagaaauccacaagcuuaaaagggcaccguugauaaugauaagccccaaauuuguccaaugaucucuccuacuucccuaauccguuauauuuuaagggcaguguuuucuuuuggcuggauacuuaauacggaauugaaacccaauuuuuacuuuuuguugaucaacauguaacagaacuaagcuaaauuuuuagguuuuguuuuauaaaauauagugauaauauaucuuaaguaaaauauaaaaccuuuuuuuaguucauuaaaaagaauuucagacaaaucuagaauuaaucaugcgauuuacauucguaguuucugcauucccccuuuucuuuuucauguguuccuuuccauauacaauaccuucuacagaguuggaauuauaucuuuaaugugaaguuaaugagaaacaauaaguauauaguauaucugcuuucugcaacucuuacuuuggaagcuccaaagaucucuauagaaguuauuuacgaaaauaaaaauuauugguaauguuuuggugguaguauuacugacacuauucucugguuuuacuaucauuuuccuauauauuuuggagucuguuguuuuuaacgauuuucauuguguuuugagauaguguaugaccauauaccacaaguugaccuugaacccaagccccuuuaugugcucuaauugcaaauauacaccugucaagcauuuuuguuguuguuguuuugagauaggguuucucuguguagcucuggcuguccuggagcucacuguagaccaggcuggccucgaacucagagaucugccugccucugucucccaagugcugggauuaaaggcaugcaccccccacugcccagccucaagcacuuuuuaauuacuaaagagguaggaaagaugaaguugagaacuugcaauaccuuugcaacuuacugaacuguugcuuugcucguaagauaguuuagacaaaauaauacaguagccugaagaccuuaauaguuuuuugcaucuaaacuucccauuuaaauuaauguucaaguugaaaugagaaggaaaccuguugacaugacuuugagaaaauuauaagguuuuucauuuggauauggauaaauguacaauuuggggaggcaugaaauuuugcauuuugguaugaucuuaaagucuuccuccuuuuuuauuuuuaaguagauuuugugaguacuuaguugcuuaguuuuguugggaucaugcagauuugacucuggugaccuaaaaauuucuguaaguaaauguauuauggcuguuagaauacugaaguaauuacugauuguacucuuaaaaaucagauuuauaacaaaaguaaaaguaugucaaaugggaauaaauauugccuuuucacagaugugaucuuuuaauacuugauacuucaauuauuccauaauuuuaauugcuugaugauagaggcauuaguugcuguugaaggaaccucauguacgaaccucacaguauacaaauuauuucaaaauaauugagcauuuccagagaagaaauacagaaacuucuuuuauagacacuuuuagaagugaaucuguaacacuaccauuuguaauugcuuuuauuaccaaugucagccugaaggggcauaaaaaugaaauugggugagacuucuggguaacacugagugggcacaaauauuuagacuaugaagacaaguaucaaaugucaaguguaugguguaguaauugaagugauuguucacuagauggcgauagacacccuaagaucauuaaucaauuagagauuuuauucugugaacaauaaugugaaggccauuuagugacuuaaauauuuauauuuuagauuuuuaccaguuuugaaaauacuaaauaaagguuaaaaugguccaaaggauuguaauaaucuaauagaauuaguguuuuaguguuugaaaugauauauuuuuuugccuuguaaguuuuauugaugagaacagucauuuaauuuaucuuaguaagugaauucuuccauugaguggauaaaucauaucucugaucauggagauacauuauuuucuuaguuauaguaccacaggcaacucuaaagaaaauuguagaugauuguuuguaugugauuuugccucuuugaauaugauuuuuugaaauuugaggaauuuaacuuuuuaaaugauuucuaagcauauuugucauguaacauaauagugauaguuguccuuaugaaauaauuaguacuuacugaauuauuuauuuguuucugucuucucuuauuucuguguucuugaagaaacaauuuuugguuuggauuucugauugcaauuucaagugcacuguucaggaguggaccauguauuuucauuuuacuguccuguaggcuggagugagucauugccagccuguuugucuaccaguuguaggagaucugguuuucagaacugaauuuguuccuuuuagaaaaugcaucucaaucauuacaugcagccaucacuaucuaggcuuggcguucugagauuaccuugcuggugaaguagugcuagugaggaguccuugggaguggcacuggcagaaggcucuuguugcugucuaugauggaagaggagcuuuaaauuauuaaugauccuuuggcuuuacuuugaaauaaauggauauuucaguuuuccaauauuuuuaugaaauacagccuaguuuuguuuuaauuuaaaagaauaaaacauagaaauggcuagagacucuccucucaucccuuuucuuucaaugguaauuauccuguuaucuauuuuucuuccccccaccugucuuuuccauuuuauaauauacaaguauguauguguucauuuucauauuugcuauauuugaauguuuuuuaguauucaugugucaugcuaugcuuauucuuuuauaguuugaaaagaaacguugagacaaauuuuguucuguauaucacaauuuaaauacaucccuuugauacauuuuuagauuuuacuuauuuauguuaacuauucuauaacauuuuagugagugaauaugacugaguauauuuuuguucucccauuuccuucuccuuuuugauauuuuuucuuuauauugaaaauagcucccccccacauuauacauauguaguuccagaguacaguugccccucccuuuacucccaguuucuuccuacucccuuuuccaucaggauucccuguuucugucucucauuagaaaacaagcaagcuuuuagggcaauauaauauaauaugauaaaacaaaaaacuaacacagccaaauagaacaaaaugaauaaacagagggaagagagcacaggaaauggauauagucacaaagaccuuguuuacauacugaggagucuaaugaaaacacuaacguggaagcaaaggacaacuggaagguaaaaagagcagcgaagaagcuaaaagcucagaugugacauuaugagaccaggaaccuccaaagaugucacugaguuuauucacucuugauugucuauucuauguacuuuuccgcuuuguuccucuccacugugcuugcucagccccuuaaucuguaacuaacucuguaguccuacagauuguagcuugguuaacacugacacaacagcuacuauccucauggaaguggauguauauuguaucuguuugucugcgucuggguuaccuuauucaggauuuuuuuuuucuagcuccauccauuuacgugagaauuucuuccucuuuuuuuuuuuuaaauuauauaauggcugaguaauacuccauuguguaaauauaucauuuucuuuauccauucuuuuguugagggacaucuagauuauuuauaauuucuggcuauuaugaacagagcagcaaugagagaauggacaaccuugucuuucugauuuuaguggaaaugcuuugaguuucuagucauuuaaguugauguuggcuguagguuugcuguuaacuucuuuuauuauguugcauuguaucucuaaucucuccaaaacuuuuaucuuugaaagcauuggauuucuuaaaggcccccuccacauuuuugaguaggaucuuucauuguaggcuguacuuaugauucaaccuagacugacucucuucugccucugcuuuuuuguuauugggauuaaagguuugucaguauguuagcuuuaccauuauuuugaauugccauguucucauuuuaaaauuuuuuuucuauuaaaacagguuauacuagauaauguguuagauuuaauuuacuauauaacaaguuaguuucuucugucaaauagcucacuaaguucuuaucuuuggcaaguuacagauccagauaccaauuucaagauugauaccuaguuucuguugauaguuuccacucugaaacuugucuauuuuugaaggguuuuccauuuaccauguauuuguaaauauaauuaaauaauccuuauuacuuggguguuuguuuuguuuuuuucaaugguuuucucuguguagcccacagugcuucauauuuguuuuauuuuccugggcuaucuugaaauugcuacccucuuaccucagccucccaaaugcuagaauuauggacuuguaccaccauacuuggaucagaauuuuagaguaaaaaugcuuucauguugugauuuuaauucuucuuucuuuaauuaggaguugaaucaguuuucuuuccauauuuauuaagucauauacuauuuuuguugauugccuacauggacauacaugucuuauuuuauugcauugcaagucucuuucugucucauagguauuuaaaaacggaaucguuuuggguuauuuauauuaaaauagcauguuugaguuggcuuauucuugcaguuuuuucuuuuauguuccuucauugugaagaaaugucugcuuuuuacacuaaguauuugauauuuuucucucugucagccuaggcuuauucuaaaaauacguuuuuucucaaugagacauauuguucuacuuuauucuaaauauuguaaaacuuggcuuuucuuauuuaggucuuuaguauuucuggagauuucuuugaggagcaauaaacuuagugaucuaauuguauuugucuauuuguuucuuuguggaucuauugaacauguuucuuuauuccagggauuggcagacuauuacuuaugaucuauuuuuuuuuaaauaaaguuuuaaugcagcacggucauacuccuuugucuuugaccauauuuauaucaaacuuaggaguugaguaguuaccacaaaaccuaaacuauauaguauuuauuacuuugcagaaaaauuuugccaucuuuuguggcaaaagauaauuuuugugacuuauuccaagcauuaucaggcaugauugaaaauaugggaaguuauacuaaauguauuaaaaagaaaggaaaaauagucuuuuugucaugagaaauuauagauguugagguuuuacuauuugcuguauuaaccauaugaaaaccucuaaaguagagcaaaagguagguuugugaauucugaaguuucaaaaaaauauuuugugucuucauauauuuuuucaagaaagugauugcggaccauuuaagagaauuucaaagggggcuuugauauaaaaauaacaaaguacuguagguuuuuuuuuauuuguuucugcccucuuuaaauauagauagcuugaaguaaaacuuuagccuuaaacuguaugguuuuuuuucccuaaaauaugccagaguuaagcaucuucuuuuccagaucagauccauggaaacuauauuugauaggaagaauucuuacucugccuucagaauucugauagccacugagacucuuuuugacauucuuguuaauauuuuaacuuuuuuuaaaaaaaagauuuauuuauuuuguauauaugaguacacuguagcugucagacuccccagaagaaggcauccaaucucauuacagaugguugugagccaccauguggaugcuaggaauugaacucaggaccucuggacgaguagccagcucuuaaccacugagccaucucaccagucuccaguauuuuaacuuuuaauaagauuuauugguaauuuugugcuuguguuugugagccugugugccugcuuucacauaugcaugcacaaauguccacacaagcaagagucagcaguucuuccuggaguuauaggcaguugcaagucaucucacguggguacugggaagaaaacugagguccucuuuaagaacaguauccacucgcaacugcugagccaucuuuccaguccuuccuuuuauuuuuauuuugggacaaucuuaucuguaguacaugcuaaucugagauuugauauguaucucugguuuucuuaagaguuuaugauucuccagcucagccuucccaguguuaaguauuaacagguauucaguauuauaccuaguccuugaucuaaaaacaaaacaaaacaaaacaaaacaaaacaaaacaaaugagguuaauaagacuuuuuugagggcuaaaaugaugguuuauugcaauuuugcagauauaguucauguuagaaaaauuguaucuuuuaguugauuauagguuacucaucauguuugaauuccuuuacauuaugaaauucaaagccagagaaacuuuuuauuggcauauuugagggauguuugaguuugaaguuuuuugcaauuuccagaauugauaauauacacuauugggcuuuauuuguauucuacuaauucuaaauucagaauuugugguaauuuaugugaaaugagguguaagucuuauuagcauaaacuuaauaguuguuuuuagagucuagguucuuauguacaguuaaauuguauagaaauaauucccugccaucaaauaaguagcauuuuaacuacagauuauuuguauugauauauuguauuaaacaucuuggcuugcuuguccacuugguguguauccuuucuaaaaauuggugaaaauaaugcugcuaaauaucagguggagaagaugaagcucugccuuggaaaacaccccauaagaggcuaguccagaucauggcaacuuagauugugaauaauuggugagaaauguagugacaaaaaguuagauauuucugucuguaguuguagcucagugauuauaugucuauguuguauaugcaagacccuccguuuagucaccauaccuucaaaccaaaccaaaccagcguauauucauauaagcuuauuguuauaaacagcauacauuuguaaauauaggaggauaugaaggauauaguuuuuauguagucuagauauuuaagccuauuuugaguuuauuuuuuauuuuuuaaauuuuauuuauuuauuuauuuuuugguuuuucgagacaagguuucucuguguagcccuggcuguccuggaacucacuuuguagaccaggcuggccucgaacucagagauccaccugccuuugccugccgagugcugggauuaaaggcgugcgccaccacgcccggcuuuauuuuuuauuuuuuaaggcauuuuuauuagauauuuucuucauuuacauuucaaaagcuauccccaaagcccccuauauuucccucuccccgcccuucuccccaacccaccgacuccugcuuccuggcccuggcauuccccuguacuggggcauaugaucuucacaauacuaaggaccucuccucccauugauggccaacuaggccauccucugcuacauaugcaaauagagacacagcucugggggguacugguuaguucauauuuauuuuuaguuuauaauaauagccaggauacuuuuuacaagccuauauaucagucucugauacaacacaauauugcauuuauagaaauaaauauguuacacuuaggccuaauuggaaaugaucccuaugauuuaaaacaauagccaaaaacaaaaaaacaaagaucgagacuugauccaaaugcagcaugaucuucuuuuuucugguuaauaaaaguuaaauaucagucccuuuaagugagucauucauuuuaaagguacaaauuuaggagaucauaaaguuggauuuuauuagaggcacccgggaagauaaagacuggcucaagccuugacucaggcuaucuugugaaauagagcuggguuugugaguauaagaaaauaagagaaggcuucaucaaggaagcacuuaaguaccuucucuuauuucuuuugcaauuacuuaaguuuuucaugacugcuacauacuugucugaccugagccuugaagaguucaagugugaguccauaugccuauauauuugucagagagaggaucccucugccauugcuaccuggcuucauuauauuaaugcaugguccuagcauugucauugugggaugacgucuccaugcuuuugggaucauuugccagauaauuuucuuuuuuuuuuuuuaauuuauuuguuuuauguauaugaguacacuguagcugucuucagacacaccggaagaggguauuggauccagaucuuauuacagaugguugugagccaccaugugguugcugggauuugaacuucggaccuuuggaagaacagucgggugcucuuacccacugagccaucucaccagcccccgauaauuuucaaagauuuguuuauucucaguuucaacuugugcccuuuuccacuuauauauuggauuuucuauuauuaguuuucacuguacauguguuuguguccuacguauucccaugucucaugcagugaucuuuguuugcccucacucugaggucauguucaucuauguauuucugcaguuauaaauagguggauguggaggauacaguuuuuauguagucuagauauuuaaacuuauuuugaguuuauaagaauagccaggauacucuguacaagaaaauggguacuuuguacauuuguaggagguacaaauagaauauuuuugcuuugauauuuugcccuuugaauuacagaaaccauugggaauauggauaaggguaagagagaaauuguaucagauugacugucauuguaaccgaucucuaagauuaaguuucauuacauugacucaaaucacauagaccaugaccuuggaaaucuuuuccuuucuucuccaaccuucuuuagaaugaaugacucuguuaacguaaauucaucccauuuucugcauaugugaacauuuuauaucagccuauuuugguauauguuucuuuuuuacaagcuguguguuauuugacagguguucuaaagcucuuacuuuggcagcaaaccaagaugacagagcaguaaugauuucaaaagugcuauucccuacuuguuaaaagacaaaaagaaaagugugaaguuauuaacuauuguucaccaguaguguggaaagugguguaggguuuaauugucuguuucuauagucaguuuguacugguuauuuccugaguaauaccacuuuuaagggaagagggagcgacauacaacauuuaccucucuuauaccccucuuauuuuuacaaauuguaguuaauucaauuaaaguaaaaagauuuguaaaaauccaaagcuuugaccuuuucuucguuauaagcuuuucuuuccuuaucugucauaaaaaauuuauggaugacaugacaacacccaauaaccuugaggauuuuuccucccucacccccaaaugagucagaugccaggguguguuucaucuguaauguacaugaaggcauuauacuuuuucuuucagccacacaguauguuuauuacuaauuagaagaaccuauuuuuuggugucuggugacguuaacugcuuuucacaacaguauaaucaggcccacuaaaggaaccuccauguuaaguuuauugugcuuauaauucaggacuggucgacugagcagacacuaauuucacugggcacuaugagccuuguguuguuuugucagaucaugaauagucuguuaaauuacagugaacugagcuugguaaguugggacuucuagaaagcaaugauaauaguauauuuguaugugucucucucucucucucucucucucucucucuguguguguguguguguguguguguguguguguguauguguguuuguagugguuugauuuuaacccagagauuccugggcccuuuauagucauuuuuuuuugagaucuuauacuuugaaauuuagugcuagcauugaauuguacagcuguccuuguuuccuuuuuauuacuuuuugugauugaauuggcuuguauccucuuuaaaguugaauguauuagagucucaaaaucuaaaauuguccuuugacagucuccccccuuugacaaagcaauaugaaguagacuauaacaggaaaguaaaucccuguucauauuuuuaaaagaacaguaaagcacaagugauuucuagaaauggcuuuuuugccaucuuuggaauucucacuacugguguguguguguaugucauacacacacacacacacaugaguuaguaauuaccuauuuuuauuggcuuuuuuuuaacaguuaaaauaagguuugucuuuugaguuuagugauggaauuuauuugccuuaaggcuaaauguugacuggggaugggaauggaacaaagauauugacuuucuuucauagguugaagucucagacauuugucuauauuuauuucaggggccuuugcccugccaacauagaaguagcuacauuucaguguaggagggugguguguuuuccccuggaagaggguaauaguuggggagaggaauaugcacauaggcuauuaauaaugcacauuguucauauuucuaagcacugcuccucacuguagguuacauguucuauuucuacugcauuuuguugcaugauacaauagauagcugguaauuucaucgcagaaaaaaaucuugguauuuguucuucagugguguucugguugacaaaacaaaauaacuuguuuucagaaggggaacuuaggguggauauacuuaauucaguugcaaauucuugaaguaauauuugcugaauauguaccaugggggaaauagagauaaaugacauuguuuaugaccuacaggcaugggaugaaaauucauuaaaacuagagcaaauguuugggaggcuagacacaugauuauuuacuaauaaagaagaagaugaucuuguuuauuuguguagacacaaaaauccaaacagaaaugcauucaagaaagcauauggaauagacaucuacgauacucaaucuuuuacaugguguggcuuugaucaggugauucagucucuugucagugagugauagguuagaugaucauuucauaguagguugcauguacaaaguauuuuaucuuaguguacuucauuguccuguguagacuggugcugguguuggagagacauugguaaguuuuaaguauucaagaucuuguccucaggaaguuuuuuguuauggugggugagagccaucaaucaguuggucaaaugaacaucuaucccacacugaagaaaauacaugcaaagaaaaggaacauaaauucugauagcaauggcucuuaacauggaaagaaaaauuagaagaauccugaguccagggcacuugagcugagagcuacuaggguguuggucaaagugcacacacaugcaugcaggcaaaacacucauaucuauaaaauaaaaaauaaucuuaaaaagauuggaagaagggaaacugauugguaggcuauuauaagaauauucuaugcaagauacauuaguaacugcacuugugugagaacaaucagaugggacgugguggggggagaaaaauauaugagguagguaaaagaaaaacaaugaaguacaaagaguacaaaaugaaguucaggucuuuuuuggggcaaccaugugaaugagacuucauugguauagccaaccucucugacauuucuaugugacagucuugcaacaaccuuuccauucuucuuagacucuuuuguaauggucucugagccuuaagcacagaaauuguguuguagauauaucaguugaagcugaguaccacaaaaugucuuguuuucggcauuuuggauuguggucucuguugcaaagagaagcaucuuugaggauauauaugugacaaacaaaagagaggcuacaaauuugaggagcaagggaauacuaggggcgggggaagaaauggaaguagagaaaugauguuaauuguaauuucagaaacuaaaaauuauagauuucaaaggcaugaugaauuagauguauaguguaggguagaacagaauauuaaggucagcuucugguuuucuguagguaaauugguggggccuuucaauaaaguauuggaagaugaccaaauuugggacaaggacaaagaacagugaacaauuugaucuuggacauguuaauuuuuaagaaauauuguuaauuuuaauuguacauauuuaugaaguacaguauauuucaguuuauguauauaaugauccggacaggacuguuggcauucucuauuauugacaauauuuaucauuuguuugcauugaggacauugaaaauccucuauuacauaguuuggaacauuaguuaauucuugucaacauaguuaccauaugugcuauggaauguuagaauucuucuuaaccaacugcacucuguaauggauauguuaauuuuauaguguguggauauacauuugagaguuaauguaaagagaaauaauggcugaaauuauuuucagaggagaaaauacaaagaguaguagguguaggacucaguccaaagggucugcaucuugaugcugguagaggcgggaggucuuagaauuaaggaguguucaauguaggaagagguaguauuauuucauggagguagauaguggucauuugucacaaaaaaagcaacaaugauugcuuugaaauuuuccaucauauuagggacuaggaggugaucgauaucuucuguucgugguuugcuuugaugggagccaugacaaugaagcugaauugcuguauaaagaaauuagaaguuuugggcuuauacccgagaaguuaagagugagggaaaguaaauuguggagcaaguuaacugauuuaccuccuacucuuuuuuaagucagugccuucucugcccugccucugauucuuccuggggugguucagaacuacugauggacuauuuaacuucucggagucccagcuucccuuuuuaauaaggaugucuuagugcccagugagguuguugaagaauuaaaugagguaauaucuuagaguuuuauuacugugauaaaaacaccaugagcacaagcaguuuggggaagaaaggguuuguuucaacuuauaguucuaguccauuaugagggaagccaggccaggaaccuggaggcaggaacaguaggagaggcuauggaggaauagccuuccuugcuugacuccucuuggcuuguucagcuugcuuuuguagacaacccacccauagucagcugauugcccccacauuaucagucaagaaaauaacacagacuugucugugggccaaucugggagggguauuuucucaguugagggucccuuaauccuguuaugucuuuguuugugucaaguugacaaacacaaacuagcacagguaauauuuguugauaccuucuuaaaauauuaauguguuaauaauuguuaauaauacuauguuagucauucauacauaguucuaaguaaguguuugcuagauaauaaauaucuuuauuauuauuauuauuauuuuagacaggcucucccuauguaggcucucccuauguaggcaugauuggucuggaacuuacuauguagagcagcuagcuaggccucugucuccuaagcucuuauagaacucugccugccucugucucccaagugcugggauuagauaauuaacuccuuuuauggucauaucugaccucacuacuuuuaccuccaacuacauauuucuuucuucugaacacuuaaccaucugcucuaaaaaggccacuuuguguuguuacuugcuaaauuauuuuacaauucuguuuucccugccaucucuuguguuuuuaguaccuacaccacuaguagucuaccaacaccacuaauuuuuauguagucucuuuaauauucuccaaaauucacuuuacaugauugauuuaaccuaaucuuccuuagucauuuaaugccuucaguuugaauuuauacuaauucacucacucuuaccaguuuaucaguuuguucauucaauuuuguuaaaucaguuuuaaaaaugcauuuaaaauauccaucgguaagccaggcagugguggugcacuccuuuugucauagcacuugggaggcagggcagaaggaucucugaacuuugaggccaguuugcucugcagaauaaguucagaacagucaaggcuacacagagaaacccugccuuguaaaaccaaaagaaaaaaaagccguuagauuaguagcauguaguaaaauguuuuauaguaguauacuggcugguuuugugugucaauuugacacaggcuggaguuaucacagagaaacgagcuucaguuggggaaaugccuccaugagguccagcuguggggcauuuucucaauuagugaucaagggggaaaggccccuuguggguggugccaucucugggcugguagucuugguucuauaagagagcaggcugagcaagccaggggaggcaagccaguaaagaucaucccuccauggccucugcaucagcuccugcucccugaccugcuugaguuccaguccugacuuccuuggugaugaacagcaguauggaaguauaagcugaauaaacccuuuccuccucaacuugcuucuuggucaugauguuugugcaggaauagaaacccugacuaagacaaguaguauguacagaauggcaagcacuaaguauuuuuagauccacaaauaguuuuuucuuacugcuuccuuaucccaagugcaaguaagauauucagaucaucugauuucuuuguuggucagucuacagucuuuucauuacugaagccuccugguacugucucucuucuuuucuuggacccuucaauccagucucaacacagcaauguugaaccauuuuuaaaucguacuuggaccuucaaguuuccaguagauucucguuuuaggucauagugaccuaugaccacgguccucugugauuugcuucaccucccuuuuugugcugcauagcugaugaccugccugucucacccacacuccagcuucguccacccaccuggagcacucacucuucuugcauuuuguuacauguucuguuuccacauagauccucuguguaacugauuccuucugccuagaaagcuccuccuguuuugaugcagaguggccauuaucuucuucaggucuuaccuuuaggucucccuuuuuugaugaauuccuugacuacugauuuugauagauccaccuaacuaauacccaucuaguuuuaaaaaacuaagugguuaucuuuucaacuuaguuuugaaauuaaauuauuuuuauguguauagguguuuucuuugcauguguaucuauguaccauguguguaccuggugacugcagagaccagaagagggugcuggauccccugggacugaagucacagagaguugagagcuguuaugugggugcagggaaucaaacuggguccucuugauuagaaaccagugcucuuaauucugaccuuccagcuccaucuucaacuauuuucauaaggaauuaaauacauagucauguucuagaauuaauacauguuaauauuuuccauaacugguuuauauauccuuuuaaauaagauccuagguccuuguugucuucuguauucuguuuucuagcaucuuuccuucuugaggacacuuacuauuaugguauuaauaaugguauaauugguauggugucauuugacuuggaacuggcauauucauuuauguauuuuaaaauauuaccuuguugcuacauauagauugauuauucaucugaacugcccuauagauauacaucuugugaauguuuuguagucuauuuuucuaucucuaccagucauucagguugugguuaguuuuccacuauuagggaaguaacauuccuguacuuguucuuugugugccagugugggaguuucucuauugugaucauugcucuucuucagcauccugcuuuauuccuauuuugucaucacugacugauuuguuuuuguucaucuuucuuuuacuagaaagagugccacugggcugggcaguguguuuuacucaauucuuccccacacaucaucuagcacaaaccuuccacucaguuugucauuuguuggcauuucuuuuaguugauucuacuuccuucuuucuguguguuuuguauuaguucauucccuuuuguuuuugaacuuugguuuucagguugcugaagaaagguggcauaaguugucaggucuuaugguuagugggcacaggugacuaagucugguauggaaaggagcucaagacaaaaaaaaaaaaagaaaugcuuuguuuuggauuaggcuccuuuguagcucugauuauagauugaaggauggcaaggacuaacugugcuaaugaaagaagcugaguuguuuaguucuggucucuccacaccuauagcagcauuacugaauauuacagaauuuuagggguggaggauugaaugcuuauugucuaaaaauuacuuuucuugaaaauuaggaaauaauuacuuagugauuggcuuuugcuuuuggaguaaaacuuuugguagucauagaagacaaauugucaacuagacaugagaggaaaucugcugauuuuugaaacagguuggcuuacaucaauuaguauuuuaaaauucuagcucagaguuucccgauaaauauucuuugguuucugggucuucuucgacacuuuuagauauuacuguuuuuuacuauuauagauguggcuaaggagcccaggguaccucaaagucaugaucuucuuuucucaaccucuuaagugcugaguauaugccacuacacuugaugucacuguccucauguuugccuguuugaugcuuucaaaagacuaauagcaagaaacuucuucacauuaauguuguuguuauaaucauacuuuggaccucuuuuucaguacagacuaucucauucuucuaggacuguaagccuuuugcuacuaauucuaaucacuguaaauuaucugcagauauauauuagcagggaaaaauagagcaauagucaggucuuaugcuagcaccuuguagcugguucuuucucauuuugggauguaaguaauuauuccccucaccucagugugacccuugacuuaaauuuugugacaguuaugauaaauuuauuaagagaauuaagaucugaucucaaccuccauauguaacugguaaauauuuagacauacugcuaaauuauuaauaacuaagauaucuucagcauuugaacauuaucugauaccauucugaguucuuuucacuagcaauaaaacuuuacuaaaacaaauaaguguagucuagagccccuucucuauuugcauaaaauguagacgucauucugagauuuaggaaaauaguuucuuuaaaugcauuuuauauuugcugaagguuguggagaugggauggggaagaaaauguuuucauuuauuaaguuaauaaaauuguauagaacugggaaaaucugucuggcuauaggcuauuucuuuccuacuguccugccuguucuucaccuaucccuuugaugaaaucauuauuuuguuuuucuaaauaggggugaaugacuauaggaaccaguucuuaacuguuguguugcaucugaauuugauuaugagacaauuuaguaugggauuuugugcugcuaacacgguuucauuguuuuaucaucauuuuaguugguuuacuauugagagauggaguccaugggcaugugcccuggugccccuguggaggucugcugggaccaaacucagcucgucaggcucgcacagcacagcucuugguuuauuuauuuuacuuguugaguugucuuccugacccugaccaugcuuuaaagaggaagaaacugaaguacagaagguugugagugcucagugucauguuuaaagccccaggauuaguggaugcaguugguccauuuuuuaacugccacaauaaauaauugcuugugcuuucuuggaguucuucuaucuauggcagagguauuagaaaguagaaagaaauagugucauauugucccagugcucacagccauuuuuuuauuugaaaggugugaguggcgcuagcauguguuaugugguuauuuacuguuacuugguugauuguuuuuauuuccuuaguccugccaccaauuguuagaaaaacagaagggccguaaugaaugaggccuuggaauggaauuucgccuuuuaaaauauauguauauucauucauucauucauucauucauuuauuugaaacaggguuucuuuguguaguccuggcugucuuggaacuugcucuguagaccaggcuggcuuugaacucagaaaucaacaucccucugccucaugugccaucacugccuggccuuggaaggaaauucuuauaggaagaauauugggaaagguuguaaagaugagaagauuaggaaagccaaggaaugcuuccuucugucacauuaugucuuaggaguuaaaugucgucauugacauccacuccuagaaucuuuuuuuuguuuuguuuuguuuuuugagacuggguuucucuguauagccuuggcuguccuggaacucacucuguagaccaggcuggccuagaacucagaaauccgccugccucugccucccaaguagugggauuaaaggcgugcgccaucacugcccagccacuccuggaaucuugaacauguguuuguguagcuugucuguggcacucuuuaccugguauaauugugaaggucauaguuuguucgccuuuagcagaauaaacaaauagauccagaaaauauauucauguaaucuuugcuugaugagcagaagcaaggaguuguuuaaaacaaaugaaggagauaaaaacucccuaacuuuuauuuaccaaucagauugcaaaggaaaaaauagccuauuuuuagacuaagacuccaauuaugcuaagucuugaagauaauuaaacagucugacacaaaagaaugcagugacgcaaguuuguguggugaaauuccaagacacucacugacucuuuaggauucuacacagugaauauuaaccuccuaaaguguuuguugcccggaaacagugcuuucuucuuuuacaugcaguguaaugaaguguaccuguguggguaauuuguuucuugcauggaaaggggggaauuaguacacaucaucuaucccucuguccuaucuuuggucucuuuauguguugaagcuaccaagccaugcuuucuuguuaauaggcucuguugccuucccaucuuugcuauucuaauuguuuuuaaugcucagcacaguaggaguuccaggguuuuuuuccaauuaguuuuauguuauaaauuuggcagaauuuagagacuuucuuuucuguuacuguuucuuuaccuuguguaagauucaugcuuagcuuuucuuauucuuacgcaugccaagugacaugauuucuuggaacuaauuaguuuggggguggggggcuaagugaaauguguuguggcagcagaguugcuugacuggguuaguaagagguggccuguuuguucuccaggcuucuuguugccuuugcacuuguagauuuggcgaugggcugcugguguuuucaccauucugccugcgauugaauacucacugaauggaaguauacagcuuccuucuaggaacaagucuucuuacuuccugaguucuguucuaccuacgucuuaagaaauaauguaaucaggagcuugaccaucuuccaauucauuucagguuuucuuuucuuucuuucuuuuuuuuuaaagcauuuaaugcaauaaggcgaaaagaaagaccuuugacucuuuuaagagugaaaguugcaagccuggcauuggugguuuaugauaggauuugaagugagacgggaaggagauggaaaggaaagaaaacuugacuuuuugauuagauauaagcugaagugcuuuggugugaccuauggaaauacauaagcuaaacuauaagacuaaucaggugauuggcaaagguaggcuaguuggaugaaguagaggguaggaaguuucuggcugggagcccacuagccacauagagaacuuacucaauuucauuuaaucccccgcaacccuguggguaggggauauuaucccauuuuacaaaugagguuaaagucucaaagggauuaaguaaauugccaaggucucuuuauuuugagcagcuaaaaugaacauggcuucucacaucuguaccacccuucugaaauauaggaaacauagacaucaauauuugcuuucuuuaacuacuugguaacuaucuugguaacuacuuuaugaugcagucacugaaaaggcuagaacagauuuuuuguuacugcauaucaguagaaaaacuucauuuuuuuuguuaaaaaaaaagguuuuauuggccaaauucacuucaguccuguuguuugugugugcuagauuuaguauugagucuuuggggauuuaguuuuauagcugguaaucuaaauuuaugacaguauuuuguuuggguuuugauaauugaaaaaaaaucuugauucuauagcugugaccuuuguuagccacaccucucuuagaaagguagagggaguucuaauuugaccccagucacuaauucaugagguaacugauuacuaagcauucccauagcacaguucucuuuauguaacucacacuuucgagcagggguucuuaaugcugugacccuuuaauacaguucuuuauguuguggugacuccaccuauaagauuauuguuguugcuacuucauaucuguaauuuugcuauuguuauaaauuguaauguuuaaguauaugagaaugcaaccucugaaaggauccuucaaccuauaaagggguugagaacaacugcccaaggguaguuugcugugggacaaccgaacuugaaaucuuccuguggucaacucauacuaauccuuuggauggggaaguuucuuuuuccuuuuuuuuuuuuuuuuuuuugauaaaagguugccaucuucuuaccacagcaauaaugaaaagcauaacuagauugucaaguucacaucaaaguucauguaggggaaacuauuucaaggguuaggguuauuguacaaaguccaucucccuauguauuaauguguuauguaucaugcuacagugcucaaugcugccgugguaccugaugugaugccugacguuugguauaaaggucucuucaucuaugaagacacuaugauuaugaaauggccauagguaaucccugagggauucugcaucauaaacguucugagauuuuucauacuuaaaaaccacuccacuuaccaggguaacucagaacuuuuugaucacauugagauggaaauugaggagggggccaucaagaaauagucuguguuucauaguaucaguuuccuaauaaacgggcaagcagcacuuagauauuguguuuggcuuuagcuccuuguacaauaaauggugacaaacauuucagugucuuuuccuagagcacaaauagcaggaucaaucauaauuuucccuuugggaugccaguuauauaaccaugucagauuuuuuuuuucuggaaggguuucccucuggaagacugaauauagaaaauguugauucuagggcuggagagauggcucagaggauaagauugcucuuccagagguucugaguuaauucccagcaaccuaaugggauccagugcccucuucuggugugucugaagauggugacaguauacucauacacaaucuuaaaaaaaaaguugauuguguuuucuaaaagggggccagaggagaagugucagcagcaacgcagucaugcagcauuuuacagcauucaccaaggaucacuauuacuuuaccuaaagcaaaauggucuuaauuguuuuuaaccuuuucaguuuaauauuaguuuggauuccaugaaacuauauuuuaaaaggccaaaguaauugaauauuaguagcucuuggugauucaucaccauagcuuuuauuuucuauggccacagcauuaauauauguucauuguggcacacuuagaaaauauagaaaaaagagaaauaauauuuacucuuaaucaaaaaguuaauuuuuauucuccuguauuugucuguuuacacauacgugcuuacauguaugcuuaccagaauuuuuuucuauguguguacguauccacacacguuuaccagaauguuuguuaagcaauuuacuuagauuguagcucauguuuguagauuuuucuggcuauuuaaauuaaaucaagcaguuccuuauaauuaguaacuuaacaaaauuaaauuuuaacauuaugauuuuuuguuuugguuuugguuuuuuccagacagguuuucucuguauagcccuggcuguccuagaacucacucuguagaccaggcuggccuugaacucagaaauucaccuuccucuaccucccaagugcugggaugagaggugugcgccaccacugcauggcaacauuaggauuuuguuuuauuggguaaauguuguauaauuuauucagacaccuuuuugaggacaugagucuugguuuucauuguugcugauuuucuugaguuguguuguuaaaagugguauuuuuggguuaaagcaugugaagucuuuaaaauauucuuuaaaauuucuugccaugggauuucuacuuuuuucagaaguauguaaccauacuauaacauuaccacaacugucacuuuuaagagaaacaauaaaaguaggaccagccaauuuugcuuuucuaccuuugauaaauuugguaaacagaucauauaauuugauuuuuguuaagugaccugaaagaguuucucauagaguccauaugguuuggcaagaccaaugugaacugaaugcagguagaguuggggguaucuaauuuacauagcaaccaugcccugaaaaguuuuauuagagauugucaauuucgaggguugccuauauuaugauguggugagauucuuugacccuguuuagcaauuucuucuagaugcagcagaaaguaaaagagcgauaguuauuauuucuuuucuacuagacugggcuucuuugaacauaagaacauuccuuuggagggcauacuauugucugucaucuguauagacaggggcaaaguuauuuaauuauucuguauuaauuuucuuggcaauacaauuaguguuaacagcacacaugcauuguguuuccugggagagauuaaguuauuaaaugugaagcacugauaagaguuacugugaauguaauucaugacccuuaguaagugaucaguaaagguuagcugcuauuguuaauuuuucucuuagaugguaauuuaaugaaugagugaaucaaagacuuuuuggagucagguuggaugagcucauacugcaaaugaaauguaacaggcaagccucucaucuuuuuuuuuuuuuuuuuuuuauaguauuagaccuguucuauaaagaaagcacugguguuuccauuguguagcucuggaaagcagagcuguguuuauccuauaggaauggacaagaagggacuuucuaccaauugagcccagucaguaguagaguugcaguagucguggaacuucaaguagaaucuuggacaucauuguaauugaauaagagacaaaaagaggccucuaacuaggccuuauacugaaugaccucuaaauuuccuuucaagucuagagugguuuagugauucuaaguggaguaugcaggauuaucaugaaacaugcaguuaggccauaugagugcaucuuuggaagaguugcugcugcuaauccuugccuaucccggaguugccugcuucaguuucuuucaccuguugugugucagccugacaucagcccauuccucagcgugguucaauccuauagccuagcuuguugucccaggcugaucauuccucaguggcaugugucuaggugaugguuugaaaugagugugcauuuuuuucuucauaaaucuaucagaaaauagaagauuguuaucagcaaagcauguuucaacugguuuuuaaggaaacucacacaaguuuugucuauguugaauaugacucauauuuuauccaggacugagaaaggacuuuaacuuuugcucuugaguucuggguguucagugucugcuguuucucuagguuuaccaucacugcucugaauuucugugaaggaagagugaaguccacacuauuauacauacuguguggucuuaaauacauggaauugagaugacuuucuguccugauaaauuguaauugcccuucagcuacugaaaaguagcuucauaacagugagguggcaaagcuuaauugggcgccuaauccuuucuuucuuaagguuuuuuuccuugcugaguaauucugacauguuguuuugugcugcacuucucauguacaguauuuggaacauuggcucuuugccacacuugucaaggguuuaugggaauuaaugacauauauaaaauucuuugagauuauuucaugaaguugguauuaucuucaaaacaagagguuuaauuuaaguguguguuagauaucuagugggauuuuaagcugauguaaucauaccaugucuguuauuuaacauguuugaugcuaugugcacauuuuuacuuaaucaaauaaauuuuaagugaaguggauuuccauccuuuaauuuuuuuguuuauaaaacccauuauuagaggucacuuuggaaaaaaaaauuaaguuuuugaagaaaauucuccaguccaucuuuuuaauguuaaaguuuaucucuaguuguguuguuuggugauuaauaguugaagugaagaacuggccuuucugcauuuuuuuuuuacugugaccagucugucuauagcuuacuauccagcuuaguauauaugcacuaacugaagucugcuguacagugagcagccuaaaaaguuacugauuugugagccaggcagguuaauguuucaaagaaaccaucucuagaccagguggguguaguaaguuucagacaaaguaccugugggauuuuacaguggcuguuauugcaaucauaguaguuuuauuccuuuuaaguaguaguauuuuuuuuucagccagaauguagaucauacugguaaaucuugggaaucauuugaaauauugauacacacaagcacuguggugaaggcugauacuuucaaggcuagaauuguuauacuuguauuuugagcuaguguguuaagccuagugccuuaagaaggcuuuguauccccuuuaaucuucaaacguuauaagaccaacagcuuuguagucuucaauaggauuguaauagaaccucaaguucuggaacauaaaaguccuagaguggaacauaucuguguuuauucuuguccuugugcucuauuaacugcacaauacaaaagucagcaaaaauaaucauuuauauaacagacauggaugauauauauguaguuugcauuucuaggauuugaacccaggucccugaauaugcuauguaagaauucuacgauucaauuacauuccuaucagugaaagauauuuuaauagauuacuaaauauuagguguguagaaccuuguaagcagaaagaaccuuguaaucugacuuucucacuuuacauagucuuuaggauccgauugacccagaaucacaacugcuauaaaauuaaacccaggagucuucuuuccagagggagagcugauuggaugucaccauucugguagcugcuccaaacaccacuguaguaauuagaaaguacugguucauuauagaauaugacuacuuguaaaacaauguggcuggcucuauaagucuaaacagguuuuaccauuugauuuaaauaacuuaucuacuccaaccauagucuucaaaaagucugagcagauuuuuuuuugucuaccuuuuacccaguuaacagaaugcuuacucucuuauugccacuuaaaagucaucuggaagacucaugcugcuaauguaaugcacagugaagggaggggguaaaguaggaaaacauaauuauugcaugcacaguuauuuuaaaggcucuuuucucuucucuccucuaucuuuucucaaccuuaguuggguggaucugguuuguauaguuuucccuuucuucuuuuccuaaauuggcugagagcuaaaaaaaauuguucaagaaaaaagccuguaaaguauaggaaagcaugugaaaagagaguaguuuauguccuuugcaaccgugguauagaucuguggauagucuggcgcuuacagaacuguacuuaaagguuuucuguaauauagaguggggacagaguucgauuugauuuugaugacuguuaaauaacuucccgagaaugauugugacaagaaugugggaccucauuuucugauaaagugcugguuuauucucacuuuuuuuuuuuacaugauuacuucuuauucucucaaguguuuaugacauuuaauaaauuuacaguugagaauugugucaacugguaguaugagagagaaaugggauccuggaaccuacuuaaauacaaacaacaggaaacuuaaaccaggaacagugugauuuuaaagugagugaguaugaucuagagcuaagaagacaggcucacacugugaacuguguucucuuuagucuuuuuguuuguuuguuuguuuguuuuuaaaccggaauugcuuuuccuuuaaauuuagacaagucuuguuuaaucuguggaaaucgauuaugucagucacugauagacaguacaauuuggugguugacacagguggcuuuuucaaccacuuuucuuuuauugaauccuaagcuugcuugagacauauuuuaaaauuagcacuucccauagacuguugugucacacaguuguuguuuucucuuugaauucagcuaaauuagucaucuuuuguaauacaugaaaugaaauuuaagguuuggucagaaaaaaacuuucccacuuucuuuacuguauguguguuuaggaaauauuuuauuuacugggaugauaucugaauacauuugaucagaguaaaauaguuuggacaacuauuugguaugugugacuaaaaacuacuuaaaaucugggguaagggaguuuuuguaaguuuuaauauuuagcauucugucugugucguguucuuaagacaaugggaaagaaucacugauuaagugaauguuuucaaggaauaagcuuuuuacuucuuuuuguugcuuuuaaaauauccuuuuuauuauaguaagaauauaacaaaaucugcaaucauauccuuacauaguauuauaaauuauguucauguuuuaaaauggaucucaaauauuuucauuuuauuaaacaaucuguguacuuauuacauagcacuuuuuuuuaccuaguccuucauucuuuuuucugacucugauuuugacuacuuuagaucccucauauaaguggaaucaguauuguguccuaagugugugucugaccucacuuaguagaccaagcuucaucucuuuuguagauaggauaggauaguuucauuugaaagcugaauaguauucuguuguauaccacauuuuauccacucauccauuaauugacaguuaaauuuuccccaucuuuggugcucuccaguauugugauuuuuuuuaaaauuuuaauuuuaauuuuuuuggggaaacaaauuuuguaaauuuuagaauuaagcacaaacuaucacauauauuuguauauacagauauagauguagcuaaguuugauagugcacaagggcauguguguguguguguguguguguguguguauauauauauauauauauauauauauauacauauauacauaugcauauauguacauaugcauauauauaaaauacucacaauuuugaagacugaaauguuuaccuaucuuaaauuuugaaggaccuuuugcuuuuuuagucuucguuguccuuccugccuuccuucuuuccuucuuuccuucuuuccuucuuuccuucuuuccuucuuuccuuccuuccuuccuuccuuccuuccuuccuuccuuccuuccuuccucacauuccuuccuccccgccucucauuuucuuucuuucuuguucuuuuuuucuuuuacgagacagaguuucucuuuguaauaaccaugauuguccuggacuugcauguagaccaagcugaccucaaacucacagagauccuccugccucugccucccaagugcuggguuuaauggcaugcaccauuacucccggcuugcuuuucuuaauuguauaaaaaaauagaacugcuucugacuuuugagguaaaaucauuaaacuuccacauuuaucagguggggaaacaguaucuuuucacaugaagaggaaaagcuagggcugugaugaaugauaauaauagcucacacggacauagcacuuaccauggguugggcaugguucugcaggguauguauaguauuuagcuccugagaacauaccugguaacugccuaaugcuguaccuauuuugugauaaagaaacuaaggcuauauaacauacccuaaaauacauuaguggcucuaggauuugaacccaucaauuuuugcuucaaagucugucucuguacucuacuaauuuugacagauguaauucucaccuuuuuuuuuaaggcagaaaaguugaguauccaacauucuauauaauggauaucauuuuaucuuucuuuuuguuguuguuguuggcaaaauauuuuauugcugccauccuuauugguagaacacugggggcugaggguucauauuggaccgggggggugugugucacagcaucuucuggaacaggacaauggccucaucuaccuuccugagcucugccucugucuguugcaacuucgcuucaucugcuuccuggaccucaaggggcaccuuugcuuaguagccagaggcaguauggcgcuccugcagccacugagccugucacugugccucaccuugcuuggccuguaacuugcucaacugcugggcugggucaacuugccccugcagcuacagagggauggagcagugaucugaagccacagcacagcccuguggugcaggagcacccagggccaggacaguuaucacacuuggacuggccagagccugcacguagccagacacuguggaggccaaggcaccuauggucucaucagcuacuuccaaaaaagucagaccuggucugggucaggugggcaagggaugcacagcuugaaugaugcucagugcuagcucaagagcagcuucagcuuccaggagcacuccgagggcucuggauaagggggugacacagaggcuagcaggagauuuucauaucugcuaggcagccucuggaauagcuccuccgugauaaagggcaugacauccaggcagguguagaaggucugcugagcacauucugccgccaccugguccacaguauucagcacgaguuuuaggcacuccaaauagacaucacagaggucauagagccaaaagcuguacugggcaguggugauggcuggaaaguuguaagccuggaagccuucauugcugagccucuuggccucagucagccugcugcggaucaagugguccaccagguucucaugccuuucaggcuuggagauuggugaaggcaaaaagcccuucccaaggcugugcagggcaaacuugguggcauuccagaguuuguugcaaaagugacggcaccccauccagauuguugucucgaccucgggaaucccugcuggaauggcccucuguccauuggcuuucuccacuucacugggauccagguugcuguucaguagucggucauggaggcccugcaaggaaacuccguggaugucauccagggguucaaugacacugccaagagacuugcucauauuccugccaugagcaucacacauguuugcauggggauagaccucucugaagggcagcuuccuggugagcuucaggcugaccaugaccaucugggucacccaggagaagaggauaucauggcccgucucaagcagagucccaggguagaacacacugaggucuucugacugauugggucagccaaagauggagaacggaaagagaccggaugagaagcagguguccaacacauccucaucuugcugaagacugaucuugucaggggacacuccaaacucccgugcugucuucucuugggccucugcuucagugcaucccuuuacccaguacugcccaucagggucuuccccaggggguacuucugggucauggauagguaauaaaguaggcagggauucaguggccccaccacagcugcugacagaugcaccacucucagauauuguccauccaagaaugccacaguugaugggccucaggcagcauauggagguccccguggaucguuuuuccacagugcacauaccaccguggccugagcagaggcuccaccacauccuuggaaugguugcaaaguggcaauaccaugagguuguccuugacgccacagaacaggcccugcuccuucagugccaccagcacagccuuccuggccucaaaccugggcaggcccaggaaaggugggggcauguugacaaggggccccuuugaguacuugaugcuaauggccucaagccuauggugcugcccaaccucagucauucuugucaugggccagguugaucuucauagcaccuaugccagacuccaugucuacaaaguuauugaagacaauggcaaggcucugggacaagaacggauugacaacacacuuucccuuuaagugcugguaucuggaaucuuuggggcauacagcuacagccacaucucccagccucaauccuaguuguugccaccaccaccaccucauuguugucugagccuuagaccugagaaaggacauggggacccuaaauucuaccuucuccuaguagccaggcacagagagcagggugcggccucucagcucuuuuuuauccacccaaaugucagaaauggcagaguugagggugcaggaucaguugaccaggugggugcagugguagaugaccccuucuucauggagccuaacaaaugccuccauuacaguugcugccaguuuaggaucuaugaugaagcaggcucaaucccagaccaaggagcugccaaguuuauuuaaauggugguaaauucugucacucugcuccucuuuccacuuccagaccuccugaagaaaggccuccauguugacauaacugacccauuguuggaccagggcagcugcccagcugccccuggggucacccaggccuccuggccacagcagcugagcuacagccaggccccccuacacccugcuccagaguugguaggagaggcaagggugggagugaauggagucuggcuacucgggaggcugcaggcagaugcaggggugagggccuccccacccaggaccaucaccaacuuccuuguagcuggcagcgaugagggcucuggaggcuggggaaggagaggauggacaugguugugcaggguccgaaugugguggagugaccuaaggagagacugggcaaguugaggaggggaugugagcuugugcugccaucauuuuaucuuucaacagcauuuuaccacuuugucgaaaugaguaucacugguuauuguauuccuuucauuuuaaaaaaaauguuauauacauguguguuuugccucugaauagcuguauguuuugugcaugcuuagugcccaggauggccagaagaggcuguuggauacccugguuacagacagacauuugugagcugcugugugggcacugggaaaucaagcccagguuuucuggaacaacagccagggcucuuaacacugacccauccuucucuccagcccuauuguguucuugaucauguaguauauuacuuuucauguuccacuaauuuugucuuguuuuauugaggaccuugguuaucucuguuuaucaagagaagugucccugcaauuuuauuuucaugucuuuuguaucaggauacuguucauguauuuuguacaggccccauaaaauacauuuggaaguauuccccuucucuucaaucuuggaaaauuuaggugcuagaagcuaaaccuaaacgauugcacauuuuagacaugcaaucuaccacugagccauacccuugguuugugucaauuuuucuugaaauauuugauagaauucuauuaguuaaauuaucggguccuugguuuguuuuguuguaagauuuuaguuauuguuucagucuuauuauuuuauauuucuuuaucauucaauugugguuagaauguuucugugauacauuacauuucuuauuuguuauuuuauuugcugguauuuggguacuuacagcauuuucuuacaaauccuuuauaguuuuauauuaucaguuguaauaucuuaaaauacaauuuuauuuuucccuuuuacuguucagcuaaauguuucuugauuuauauuaucucuuuaaaaauaaauuuuucauaaucuacauuuuauauauuuuuauucauuuuaaaaauuauuuauuuuuauuuacauccccaaauguugccucuccaguccccuccucaccagaguucuucagcuacuccuuccuaccuucugccucugagagguugcuccucacaucccccuuuccuugggcaucaaaucccuauaggauugggcacaaccccuccuacugaggccagauaaggccucuacucuauaugugcuaggggccuuggaccagcccguguaagcucuuugauuugugacuuagccuuuggguuaguugacacuguuggucuuccuauggcauuggcauccccuucagcuccuucaauccuucuaucucuuccauucuuccauagagguccuugcccucaguccuuguggguuuuuuuuuuuaaguaucuccuugauaggagccuagcagguuugcccucugaaaagguaacuuuuaauuucauuguuuuauuuucuuguaaguguguguguuuguggguagguacagacaaaaugguggucuuuaacaguuuccucccuccccuacuuuugaggcagagucucuuacuuggauccauggguuggauagguuggcuggauagugagcccuuggaaucugccuguuucugcuucauuggcuucgaaaacaugccucaccauagugguucuuuuuccuaggaucuaggguuugaacucaggugcuuaggcgacaugcgcuuuaccagcugaguuauuucucuagggcuucaugauggauuuuaccccuuuucuacuauucauuuauaagacugccaaugcacaauguucaacugucauguucaauagaaaugugagguugcaaauccuugucuuuuucuugaaacccgggggaaacauucaggguuuuuugguauuaauuaagcuggcaguugcagauuuuuguuagauaacuuuccacucccccuuuugagccauuuuuggcuaaccuugaauuuacaaucuugccucagacuuaugaguagaauuacagauauguaauacucucgacccaagcagcuuaaauacauuuuaaguugagauaauucucuucugaaaauuauuuuuuaaaaagaauuuuuaaaucaaaaaugguuauuggauauuuuuugugcuggcuaguuuugugucaacuugacacagcuggaguuaucacagagaaaggagcuucaguugaggaagugccuccaugagauccagcuguaaggcauuuucucaauuagugaucaagggggaaaggccccuuaugggugggaccaucucugggcugguagucuugguucuauaagagagcaggcugagcaagccaggggaagcaagccaguaaagaauaucccuccauggcucugcaucagcuccugcuuccugaccugcuugaguuccaguccugacuuccuuggugaugaacaaccguaugaaaguguaagcugaauaaacccuuuucuccccaauuugcuucauggucaugauguuuuguccaggaacagaaacccugacuaagacaaauugguaccggcuuagugggguauuccugugauaaccugaccauguuuuggggaggacuguggaaggacuuuggaacuuugggccagaagauccauacagaguucuguggaauguuguguaggagcuuaggagauaauguugagaacagugcagaagauggagcccugacuugugaacuuucugagggaagaugaaagacuuuuuucauggccauugcuaguuugauugugaagauucugugguucugguuagcuggggcugaagaaucagcugugauuaacacgauaccagaacuacuaaaggaaaaacuuugcauuacugggacuauugaugcugguuagcuggagcuaagaaauuagcggugauuaagaagaaaccagcaucauugaggugacaucuucugggaaguguuuucugagagcacagaggcuguguuccagagauggccaagguuguaccuugugcuguggcuggacuugguaauguguaagaguuacccaggcgguacuagcuuugaaggcaugaaggggucacgcagaacaacugaggcucugcagugugagcggccauggaaggccauuggugaagguugcaauugguggcccaggaaggggucaugcaaaggauuugaggcuuggcaccauuaagagagccuaugagaggcuauuggugaagccuaguuacagcggaagacagcagaguuuuggagaugccaguaccaugagaugaccaccaagaacagcagcagcaguggaguacaggcaguuggagccuagaagacaaggugugugcuacaaagggcauggcuggagaagugacccaagcccuuggaggagcccagagauugugaguuggaucccagacauuggaugguuggagauugauuuuugcauuugauugugacugugcccugauauuuucccucuugaaggaaguuuuuuagugaagcccacaguuaagacacuuugaauuuuaaaguacuuuguauuuuaaaagauacuggauauuuuaaagggauugaacuuuuaauauguaaagacuguggacuuugaaaguuauuuagaucuuggggaugaauaagaacuaaggguugaagcuuacuagugauguguuugugugucaaguugacaaggggucaauuguacugucuaguuuugugucaacuugacacagcuggagucaucacagagaaaggagcuucaguuggggaaaugccuccaugagauccaacuguaaggcauuuucucaguuagugaucaagggggaaaggccccuugugggugggaccaucucuaggcugguagucuuggguucuauaagagagcagguugagcaagccaggggaggcaagccaguaaagaacaucuaucccuccauggccucugcaucagcuccugcuuucuuaccugcuugaguuccaguccugacuuccuuggcgaugaauagcaguauggaaguguaagccgaauaaacccuuuccuacccaauuugcuucguggucaugauguuuuguccaggaauagaaacccugacuaagacauuuuucaaaugccuuuaauuuuuauuuuaauuuguguauguuuguauuuuuguguucaugcauacaugcacauguaugucaggguagaagaggguguuugauuucucugguacuuaaguaacaggcaauugugggucaccugauuuggguguuagaaacugagcuugagucuucuggaagaacaguaggcagucuuaaaugaugagcugucucuucagacccucaaauguuuuuuuuaugucuguugaucacaaauuucucuugcuguuuuccauuuuaauuuguuaagaggugauugauggguuuucagauacaucaagccaaccuuuuacccuaagaaaauuccuaccucuuugugauagauacuuuuuagguuuugggucuuuuuuuuuuuuuuuuuuuuugguaaagcuuuuagaauauuuauauuaaugaagacuauuugaaaucaaacaacaaauucaguugugucuguguuuggcuauguguauacagaagugcaaguauucuuggaguccagaagaggguguuggauucccuggaacuggaguaacaggcauuugugagccaccuaauguggugccuggaaaccaaaccgagguccccugcaagagugcuauguucucuuuacugaaccaccuuuccaacccauauuuuuugauaaugccuuugucugugaaaccagguauauugagaaguaguccuuccuauucaauuuucuggaauauuuuuuauagaauugauauuauuucuuccccaauuguuuggaauaauucacuauuaaaaccaucugaguuuggacuuuauuuguguaauaguuuuaaauuacagauuaauuucuggaacaaacagcuguuuaaauauauuaauugaguuuugguagcugguaucuuuaaaggaaucuguuuuaucgccauguauuuuguauuuuuaccgcuuaugauuuguagaauugauagugauaaucucuccuucauucuuuauauuggucauuuguaauuuuucaguacaacagcgauuaugauuacuuugaacuugucuguuaguucuucaguguaguuacauuaguguucuacacggagucugugccuauucuccagugaaaaguuggagaguugggcaucuugucugauucccuuuucccuuuucaauuguagacuuagucuuauuuggauuacuugugguugcucuccagugccuucaggaaguuguuuuucuuucuuucuuuguuugccauguacuaauaacagcuguuuuauguaagacuguuuuggaccagugguggagauagagucucuggguuucugauuuugugauagucuagcaaaaacgagauauauuuuaaauggcugcaaucaaagcauagaacuuaauaacuuagcaauauucuuuauuauugccuuuauuggauuugguauggcuuagcuccacuggauguuuagaauaaauuauggaguuuggggaaaagcaaaauggacauguuggguuagcuuuuucaaaauguuuucagcaggagagacuuaccacuuacuguucauuuugaauacuaaauaugcccaguuuuuuaaaugauuuugaguggcuugucugucauagguaauuuuuuaagagaaaaugaugaaaauugugauauuuuacaucugaaaagaacauuucuaauuguauaauguauauugcauauaauuaauuaguuuuagucagugcugugaaaauuaaacaauuuauuuguaguagaauccauuucuuggcaauuuaaugcacuucuuaguauacauuacaguuuacauugaaagguacuucaaaaagucaucuugguuauuugaucucagccuuauauuuacugaacugugcuuugagcacaagagguucagugguaaaggaggagcuuauauucuuagagacucagaaaucuuaccuuguuagcacacuggauggucagacucacauggacuugcccuaaugccaauuuguucauuugaaaugaguagugcagcuguuaauuagacuggugguugaacugagagauuagugcauuuucucuuuauagacaagccacaugggaagccaaauuacaaucacaggguugcuuggugagaauggaaucaaaacaaaaggacuugcuuagauaauccaugauuaggauccaccugcuacagggacuauuuggguuuccccugaguacugcugagcagaaaagcuugccagugucugggguuugaggaucuuauuuuuaagcugaccacauuuuucuucuuuucauauuuuuuccaaaccaagguacaaaaugcauguuacaaaaugacaagcauaaucuaggccuucuucccaagacugaauuuacacgaccuuuggaaacauuuagggacauucagauucuguaccugggcccacauguaaacacuagcuuuccauuucaguaaagugcuaccaccucugucaugcagguacuuuuacccccauguuguggaaaaaguuuucagauaccucagauuaccccuguguuacuaguguuaccaguuugagucuguuuaaguaguuaauggauucauuucuaucuuuuauuugauuuacugauaacaaaccucaauucuuaagaucaaucuacauaaucuaauguguuuucaauagaagugguugaucuguguuaaaaugaauguccgaagauaacaauaaauaccuaaauuuaaaccuagaaaguuuuaaaagccaaucauacauacuaacuuaaauaaaaaggaaagaauguauaauaauuuccuauaaaaaggcccagagaacuugaaaaguuguuguuuucaagggcuaaucacaugccuucaggugcaauggccauucugacacuguaauuguaaaccauuuuuacucaccauauuauuuuaucauuucuuccaucauugucuacccaucagccauuuaccaccaagauggacaugccacucaguuacaguuuuaagacguaaacaacaaguaguauuaagaccuagugauagccaugaauguuauauucucagaaccaguggaguguuaacacuuuccauuuagccacuaaaaugugcagccuuggcagggucccauuuguacaucuuuggaagguaagaaccacaacaguacuacugauagcaacaaucaaaaugugugugaugguucuaauuuuucagggagcuccguguaguuugaaugaguucuucccauaggcucaaguauuuaaacccauuguccccaguugguggucuguuucagagagguuuaggagguguggcccuguuugaggaugaaugucacuagaggcaggcuuugagaauuuaaagacuugugccauuucuacuugcacuuucugguucaagcuuaagguaaagcacaugagcuuaguaucuugcuccaguugccaugucugccugcuaucuuugcccugccauuauggacuauuaacucucuagaauuauaagccaaaaugaacuauguuuauucuguaugauucuuagucaugguguuuuauuacagcaacaggaaagccaacuacuaugagccuuuucaccagaguuaaucaaauuugaauuuuauuaguaggcuauacaguguauagauauauuaguaaccauuucugcuuucuacuaggcuauagcccauacugucagcuacuauaaaauuuuguugaaaacagaugaaucaugccuugggcgauggaucagugggcucuauacacauauaccacacaugacucagucacuggagcacucuucugcucaaacccuaccuggugaaucucuccuucaucugaacuacugcaguacuuucuuuuuuucuuuauggacaaauuguguuguguaaaagacaucuuagcaaguugauuucuuuuuuugagacaggaucuuaguagcaaaucugaucuuugcuccuucauccaccucccaaguacugggguuacaggcauauaccauguaucacaccuaacugcaaguugauccuuuaagacagcaguucucaacauguagucacaauccccaaaagaccaacugaaaacacagagauuuccauuacaguagcaaaauuacaguuaugaaguagcaacaaaaguuaguuauggauggaagucagcacaaccugaggaacuaacugugugaaaggguugcuacguuaggaaggugaaaaguaaaaguaaaaugaaccuucugacucuuuggauggcaacugcucuuuaaaguguuuguugacuuguuuuaaggcuaauacgugcacuguuucagguucuauggucuuucaguuucaauauuauuuauccuuaaaguauaucccaauuaacacaacuuuucuugcaaacaguacuucuugcuaucaguguucuagaucuauaugggccaguaugguaguuauagguuauuauuuaaauuuuaauuaacugaauuaaguuaaaaugccaguuucucugucaugccagccacauuucaaguacuuacuagacauaguagucacuggucacauugggcuguuuaaggaaauuuauaccaaaucaaaucaaacauugcuuucuuagucuucccagcuguguuucaaguguucauuagccauauguuggccauauguugagucacauuguucuagacucuuaacuucuacuuaguuuagggagauauugagagcucauacucuaaauucauaauuuuacuauuguuuaugauuucuucccuaagguuaguauuucuuuuuuuuuuuuuuguuuuuuuuuuuuuuuuuuugagacaggguuucucuguguagcccuggcuguccuggaacucacucuguagaccaggcuggccucgaacucagaaauccgccugccucugccucccgagugcugggauuaaaggcgugcgccaccacgcccggcagguuaguauuucuaaauacauucacuuauccuuccuagauaauaaaaaugugagauacucuugguuguacauaaauacguagcaauggaaauugaaguaaaaaucaauguaacaauaaaauguucauuucucuuuccuucuagggauauuugcugaaguacgacagagaaagauagguauaagcacacuuguucugcacuaaauaaaaacagcacagccaucagaagaagaagugacuaaguuacaguaauucuuuuugagauggaguguuccuauguugccuuugguagacuugaagagcagaacuccuaaacugaaucacauagcuaagauuccaugaugcagaaauuuaggucaguuuugcucucaucaaaugaaauacuauucaaagaguuuaguuugaaaagacguuucacaguuguagaauaucucaaguguaaagcugguauuaaaagcuugaugcuguguguuagaaucuuaaguguuaugaguuaauucaguaagaugucaagcauaucuuuuguacuccccuuuaccccuuguauucacacugucagaauaaaagggaauauccagaucaacagccaaaguguauauuuuaaccauaggugcacauucagguugaaagauuccuuguucuauaauaaagucagauuagagcaaaccauucaaaggaauauccuuauaaaacauggaucagaacacauacacuuauauaagggaauaauucuaaaguucuaaagcauuuuucuuagugguuuuauuaauuuacauucucacuaaguggauauaaaaguuuuuauguuaacaucauuuccagcauucuuuacuugucuuuuugauaaugccauuaaaaacaaggaagguacuugacuaccuauuauauguagguugguauugaacucacgcauugaaguguggugauaaccauuuuaacuugggugagaugaugucucauuguguuuuugguccuuggauacuuaaauugucuccauauuuugaguuugaguaaugcuguguucaaucuguugguacaauuauuucuugggaaugguuauuucauuaccucugaauauauucccagagauuacaugaucauucuguuuuuguuaagggacuucaaguugucuuccguauggcucuaaaauauuacauucucuauuacuguauaaggguucccuuucuguauaucuuugcuaacacuuacacaucuuuuauuuuuaguaacaaccacuuuaacagguaugaagauauauauuucacuggcuuggcuugcauuucucugaugauuagugaugauugugucuuguaauauaccuguugaacauuucagugucuuugaaaaagucaauugcuuugcuaaguuuuuuauuugauuguuagaguuuuucuuuuaucuucuagaucuaauguaauuacaucauuucuuucuuccauuuccucucucaaaacccucccauauaccccuucaugcucucuuaauucauggccucguuuucauugauuuacauggauauauuuguguguguaugucuaaauacagccuguucagucuuuaugauguuacuuaaauauaucauucuuuuuacaauuguauguauuucaaaugagauguauaguuuguaaauaucuucucuuuuuuguagguuguguuugcuuuucauaguuguuuccuuuauuuagauauaaucuuuucguuuagugugaugugugaacucuugauguuauauccaaaauauucuaaaacuuaugguaaagaagaucucucucuucccuguuuuuuucuagaaguuuguggcuucaaccuuaauuuacuucuucauccauuuugagcugauuuuuugauaugaugugagcaaaggcucaaaauuuauccuuugcauuugaauaucuaguuucuccauuaacauauuuuaagaagacauuuuccccauugucuguugucaguacccuugccagaaguuuguugaccauauaucccccucugaggcaucauuguacuggauaaaacuaguguaauuuugauaggaguuucacuggcuuuguagauugcuuucaauaauaugguuauguaaggaguguuuucauuaauuuauuuaguguguguauaugcaugauauauguauuuguucguguuuguauuugugcuuaugccuguacauguguauggaggccagagguugacuucagguaucuuccuacaucuuucuguaccuuauuauuugcaaaaugugguauaagaucuuacuaauccuggacuucaccaaauuuagcaaggcuguccagguggccaguaaacuucagggacccacuugucucugucucuccagugcucgggauaaaaauucacuuugccacucuuugcuuuuacuugggugcuggggaugcaaacauagguagugacacuugugugguaggcauuucacugacccauuucaccaaucccauuauagucucauuuuacagauaaauaauuuuauaaugcuaguccaauucucauaugaggucagauagggaugauaccagaaaacacaauugcagguaacuuucccugauaaacaugugugcaaaaauccucaaaaaguaaaaaaacaaaccccccccccccccacaaacuagagauugguguauuaggauuauauaucauggucaaguagaauuuaucccugaaaugcagaaauguauuaacaacuacagaucaacaaaugugaugcauauuaacagacuuaagaauuaaagucaugugauaaucucaguauaugcuuuuaaaacauucacagaauucaaguacuuuccaugauagaucuggucaacaaccuaaagacagaaugaauguaccucaacccaguacagacuguuugccaaaagcacagcuaacauuacacucagcaaguucuccuaagugcuggaagaagaugaggauuccuacccuuguugcuucuauucgacacaagaccuagccagaacaguuaggcaagaggaagaaacaaaaguccuccagauaagaaagggagaugcuaaauuguuuccuaagagauucugugaauauuuccaagacuucacgauaaugcuagaacaaaugaaugaauucaguaaaguuacaggacacaaaaaucaacaugcaaaaauuaguuguguuucuauguacuaauaauacuauguggaaaagaucucaaugaaauauaauguaagugaaauguaaaugagaaggacguucauguacaacaacaucaaaaguaaaauaggcauucaggauauaguauggugguagaguaaaauaggcauucaggauauaguauggugguagaguacuuucccaggcuguggaaagcucggacuugcguucuuagcaugacaaaaaaugcucaaguucaaauuugaccaagaauaguagaaggucugaacacuaaaaacugugaucauugauuaaagaaaucgggaaagacacagauaaauggaaagguacuuacucuguucauagauuuaaaaaaaaaaaaaccaaccuagcuuccuauuaguuggugauauguguaguguucacauagaaagcaaauauuccucuuuuuauuucuauauucauuuuagauauucuuugccaauguaacagcuuguuaugagcauaaguauagaaaagagauuuuuauucauauuuaaagaacaucaguaauaaaaacauuuccccagcuuugacaaagaacgccuuuguuuaaggguuagguaugucuaaggaagugacucuuguuaaaaacuaaggaauaaaauauaauucaucuuaucuuguguaaggaaaauuguccuaacuugcaagcugcugagugccuaauuuacauuuaaaucugaaguaaugaagccuuuauuuuuugccagaaauucccauuucucccaaauauacucucuaucagggggguaaaaaccaccucauuacuuugcauggcaaugugucuuugcugauguagaaaagcaacauaauucaggaugaaggauuaauuuaaacuucuuacaugcucuuuugcagguaauuaacauuauuucuagggaucaaaagguggguuugcagagcacaccaaaaaagaauagcuuuauccuggugaauugcaaagaaagaguacagucuuuuuaucaugaggagcaagagguucaugaaaacugucauguguguagaauugaagcccaagaauuuuagaccucaugggaacuauagcugcagaggaaccaaaguugggaaugucucuauggaaacccguaggaauaaacaguguuuacauuacuuaaauaauuucuaaaugcuguacagaugacccuuuaauuuauacucuuugauuugguaauaaaugauaguauucuuuuuuauauauaacugucccuugcuuaauuaaaaaaauugcuuuguugcaaaucauaagcuuguuuugaggcauucauuuccacuccucuaccaugauugguuuacuuucuaguuuuaauuaguuuccucauauuugaccucagaaccaguugcuguccacuugcuuagcucuccauacucacaucguacuugcgugaccuuugcucccgacacuugaaucuccucaauaugugccuucauuuuaaacagcuuuucauuuuuuuaauuuuucaggugagguccuacuguauguagauagcucuggcuggccuguaucuuacuuugcaguccagacuuaaaugcuaaaaccucuugaugcauauucugacauuagcuuuuaccuucuuccuauucucaacucugccaccaucugucucaugggauuuaaucauagcugguagacuuuucauauuucaaaacuuagugaaaauuugaaguugcccaucaaaauacauagugcauuuuagccagugcacuuaagaguuuagcuuaagaguagacaugaggaauuagcauuguagucuaaaauguauacgaaucuacaugcucgcaaacauacaccuccuccucacauccauagaaauaccuuuugacuugagaagaacuugaaguuguucaguugcugaagaauuuggaagcuuguucucaguuggaggcauaaucaguaauuuauugaccauuucuuugaauuuguaaacaaaugaaauuauuugucacuuuuuuggcaucuaaaugguuaugaaggcacauuuuuugugcuauucuagcauaagaguuacagaucaacugcuaauuucuaaaaccagauuuuaugauuuaucuuauuucuaugaaaagauacucuuuucauaguuuuuuuuuaaacaaaagacccagcuuucuauuaguuggugauauggccuuuggggguaucucagaugagaugggaaugucauugauuucugaacugugacagaccaguagcccuuaguuuggagaaagcaaaaagagccccuuaccagaaagaggcuguaaguuuuguucugugaguaaacuacauuucuugugaagucuucgauugcaguuuccuauuuuuuugacuuaaccauagguuuugguuugcacguuuugcuuuagaaaagaccauguguguugacaguaugcugcaaccuucaaaaaaguuaugacauaaacucguguguucugaguucuguucuauauagaguuuuuacucaaaaagaaguuaagaagcugauuuagcaaauuuaggaucacuuugaccuaauuuaguauccuugauagugggaauuagguuuuucuugugauuauuauuauuauagcuaagauuuaucauguuucacucaauaaugagcaguuugguuguuuuguacugguuucaggaauacuguguggaugagguagaaguauugagacacuguuauaacagaauauagcuguugcuauaauauaccagaaaucaggagaaacacuuucccauugcucucaaagaacugaaguucaaaguaagcuugcuguuguuauucauuaccucuuuuucuuucaaacagaaaacacuuggguuucuguggacaaggcugccuuuuaauggcauguucuucaaacagcuguuaagcauuucccccuccccaauaccacagaccacaucuguucccacuguugauuagcuagagggugaagaaagaagagaggcuguagcauauguaauuaccaguaauuaauucuuguugagccuccucauuuccuucuauucuaacuccaccuacucuucuuccugucuguguuguaaauucgguuucauguuggcuacuuguggaaaauaaucuugauggguauacagcuguuuuccuaagguuuuauaucaccuuagagugaagucuucauuuuucuugagguggcagauuaucuuuuuuuuuaauuauuuaaacaauuuuuauuagauauuuucuucauuuacaauuuaaaugcuauccccaaugucccuuauaccuccccaccccugccaugcucaccaacccacccacuucugcuuccugggucuggcauuguauuggggcauauaauauuugcaugaccaagggccucuacucccaaugauggccgauuaggccaucuucauggcaaaauaucuugauaaaacauaucaaguaagaaaauaaguaaacuuaggcuagcuuuauauagugugucauuacuauuagagauuuuguguugaaguuaaguucaguucugccucccagccucaugcuuccagaaaucagacucaaauacaaaauaaagacuuauaauacaagcaaaaucagacuaacacacuacaauuuuguguuuuugcaacauucucaacuguugacaauugcuuuuacauauauucuuuguugaagagauuguugcuguaugauuucaugugaggaaaacaaauagaaggugcguugcuaaccauuguguaauagcaugcaucaaaacauaaucauguaguuaacauauaaugcuagucauguguaauaacuuuaagaccuuguggggagguaauggucuacuuacuuucucuuugugauaaauucuguuuaaaauaaauaucuuugaacauuuugguuaauauauuggaguaagagagauagauauaggaucguccuuuaaagaaaguucacaguacauguaguuuacaaauuuuaaaagccuggauuuucaaaaugugcuuaucuugugagucugauuuuaagagggggaucuuuaagcaaggcauuaaaaaauugcuucuuuugucuuuuuaaaaaaauuugauguaucacccaugauuacaauaggaaagaaauggcacugggaguaauuguaucaguuaaagagaugauuauaaaaaugugggcagacaauagugaaaugauaagagaaaguauaagaacucuaagguuacuaauagcagugauguuuuucucuucuuaaagaagaggugauauauaccuaaaagugaaguggaaacuuaaggguucuuuggaaagucaguuguguuagaugguauuuugcuggggcaaaggcaugaaggaguguuuucuugaagcaaacacaagugaaaggauguuuuugcuaaagcgaacacagguaaaaggcuaaggcugacuuacaaaggaaccuuuugcugaagcagacacagguuaaaggauguugaauggcuggugcuguaagaucaagaauugacaaaugggaccucauaaaauugcaaagcuucuguaaggcaaaagacacugucaauaagacaaaaaggccaccgacagauugggaaaggauuuuuuuuuuucuguuagcuauuuuuauuuuuuuuccauuuuuauuagguauuuagcucauuuacauuuccaaugcuauaccaaaagucccccauacccacccacccccaccccccuacccacccacucccccuuuuuggcccuggcguuccccuguacuggggcauauaaaguuugcguguccaaugggccucucuuuccagugauggccgacuaggccaucuuuugauacauauacaccaauccuaaaucugauaggggacuaauauccaauauauacaaagagcucaagaagcuggacuccagaaauucaaauaaccccauuaaaauggaguacagagcuaaacaaagaauucucaacugaggaaugccgaauggcugagaagcaccuggaaaaauguucaacauccuuaaucaucaggaaaaugcaaaucaaaacaacccugagauuccaccucacaccagugagaauggcuaagaucaaaaauucaggugacagcagaugcuggcgaggauguggagaaagaggaacacuccuccauugcuggugggauugcaaguuguacaaccacucuggaugucagucuggagguuucucagaaaauuggacauaauacuacaggaagauccaacaauaccucuccugggcauaucccuauaaguaguuccaacugguaauaacacaugcuccacuauguucauagcagccuuauuuauaauagcuagaagcuggaaagagcccagaugucccucaauagaugaauggaugagaaaaugugguacauuuacacaauggaguacuacucagcuauuaaaaacaaugaauuuaugaaauucuuggacaaauagauguaucuggaggauauuauccuuagugagguaacccaaucauaaaagaagucauuagauaugcacucacugauaagcggauauuagcccagaaauauagaacacccaagauacaauuugcaaaacacaagaaaaucaagaagagggaagacaaacggguggauacuucauuccuccguagaauagggaacaaaauacccaugaaagaaguuacagagaaaaaguuuggagcuaagacaaaaggauggacuauccagagucuaccccuccaggggauccauuccauaaucagccaccaaaagcagacacuauugcauaugccaggaagauuuuguugaaggcacccugguauugcugucuccuaugaggcuaugccagugccuggcaaauacagaaguggaugcucacagucaucuauaagauggaacacaggguccccaauggagaagcuagaaaagcacccaaggagcugaaggggucugcaacccuauagguggaacaacaauaugaacuaaccaguauccccagagcucaugucucuagcugcauauauagcagaagauggccuaguuggccaucacugggaagagaggccccuugguauugcuauugcaaacuuuauaugcucaguacaggggaaugcaagagccaagaaguaggaguggguggguagggaagcagggcggggggaggguauagggaacuuuugggauagcauuuugaaauguauauaaaaauaucuuuaaaaaaaaggauguucugcuaaagcaaggacuggaauggacacaugaugaaggauucguuguuaacaguauuccuguauugguccacuuuacauuguguaguugagcugcauaggucaguauuccauagaaagaaaggcacacacacacacacacacacacacacacacacacacacacacagccauucugauggugugcucuggcuucuugcuguuucacugacuccagcugauuggcacaguuauuucagcugaggccagacacaagugcucaguacuaguauuguggaagaggcuacccuuugggagagaguuuugccauuuugaaaaucaugugauaucuguggauuuguuauggagagaugugcucauguguauaugaauccagagauuaauaaguaggguggcauauauugaguuauagucauagugggacuagguauaguucaaaaguacauauuuuaaauuauuguugauuuauaugugugcgugugugagguuaaaauaaucaaauuugaaaacugaacuauagaauguaaauugucaaucuuggcaaauuguguauugggagaagauuauuauuacuuucaucugugguuaugaauugacauuucaauagaauuuuaaggggaagggaauuuucaaagaauuuuuuggaggguauuuguuauuuuuuaucaagcaaguugaucagcauggaccaguuuugcuuuauacccacaggccuuguacuucuuuuuuuuuuucuucaauuuuuuauuagauauuuucuucauuuacauuucaaaugcuaucccgaaaguccccuguaccccccccccccaccagccugcuccccuacccacccauucccacuucuugguccuggcuuuccccuguacuggggcauauaaaguuugcguguccaaggggccucucuuuccagugauggccaaguaggccaucuuuugauauauaugcagcuagagucaagagcuccgggguacugguuaguucauaauguuguuccaccuauaggguugcagaccuucuugauaccucuauaaagacacauugccagaaggucaacuguuggauguagaacaggagagaagaggauggguggagcauaaggaagaagagaaauuucuuaagccuuugccuuaagcuuaaugccauuuguuuuuucccuugguuuaguuccuagcaugucauuaaacagaaaccaaaaaaggcaguucucucuuugacagaaguuguuggggggaaaaguccacuauugucuuauuccaucuccuucaauguugaggagaguuguuauuuaagaaguuguuuuguguucuuuauaauaaucuuaagccugcuagguuucucuuuuguuuaggagacauguaugaucuuauuguggagcucuggauaguuuugaacucagaucuaccuaccucugccucuagaguauaggaauuaaagguguguacuaccauauccugccuaguccagcauguuucgacaaauaaccgauacuuuugguaguguuagucuaguuuaccuaagcaauagaagaaaguaaguauuucuaugguaucaacaguugugggauuuuagccccccccccccccuggcauaauauauuaaugcuaagcagaaaacuuccaaaaacaaagacaaaagugauguuuguuaguuguaguuugagauauuucaggagagaugagaucugaagcaaagcaauggccauauuuagaaagcugccucaaacccaagaguaucuauugaaguaaacuugaugacaguuuuuuccuguucaugaaucauuguauucuauaaaagcgaaaauuccccuucaucuaaacaaauggcuuccacaucuguuuucuuaguuucucaaaaggguguuuuuggcuugcguuuuuuaaaaaaguguuuaucuguuuaaaaugaaauaucaucaaaagcaguuggcacaucaaaauccaacuuggucuucagcuaacaagaauuaagucaggaaugaucuauuggugauguugauauugauauagggauacagaaagcacauuuuaauucuucagugcuaaguucuucuuacacuguucaaauuuuauugguuuauuuguaauuaucuaugcccuuugguuuugaagauugauuaaauaacuuuagcacauuccaucauuuaaaugcucucuucucagaguucuaaaaccaagcauuuuagaguccaaucgaugaugaagagauuuguaguuuugacauuuuugcuccaaauuuuuuaguuuccccuuuacuauguuaauaagagaaguccuuuagugacugguuuuuguuuuuguuuuuguuuuuguuuuuugugaaauacucuuaugcucaugugcuuuuuggaagcauuuguucgguuccuuaguucuauuugagcuugcgcacccuuaaguguuuugauuuuuaucuuuaaaauuccuuagugucuuugugugugacaggccacccugcccuugagcccauucugccauuuaaaaauaaagaaugagaagcagcugaagugcuggcucuuucacagcugacagcaaucugaucuacugguuggauucuuuaucugaguacccacaugccagugguaugugucuuauucuaaccaugcccucuucagucauaaggucuaagagugcagaaaaaguugucuccagagaaaagaaagaccuuuccugacuucuuaccauucaguggaauuguugagccuugauuaagguguuugucuuuuuuuuuuaagauuuauuuauuuauuuauuuauuuaauguauaugaguacacuguagcugucuucagacacaccagaagagggcaucagaucucauuacagaugguugugagccaccaugugguugcugggauuugaacucaggaccucaggaagaagaacagucagugcucuuaacugcugagccaucucuccagcccccaagguguuuguuuuucagagaagguugaaccgguccuacucccaccuaguucugagcucuagcugccuguccugucuauaaacaguggcuuguucugaggcccaagauucaugagaacuauaagacauuugguguuauaaaaucuaaccagugacaaaguaguaaaaucacuuaugaccuggucauaguucucuggaauuguaugaaggauaugauuuggauauugaggaaaacucuuucuggcaucuaguuuuauuucauuucaguuuuuaaggcaggccuuuacucuguagccuaggcuuacuuacauagauuucacuguguagcccaggcugguuuugaauucauggugcuuaguccucauuuuucagccaccugagugcugagacucaagguacgaggcaccaagucuggaucuaccuuuuuuuucuuuuauugaauaaauaaaaauuaccuccuugcuaauggcaccgaauuugaaauaagaaagaucaccuuucccuccaacauaggggagagacagagaaaaggaugguuacuuaaaacuaaaaggaaguucuuucuugugauauaaauugauccuuguucauucuucuuccuaugaagcucaucagcaucauuucaaaaacagaggcagagauggaaauuugauuguuguuugaguuguccgcuaaagcuguggaaaggcauggucuucgaccuuguucgguauugcacuagccaccuguuaggauuguucucauucaaggucauuauguggugccuggcugucugacuggcagccugugucagauuugccaguggccccucauuuguaucaccccugccaauuuugacagaaagaauggagacaugcuagcugaaagggaaaggagggugcuggaggaaugagggaucaagagcuccuuggaccaccuguuaguuuaguaucauugguuuugguguaauccuuugcuuaguuccccuuuucgccuuuccugaguuuugcuauccauuucucaaguuaucugugggaugacauugcuuugcuuauucaucuauuguaucucuuucaaacacgagauuucuugacccucccccaaacacacccuccccucugcugagcauuuuuacuuccaacugccugcuugaaaucuuuuguuauuguguuugugucaggguguaaaggaaggcaugcacacaugccauggugggugcauauguggagauuaauaagacagcuuugagaagucaguuuucuccuacuuuuauaauuguuucaggauuagaacucaggccacugagcuugcccagugaaguacauuuacccacugaaucucuuaccaguccugugcucuugauugaaauguucccaaacugcacccuacucaauuucaaaacuacccuucuuagauuccuagauagacuugguaagccaggagcauaagcauuauacuugaccccauuguccucuugccccaaaugcaaccuguugccaagucaucuagauuucauuuccuaaguacaugugauuuuuuuugugucccuacagacacuguuucuaugcugcuuagcccauagcaugccacuuuggucacuguguucccacuguccauguuugcuacaugcuuuauuaucuuggagaccucuuuaaggucucagucuacagugccagucucuaauguccuuaauacaguuuucuuucauagcugaggcucuuguccauuuucuucccacuuucccugagcauuccaacucuaccauaugcuuuauagucuuccuauuggauggcuaaagcaguuuuaaaaacuuuuaaaagaaugugauuucuuuucagcaccauucauuuuccuugguauuuuguaucuucuucacacagucucccuucauucuuccuuucucacauucucugauucaucuuccacuuacaugcaaucuaauuccaagaacuuuuuucugacuucugccccagggugucuuauuauggacaugcauguauaugaauguaugcacacauacaaacacaccaaggaagggguuauuucuuaaucauucaucuuuguguuccuuacuagcuagagcauggggaauucaguaaauuauuuuugguacaucaauaaaugaauucuuuggggggguuucuaaacaaaaagguaacacagugcuucauaucauuuguauaaaaugcuugcaccauggccaacaugaaagaguagaaaugccacuuuggcuucaaauuacuguuucuagauuauauuccguaucucuauccuaaaugacuacucaaauuuacuuucacuuuuuuuuucugaaaauauagaagauaaucaguuaggagaaaaauuauugauaaaugaggaccugugauuugacugguucuuaaauauuuuuauucuaaaagaaugccugaauaaaugucuauaguacauauuuuucugaguagaugagcacaaauacuuuuuccuuaaacuagaucaucuuucugaaagauuuuuuuucucaagugggcuccuaaauuuaaagcauagcaaugucaugaaauuguuuuuaggaacuuguaaugagauagagggguauaagggauaaccuuuguuuaaaaaaauuacuauaagaggguauguuaaaacaacaaaauuacuauauaacuuaaguacugaacaaagggcuacccuuugguauuagguguaaaauuuucuaagccagugguagagcacuuaccugacauucaugaagcccuggguucaauuuucaagacuaaaaaaaaaauacaaaaggaagaaugaaaguuccuugugcuaccugcucgugcagggagaguggugaaagacauuauggggacuguccugccgcucccugccgcugaaaaggagauuugaugaagucagaaauggggaugucaagacauuggucacuuucuaauuucaugccuucuagacuaccagcuauguguuccuucaggguuuugcuucaggcuauuuucuuaguaaugacaacugacaaccuguuagaucugucauuuguuuguugggaguugggggcuucaaguuuucuagucagauuuucccaugaccucaguuauaaagaaaauguugcagauucuagaaaaugcuaauauccuuuuuagcuguaaguauuaucuugauugcagugcuucagaauugcccaacuucauuaucugagcauagccagccugacgccuucuucucaaauagacaauuaugaucaauuaagcacuuucaggccuuauagaauacuuaauuuuauuagucaauuauuugugcuuugaaagaguuaaugguaucuacccaggccauuauuagaaauuagaaugucccaaaauagaaaggcuauuuccuuuguguguggcacugcaguggaaaaugccaagcauaguuuuuacugaguuaaagggugagggaaggcggggugggggagaaaguuacauguaaaucauuuagccauuaaccuaauggguggguuuauaaauccuauuacuguaagcccuuuucauuuccacugaggccugguguaugcuugaucccacuaauguaaaauucauucuaucuaagugauuacugaaguaagacauuuugagucaauuuuaaucagguugugugaaacuugcuugaguacugauguucacuaaagcauggacauagcuuggcugcaucuuaauuagcccccuagaugaaucaaucagggagcccacucugagcauuuggacauguacaugcuuuuuugugaggggaauuguacuauagauaggggcugaaaacgcccaacucaaaagcuaggggcaagacccuuuaaauugaguuuugauaguuuauggacauucugugaauccuagggaggcagaaaauucuguucuugugacucauucgugcaccuuuaaggauauguagguugaagcaaauuaaaguuucaaauuugaaagauaaagccccuuuuccuagaaaaaugcauacauucaaaucuuuccuaggaguuuucaggauuuuuucacugaccugagguuacuaucuccuguuucaguuucaauuugacuuucuuagggcuuuauuuauuuucuacagggaauuuaauauuuuaaaacuaugcaggcccauacuugcguucuuguguuggugaguagauaagguucaacugugcuuuaaagccuuuuuacauagucuccagggucuuguaugagauccaaacugaaaucuggcguuacugcucugacacaacuugaacuucuaaagcagagacugaagcggagggaggaagaauggagcagcguguugguugugaaagguucguuuuuauaaaguuagaacgcgaguucuuuaaaaacucagaggacaaauauucacauuagagauuagaaauuguaagauauggaagagauuacauuuaaaauuugaaaccacaguuggugaucuauuagauuuuuggaucaaaauuagagcccugucaaauuguagggcaauaguugagagauacuaaaaauaucauuaaaugugucuucuguaguguacaaauguuucagaaaguguuguuuacucaacauguuucauuuucuuuacacaugaauuaccagaagcuaaguuaugaauuaaggauuuaaaacaaguuccauuuaucugaaguugucuagaagaguaugcuuucaguuaaguucauaauugaugguuuguuauuauugagcuagaaauucacuuguugauuugucuagauaauaugcauuguguuggaagagcaaaacuuauucacucuucauuuuuuaaauggaaagaaccagcauuugaauauguguuguauauguguaggaggauauuguagagaugaauguuuugauuuauaauaguguuauaaaugggcuuucaaaaugggcgacugagauuuuuccucauuuuaccuuaaccugagauaauuauuuauugaauuauugcucugugccaagaauuguguugggauuuuuugaggccuugcuuuuguaaggcuacuagaaaagaaaacaauuuaaaaagaaaaaguauuguguuagguuaugcuaugaucucugccuauaguuugcuuauaggcuuucaaucuaccucccguauauuggugggacuggcauguucauuaguaucauuggauuaucagaacgagaggaccuuucugauguacaauguuccuuauacuagaaauggauauuagguaauaacgcaccuuuaucaauuuuuuaucucagaaagcauauauacuaaaauauauguuaguauacuauguuaguauguuauguuuaauauccuaucauaaugaauugucaauuagugucucuuuuuuugagaaauuagcaauuucgagacauuguuuucucucgauugugucacacacuguuaaguuuugcauuuagguugcccauguuaacauucuucaaagaaacugaaccaguaaguguugugugacuuguagggagguugcauacauaaauauuugcucauauaaauggagaagccugcaaguauaaaauuuguggggcaggugggcaagcuggagacccagaaaguugaugcugugauugacacuagaagacaaucugcagguggaaucucuacuuuggagagagccucaguuuuuaucuuuugagaccuuccccuaauuggaaguguugguaaucugcuucacccagaauucauugacucuuaauccuguuuggaaaacauguuuagcaacuucuaguuuagugacuucuagauuauuauucaagcaaaucuuugaauauuugguauaaccaagcuaacauacuaaguuagccaugacaaaauuuuaaccacuguggggaaacuacaugugaagagcacagaagcaaaaguagaacaugaagcaauuuaaucucucuccccacucccacccccacuuaggagguagaggcaggcagaucucuugaauuuugaagccaaccuggacugcaaaguguguuccaggcuagccagaguuacaugagaccuguuuguuuuuuuuuuuuuaaagaguaaaagaacuugguauguuuagugaaugaugugguaccuauuacacugaggaggaaccaaacauacuguguuuaaugaaccuaaaauaugugagaaaggacugguugaaggacaagugugggaaacauuagacguccucaaguagaucuugaaucuuagggucaagugagggaucuuggauuucauuuuaaagaaguguuuuagaaugaauauuggaaaaggauuaagauugucuuagaagguacugaugcuagagacugacuggugaaaaaucuaaggaauaagaaaaaaugcaaaggaagccccacauugcaaagauaaaguuuaguaucgggggacauauugguucauuaaauuuugagaaguucuaccuuugucugcuagacaucuugaguguacaucauguaaaguagacccucaugacaaagaauuaucuggccuaaaauauaaaugcugccaaggcugagaaacugugacauauuuguagauguguaugggcacuugguagaaguagaaaagauaacuugcugggcauggugucacacgccuuuaauuccagcacuuggaaggcagaggcaggcggauuucugaguucgaggcuagccugucuacaaagugaguuccaggacagccagggcuacagagaaacccugucuggggauauauauauauuauauauauaaaaacucaacagaagguauuggguauuuuuaaguacugcagauauagucagccacuuacuuauacaguagacauaaagcucuauauaccauuugugagcacuaacaguuuuagguauuuuacauuuaauagucuucaaaggcaaccuagaauauggaaacaaacacacacacucacacacacccuuguauucaguguauuuuuuuuggauauauuauugucuuucuuuuccuaauauuaaagagauggcagaagcagggcagaggcagguagauuucugaguucgaggccagccuggucuacaaagugaguuccaggacagccagggcuauacagagaaauccugucagagggagagggagagggagagggagagggagagggagagggagagggagagggagagggagagggagagggagagggagagggagagggagagagagggagagagggagagggaaggagagggagagggagggagagggagagagagggcgagagagggagagagagagaaugagagaaugaaucaaacuuggaauucuagaguuuuaucagauuuuaagauaaucccagccuccuuguuuaaucaaugaucaaugaugaggauccagaugccuaacuaguaauuggcaauuuaaaucagggcucacgguuugaccucuuguuuuauuuauuuuuuauuaguauuaguauguuuuauuguuucagagcauuuucuuuuaguauauauuucuuucuauuccuacccagcucagagaacuagguacucagaauaccccaguuucagagaaaauaaaauuaauguuaauagcaguaagcaaccuaucauaaaagcagugauuguuaaagacagaaaacagaaugcguauucagcucacaguagauauucuuugagcauuuuacacagaagacacauguaaaaauuaagaauaaaaaugaagagaaaaugcaaucuaauaacaugcuuaaauaaauguucaucaaguagaacuguguagccuugggucuugcuuggaaauugcugaaauuuagaguaggaagcacuuagaugauggcuggauuaccaaauauaauauuuauauuucuucuacuuuuuucuuuccuaucauucaaaauccuucauuuugcuacccccauuauacuguuuaauuuuccaguuauuucuaauuuugugugauuuuagccauugagauuucaauauuuauuuucuuuucauuauuuguuugaaauuugaccuuauauaauauuucauuaguguguaggauuuccauuaauuuuaacacagauugugcauugaaguggguuucuuguuaguggcuguuauaguagacauaauugaguguaggaccuugaaacuuuuuuuuaacugugaaaugcugauguuuucaauuauuuaguguuaauaaacauuauuaaucuauaacaacaucuaaaaacauuucauaacuuuugaaugcuuuuccacagaacaguauucuuuugaaagaaaauauaaauaaauaccaagguguacugcugggcagguuaggaaaaccuauaaauauacaugucaauaguagucuuagguugcugcuguuguuaguuguuaaccuccguauggaaaacuugugcuuucugcuuaguaaacugcauauuguauguguauuccaggaaaaagccauuuuauucuuaaaaagaaaacauuuuuaaaaauuuuaacuuuccuuuuuuaguuuuaccaccuuucuccugccuuagaggcucagauuuggguuaaaauaccuuuuaauauuauuuuaauuauugcuuuccccacccccaccccuuuccuauuuucccccuccucuuucccccuaagcacacuguucugcaaagccaguaaugauugauaugauggcagugcugucauucuuuuuaaccaaaaaaaagucauuuuuguucuaguuauuuuaauagagucccauuaaagauguauugcugacugaaauaucggcaugaagggcucucacugagcugagcccaggaauuaagaagucaggauaucggcugcugcauugcaagagagccuugugugacaccgaaucuccugauuggggagaucauuacugcuauuaugacucgacuugcguaggaauuuuaaauuccaucugaaugucaguaauaacccucuuagcaaauuauccugaauaaaaucacgaaggcauuuuauauaauagguguugaauuacuggauagauuugcuaauuaaauacucuuuguucugcugcaguugacauuacaggguaagaucuugaacaauuauucucaacagcuguacuuuguuaagggaaaaauuaaccacaaaguuuauuuuuuuacacuugaaguuggcagauuuuugaaaugugcuugaaaaaaauuccaucauccaauugguaaugaguagcuaaauaugcagguguugcugugaaaucagauagcuguagacugccuuauuaaugaauuuagcaaucuuacagcccuguuugcuggccaauggugcuuauaaaaugauuuucugucagaguggcuagcuuuaauauuaggcuugucacuuugaagugaauuuaugaacagucaucauguauucacuguaccuuguguccaguagauuuuucuggauaucaguagcuauuuuuacaacuguauuucuucaauggagaaaauaccugugacauagaaguuuaugauuaguagcuccuaggacauucauauggguuggcuuuucuaauaaagcugugggaacacagaagaaaauguauccaaaggcccugcuucuagacuaggcacugaacuauaaccucugggucaagcauaauucuaaaucuugagguaaagugucaacuuaguuuuccucauuugucacaugggucuugugaaacuaccuacccuuuagggucauucauccaccaccaucagguuguucauuagugguccccauguacugggccuucuagaugcuaaguuuuguauuuauuggguauccaauaauagaaccauccccacugagcaguuggaauugaggcuugggccuaagcaagccuuuggaugguauugcuuauuagcacuuugguaacuauuggacucuguagguuacuacaguaucuaucauguagagcugcuuaguggaaaacaggaagauaguggucgcaggcucaugagaacuuugacuugagggcuuugucacuagcucuugguagaaagcacuggggaacauggugauagaaacuacauacaaaauuauagguucuauagugaguuuagcgggcuauauuuuucaaaaaugauaaaacauaaugauugacccaguaaguucacuugggggaauuucaauaugguuuauaauggcaaagauuuuaaacaaccuauguucaugaauagaacaucaauuggauaaauuaugauuucuuccuauaauggauuauuagucauuagaauaagugaguuguuaaaaugaaaguauuaguugacaaaagcaguuuguaguacugucuugccaguaacagcagcaacaacaacaaaguccaaaucacucaaaggguuaugccucuagggaagauaguuuagauagcaucuuucagaucaggccuggaaauaauugagucuguggcagauuagaacagaggugaauguugaaaguugcuaggucaugcaccgggaugauagcauagauuuguugcacauuaugaaagaagaggaacaaaaauugggucugaguauguagugaaaauugacauugauccugggucacuucauuugcagguaacagcuaccucaguuacuuagggaguuuauggaguuggucaugugaugcgaguagcugagucuuauaaggagguggagaugaaccuuugauaagcaauuuguccucucugugauuagcuuaacuuaggccaaucucacuauuucccuuuccccaacccaccccccaaaaacuuguuggguauuuucuacauugcauuguuccauaauuuaauuuuaguguuuauuagaaaaacaaauucagauuacuguaggaccugccagucacuuggcauacaguuugauugcuugucaaaucuaaggucugcaggugugaacaugcccuugggccuccagaaacguguggucuaacuggggaggguaauaaucauuaauaguacaaagcaucauuugguuacuagagaagccgggcaagaacagaucaaugagauucuaggcugggacaguaagcucaggcuuuauggaauaaaauucaguuuaaggugaacuuuauaaauuguaauuauggucagaggacugggcaagaaaucucucuguaugagugaaggcaagaaaagaugaaccuguaguaugguaacuauucacagacugcccaauuucccuuggccagcuaagguuuugugacggaaauaacagcuguacagguagagcugggguuuagauguaguuguaaaauuucaacuugaucuugaaaacauuuuaggagauuaguccuguuucauucaaauuguaagcaguaagaaaaguuacuuuacagaugucauucagcaauaaccacauaaaccugcgagucaggugcuuucucaccauguuccuuugaaccuucuggcguaggccuucaugaucaccgugaugucuuuuguugcucacugucaaucuauacuacuggcuuucuucuaauucucaugccuuuuacaugguaauaucuccaaaauggaauuaccaugguuuucuuggaccaaucuuaagaaucaucuuuggaagucuuuuccaaaacuuugguuagagacauucugagccagauacugaaugugugugugugugugggggguauguugguguuuguuuuauuuaguauagaaaaaaauagcaccauguaauaaauuuuagaaagccaguacucuggcauaauaguucucaacaugagucagggagaguuuuauaccaggaacaagcucuggagacaauuuugaucgucagugcuuuaguuauuuaagaauccucagguaauuccacuauauagcccacauaaaaacuagugguuuagcuuaauagaauucaccacgcgcccccccccccccaaguuauggaagccaugaagaacuuuuggacauuugaacuaaguuggacaguaguaaaaacagauaguuggcaauggagaugagaagugauggauagauguauaaucugcucaaaggcaaguacucuugucuguguacuaagcuuugucuuacuguggagcacaacaaagacugaaaugaaacuuugggauuucaguuagcuggcaagguagaaaaaaaugaacgaaggcauccuucuguucgacauacuggaaaagagacuucuaauuuagauagaugcauaaacaaugauuaauaccagaguggcaauacuguggagugauuaagacuucuguccuauagcccagagugccugguuuuguacccuuguuuugcugugacuaggagaaaggaauuacuuucuuuuucauuuggcagcuagcaaauggggauauaaauaguagcuaccucuuggagaucuuggggaaagaaauuauagaaugugggaagugcucucagcauaguauuuugcacaugauuuaauauuuccuugccucugucucuguucucaguacaucauauuauuucuucagaguuuuuccacauauuaaauaugaugcuucugauaagguucgagguaacuuacaucugcuuuugucuguguguacauuauuuuauguuuuguagccugucgaacgugggccuggaaacagacccauucauaauuaacuauaguaguuuucauauacuguuuauugaaauucaccauuuugcugggcacugggcuaacuccagggcaugcagucaucuucaaggaacucagccuacaaaauaauuuuaaguuaaauggaauacuuuuaaaauucugaauaugggugugaauugcuagauuuuaagugcuauaaagcuuuuuaaaaaucauguaauccuauuaaaauauuaguacugagaauaaguggcccuugccauauuauuaaggaguacauuauuauauauguuuauuaaauacacauagaaauacagauauuuaucagauuccaucucucuauuaagcaucagccuagagauuaaacuuaaauuauaaugauguuauuugagaguaguuggugugauauauucaagaguuucaaagaugcuuagaaauuggaaaucucuuguacuauguuuaugccucuguaauuuuguaauauauuaauguugacuuuuguuuuauuuagauuuugaugcauacgaaagacaugguacagaagguaaugcugaacauuuucauucuaaaacaagucuuaaauaugccaggugacaguuuugugucaagaaaaaguguaaccaaaacauacugaaaauuggguuuuaggaugccuaguguacauuuauaaacccuccuaauagauuacagccuuuucucuuguaucagcacugauaugcuagcuccugcuugaagccuguauguauuucaggcaaauuaguaaugguguuaauuagaguuuauuuccauuccuuuauacuuauuugcucaaguguuguuugcuauugauuuuuggcacuauuuauagucuacuaaauauuguuugaggauuuaauaaauauuuaugcccuagaauuuuuacauccacauuuuuucacuucuuaaauugccaugaccacuaaguacaugucacaaugguuaaaaaaagacccuguuucuuaggcuuauucuuauuuuuaucaaauuccauauuauguuuggauugaaacugcauacaauuaauucucccagcauuuuuaggagaaaauuggaaagguuuucuuaaucuuucacuacuuacauuucuaguucgugaagggcuuaauccucaauugugugccccgauaguacggauaguaaguaacaugacuugucaaacaucaauggcaccuauaguuucuaguaguagaaaccuuuacuuucauuuuauauaacaauucauguguuuuuguuauuaauuuuuauacuuuugccuuuuuuuagaugaaucuugaaguuauuuauggagacacagauucaauuaugauaaauaccaauagcaccaaccuggaagaaguauuuaaguugggaaacaaggugagauaguuuaaugauugcuuuuuaaacuuggguuugugaacucuguguuuaacacaguaaauacaauaaguucauguguuaggugcaccuguauccuuuugaacauaguaaguguggugucauuaaauuucucauucucuuuaauuuuucuuacacucuuacuuguuuugagacaaaaauucaaaggcaauugguuuccuuaagauauggauaacauuuuuccuguuuaaaaaaaguuuacguauagucauuuuagaacuucucacauugucauucagaaggaaauauauaacuaguaguauucagguauauuucaaagagagguuugaauggauauuuacuuaucuccacauacauguguacucacaaacacucauuuaauuuaauaggauuacuuaaaauauauuagaaaauacaaaggaacauuuagaagcaaucauugguaguuaagauuuuugucccaguauucuaaaauuggaaauaucuuaggaauuagcauuuuuccuuacuggaaagugugggauuugaaccguacucucuacuuguacagugcaucgaccuuuuguacuccuuauuggccuugcaaagcuuuugaguuuucagaagacgcgaugauuugugccuuggccuugucagcagagugcaagaagggcuuuuguuauucagucagcacauaguuauuuaaugugccaaugucauuuuuggauauuauuuaacaaaguucuauauaauguuuuugcccacauacuaguuggacuguguaguuguuaauucaguaguuucauggcaaauauaugcauugucuuuagacucaagaaagaacuucccauaguuauuuccuggagucaaacgauccaguccuagccuuuauuuugguggaauuauauguaauauuuguguuucuuuguuaauuuuuaaaaauuuuaaagauaaacucuugcuauauggcucuugcucuccuugaacucuguaagcaccgaacuuugacuucaauauugaauucaucuugccucagcuucccaaguuguucagaucuuuauuuuauuuuuaauugguuuguauccaguguguguguguguguauauaugaguuuuauccagacauugucauauauguuuauauuguacuuuucgccaugguccucauagucuuguaccccuaaauaugagugaaucccuuuuguucucuuaguuuuguuucuacuuucuauaaucuacuuaucauaugauuuuauauguguauggauguauacauauauaaucuaaaaucuacaaaugaguggagacguguaauaauuguuuuucugugucucucaacuaacuagaugaauuugauaauuuauuguuguaucuauuuuauacauacauuauaauuucauucuuuaugucuagaaaauuccauuaugcauagguauaaugaauguuuuuuaucugaaccucugcuggacaccuaggcuaauuuuauaacuaaguuauuaucaauaaugcuacaauaaaaauuuaugaaccaauaguucugugauauucugaugucgagucuucccaguaaauacuggaaagugauguuaaguucugauuuuuguucuguuacuuaaucuuaauguuuuuaaguugugcacuaaauaaaucuauguuauauaaguugaauaauaauuuuuaauuaugugcuuucaaguuuuauugaagaaaacucaggaauucauagcauguucaucuuuucccuguuaggcauuugaaaaucugacaauaguauuugaaauuuuuacagguaaaaagugaagugaauaaauuguacaaacugcuugaaauagacauugaugcuguuuucaagucucugcuguugcugaagaaaaagaaauaugcugcucuaguuguugaaccaacaucagaugggaauuacauuaccaagcaggagcugaaaggauuagauauaguuagaagagacuggugugaucuugccaaggacacuggaaagugaguuuaacuuuuauuuacuuuuguuguuggucuuuugaauuuuuguuuaaaaaaaaaaaaaaagauccaagggcaggggcuggagagauggcacagcaguuaagagcacuuacggcucuuccagaagaacuggguucaauucucgccauccaaauggcagcucacaacugucuauaauucuaagaucugacaccuucacacagacaugcaugcaggcaaaauaccaauggauguaaaauaaaaagaaauaaauucuuuuuaaagaauucaagugcuauugaaaugucuaugagucugccaaguauaaggauacaacuucccucuuuguuguuauuguuacuauuacauauuacaaauaaaauuuaacagauuaaaaguuagauaaugcuaaauuugcacaagaagagacacugguuuuaagauagcaucuccuggugagaauaaaucuuuacaccuggauccuuagagagcugauuuuguugauagugcuuuuuuuuuuuuuuaauuccuguuuuugaaaguguuguauacugaaucccuagauccuaauuauaaacauaauuuuuaugauuuuucuguuauguaguuugaaaugugcaauuaaaauugagccauguaguagacuuuauuccucuauaucauuuguauauaaaugauucuuacuaaucucagauuaauuugagagcaaguucuaaaauacuguguucacuucugaaguaauaauacaugaucuacuagccuugcaaauuaaagauuaugauaaaaauauguguucacauuaaaguaugaaguacccauuugaaaaauuaauacuucaacauauuauauaucaucuuucacauauuccuauauugugauuuagaucaguucugaaaacagaaguuuuccaugauggcuagauuuaaaaguacuaauuuaacuuucagguagauagcaacauuuucaacuuaucuuccaaucuucuuccugcuugcaaguugagaaauugaaugaguguuguuuccucuuaauuaggcaaaggugcucaucugaguauaggccaugcuucgugucuuaggaaaugugcuuuggaaugcuucauugcuccaaauauacucaaagaugaaacuacuuuguguaggcugucaauuguucuccuuagcuuucuguuuucuaaggaaagaugcauaauuauagaagcaaauuucucugaguuagaaauuuauuaguaauuaaagcuauacaaauguuuucgucaggguucuuuuucugacaaguuauaaagcagcugucaaucuccugaucugcauuuucucagaaauguauaaaauguuggcuacuuuauuuuucuugagacuuuguacaauaauaugaaauuuuugagugauagccuaaaaguuagaacauugaacaauuuuuaaugauccugaaagaaaaaaagaagaguuuuauguuuuggaauuuuuuuacccccuuaaaaguuuaaaauaaacuaaaaaauaaacuaaaguuuauuauuuuauguguaugaguguuuugccagauguaugucuauguuagugccuggugcccauagauuccagaaaagggcauuagaucuccaggaacuagauuugugagcuguuaugugggugcugacaauugaaccuggguccucuggaaaaacaaguauguacucuugguuuuuuugagacaggguuucucuguguagcccuggcuguccuggaacucacucuguagaccaggcuggccucgaacucagaaaucugccugccucugccuccccagugcugggauuaaaggcguguaccaccacugcccagccaaguauguacucuuaaccuuugagcuaauuuucuagccucuuagauuuuuuaaaauuucuuucuggagcuuuauauuucuucuuaccuagcuaaauagccaucuuagauugagaugcuaucuugauaccagauaugcuaucuuguugcuuuaugaauaaagauaacauuuaucuucuaaaauuuuaacuuauggguagaauauaaucgcuucuauauuuuauaaucauaaaaucugaugacaaacauuuuucucuguuguauauaaaagcauuagccgcuacauaaaugaguagucuaugucaaaggguagaccuggaauucguagguaaguaaaguuauagaagaguuaauauuuaaaaacaaagcaguugggauuggggugauggcuuagugcuuaagaacacuuguugcuuuuguagaggagcuguguuucauuuccagcaccaaccauccuuaacuccagugucacagaacccuauagcuucuucugaccuuugccuaugucagacagauuugauaucagacauacauguaggcaaaacguuugcucauaaacauaaaauaaaaugcaaauugccuuuuagacacuaaccuucauaauagcucuuggcauaaucucuuguccacaugccaaucuagcgacgugaugucugucuuuucuuuguuaaugacauaugaugaaaaaucguauuuuuuucuuuauacagcuuugucauuggccagauucuuucugaucaaagccgggacaccauuguggaaaacauucagaagagguuaauagaaauuggagaaaaugugcuaaauggcagugucccagugagccaguuugaaauuaacaagguaaauguagcauuuauugcugagcccagcugcugucauguguuuuucuccuccuucagauaguugaagaaccaccucauccuugcaauuuaaauaaauucuagcugguggugaaagcuccuuaacaacugucucacagauugaacauuaguguagcucucucagccacagguacugccauggcugccacagaugaccucucuuucccuuuuacuuccagauggcauaauuagcuugugucucaaggccuagagaauguuccuuuuuucauaguccuguaaaguaauaguuguuugaugcauagaucuguucauucauacucauucuuaugguuucacucauucuuccgcucucuuccuccucccugucccccuuccucccuauuaccuguccucugucuccuugucuuuguccuuuuguuccugcucccaaauguguauguaaauguuacuucucagauggugauccgccuaguaucuguagucaaaagauuuuuggguacagauucaguuagaauuaagauagugguaaccacucuauaucuaaaguacuuguacaucuuaaaauaauaucacacuauggauauggagaucuuuuccaaccuauaucuauauuaugugaaaaaucauauaugcaagucccuaugucugacuccuagcacucauaaacaaaguuaacacauuagucaucuauuuugcugacauguuuacuuaauuuuuuuucauuaaauuuuauuguaaauaacuucauugaacaucuuuguucacuuguuauuuuucauccagaugaauucuuuuuucaaaagacuguguguuuguguguguguguguguauguaugugacuauacugcugcugucuucagacacaccagaagagggcaucagaucucauuaugggugcuugugagccaccaugugguugcugggaauugaacucaggaccucuggaagagcagucaauacucuuaaccacuaagccaucucuccagcccgaauuacuuucugguacaauccaugaaauaaaacaaaaacaaaaacaaaaacauuuguaucaaaagauacaacuaccuaucugaauggaucuaggaaaauuguuuugugaaaaggugguaucaguuaauaauaacaaaauaugcaugcuauuuucaucauaguuccuuugaugauuuuuuaaauaaaauauuaccaccauuaguggauaugaagcuuucacaaugaguuuaacuuguuuuuauuugaauuucggagagaagacaacucuuagcauauacuuaagacuuacauugauucuuagaucaauuuucucuuucucuacccugaccaucauguguuuaauuaaaaaaaaaaccaaagacguuuauaaugucuacauaucauaaacauaucccaccuggggcuguaugugccuuaccacuagcucuucacuauuaauaaugaagugcaugcacaugauggcaucuguagaguguuuugcuaagaagcaucaaugaguucaucauucuucuuuuaguauuuaguauucuaaauacagcaucuauagcuguucuuugucugucuuuuuccaaacauggcugucagugacaggaggcuccagggacagagaaauuuaaaagaaucagucuaagccugacuauauuauucacaacaccacaaaugcaucuacaaggauucguguccucacacucuuauuggcucauauuacaguauguaagaagaacauuagucaagaauauagugguaucucugugucuacauuaauauuuuuucauuugguuucaagacagggucucacugugcaguucuggcuugucuggaacuuucuggguaaaccagauuucuuugccucugccuucuuagugcugagauuaaaaguauguugcaccaagcccagcaaaggggacugaacucugcacaggccaggaaucaauuucagugaguuuacuuguuuuuauucuuuaaauuuccaaacagaaggaaaagaauaauaucauaucucuaguaucaguugcucaaauucaauaauuauuaucuuaugcugagguuacuauuaguaguaaaaguuaauacuucauguauacuauguuaauaagggcagugaaucuuacaguuuacuuauuaaaugugucugaguguauacauauguaucacaugcaugaaggagcuguaggaguucagaggaggaagucagaucaccgaacuggaauuacuggcaguugucagcugucauuugagugcuggaaacugaaauugugucuucuguaagaacaauaggcacucuuuaaucacucagccuucucucuagagugaccugugcucuuuuaugugaaaagaauggaaacugauuucacaguguuauauuuuccauuuuuuaaguguaauuguugauaacuaauaguaauuugaugagguauaaaagaauuugcuuguuuaaucauccacuuagcagauagggaauuccuuuuacauguacaguaguagaugcugaaguaagucaaaugaggaaaaccuaguucauuucaaauugauugauugauugauugauugauugauucacucucucucccucuuccucucccccucucccccucucccuccccccugucugucugucugucugucugucucucucucucucucucucucucucuucccccccauucacuuuauguaccacuuacugcucccucccagguacacccucacacaauucuuccccuaucgccucucuucugggugggugugcgcccccccccccauguauugcccuccccuggcacaucaagacucuuugaggcuaggugcacccucucccacugaggccagacaagacagcccagguagaagaacauaucucacauacaggcaacagcuuuuuggauagccuucacucuguuguuuggaacccacaugaagaccaagcugccuaucugcuacauaugugcagggaggccuaggugcaggccauguauguucuuugguuggugguucagacaaugagugccucaaggguccagguuaguugguuuuguugauuuuccugugggcuuccuauccccuuaggggccugcaauccuuccuccucuucuucuguaagaguccccaagcuucaucuacuguuuggcuguggcugucugcaucagucugagucagcugcuggguagagcuucucagaggaaagccaugcuagacucuugauuauuugcagaguauuuucuggcccauugucuuacauauuaucccccucucccuuccuauuucucccucucucccaauucccaacccauccuuuuguguguguguguguguuuguguguguguuuugugugugugugugugugugugugugugugugugugugugugugugccaggauaaaugcagcagaccuucuguaacuuucucugagauagucuuucacuggcccagaacuugcuggguaggccaagcuagcugaaugggaaaccccagggaucuaccuguuuuccuucuaucuccccagugcuaagauuacaagggcaagucuauacucaacauuuuuaugggguuuugggggucaaauucaguuucuucugcuuguaaaguacuaugccaucuauaucuucuuugcuccucuuuuguuuuuuaagacagguugguaucucauugacuuagagcuuauugaauggguugcuggcuggcuggccugguaguugcagaagucacagggagcugccugucucugccucuccaguguuaggaugacaaguacuagcaacugaucaggcugcuuuuuuguuugcuuuucuugucauggauuaaacaauuuaaugacaaaacuaucuuucaagcccuuuaaaaauuucuagauaagaggguuuuuagauauaguagugcauacccagcccuugggaggcaaaggcuauuuaagguucaccuuuucuguuuauugucuuugaggccagauaaggccacauaguuugacaguauuuuuuuuaacuuuuuguaguguuguugaaaguauaguaaauugugaugaauuauaucaugguuagaggucuguuucaguuuagaggaagcuauucauauaucaaaggugaguuuuuuuuuauuuuguuaaucuuuaacauuuaccugaauucuuauaucauuuaaaauuugggaaauucugaguuuagauuuuacuguuuucaaaggagaauggaauagaaaaagaaugacauguggaugguauuagaaaaguaugauggguuuuuuuuuuguuuguuuguuuuuauuaucuuuguagauaauguugguagagcuugaaaauggcaaguuagauuaggauggaggccuacauaaagucgugagauuuaccuuuguggagauucuaggccuuguuaaaaaagaaaaaaaauuugauuuuucuggaguauuggaaucuuauguauuuguaagauaucauaacaaacuuugaaucuugcuuuuuacuagucauggauaccuugagcuuauaccacuacagugcauuuaaaauauuuuuuauuuguuuguauuuuuaaauuuuuuuaaagauuuauuuauuguuauaucuaaguacacuguagcugucuucagacacaccagaagagggcaucagaucucauuacggaugguugugagccaccaugugguugcugggaauugaacugaggaccuucaaaagagcagccagugcucuuaaccacucucuaggccccuuaaaauauuuuuaaauugcaugucuauguccuuggagcuggggugacacaggcuugugcauauguacauguaugagugugggggcuucauacaccaugacauacaugacaaggccagaggacaacuugaaggagcuagaucucucugucuaccauguggauccuagagaucaaacugggaucacccaucagcuguccuaccaccucaucccguguguguguguguguguguguguguguguguguguauguguauguauguauguauguguauauauaccauauguauauaugguuucuaaauccagcuuucuaaaucuuugaauauucucuauuucauaauuagaaacgcuguuccauaauguucagaauuucucaauauuguacucaagaauagucauuuguugaaaguaauuauuuucuuaaauaaagcuguuuuuuucccaagaugucuaugcaauauugcucauucaagucauaguccagauuaaaaaaaaaaugaaauguauuaggauagcuuccuaggcacucugauggcuuaaguauacuacuuggaaaguacaugcaaagucauguuugaugaucuacuuuacuccauaucaguuuucaaauuccuuguucucaagaguuuguacuuaaaguuaguucaaucauuuaagagcuuuuguucaguugggaugugcugguauuuauuugcuaaaacuaauagauucauugcuaaaauaguuuuauuugaucacaucuuuuuuacauaaaaguaacuuuguuuuuaaaaaguaaagauaccuaguggaauggcguaguuguguaauauuucauuaguaugaguauuuggccuguugugcguguugcacgcuugucuuguguccauauaggccagaagaggcauccaguuucuuggaccuggaguugcagauagauguaagccucguuggcaagaacggaaaguguucuuaaucacugaacaaucucacuagccucccauuuuccauuuugcaaaaacucuuuacuaucuaucuugguagauacuaucugaacuuuccugccuacuuccuauuuuguugugaaguaugguuuuccugauauguaaaaauaaauuucaauuguauagagauaauuagaaaaaggcaaaaguauuuauuuuucuugauagcuuaaagacucuucuuugaucuugcauuagaauucuagauguauauuuuuagauguuaugugugaugugaaguccaaaaccauuucaguaaacuguuuaguuuaaauuuuuacuuauuuuuguaaguauauauccauuguauagaauaauguguuugcuguaugccaucuuuguccauguguaucauguauuuuuaucuuauuuacuuuauuuacauaaaguuuauguauugagcuuugaguggguauuuuaucaguguaugacauuguggaaugauugauuguugguugauucccugaauuauguagauauuaaaaugaguguauuucaaguccacugccuaaaggcauguuaaaauauucuuacuuuauuagaaauauccaguauuaggaagcuggcaaguucucagaaguggaaacauguuuucuaaauuuugcauugggcuugaaagguuguauuugaugauaccuauugucagauugauuuuuuuuuucuucuugaaguguagcagguuuuauuuaguuuagguuuuuuguuauugagaaacugcugguucacaugucaaaauaaaaauaacuaguuuucuuaccauucuuucaaguaaaaauugcauucuauguaaauagcaguuaguuuagccuguaacucaaauaguugcacaguuuuccuagaguaaccuuuauucuucagauaugcuuuguauauucauuguguuucaucaauacaaaauaguagacuuguucucaagguuaaaaacuuuaggaauuacuaacuugcuagauaagcugggucaugcuuguaauaccagcauucagaaaguuuaggcaggaggauugccucauguuuguagcuagccuguuuucauaccgaguucuaaagucaacuugggcuacagaggggaaacugucccccucaaaguuccuagacuuuacugcaucaucaagaauguucucaagugaaaguaccuugcuauggugguagaaagaauacagugaguaucaguacaauuaggugcuucucuugggauucauauuuuuaaggcaucuacaauuuuacccaguuuuccuucuguaucaauacaauaccaguguuaggaaguagcuuucuucugacuggggcuguuccagaucuugugugcacuuucuguuacaaacuuauugcuuauguugauauucagaguaaauucagugcugugugguacauuguguguguguggggggguguuuuuuagucagagaagauuuggagaaacauuauuaagugagagagaguagcuguuagucuucaaucuaacuaaucaaaugagaaaauuacaaacaugaggagaacucuaaggcuacauagaacacuggagcuagagucuugauuauuuuaaauauucaaauauuauguggcaaagcccauuaacauauuuauuucuuaggcuucugugugguuaugccaguuacuaauugauggagagggaaaucuugaggaugaacuguuggaagauucuauggcuauguugucugcauacacacuauuauguuauauguauauauaugauucuggcaaaaaucuuugaugcauauaugcauagaaaguuucauucuaaauuuuggugggguuuuuauucccucucuucugucuuuuaggcauugacaaaggauccccaggauuacccugauagaaaaagcuuaccucauguacauguugcacuguggauaaauucucaaggaggcaggaaggugaaagcuggugauacgguguccuauguuauuugucagguaaaacgauucuauuguacaagacuugugcuucuuaagaauccugggcugggaacauggcuguaugggaaguguuugcauaugugaagaccuuaguucagaucuccaguccucacaaaaaaagacugguagaguagcuuauauuuguaacuguaguacuagaggauggggucaaauagauacucagaacuugauggcauucauugaaugacucuguuuuaaaaauauaaagaaguggcuuagcagucaagaacgcuggcuguugcuccagaggaucuggauuuaauucuagcaccuauauguuggugcacaacuguuugcaacucuaauccaggagaucugacacuuuucuggccuccucagguaccagaagauacacguguguugcacagacagacauacaaauaaaacacacgcacacauaaaauacaaggaaaauauaagguagagugauugaacaagucaccugauacccaccuguccuccacauucaugugcacacaugaauguuuauucacacuaagucuuggaaucuugggucaaaucuagauugccacauuaucuuacuuaguaguauucuucuaaggaacuggucccauauagagaugguuuaguuuagcuagcuuucaagucuuaaaaaaguuaugggcuggcgagauagcucagugguuaagagcaccgacugcucuuccgaagguccugaguucaaaucccagaaaccacaugguggcucacaaccauccguaacgaaaucuaaugcccucuucuggaguaucugaggacagcuacaguguacuuacauauaauaaaucaauaaaucuuuuuuaaaaaaagaguucuauaaugguucaauucaaguuucacaaagaauucaaaguagcauuuggaggucauuugaaauuagcuuaaugagacaguuuuauaacaguuacuacuguuucaaugcuaaaauaauugcugugaaaaugucauaggcugugauuauagcuuagugguugacuacuuacuuaguaugugugaugccuuguguuggauccccaacaauacaaaaagagaacaggaaguauauguacuuauggugguauguccagcaacaguaguagguaguuguuauuaauuguucuucuugugacaguuuucauuaugaugagucaguagaauaguagaauaaaugguuugucuuccuuacuuaucaaauuacuugaaagaauguguagcuacauggagaaaguugaaaggcuugaagauauacuuuauggaaaaaacagaaaugauccaacuaguuuuuccuuucuccucacccaucuuacuuucccuucuauaggcuauuuccuucauguuucccuuccuccuauucugugagacaccucuaaggauauuguaaucuuucucaacauacuuuacaacugaaaaguaguuuuguuggagaguggcaugucauuaacaggguccguagggaaguagggcaggguaggacaucaggguuuuuuucucugaaagugcuugacuccaguuggaagaaaagaacaucaaacuuuucucccugcaugcaaaaggcaguuaauaaucagccucucucaaguucuuuaaaauuacuaauggauggccuacuucacccccaagaaauaauucaucugaguaagauuauucuuuuuucauuaguaagagccauaguacauuauuacaguaaaauauuuagguaaaccuuaaaauucauuucuguacaauugaccuuugcuagaacacaaccaguaugcuucauaagcagaaggcuucaugacagucagaagcuaguguguuaauguaauaucugccacauacuguagacgauguacauaacaaugauaaguacauggacaggaaucagcacuugacucuaucucccuccuaggguuacccuugauuaagaacuguuagcgaaagccaauuccugcaggaaaauauuuccauaaaugucuggcuugcucagauccuuaaugugcuuugcauauugcuucugacaagucucaucucaaaaaaacaauuuucaaauuaugcaaauaaagauuuugguaaauagacuaguuuuuuuucacuuaugucuucacauacauugagaagcucuuagauuauuaaugacaagaacagaugguagcuuauaaguuugaaaaauaauacagguucaguaaaauagcaucuaaugauaaaaucaugaagguuaaauauuuuguuuaaaacuagaauggaggaauuugguaaucuauaaauaguaugauagauguauuuaaaagucaaccuuguauuccuuaaugucaaaauauuugguauuauucuuguuucgauuaaaauacaagucuuuaaaaugcugaugcuaaugcaguacaauaagcccuauuugaugucacuuuagcaucuuuccacccacuuaaugcugguccuucauuuuaaaguacaguucauauccguguuuauuaacuuauuuuucuuuagcacauucuuagaaauggcaaaggauuuuaauuugcuauuguucuucuuagugggacaagcuaucuuuaaucauguuugcuagccaaagcuuccugucuccuuuuuuguuaaguuucauagcauaauauuuagaagaaguuugugaagaugucuuguaacaaauuucuaagaagauuguguguugccuugagguaggguguucucuaagaauagccuguuuuucaaauagguucaguuuuauuuaauauuuuacauauagaacacugacuguauccuacugguaacucaaagcuuuauuuuuauacuuuuggugaguguuuugcccacauguguguguguauaacacauaugugcuugaugucuggaugcagaaaagugcaucagaugacuuggaacuguaguuacagacuguugugagcugccauguggaugcugggaacuguaucccaguccucugcaagagcagccagugcuccuaacuguugagccaucuuaucagccuuuguuuccucauuuuaaacuugcacuuaguuuucauaagucauaauuuuuguaaggcaaaccuuuggcauaauugcuuuuagauuuuuuuccauuaguuuuccauuaacagaggcuccuguagaguaccuaguuauccccaaaauucaugaguggauaccucaagaaagaccaacuuugcuuccauaucuguucuuaaaagguguaugucacauguucauguaugccaaauucuguugacaucuuguucaguuuagggacuacaucuuucaguaauauaucuuaggugagagccuaaaugguuuuccagcacacauuauaaaaccuguuagcuaaccaguugugaaauuugcuguauuugagcuuagguuuuaagaauacaguaggaaauacguugggcucacucuuaguuagcuacaagcuauuuagagguagaaugcugucaguagaaagaaugcuuggaaauuugcuucuggucuuuagaaauacaauacuccuuuaugaaaucuuuuagugauacauauuugaaaguaacucaaagcacuugguggugguuguuuugcaguucuuuuuuaauuauuaauuuaauauuauuuuaaauuuauuucuuacacuccauauuccauucccuaccccccaucugcccucugucugcuccacaucccacaccuccuccccaccccacgaggaugcccccaccccccaccccaccuaaccucuaaacuccuuugggccuccagugucuugaggguuaggcgcaucaucucugaaugaacacagacccggaaguucucuacuguauguauguuggggggccucauaucagcuggugugugcugucuguuuggugguccaguguuugagagagaucggggauccagauuaauugagacugcugguccuccuacagggccacccuucuccucagcuucuuucaaccuucccuaauuaaacaacagggcucagcugcuucuguccauugguugggugcaaauaucugcaugugacucuuucagcugcuuguugggucuuucagauggcagucauaggaccauguguaugcuacacaaauauuuuacuuucacuccaguucaccagugccuuaauuuuuuucacuuacauaaaauugacuuuaauucauuauuuaaaaguaauugaguuuccucaguguggugguguaaauccagcucuuggaagguagagagaggaagaucaguaguaguacaaggucauccuuugauacagcacuaagcuagaagucaaccuagggcaguauaagaucagccucaacagcaacaaaaaaucaugagagaaaagauuaaauucaacaaaagccuaauucuauagggugagcagauuucugguacuaaaaggcagucugaguauagcacaugaagacauagccugaugguuguuuucaaaugcccagguagcagcuguuaccucauuuccaccuuacaauucaguuugcuuaaaggacaugauuaagccucauucauucucauuaauuuuuuuauugaguuguuuaauauggacaaacaaauuuuaaccugaggguagcuuucuuucuagaaaauucaucauacuucagaccagguagcaccuaauugaaagacagauaaauucugcuucuaucaggaacagaagcucaaagaguagguaggcccugccuugugucucugguaaagaccaugauguggaagguugccuauguuuugagcugaaugcugagcuuagaagagacugauuguggcaggagugaaagaauaggauucacauuauaaucaguucuacagagcagcugagcacugugaauaguuauaauuuacuagugugaauauuaaauucuguuguuucagucaagaggaagaguggagugaaucauuggauguugguccaguagaaugaugacuuuuugauucacagaugucagcgacaucacuacagagcuguaugugagcuaauuaagucgaaucucacaaguuuaaaguauaaaacaaguagccccuaagaagaguaucuaucccaccuucauuugcuugaggagagaucagccuccuccuuaccccuuccacuggucagguauuugacuuuagaguacugcugcuguguagguaaaucaguuacuuuccuugucacugugauaaaauaccccaaagaaacaaaggacaaaggcuuuauuuugucacacaguuuuuggaaaggcuacaugcuucuaugguuggaauuguggcuggaaguaauugcauuaauaggauaaaaggaguguuauuuauucuuuuauugucaugucuuucacagucagcuauuggaugggucacacggccccuuauggaggagcuagagaaauuaaccaaggagcuaaagggaucugcaacccuauagguggaacaacaauaugaacuaagcaguacccuggagcucuugucucuagcugcauauguaucaaaagauggccuagucggucaucacugcaaagagaggcccauuggacuuccaaacuuuauaugccccaguacaggggaacgccagggccaaaaaggggcaguggguggguaggggauuggggggguggguuugggggaccuuugggauagcauugaaaauguaaacgaggaaaauaccuaauuaaaaaaaaacaaaaacaaaaacaaaauaaaacaaaaaagucauucucaguagacuaauagucacugguauuuucauuccuuuuuuuuucuucauuuuuucuuaugauauggcagguaggauuauaaucuagcuagugucaucuuacugguuuccuauccugacagaaaagagcacaauacacuggauuuacauucucaagcaauggauaagauugagaccaaaaaguucuuggucuuucuagucuaugauacaugugagauuuuuaacagggcaagacuucuugguguuuggaacuaaggacauaaaauugaaacuuuuguucaucuauuugauuaagcaaguguaugugugauugaguugcuuacaacuuuaugcugugucuucuuucaggaugggucaaaccucacugcaacucagagggccuaugccccagaacaauugcagaaacuugacaauuuagccaucgacacccaauacuacuuggcccagcagauccacccuguuguggcucggaucugugagccaauagauggaauugaugcuguacucauugcauuauggcuagguaagugucccaaauucaugaaaagcugcauaaaguaguagugauaugcauauuccuccuguguguguuaguaucccugcuugcagaagcaagagugugucuguuacuuuuuuuauuguucuuuguaguugcuugccucaucuaucccaccagaaugugagcuccacguacuugcugucuuuguaagucugggccuacaggugauauucacugagugcugaggaaaggaagaauuuuauguacuuauauggucacagugcuuccauuuuuaaaggucuaauuagucaccuuccauuaauaaggagguuaaugauuuuuuugcaucuugucuaaagguauuuuguuauaaagugagaaaaugcaacuuuaacuuuuagcuuuuacuuuaaauuuucuaaaauuagacucacuguuauuaucuagaaauuggaugguucuuaauuuaucaucaucuccagagguggcagcuaaccucgaggcaccaaugucucuuugauuuuuuuucuuuuuacaguucuaccccucuucuaugucauuauugccauauuugcuuuaaaauguguuucuuaaacaucccucauuucaauucuaagugaccagaacauaguuauguugcuuuuaaggucccuacucuauucuauaguaagcaaagcugaauauuuuaaaaauacugcuaaauccuuagaugguaccucauucuccauaaaucaaguacaguaaugcuacugacauacugucuuuggcucugacaauuucagccuaguuucuaacuccaaccuauauuaaccuuguuccuacucugugcauuccuuguucacuaaauaauguguugcucauuuucucucuauuuguuggaaaaaucuucucucauuuugacuacaaaaugagcugcagugucauaggacauuggcaucucuaggaccugguuuagauauuaacaagccucugaaacuuggucaugcauugauuuauuuuuuugcagggagagguaauagaauauaauugcuuugacagagauaagauauaucugugaugcucagcacaggacuuggagcagagggagugcucagcacauggugguauauugaccugccaugcuacuuucuaaauccaguguaaauauguccaucuucuuucaguccauaggauuuaugaauagguaguauucaguaugucuuuggaaugucauuggauuuuccaaagcucauuaaaaucauauauauuccauccugccugugucgaauguguuucugagaucacauuccacccccauccccacuauccccaucagugucugaucuggaaguggaaacucauuuuugacauuugccuaagcaaaacauaauuaggaagauaaaauucugcuaccaaaauaaucauauaauguauucuccaaguugaguuguauuugaugauguuuauaaauccucagcugggaggaggagacuauaaaugcaugauuuuuuagugucauuuuuuucuguuauauauugagugcuuacuguguuugcugugagaaguacuuuccauaucuuauucagucaucgugacagccuccuuuaggcauauugcacuagcuccauuuuacagaagaggaagcauaugaaaaguagcuaagguaguuuaucauauagcuaguaaguacggggcuguaguuagauucuuacuaaguuguaugugacucuaaugguucugcuucugaccacugugcuaaacucgcucccuagcaguaaauagcauagcucuaagagacuggaagauguucuuuaccaggagugaggugcuguagauaugcaagcaugaggagcuuugcucuugugcccucuuagcaaaaucuagcucuuuguuagcucuuucaauuuguccuuugcuauauaauaaguaaccugauccaaaggcaaacuguucugucuuucuuugauuuugagucugccaguggccaaugauugauaaggaaggcacaugguaaaccccucauccugauugaagucaauggaaguccuccaucuugagccauugacaaacugcugcuauucucucauucaaagcuacuauuccucuauuggucucuugauaauggguauuuauuuauuuauuuauuugaugggggggggggcaaaaaaacccaagagguuuauuuucugacgcauccgggucaacccucaaucagacccuagaggcgagugaugagaaggugaacccaaauggauaauggauuuuauaauaucaaugugugaaguuguugucaguuguguaauuagacuccucucuugugucuccucuucuuccaucuucuucauugcuagcccuaccaguaacacauauuugagccuuuuauuguucccucuuucuucaugugaaguucugcauuaauaaguagcagcaggaaacauuagugugcacuaggcagcaaaguaggcauuugcuucugcccucuuaaggaacugcuuuuauuggcagccuuuauuucuccauuccacaugaaaaauuaagguggcuguucacucggagcuuugagcccaccauuagcgguucucuuggaguuugugguuuuagagagggauagggaggagauguggaaguaguggcacaguaaggggagugcgagggguuaugggguuucuaagagguacgagcuauaggcauaaaauuacuguaauuuauuuucaaaauucuaaaucuguuuucuuuauguaaaaaaaacugcaguuagugaaccgacacuguuaaaucaguugaaguguacaaauguauacauaaaauacaagcucuccaacugccuaaucacagacauaaaauaauucuccugcuuuuaauguaguuuuuaucuuugauuaaugaaauguauaacaguguuaaaacuuuagugaaguuugauacuuuguccuuuuaguuaauacaaagaaaucaggaauaaugguauaauuucauuuaggagaauuauuaaguucuugauuuuuuuuuuuauuuuuaagucucuuuuguugaaagcaaguauauuuuucaacuacccuuuucuuucucuaaugccuuuaugcuacuuuccuuggaaugaaaggcaagcaucaaguguugguuuuauccuguggcuucacuuuggaaauucucuauuucucucccaucaagaugccuccugaagucugucugaugucauauuacauggccagaugcucuauaugggaaggccauuuuagugaaaaggagaaagaggauagucuguuaaacaauugagugaauuagucuguugaauugaaagagaauaauuuguuguaauaacuaaugguuuucauuaucccacuauaaaauguguaucauuuuucugaaacauaugcaagauuauugcuauuggacuuaaguaaaauuuuacucuuuuuccaucugugaauaggaaaaaaauauaguauuacucuucuaauacaauaucccuaugggaaacauagucacuaaaacuuggaacucuuagcuuuuguuaucuagacuguagguuuuucccucuagcucuaaugaaagcucuuuauagccuguguaugaacuacucaaagugugcucaaacauccagauagucuucaguuccucaaagaccagacuagugguaaggguaaucuaaaauuuauuuuagaauuucaucuguuaguacauuuuuauuucauaaauauuguacuuagaauuaauguuuuccuucaaugagcagugaguuuuacaacaucuauaaaguacauugcuuuauagucaaugcuagaauuuaaggauucuuuaacuggacaguuuucuuauugguccugugaaauuacugauauuuguagaauugagaauuucaugucugaaaauauuucuuacuauaaggcagaaugcaaauguucuccuuuguaaaaugucacuagcuggucaugcuggucaugguggcauauaccugugaauccuagcacuguugaggcaguagcagaagguuggugguuauuuugggccagccaggguuccauagcaagaccucgugucaauaaaauaaaauaaauauuauaagauaaaauagugcaugccacucauguuacagaaaauaaauuuuugugaauugauaagacccaguacuuuucaaaaaauaaacgcaguaguggguaaacaauauuuggaaaugcuuugggcacuuuugaggaaguauaucucaaaaaucugauagaagggacagaaugaaauacauguaaaacagugauaccacuaucaggugccucaaguauuaauuugucaaaggauuuguuuuucuuuuuuuuccccacgauuaagcuccuguaggaacaucuauauuucacugucauuuucaagccucacaucuugcaagcuggagaaccucuucuuacauucugggguucuguuccuagaccauuauccaauaacuccugguucuggucuaauuuauucuuguauucauuaaacaacuuaaugucaggccuguugugcccagcaucaugauagacuuugaaggauacagaagugagauagagcuauggguucuuuuaguugaguucaggccaagugauuauuaguugaugucacuguuguaaggauguuuaguagacaucacugccuguuuucaaaagauguaaaauaaaagguuaucaaagugauggaaagcagauuauuuaaauuaagucuuucccaaaugacaaugaaaauuauguugcauguacuagguaugguagcuuaccucuguaauccuaccacucugaaagcuaacaacauaaguuuaaagccagcauggguuauacauaaugagaccuugccuuaguuacuuuucuauugcucugauaaaacaccauguccaaguuaacuuaauaaagacuuuaaugggcuuggaguuugaaagggccagagucuaugauggcagaacaaaggcuugguggcaggcagcuggaguaacagcuuagagcucacaucuugauccaugagagugggcagagaacauacugagaauggugugaaucuuuugaagaaucaaagccauacuuccuaacccuucccaaauaguuucaacaacuugggaccaaaguauucaaaucuaagagucauucuuaucaaaccaccauggacucuaucucaagaaaacaguaaaccauaaacagaaaacaaaaaaucggguuguggguauagcucuguggcagaacacuugccuaucauuugauaggucauagauuugcucucaauaguauaaaaauuugcuaauaggaaaauggguaaaacauagugagaaaacuaaauguaucacacuaagguaccuuaaguauauuaaauauauauguauaaauaagacaggaaggguuaaagugguaaguuguugguuccacuuugcugucaaaugucaaaauuuauugcuuaaaaacauaauuuggacaaaaugagaaagaggaagcaguuaaaaauuacuguuacuaaguuacuaaguaucuaacuuacuaaguuacuagaauagaagccuaaccccucguuggaucccuuuaucccaucuauuaggauauuugaaagagcagaggucuuuuugugagcuagggaaucauugcucuguuauuuauuuuccaaaccuuauguaguauaaggaauucuaucaauucucagguguaaaugaaggaguaaagguacuuuuggacuacuauauauagauugagcauccuuaaucugaaaugcuacacagucagaagccuuuugguacugacaccaugauaccuacuuugaauaauuuaauaguuuaacuguucuuuuccuucagucuaaaaaacaaacacaaacauaaaacccaacaccccacccucaaaaaaccaucccaugaucagcuuccaaacacugacaccauugcacacacuagcaagauuuugcuaaaaggacccugauauagcugucucuugugaggcuaugcuggugccuggcaaacacagaaguggaugcucacagucaucuauaggauggagcacagggcccccaauggaggagcuagagaaaguacccaaggagcuaaagggaacugcaacccuauagguggaacaacaauaugaacuaaccaguacuccccagagcucaugucucuagcugcauauguaucagaagaagauggccuagucagccaucacuggaaagagaggcccauuggacacgcaaacuuuauaugccccaguacaggggaaugccagggccaaaaaaugggaaugggugggggagugugugggagacuuuugggauaucauuggaaauguaaaugaaauaaauacccaauuaaaaaaguaauuaaauacuuaagggagacuuauaauauauaagcaguuuaucggaaauuaaaauuucauauggggaaaaaaaaccaaaacccugauuuauaugguggaagauaucaaaacugcuuucaugugauaguucauaguuaaaugauuaaagguauuacauaaaauuaugugcaggcuaugcauacaaggauuauaugaaaaguagaagaauuuuguguugagauuauccacagagaaucuuguuauauaugugcaaauauguuaaaauuuuagaucugcacucugaacccagucuggucccacguguuucagauaaggcauacucaaccuguacacauuucauuaauuuaaaauuuauacucaaguguagcauuaagacauauuugaguugaaguuaugaauguugucuacuaggaauuuguugcuguugagauuuuggagagucaucucuuccaaaacaguauaaauaauggauuagaaauauaaacucugaacaucuccuaguccacgugcuuuuauuauuauuauuauaagcaggaguuacauguuuuuuuuuuuaaucaggaauggcuauauaaagucuuaggacugcucuacaaucagguuuuagagcauuucuaucacuucugacuacuccauucuuucuaccuuucccagucaacacuccuacagcagcaauacuuaucugauuucuaccaccauagauaaguuuuccccagucuauaauuguauguaaaugguuuucuacaguauguacuuguuauguucaauuucuuugacuucauguaauuuuuuugaucuaucauguuucuuguauugguauccauuuuuuucauuucugaguaguauugcugauaccuauuauguuguuaauauccuucaaccuaauuuucacuugggacuauuagaauaaaacugagcauuuuguauacacagcuguuuauggagauagcauugccucuuucuauuuucacaaauucuaaauuugcauuucauauauuguuuuuuacuaaggccagauacuuauaggccuagauucaugcaaaagaaaaugauuuacuucuucagcugauuuuuuuauuuaagaaugacaauagcaagucuauuaauuggcuucccuaguauccuugcugacucuuauuacaaacagcugcuuguggguaccaguuacuuccuuuacccaauuagaauuucaucuguccagauuuucccuuuuuucccacuugugugaguauauggaauuagcugccuuacucuaguuauuugcaguuguauuaagagaccuuauuguuuuuuguuagaagagagaaauauuugaucaaauacaucaugauacuucucagauaaacaagacuuuauuauaaauaguuuaaauauuugagaagaggcauaaaaaaacauugucaucugcagugguuuuaaaaagacaguaguagaaaaaaguaauuaugugucaaauguuaaauugugugauuaugacuggcgauauuaaguaaaaacuguacugcuaugcucacccacccaguaccuccgaugcuucuuucuauaaauaugccugugaaacugagcgcuuugauccuguugccaaaauaauguaagauccuagaaauuuuccaauuauaaaugacaguauuuuaauuucauucuacuaccucucuguccuucccgucuuagcacaagugacuugaucacaaguugcaggauugaauuaaaccauacaucaucucuaguuauuguggggaaaccacagcuguucaucugccagacaauuaguuuccaaagcccacucaaguuacccccuucuguauucucugccugaccaagugauucaggucaccuauuuaaaggcagucuaguagaaguagaaguuuccuuucucaaacaggacuuaaaguuuguuucuugaaaccaauuguucagagaaagcuguagguagaagagguaaggaauuuggacuucaguuuuacaucucuugcugagcuuucauaggguuacacacugugagcaguuuaauauuaauuacagaacguagaugcaggcagggcaagugugaugguaaagagugugcuuuaaaggcauuuuugacagcuuuuaauuuuggguugucacacaaagggaguuuuaugcugcuggucuauuuugaauucuuaaaauucaaaaucucuaccucuagguggcagcacuagauacuuuuuuccugugaggccagcuuuaguaaguuccaguauaaguagugaaacuuucaaguauacuaaaacuuugaaauauucuaugagucuuugguuaaauuacuucaugugcugaauaaguuugggacuugcuguagucuggguuuucaaguuuucuaaagaauuuguuacucccucugcccccuuugaaacauggcauaguaugucggcuuuacacgaguaaaccuucaguuugccuguuacaucuuuaauucuccucccaagaaaaccacuuguuuaauaauguuuuuauguuaaaguagcagguacaaaggauguugcaugcuugauauuuuaaagucgauugcaguuuauuuugcuuuuguguuaauaaaaauucucaagcacuguagcuaagcgaauacaagguggaagcuuauuucuuuaaaacaguucagccugagaauaagucugaagcaauuaacuaggccaaagucauuaacuagccugccugucacugccaugggaaaauaacggucauuucuggaagucaacauuuaaaguagauacugcauaaggcuucauauuuuuuucccucacagucagauguuuguuggguguuccucuguaaguagcaaauaggucauguucuuuucuguuuaacuccucaggcuggcaggcuggcaggcuaccagugugcuccuccauguacucaggugugccaggugaaccaaggcugguagaggaggacuagggaauagccucuggucaguuguguaccuguacaacccagcaugauuuuguuccuuuguuuuuaacuaugcaaucuugccuuuuagaaaacucccguccccuccccuuuaaaguuaaaauuagcauuggaaauugauuaauaauuaucagucagaauaguuauagcugcuugcuuacuccuaacugcagauucaucaacauauucugugaauauccucuuguauucacaacuagagauuaaugaaauagcauuuaucuguuacuguagagaauaaacaaccucacuuauuaauaugguuuuucacauucaguuccucuauccuguuggauguuaaauaugaggguguguauucuccauaguuugcuuuuuuuuccuaggaggcagauaacuuguaaacuaaaagugauggccuuggcaugggccaauuaccauauagcacaguaacuuauaucacuuauuaucuagauuguucugaaaaaauauuuaaaaauuuuuucucaugaugccauauuagguaauacuuuaauuucuaugaagcauaguuauuaacuucauggguagcacagacauguguuucaugugaauauagucuagauaaaguuguaucaguuuacuacuuuguguuguaguuaaguaugauuuuauuaaguauuuaauauuuauuaagcaccacuggacuaggcuuauccuuauauuaucucauuugaaguucaaaacugaguggcuggugacacuuccauuuugugggugagaaaacugaggcucauaucacaguuaucuauucuuuguuugccaccuugcuaugcugaaaucgauugccucaagaaguuuauaauuacuaugugucauuugacugagcaacaagaacauaggaguuugauaaauccaaggagugaaauuugacagggaaaaauugaauugauaagaauguuucaugucuuaaaauaguugguggaaacaagauaguguauacuauaccuagauuuauuuauuguguugucucaaaugaaguguaggaauuacauuuggcuucaagacugucgaguguaugugggccuaugaaauauguagauccaucacuuuguacauguuuuaaguuugugaauuucagacacaucugagaacaugauguuguacuuugucuaagaugcugcuacugaauuauaaccacugaauuagauugcaacauacaugcuguuaacuauugagccaagaugaaaucgaccgcugcauugaaaucaagguuugcaguugugucugcauuugaaggaguuggaauggcagcgaacauaauuucuuuaaugggauuuuuguucuguuuucaguuuuaaugguugcacuauauuuuaagaguauauauuaguaacaggauauaauuauuugaguuuuuuauguaacuggagaaaaacccuaugaaaugcuuuggagcauuuuucuacauguugacauguuucuacauuguguuguuagaguuacuuguuugauucauauucuuauaaacagagaaguaauuuguccacgugaucuugaguucaagugguuuuuaucuguguauauacaaacuuggaaaacguucuuuuguaagaauuuacuuuggggauauuuuguuuuggaugaauacucuuaauauuuuuguuuguuuguuugcuugauaggacuugacuccacucaauuuagaguucaucaguaucacaaagaugaagagaaugaugcccuccuuggugguccagcacagcuaacugaugaagagaaauacaaggauugugaaaaauucaaaugccuuuguccuucauguggaacugaaaauauuuaugauaaugucuuugaaggcucgguuaguuauucuguuuuguuucugucuuucauuuuguuuggaaaccaauacaguacagagugcccuucccuacacuuuagagaacacacagacacacacagaauauauauagguaaucuagauguuucauuuaugucuuuaaagaauuuuaguaaugugaguucugcuuucauaacuucauuuccgcugagaaauguuuaaucgaaugugcuuuaauaauuguuuuuugccucccuagagugcuugaccuuuuuuuuuuaaauggacucuuuuaaaaauucucauuaucucaaaauauuuuuauuagaacuccuuaauuaguaaccuuuguuuuccuauuaccagcucccacuuauuaaagcugagcaauaccuggguuucucuuaaacaaacaaguauuagguuugucuuuacaugagcgucccccccaccucuuuguuguuguuguuguuuuguuuuuuuuuuuuuuuuuuguuuuuuuuguuuuuuuuugacaaaggugcuuuuuaguuuuuuguuguuguuuuuuguuuggugguuuuuuugucuuuccauaucagacguuuuaaaaaaaugacagggagaccuuucugucaagaaguacugccaaaaauguaucauugaccuuggaucagaacuugaaacuuggccaauucaguuuauuucacugcaguguuaaaagugugcuagccauuggcaaaugaguaggcagcagaacucugaaaccuugaaacugaaggaaaauacauccuuuaucuaaauuaaaaguaauuauuuuaaguuaauuuggacaaacagcagauguuuugcauuuuuugaaucaaaacaaagcagcuuuuggaagcaagugcaaggaagaggcagacacagaucagcaguacuugcuaaauccuugagcuuugcuucauugcagcuguaaauaagauaguuaauugcauggaggcuugacgacuugcagaugggcuaacuggggaagagcccaugucaagcucugaaaucucucccaccuggaguugcuuagcuugucgggucggguucuacaccagauuggagcaggaaaccaaccaagauguuuaaguauccagaaggaaaacaaaugcuccagaaaccccaacaguuuuccuauaucuuauauuuguuuugucuuuguuuaaaacacacugugacacaauaaaauguuucuccaacugcuaauaguuacucuuccaaacuuauacuccucuugaagcauccuuuccuaaauaauuuuaauucuuuuaaggcacaagaauuuuagauuugcuaaucuuaugauaaaugagauugcuuuauuacucuugcgguacaguacuuuuacguuuuagauuucucugucuaaauuucaguugauguaguaacagcuaacuaauguuguauaaggcucgguccuugcuuuaucuucaaguuuguaaugaaugacugcagauuagaauuauugaucagugucucuaaaaauaauguuuauuuuugguaacaugauuucugugcuauuuucaaagaggaaaugaccuucucuguaaguccugucuuacaugggauguaaaguagugaguucauggauuuccauuugacuuuguaguucauugugaugauagcaaaagaauagauaccacguacuucuaauuagggucuuaaagccauaaauaacacauaaaguauaguuaaaaacucuucuagaaaaguguugugugccaagaaaaaauaaaguaaguuugagccauaacauuguuucugguaauaaccuuguguguacuuguuuauccuggcuucuauagggacuggauauggaacccaguuuguaucguugcaguaauguugauuguaagguuucaccguugaccuucaugguacagcugagcaacaaauugaucauggacauuagacggugcauuaaaaaguacuaugauguaaguaucuguaauaagacauuacacacuccauuuacugagguuuaauaauuguuuuauaguuuuuauugcaguugagaacacuuaggaaauucacaguaaaauacuacuaauaaaaugugacacacuucaacuuuaaaaucuaucuaucuaucuaucuaucuaucuaucuaucuaucuaucuaucuaucuaucuaucuaucuaucuaucuguggggugguacaggauaaugccuguauggagguuacauggagggaguugguucuuucucuguuuccaucaaauugauuccuagggauuagaauuaggucaucaggcuuggugguaaggccuuaaucaacuaagcuaucucaccugcucaaaaaauuugauuuuaguaguaugauacaaacuuugauuuuucucauaaaugucauaucucuuuaauuauuggaguauuaagauugaaaguuugauuaguuuucugaagaaguuaaaagaaccaucuuuuaaauugaagugcaguuugagaucaaagagaaugucucauuuucauauauguacaauaaaaaaaucucagaagaguaaguaagcuaucuuugcuuucauucugauuuuuuuuuuuguuuuguuuucugaacacauuucagacgaaugcaucuuuuucucuuuaaaaauuaaaauugaaaaagacuguauauuucucauuuuucuuugugugucauaucauuugucaucgaaacaaauuuucuguuacuuaaaaauucacuauacccuuuaaaaggcuguguugacaagcuacacagagaaaucuugucucuaaaaacaaaaccaaaggcucuguuggcaagacauuuuaaaaaaaaguugaaguacuauuagauaauacucaugacuuuacuauucuauacuuucuauuuaauaauuaagauguaacauagccucuucuuugaaacacaugugaaguaauuugaaacauguuucacauaguaagaaauauaacaauauaaaaauggauauuagaucauuaagaugaagaaugagaacacggagucccaaugugauuuagcauggaauaauuuguguuuacauuuaaagaaaauaaguagguuugccuguuucaaauaauaauuaugacuacauuuuguuaaacugcaaaguuuuagugaauaaagcuguguuggacuuaaugaagagcuggauggaaguaaagguuaucuauggggucacauucuacaguauaugaaacguucaacucaugaaauguuagaccuuuauuuagcaugaagaacccacaucagaacuauucagcuucucauuuacaggccuuauugagcaaaguaggauucuugacucuugggaagaguccugacuuuuccaucuguguuuagucuaucaaaagcuucaccauggaaauguuaaugcuaaaggcaaugacucuaguucuuucuguaagaaggagcuaucuguuuugacuaaguugagaauagggagaaaagugauccauauaauuagaaugugccaaaacuaaaaguugaauuuauaaauuguauguggguggguaggugggugaguggugguggugguaauggccuuaguuacaaaagcauuuuuuaagcuaaauaaucuacuuuuggagagcagguauuuaaaaugaagucguuagagcccuugcuuucucuuauccaccagcuuucucuguaacaagcaagugaaaguuuuucuguacuuaacuguuuacuugguugacuuuguuaagauauuucugguuaaaauauccaaauguuacuguugugauuaaagaaugauagaaccauugguucuugaaauuagaaacuuuucuccuaucugauucuaauccuaagugaccagauggaagaaagguaacucuuccuggucucagacugagguuguaugugaacaguauauuuuaaaaguaagugagagacaauuucuauuuucuguugucuucagacacaaugcaccauuugccagcagaggggugugauauugagcuuuuugguuagccaagcuucaagugacacuguucagugugaugucugagaauuaauggcaauuuaucuagauacucauacagcaaucauauuugaaaggauauugagauaaaauacugagauuaaaugacuuuucucugaagcagguuaccaacauggcuuuuucauauuuuguaauauuaaaaaacacucacugaauagaagaagcacuuauuuguggaccuuaguuaagaguaucauuauauuuauuuuagucuuagaauuucagcaagagaaaucaauguacaccaagcaaagaugugauucuuagaaaggaagaacuuggaagacaguuagguggaagauggcacuugagcaaacuauauaaccugcuaaggaacauaguuuuagauuacuauaaaauuagguugccaagaaaaaaauuaaaaaauuaaaaucccaaaguauucuucugaaucauuuguguuuuagaaaaaaaaguauccccugcucuugagcugugaaaugucauggaacguuuuucuacagauguacgcaucucagaauggagcacucuagaucacauuguaacauuuuaauccugacugcuuuacuaggaggagacgcuucccuucuauacagcacugaguggaggcucgcaauucucauuuucauuaacauacaaaucuucaaaugcauagaaaauuugaaaacacugaacgaacacauuuuuugaguaauguauuaauuuacuuaggagaaagacaacuuuguauuuuacuucaaaguuuggugaaauguugaaaaugacauggcacaaagagucuuauucaaaauugauuucaaucuuugagcuguguuuguuacucuguucauacugaacugauauaauauauauauauauauauauauauauauauauauauauauauauauauaucucauaagaaggcagauuaagcuuuuaaggauaguuuuugagauucaaguuuagaaugaaaaauugauacauguccucccuuaaaauuuuuucccaagaacaaacacacacacacacacacacacacacacacacacacacacacaaagggagagaagcacuagcuaaucuaaauugggaaaugaagagggcuuuuuuuaagcaugaaaauuucaucaucuugucagcuggcagaaugccugcuguguggauucacaaaggcuaagaauuacacuuucaugaaauuuuccucacuaacugcccugguuaauuugaaagauaacccacuguucuaauucauuccucaauugggcggugcagguuuuaucuuugaucugacaaagcauuuguguuaaucguuuuggcccuccacuagacacucuugggauugugcuuuuacaauaaaugugucugugauagcucuuuagucuauuauacuuacaauagauccauagaacugguaauuaauucuccacugcuuuggaaaugggaagaauagguguagcucugucaaguacugcugggaaguuuguuuagcugguucauuucugaaguguuccccucaacuguuaaaaaaaagcgaaucugagauugaaauguuacauagccugaugccuuccuugcucaugagugggaaauucaacccauuguaguaccuaggaagggggugcuguguccauuuacuaucaguuacuaugugaaucgaauucuuauuugaauauuuacauagaguuaaaccuuucuaaagguggagccugugacagacacaaugaugagaguaaauccaaauguguuccccaguccucauuauggugugucuguuuacgguguuugaauagggcaauguguguuuccuuaccagucuucuugucugucuggguaccugcagaagagcauuuccuaggaguucuuugcuauuauuuuugaauguugagauauugcuaaccccacaugggacugccccuccaucuuuaaaaaaaaaaaaaaagaacagauaaguacuggcuaucaaucugguagucuuugauuaguugcuaggucuagaauucgugacguaauuucuuagaaauuagcucuaggcuuuauaaucucagaauguuccugaauugugccuuuugaggacagggguuauaccuuccucuguaucucaucugugaucucugccagaguacuuuauuuuauagugguaaccagggcacaaauaaauaaaguuaguauuuuuaauuuuuucuguaaauuauuuuuucauacuauuacacugucaagagggcuuguuugugauauauaaaauugauaucaaguuaacucaaaacucuacaauuauuuuaagaaccugaaagcauccugucuuuuguauuuuacauuaucaauuacugcagguuucaguaaaugccuauccacaccucaguagccuuaauuuuuuuguccacacaccaaguauauagcaaaguaucaguacucgcaaauauuguuaugaugcaguauagacagccuaucuaaguauaauaccuucauugucuuguuagagaaguccuaugccuaacugaauaacaugggggcagugggugggagugggagugagguaacaccuagcuuguuaccuuguuacuucuggucucuuuauuucucuguuuuaccucuucuuauauuauuguggaagaaguacauuauuauuucuuugggccaauuuuuaugaggaauuaaaaaaguuaugcccagaguauuaauaucagccaucauguaugauguucucauacccaagauggguuuggaauugccuuuuaucuaaaguguaaugaugucacaauagaauauugguuaaacuauuuguucauaaaaauguacacuuauuuagcaucaugagcaaacaucauuuaugguaccuaauugcuuaagcaagagugauuuuaugaggaauccacagaaugaaauuaaguaaauauaucugauaaaugcagaacaacuuuucacuccagaccccacuaaauguguuaccugcuaacugggcacucguugccauugccuucucuuguucugucucuguggaaugacauuguacaauggaucuauuugagaagcaaugcaguagcacccaguaacucugcuguuccgcugcaaauauucaguguucaauaacccucaaaauuucucauuucuuaccugcggugaugugggcugauaguucuuagguuauagguugcaauaugcaguaguaucacagguguauuaguucaaaauaguuuaagcuuuaagcaguaggggaauuauuauuuauuugcuucuuuauauguagaacauuuagaaagaauaaauugagcuuuuuuuuauaaagguguuaacagcauaauuauaagugguguuaaaggcuugcaguauagaagcaguggauaucuaucucaaaaauucagcuucaugggcagcucaauacuugcugcccaacggugcuuaaagagaggugauuucuuuaggaauccauaaaacucauccuaaaucuuauuaaaaugaaaagaacuuccugagaacuguuguuucuucugguuucacaccauuugauagguaaguuaaauauaaaugaacaccagacaugccaguauucuaacaccaagcccauugauggagaggugguaggcuuuuauuugugaguggcugauuuuucuuagauuuaaauaagucaaacuagcuaguuuugaguugaguauaacauuuuggaguaacuucaugggauguuaacauaguaaaacuaacaaauagagcuuuuaggauaguugggguagaaucuuauucuaagaaaauuuauuacuguacauggguacagaugugugccaaugcauaugaaggccagaagucaguguuggcuuuauugucuucauuagcuucuuuaccuuauuuucuggagaacauagucucucagugaaccuugagcucacugguuuggcuagacuggcuggccagcaagccccagggauccuucuauguucaccucccuacugcuaggauuacaggaauacaugccccucugcucggcuuuuuuacauggcugcugcggaucaaacuuguauacuucuacuuacacagucaacgcuuuauagacugagcuagccccuuggccaagguaguuucuuaaaggcuacucauaauauuggauauuaaaucaugucuuucaucuuuuuguguuauaguagauuuaaauauguuacucuugucuuaaacguugagugaaucauuuaugcaugaguuuguagcauggaaugauuauuuagaaaaugcugguuaggugacuuauacuuguuuuccacauguuaguacauguuaguuuaaaaaucagcuuuuugaaucagccucauuauaaaaaccuuuaaguauugggguacuauguuaauauuccaaugaaaaugcguuuaacacuggaauuuuaucauugguaacaaauacugucaguugauuuuucuugaagugacagacucaguugguucauuuuugaggaaaaugucugcuagguacuuaggucugaauaaccauaguuugucuaucaguuacucuuucagguaaaaauggauuucucugaacaaaauaguuagcucagugcccaacgcagauaguuauccaagugcauucccuacuacuguaucuuugcauaugauaauaaaagggaugcaaacauagaguaagcuucuuaguaagauucugcucucugagcauaugguauugcugaaugaaacuagcuuucuuauaggucagguauugugagugugugcugauaaggaauacaaaagcuaauaggauaauuuguagccaccacauuuauuaaugcccacauaccagacaucuuauuuacauauccuuuugcaccaucaguacaauugcaaacccaaugaaaaagaccaguauucacaaaacaguuauggguuuuuaguuguagguucaagaguuugacuagugcucuagcaacuuguccuaaaaaacauauauucuuugggcugucgauauggcucuagaaggcuaagagcacuacugugcaaacaugaggacccgaguuccaauuuccagaacuaguauaaaaagucacgugcauccccgcauacccauaacucuagccccacaaaaggcagaaauaggaggaucacuaagacucacugucugugcagcuuaguucugggcucagugacagacccugggucaaaggaauaagguaagaaguggcagaacaggacacccaaccuccuccuccagcuuucaugcaucuauggaaaagcauaugcccguauacagacauguauauacuucaaacuccaguaaauuuuaaaaaggagaaaaauaaaauuugggugcaagaauauauugaugaguaacugcuuauaauagugaaaaauggauaugacuuauauaucucagaaugaauuauugcuaaauuagggcauaucaacagaauaguauaauguacagugaccugaaacacuguuuuguuaaagagacaggaaauguuaauaaggaaaauaaggaaacaaauuaugguauaaaaguugauucagcuaugcaauacuuguaccuauauacauaugugucugaaaaauuaauuagaaaauaauuaaaaauauaauaaauaaaaauaauuagaaaaagaauauuaauagguugucuucauuaguaagaauaugggcuauuuuaauuuuuuguguuagugcuauaauaaauauauauaauauauuuuaaaggggaggauuuugguuauguuuucaauauauauuuuaucauuuacaguaaacuuuacuguagcaaguuucauuguaaaauucacagcauauucuauuguguauauaaauggauaaaaucauguaacuacuacuacuacuaccaguacucaguagagaauaaaggcccuuauuugggagggggugucuuauuugcugcuauacuaaauagguugccaguuucagagcuguauacaugaagguuaguagcuuccuuacuaugcaaagugacaacaauugauuugaauauaaagugaaauuaucagaacaauucccaucaagaauauugagcaaaaaaucucaauauuugcacuggggccucauggauuuuauagcucaauuugggaaagaaaacuuuuuucuuuaacucauuacuuccugucaauggcucauaaggccagagaaaaccucaaagguuuauuuaagcagucauuauaccagucacugauucuguucaucagaaauugccucgaggucuuaaaucauugagagggauaacuuuuucuuacuuagguggauccauuguagccuacccauguugaugcuuuuacaaauuauaguaaauguauaaauaguuccuauaccugccaccauucauccaaauacaaaauaguuccaucacaaaacaguaucaucucccugucuuuccgacuccuaaauuuggucuguucacuacagauuugucuuuucagggauguuaaauguaucaauacaguaugcagccuuugagacugucuugucauagaggcuuuuucuuuuauugcugaauauuacaccuguguguguguguuuguuugaaccauuuaaggaugauugauauuguuuccaguugaggucaaguauaaaaucaggugcgguaaacauuuguauacagauuuuggaugagcguauucucauuuaccuagaauaaguauccaggagcaauauugguggcccauaaaguaauuguauguuugaaacuuuuaagcauuaccaaacuguuuuucaaaaugaugauaucauuuugcauuacuauuaacacuauguaagaguuccauuuauuuuucauccucguugguacuugguauauuuuuuuaguuucaacuaugggcaugaagugacgugucuuugugacuuuaauguuaauuuccaugaugccuggugauauugaagucuuuucaugcauuuacuugcuugcugucuuaguuacuuuucuauugccaugacaaagcaugaugacaaaggcacuuauaaaagaaugcauuuacuuuggaagugcaugguuucagagggauauaguccaugaccaucaugguugggaacauggcaacagguaggcauggcacggcacuggagcaauagcugagagcuuaugucuagcccacaaguaugaggcagauagagagccaauuaggaauaucuuggguguuuggaaccucaguccaccccuaagugacuuaccuccuacaacagggccauaucuccuaauccuccccaaacuguuauacugacuagagagcaaacauucaaaugguguacugucuuucuaguguacuagaucaaauauuuuuuauuuggauugcuugcuuuuuauuguugaguuuugagacuuuaucuuauauucuaaauacaaguccuucauuggauaugugauuuauacguguuucccccaaguuuguagcuugcauuggucucuauaauauuuuuaccuaggcauacuggcacaugccuuuaauaccagcacuugggcagcagauggagguggaucucugugaguucgaggccagccuggucuacauagugaguuucaggacagccagagcuacacagugaagcccugucucaaaaaacaaaauuuaaaucauuguuauuugucuggauggaugaacauacuguguauaaagaucccaagagaacucccuggaguaaguuuucucuuuuaccuuaauguggguucugggaauuuaauucaagauuagaguugcuucguuuggcagcaaaugcuuuaccugaugagcaaucucguucaugcuuuguuuugguaucuuaaaguaaucuuucacagagcaaaacuuuuaaauuaagauuaaauccaauaaaucaguauuuuuguuuucuacacuguacuuuuacuugaaaguugacagguucauacacauacauauacgcgcgcacacacacacacauacauacacaaccuagauaaaauaucugucuugagcuagaguuuuuauaugaggcuuaggaccaacugcuuucuuguaagacugucuucuauugaauugaauugccucuguguccuugucaauaaucuuuugugcagacuagaaugggacuauuucuagacuuuuuucccucuuccacugaucuuuguguuuaucaauuugucaauauugauuacuguuagcuuugauuuuucagauccuacuguuaauuauuaaauguuuuaaccucccuuguagcccaccacccaucagagguagugggaaagaaagguuauuaggauauagaggaaguagaccuguuuggaaaguguucuuuggagcaaauccaauauaugucguuagaaaaucagcaguucaguucacaggaaucaucaauagcagcuugauccacuucacaaauauaccagcagcccaguucaguaguguugggauagcaaacaccagucagcaccaguggugugacccagcagaagcauccaggccuccacaaaauagcauggggcagcaggagugaccaggaccagcagcguugccgugagaaguucucuguuuugccucucaacaaagcauaggucagagaugaagacaagagaccgagaaguguugcaaagcuagcuaugcaagccuccucacugucuguugaauccuauuuaucuucccuccacacaucacauguccucccaugaaucuugccucaguacgugagucuuuaucugcugacgucacugccaaucagccugagugcgcugaagcagccagaagccaccggaacaccacuaguuuuugguguguuucuuucuauaaaaucucgacaaaugaugacuaguaaggaauugcaaagcauaccaauaccauccagcaucauccaucaacugucuguugugucuuucuuagcaucauguguccuuucauguguuugcuucagcaaaacauccuuucgccugugucugcuucagcgaaacauuccuuuacaugucugccuuagcaaaacauucucuaccuaugucuacuuuaguagaacauucuuucuugugucugccccagcaaaaugccauccaacacaacugacuuuccaaagaaaccauacguuuccacuucagauuacuguggcuuugcauguagcauaaguacuuguuuucaaaacuguguuagccauuccaguccuuuuguguuucugugaaagcguggaauaaacuugucuucaacaccaauauaaucuucauagaugcugugaguaugguuguuguuauugaagucugcgaggcuuccauucugugaguacuuucucuucauguacuuuuuagucuucuuugagcucuuaacauuuggugcuuuucaguccacagucuuguauuuguuuugcuggauugguacuuaaaugaucauuccuguaggagguuaagcuuuaagugguguuuucuguuguauuccugauauauuuagagagaaauauacauuuauuuguuuauauauuguuaauggaagccaguaacuaacugauggugacagugaucaucagccagccagugcugucuucauuuuuuuuuucagaugacugcucugacauuaucaauaaugaagucauggaacauuuuuaagaacacuauauguagaguauuucuucacacuaucguguguguguguguguguguguguguguguguguguguguggcaggauaucauuguguagcucugguuggcuugaguuuugcuaugaagaccaagcugucuucgaacucccagagauccacuuuucucccaagugcuaggaugaaagugaaguuccaucacaucuagucaccuuagcauuuuuuuauagcauuuguuugcuuaucuguuuugcagacaaagaugaucugucuugaccauggcugcauguuuaaucaccugagcaggugauuuguuuucuuuguagaguaucugaugauauagcuuuaucuagaauguuacuagaauuuaugggguaaauucuuccccuacaaaauuaaaccuuacaaaagaacacuuguugaggaauucuuaucuaauguaaaauaaucguugaauauuuuaaugugauuuuuauggguuacauauauuaaaggauacauuaguuuucaaacuuacaacaaaauaagguguuuuguauccagaaauaauuauaucaaagcaaaauuccagcuaaacauuuuuaaugggacuuaaccauccauauuaagucuucuaguauauugcugacacuuuacaaauaacagguaguuaacauuucucaaucuugucucucuucuguuaugauuuauaaaucuaagugaggaguauuuguagauagaaagggcaguuuggagacuggauuuuguauuuucaguguuuucucuuaggaaucacauaauaacaauaaggcuuugaagcuucuuuaguauuuagggacuugaaugaaaauaugugauuuuuuuuuacaucuuuugaaauguuuugauuuccuucaguguuccuaugagaacuuugaaaaucuuauaaaucuaucucuaggggcuagcaggauuugugaaaggcugucuggauccuccugccuaaauguuguuguuaguguuuccuccuguggcuguuuuugagcaagagaaaaaugauuuuaagaagaggagauauucugcuauguucauaaacauuguauguugaacacuacauaugaaaacaguuuugagaauauuuuauacacuuccuaauuauaagauuauuguaagauaggcauacuaauaccauccaagauuuuccaacuugugaugacagauuuucacauuggguguuaugagguuauauuaugauuuuguuacauauuuuuucucucaaucucuagagaaucaguucaacucauggccccucugucuucagguccccccauugguucauuucccucacuguuuccugcuuucuuuuuuucuuuuauuuuccuuucuuuucuuuucuuucuuuuuuuuuuuuggaaacaggguuucucuguauaguccuggcuguccuggaauucacuuuguagaccaggcuggccucagaaauccgccugccucugccuuaaaggcgugugccaccacugcccuucguguuuccugcuuucaaugccuccugcacuugcucauuucuuauauacuaaguuuuaaauucuauagcauuaccuuagaucaugagccaacuucucuaccuuuuccaucuacacuaucuccucuauacuauaagaaagcuuguuccugaaaaaugauacacacuuuacuacagcuucaccuguaucuuggugccuaaaaccauaccccacaccacagcaaugccugcuugcuaaaauccacuguuccucuucaguggcucuucuggaaagcuuuccucaguaaguucaggcaaaauauguuauauuaccucuguuacacucuccuaagccaucacacacacauaugugauggcuccuacuacucauugucucuuuuacuuaaaggcugaacuaagccacauauuguguuuagcuucaauguuaacucugaaaaguauaguaucagggauguggaaggcacaugacauauacuugaacaagggaguaauuuuuggaacguucacaaaaucuggauguagccuuuauauucagugggaggagauauuaacaacucuacagccacuggagaguauguuuguccuaggaugucuuuaaucucuuuugcuauauuucaauaucagucacauuaggaaucuaauaagguaaacucacuuuuucauugcacacauauauagugcauguuuuauuuucaucuucauuuuucccuugaaagaaugaaucagacacauucacauuuguuuucuuuuguuaaacaaauuucaaaacuccaaauuaccaacuuuuuuaaaccuaagcuuaauauuacauacuuuuuuuauuagauguuuucuucauuugcauuucaaacguuauccccuuuccuaguuuccucuccaaaaauccccuaaacccucuaccugcuccccaaccaaaccacucccacuuccuggcccuggcauuucccuauacuggggaauauaaucuucacaagaccaagggcgucuucucccauugauggcagauuaggccauccucugcugcauaugcaacuagagacacgagcucaguggguacugguuaguucauauuguuauuucuccuauauggcugcagaacccuucagcuccuuagguacuuucucuagcuccuucauugaggacgcugugcuccauccaguagaugacugugaacauccacuucuguauuucuaguacuggcacagccucacaggagagagcuauaucaggguccugucagcaaaaucuuguugauauaugcaauagugucuggguuugguggcuguuuauagaauggauccccagguggggcagucucuggauggucauuccgucagucucuguaacuccuuccauggguauuuucuucccccuucuaagaaggaagaaaguauccacacuuuggucuuccuucuucuugaguuucauguguuuucaaauuguauauuggguauucuaaguuucuggcucauauccacuuaucagugagugcauaucauguauguucuuuugugauuggguuaccucacuuaggaugauaucagccagauacauccauuugccuaggaauuucauaaacucauuguuuuauagcugaguaguaguccuuuguguaaauuacaacauuuuguauccauuccucuguugaaggggaucuggguucuuuccagcuucuggcuagaauaaauaaggcugcuaugaacauaguggagcauguguucuucuuaccaguuggaacgagauguauugcuggaucuucccguaguauuauguccaaucuucugaggaaccgccagacugauuuccagagugguuguacaagcuugcaaucccaccaacaauggaggaguguuccucuuucuccacauccucgucaucugaauuuuugaucuuagccauucugacuggugugagguggaaucucaggguuguuuugauuugcauuucccugaugauuaaggauguugaacauuuuuucaggugcuucucagccauucaguauuccucaggugagaaauuucuguucagaucuguaccucauuuuucaauagggcuauuugguuuucuggaguccagcuucuugaguucuuuguauauauuggauauuaguccccuauuugauuuaggauggguaaagauacuuucccaaucugaugguggccuuuuugucuuauugacaguguucuuugccuuacagaagcuuugcaauuuuaugaggucccauuuuucgguucuuacaacaccgaaaugauauugauaagcuugaucuuacagcacaagccauugcuguucuguucaggaauuuuuccccugugcccauaucuuugaggcucuuccccacuuucuucucuaaguuucagugucucugguuugaaguggaguuccuugauccacuuagacuugagcuuuguacaagguuaugagaauggaucgauuugcauucuuguacaagauaaccaccuguuaagccagcaccuuuuguugaaaaugcugucuuuuuuccacuggaugauuuuagcuccuuuguugaagaucaagugaccauagguguguggguucauuucugggucuucaauucuaucccauugaucuaccuuucugucgcuguaccaguaccauacaguuuuuaucacaguugcucuguaguacagcuuuaggucaggcauggugauuccacuagagguucuuuuauuguugagaaucauuuuugcuauccuagguuuugcauuauuccagaugaauuugaaaguugcccuuucuaacucugugaagaauugaguuggaauuuugauggggauugcauugaaucuguagauugcuuuuggcaagauagucauuuuuacaauguugauccugccaauccaugagcaugggagaucuuuccaucuucugagaucuucuuugauuucuuucuucggaggcuugaaguucuuaucauacagaucuuucacuugcuuaguuagagucacacuaagguauuuuauauuauuuaugacuauugugauggguuacucugauaccuaaagacaaaaagacccaacaaagaacgaguacuccugaccaauuucucuuaugaauaucgauaaaaaaaaacucaauaaaauccucucuaaccuaauccaagaauacaucaaaaugaucauccaucaugaucaaguaggcuucaucccagggaugcagggaugguuuaauauacggaaauccaucaacauaauccacuauauaaacaaacucaaagacaaauacuacaugaucaucucauuagaugccgagaaagcauuugaaaagguccaacacucauucaugauaaaagucuuggaaagaucaggaaaucaaggcccauaacuaaacauaauaaaagcaauauacaacaaaccaguagccaacaucaaaguaaauggugagaagcuugaagcaaucccacuaaaaucagguacuagacaaggcugcccacuuucucccuaccuauucaacauuguacuugaaguccuagccagagcaauucgacaacaaaaggagaucaaggggauacaaauuggaaaggaagaagucaaaauaucacuauuugcagaugauaugauaguauauauaaaugacccuaaaaguuccaccagagaacuccuaaacaugauaaacagcuucagcaaaguggcuggauguguucuuucucuacacaaaggauaaacagucugagaaagaaauuagggaaacaacacccuucacaauagucacaaauaauauaaaauacguuggagugacucuaagcaagugaaagaucuguaugauaagaacuucaagucucuaaagaaagaaauuaaagaagaucucagaagauggaaagaucucccaugcucauggauuggcaggauuaauauaguauguaauauauguaauaauauuacauuuaaauagucagaauauuuugagaaagccuuagcaucaugcuaucuguagguauguuugucuguuuuugugucuguucuuaguaugcacaaagugcacagaaaaaaaaaauugaugagaccuuuuuagcuuuuccuccuagcaguuguuauguucauugaucacauacucaauggaacugguaacagguuaagagaaauuaguauaaguaccaauguggcuuaugauacaaugucaaauucagacuuacaacagaaaccuugagaaaguuuaucucauccaguuuucuuaguaauuauaaccucuucucuuccauaucuaacucgugacugcagugcacccaaugggcugguagaugauauaguucaacagcuaagggcuccguauaaaacuuguccagccuugauuucaaggaacaugucuucaccauagaccuugaaaaugacuuuucccauuuuccagauuaaauauguuggcaagauugugguguagagucucauuucuguuuggaaguugccauuagaagcaacuacacaaggccagaugaaaggaguuuagacuauguuuuugguuggaccaucacuuuaguugguaaaacagcuguacuguccuccuuuuaucagguagagugaaguacaauauguaagauaugacuuaacgaaagacuagcaaacugauaaacuaagucacacacuagggaaagcuuugucuuuugaauuaaaugccuguuaaagugucuaaaacucaaggacagugacuaagcagacacuuaguuuuauauggcuuugcauugacugaaaacaucugaauuucucuuuccauguuugcaaacauguggaccuuaacgaacaauucauuuugaaaaccaaaguuuaauuucguucuuugauaaucuaucagaugauuuugggccauccucccagauguuaaugucugaucuacaucaugacuugccauuuguuuuuuagcaaaaaagaugggauauuuggggagaaaaguuagaacuugguaauguuaaaauuagcuaggugucuauuuuggaaguuuggagacccuuucugcuuuuugagcuuccauuuauggcaucuuuuauuuaauugcuuaucuaauaaagaauaugcuugaagccaaauuuuguauuuuauaaauguuaauuuguuuguaaaauaguucuaagcaaucauugugggcuuaaaguagauaaucaaaauaagcagugguugaagagaaagaucuauuguagcuaucuugugcuguuuaaaagaaguacuguaccuugggcgauggcuguuagugacugaaaguaaggaaacacagcacagguagaugcuguuacacgugaccuguguguuugccugguacugaacaugaauuuuguuuucuuuuguuuuuuugagauacuuguucuucuuuaaaugaaaauacauuaaucauauuaucauacaguaucauuauucuucauugaucaaguuaggaagagggcucgucagguuguugugcuuugccagggagaguuggggaagagugucgugaaacucuccagacauugccuucuuuccguuuggaucuuucacuagcuuugucuuuguccuuuuaggauacauugcugcucauucugaaugucgucaggccuuuuauuuuaaaacagcagugaagugaguuaacugagaaacuuacaggcgcacaggguuaguuccuucccucuguuagagcuagucuuucaacagucucuacauuuagggaaaauuuguuuaaaaaaaaaaacaaaacaacccaguuugcaaaagcagugccacuucugagagcuuuggggcaauccucugguauguaauugcuuuuacaucagucauaagagagaggcaagaaugcgcuuuccuugaacuuaacaguuugggcaauuuucuauaauccaguaaauacaaauuguagcuugauuauucaucuacgucugucaagcaaauuuuaauggaugaaugaaugagucaaaucuaugcauggaaauauacaaaugugcaaaaucugggucuaauuaccaggcugcugaauuuacacaaggucagguaaacaaggcaccaauguaaugauuauuaauuguuaauaaugccuuugggaaaacauucacauuuuccuucugaauaccuaacaguuugccuuuccagucauuuuaaacucucaaaauguuagcuggucugaaaaaacagaaacauuuuugcccuacuuuucuccuuucccucuaauuccuuacuaauucuuuuugaaauaacagguaaaauguaauacauuuuucagaccucuauugaaaaucacaguuuaaugugauggugagagaauuaagggagguaacauacucacacagaagaaugaaauagcugauaucuuuugucuccacugaagggaagagaaccccucccauccaacacccucuuuucaaaaccuagccagccuucuaaaacacaaaaccaaggugcugagaaagaaaagaaaucaaagcaggcccucuucuauuuaccagaguaagucaacauuugauuguaucuugaucuucuauaaaaugaauguuggaaaaagaaucauauugaugaguaguucccuaucaaaauguccacggggagaaauaauugagggacuauuuacagaggcuuuucuuaguuuaguaacucuugaucaguguucaguuucgagcugugcuaucauuaaugucucucugugucuggaaggacacagcuuuaauccaaaagucauaaauuguagaacgaacaugucaucuguaggucacccaugcgaaaacaccuuaucuagagaaaccuaucuugcugccagugugcuuuggaaaucuuugaauauuuugcauugaugguaguacuggcaaucucuugcugggcugucuucucaucuuccauguucagaaguuauccuauauggcuaaucuaaauacauuuucucuguucuaggcucuaauucuacugugcaucuguguucacuguuauaguuguauauuuuuccuuuaugcuuuuaaacaaagguagcacaugucaaauuuuuuucccugguuauuguuucaguuaugguuguucguuguggguuagaauaugcuguauauaaauuaaagugacuugcauaauuuuugaccuuagauuccuagguagcguccuaucuguuacgauagagcacuuugagaauaugccacaaucuuugugcauccuugugagagcugugguaguuuaauuauaucuacauagaacuguagcacaagucuuuauauggcucugagacauugacuuauccaucuuuucuccccacacacuuuucuuuggagcacugucaaauaacuauuccuuucaucagaccuuauauucuuucgacugccagaauuauccuugucugcuugccaucucguuaaauuauccuuagccuuaaugaccuaaggccaucccagcaugguccccacaccuauaaccuauaacucagaaggcugagacaggaagguugacauggauuggaagccaggcuggaccacauuguaaauuccagaccaaucucuaggaaguuuuucauagacaucauacuuauggaacguuauuuuguguccugaauuucuucagaaguuugaccauauaauauuuucucuauuucuuuaauauaguauaucgaaguauguuguuuuauuuugcaaaauauuuuucacuauaauauugaagaauucuggagagcagaagaaagaaaaaauauuuuuaagccaccauucaaauacuuuguuaucacuucuauguacacagugccauuuaacuccugcaguacucuuuaugggggugccucauaaagaaggaauuggaaccuuagaggaagaaaaucaguugauguuguaauuuguacagcggaaauguaauuugggucccuucugauucaaagcccauguauuuuuuuuuugaaagauuaaaaaaaaaacacacuuguuccauaaagaagugacauuuugcaucuuggucuauccauuuauagaaaguuaaaagaacaaaagagguauucaauuguugauugaauuugugacuguggaugucugaauugauucugcuucuuuucuuuuacccauuugcuauaaauggugugaauuagcaacaaaauagcugaagucuuaguaagggcccucucuauucucagagagggugaacacaucagaacaucagcgguugacaguuguguuccaaccuuaagacagugcuugaaacaaauucuuuuaucuguuuaaauauuuuuucccauauucguccuaguauucauugauauuuuuaaauaucacuuuucuuacuuguuuacauuucauuuuuaaaaacuaaauaucauugucaaagcaagaauaaucuuguuucagccagugaacuaauaaaauggcaauuucagaaugaugcauauucuagaguauauauaaaacguaaggagucuuuuuucccucucucugagugcuucaugaauaaaccagggugcucgcuaaaaaagcauauucuaacugacuuccauuucgaaccuauugcugagcuguuaauuugucgauagguaagggaaagcuggcauugcaucuuauagaaaauaaaguuguuuacacguucuauuaacugaguuuuaugggauauguuuguucucaaauaauagaaagauuagaaguaagagugucuaaccaaagaaugaaaagaauuucagauugauggucacaggcaauguuauugagcuuugggcugauaaaaauaugauccauuuagguaucuaagguuuccucuuagcaacuuuugugcauauugauaaguucagcacauuuugcaagcauuuacuaaugccauaaugcauuccccauaucuuccaucuuaauuuuuuacguuauugauugaagauucaauugagaaauguguuuagaacccugcuuucugugguaaucauagaagucaguggggagacaagaaaauugcauugaaagaaauugugugcguuuguguuuuguguuucagcauagauuaucucugccaaaauaauagcugucauuuuguucuuguucuauuaguggccuguagcuugcugcuacuccuuugccugaguuuugcuucugaccacuggcuauuaccagcagcacgaagaccuuuuuaauugaaugucuagguuugcaugauucuauccaagugucacuggaauuugauccauuucaaauuagagaguccuuaguuacggccuuucaccccaacauaacagcccuuuaacauuuagagacuuugaaacuugacuucuguuuagaauuucauaucaugcccaucugggaaggggguggugguggauggaaaauguauacgcugagccuauaggacuuccuguggugcuuauuaguccuuuauggaucauuugaaauguuucuaguuuauuuaagcuuugcugcuuguaucagauuguucuaugaaaaaagagaaagugaucaugcuuugaauuuuuaaaaaugaucucacuuucaagcaaaagcacuuuuaugcuccauuaaaguugaauuugccaaacucuuacgucgcauuaacacaagcuuuacuggauagguaaacguguuguucaaaggcugacuugaacuuuaccaaacugcauauuaagauuuuuuucuuuaugcuuuuuauuucuuaaguuauuuuaaaauggauuuguuaaaaucgauuauuccaaauauguugcuccaaugauaaaauaauuuuugugugauuuacaguauagauguagauuguuagcuaauuauuugaauaugaaacuaaagaaaaauaccuuaagccauuaauuuaguguuuucauaguuucuauagcaucaguuuccguaaauuugauuuuguuucuugaauuuguacaaguggcuuaauuuagaacaaacauuuuuaacucagguuuaucguauaucuuugaaagcuuggguuuuuguguguguguauuugaguagauuauuaggcaauaaaaugacuauccuuuccuuucuuucaaguuaguggauaguuuaaauaaguccaggaaaccuuucucuuuuguacuaauuauagugagguuuuaaaauuguauuuauuucaugaagaguuuuaacuuagaaauagucuuugacuauaucuccuuuugaccuggaguucuucagaguucuagucugauuuguuccaugcuccuugccuaccuuggauuagcauaaggacuucaucuuucuuuugcaucucuuuagucuugagcuuuaauguagucuucagaaagacuaugcuaguuuucuacuugaaaugucuuucucuguuuuuaaauacacaaaaccuuuauaauguaugggauuugauuuuuauaauaaacacauucaugaccuuuuuuuaaagaagugauuuacuuuaauauuuguagugaacuugaaaguuguuuuaauggaaacaaaauauaauuuaauaucaagcuaaaucuuuuucaguucuuagauuccacauuuuuggaguugagucguuggaagguauuaacaaggaagguacauuuucaagaaauuguuucuuuaaagcaaacagaaaauuauaagcacagagagaaaggggaacguuuuaucugcuuugugaagggagaaaucuaagcauguacaugaaagaccauuuuaacguuagcuuuucauuucuagugaucgaugguaccuuguuaguaaggaacuguauuaacuuugacuucuaauauaaaaaucuucacugaauucauuuuucacuaauucacuuucuuuuuaucuccuaguguuuccaugaccuuucagaaauguggaguuucauauuuuguacuauacaaaagcuaccccuuagguugcauugaauaacacaaaguugaauuauggcauaaugguaguucucuguggcauuuccaggugaaacauacuuuuuguuugcuaaguucguaagugaaucguuuuuaauguuguucauguuagggaaaagguuaaauggguacugcugagcuccuuuuaauggccaaaugagaggacuugucuugguuguucauuggaaagcugugguguauuuucauuccuacaucaucauagaagaggugcuagauuguucugcagcuuucagauagaacuuuuaucaaacauacuucauaaacugcucaaguagugagaagauucugugucacuuuauagugacauuaaaaauauuucaggauuuagccaggcgugguggcgcacgccuuuaaucccagcacuugggaggcagaggcaggcggauuucugaguucgaggccagccuggucuacaaagugaguuccaagacagccagggcuacacagagaaacccugucucggaaaaaaaaaaucaggauuugaaaacuugggacaugauauuacuucucaaagccauaaacuuugagaagcccugaaaagaggcaagagagcaaugcuuugaguucuuuguucuaguaggaagccuaguaacucccgggaaauggaaugauugggauuaaaaaacuuuuagcauuaucuuucuaaaaaauauacuacuaccuuagcuuuaacuuucauuauccaacaggccauaugugcuggauaaauauucacuauuuaguugauguaaucaucaccgaguuuuguuaugaagggacgugagaagguagucacaguuaucuaccaguagucaaucugauuaaaaugugcaugcagaugcaugcaugccuuagagaaggagagaagaugaguuuguguaugcgggaauuguacuuguuugcacaaguaccugaaggcaacuuaagacaguaguagccuuacauaccgugcucauuauuauucuauaaaagagucaggucucuauucaugggaauauacccagggacucagaaagugaagaguuugcuucaaagcaguaugcugacuuuuuucuuuuaccugcaucuuguaaggaggguuggauacagugaagaaaggcauugauggcuuuggaacucuuaccucucauagccugaaggaagcugaagcguggccaucugaauuacucuuaauaucacagagcuuaauuucaucaagaaaaaaauuuuccagcccuuguaguuucucagagacucuccuaggccauagaagcucaaagcucagugagccugucagggucuaagaaguuggcuggugacuuucuguuuucuucucuaucuucaaaccuccccgauuuuauucuaguguguucaaaccucuuccucuugaagucauguucaauuucucacacuccaggucucaaagugauuccuccagacagaacaguucaaguugugcuuuaauguagaccuuccuaguguguuugaaccuauaugacuucaaaaggaagagguucaaacaccccaagagugugccuaggaagaaggguugauuagguaaagacuucucuguuuuuaggaaauuaguggccuacuccagacucauuuucugcuuucccagagguacacucagugacagugcuaaaagaagaaagucaaauucuuuaguuuuauuauauaaaacuaaagagaaucuucuucaagaagcauuccuuaagcuucagagucaaaucagaagugggcaguauguuagcaacuaaacugucaugucuaaaccauuuccacacuuaagugaagcauuccagccuugcuguaaaugagcaaaauaugaagcagguucuagcaaggucaaaacaucuggggagguaaauuaguauucuuugaauuuguuucaguuacauaugaaagcauccuaaaauggaagauuuauauuucuuccaacuuaggaauugaaaaagaauguaaauuuaaaauucuauuuaaucuuuugguuuugagaguuguagcauauugaacacaaugacaggauguaucaacugagcuuauuuauaauugugcuuaugcauaacacauuugcccaucauucuagcccucuuccuuaaccugguuucuguguuucacagccugguagaguaugccauguaguuugauuuccuuugauggguagagauucaguagucuaaagagcucuuacuacuaagccuuuuuuauaugaaaggcuuauucaucaugaacuuugaaaaacuucauaaaaccaauugcuggguaucauacccacagaaccugauuccacaucuaggguaagacuguauaauaggcaucuauaacauuuauauuuauguggucuuuauaugguauuuauggauuguauauuaagguacacugcuauacacaucccauuauuguaucauauagaguaguuuuacuaaccuaaaaaucuuugcuucaccgauuuaaaagcacuuugaaaauguuguuaaaugguaagugcaauaauaugauagucugacuuaauaacaguuggguaaugagauuauuuugugcuugacaagguaguguacaucuguaauuucagcacuugggagacugagacaggagguuuacaaauuugacgccagcuugagcuaugcaguaaguuuuaauacagucuagggugcuaugguaaaauaacaauauguuguaaaacuagagauuuuuuccccuuaagcaaaccuuaauaaccauuacuauauagucuguuuuagcacuagucugucugaaagaaguauaggauuccccaaacugagaccacuccuaugccacauuauauuguacuauuucacuauauuuucagacugaguuaaagaggugugauugaauaagaaagcugaauuuacguucaauccauauuaagccuagaagcucuuuagaguacuuaaucucuaacugucaaaugaaauauuuuagucaugaguuagccauuuaaugaccuuaaacugaauucagcagcaaguuuauuuuaggcacuuugaaacaaagauaaagauacaggcuuuguaaugaucuuaaucaaauuaccuuuucucagcacagagaucaauccaucuaugaauuaacucauggguguacaacugaagauucuugugaaauugguuggagggacaccccaguagaaauggugaucaauaguauugaguugucaaagagcuaaccgucauaagaacaagaaauauauuuuaaaaauuggaagggcaggaaaaacggcauuacuuguagauugcuauaaacuuggaaaacucagugaaauuuaucauaaaagacaaaaauuauuaagaaugauauuuuuaaaauuaauuacauaucaguagcuuuugagcuauacaauuaccaauuagaaaguguaacaagaaauuuaauguauacaaaugacagugaauaugagauaugaaagaauauauuuaaaugcuaaauguaaagaaaacuauaaaauauagaaagacagaaaaacaucuuaaaaauacauucuuaguuauaucacaguuuuuguacacuuuuuuuuucaaaauuuaaacaaugaaaagauuuauaaaaacuacuauaggaguauagggugacuauuuuuccccuaugaguauuuaaugauuugaauagaauugcuacagaagaauucagaaauaaauccaaaauugaaauuaguaguuuauaagaggaugauuuauagcaguagauaagaaucaucugaaaaauguauagcugaauguucuccuuccuccuucagggcagagaaggacacguuaaagguguacuaaccuugggaagucuuuuucaaagcaggugauuguguagaauaguuucaggaucacaauaauuucuccuagauuuccagcuucaucacuugcauauccucacaacaucuguuauaguggaaugcccaucaugaguaugugaacguaugaacguguggacauuggcucaguguucauaguuaccuuacagcucauucuugguguuaaacauuguauguaaggaaauauacaguagcaagugucaauuguaguaucauggaguaguuugacgccucuaaaaauccucugugcucuacuugagaacacuuugaaacaauaaaaauuucagacuccaaaaagagaggaaaacauuaguaaaugugacuauaaguuuaaaagaauuuauauugacugcaaagauggcucagugauuaagaacacuggaugucuagagaacuuagguucuagagaucccaguacucaugugacaccuccuaacuguaacucuaauuccaggagaucugaugcccuccacugguuuucacaacacuagacacagagauacaugcagcaaaauacucaaauacacauaaaaucaucaguaauagaauuucuguuuugcauuuauguauacacacaugcaugccauuaaguuaaaaaaaauuaugagcaacaaacaaugcacuaauaaacagggccugacuacuuucauauauaaaguacuccuuuucucuucacgaagcugugagguuaaauaaaccauucccuauuugaaaauuaaaguccccuuucaauucagggcaaaaaaggagaaccaccuuguagggaaaacuaggccaaaggcaggcaacugcaacuccugggcaaaucuguaugcauuuauaggguauuaccuuuauauuuuauaaaacaggcuuuacaacaguguauauaacacucuuguaaugaucucuuuuuuuacuuuucuuuuugagacagggucccaugcaucccaguuuaugcagguccucgguauugaacucuuggcuucuuggauaguacucuauccauugagcuaaguuucuaguccccauuuauguuuuuuuuaaucaagaauuguuaauguaugcuaauauacguguguauauacuuuuuuaacuuagcacaauauauccaaauuauuucagacuauaaugcauauuuaaaaauaucaggaagcuguaguuuuacccuugcaucacaucugaguuuggagcagccacauuacaagugcucaagaacugcaugcagcucuaaugucugauguauugagcaucauguuagaaaguguaaagaaaagaacauuggacuggaaguucaguucacauacuaggcauuaguacaaggaauugacuuuuaggagguuuuauuuuccuuagguguaaagagcucugaagucucuuccaccuuuaaaauuuaggguuaaaauacaugauuucaugcuaccugucaaaaauguuaauuguggucacuucuuauauacacuuauuuaaaaacccuccucuaaaauacuuuuauucuuagaggagaacauuucauauuuuagagacauauuuagaggauguauuuagaguaugucuuuguugcuuucuucaaauugcuacuaagcuacacacuugguauaaagcauuuagaaucagucuauucuauugguagaauuaagacugauuugaggcuuugcuaaaucagacacugucuggagaacuugagagaguuagaauagcugcauaagcaguauguagagagggaaaaaaguaaauauugaaugagaaagaaauugagagagacuauuccgaaguauaauucuguuaauaaagugcauuguucagaaaaucaucuuagacagcagagagaagaugagaguaaugcagagcagugauucucaacccugacugccuaguagcaucgcucauggauuguuuuuuuuuuucuuuaaauaaaaacaaaaacagaacaaaacaaaaaaccaguacccauucuaaaaggcacuggugauucuaaaaguaaggacccaaaucagcaacagcacaccuggagaccuguuaaagaugcugcuucuccggccccagcccagcccagcccagcccagcccagcccagcccagcccucagucagaagcccuggagauggugcccagccaccuguguuaaugcuccuucggagauuuuagugugcagccagaguuucaaauugaaaagaaagaauuuggggauaguauaucaggcagguuuccuguuaauugcaagcuaccaucuuauaggggacauggggaaguaaacugaagaagaaauguaguccaucugcuagauauuucuaauuucugauuuaggguuuugaguaauuuauuaaaguuauaggaggcuagcugucaucaugccuuuuagaccuaaacaaaccaaugucaagaaaggaaaaauagaaacuuuggaaaaggaacuauuaagguugggaagaaggcagguauauuagguaauuauuacaagugaagggauucuggacagauuauaaaguguuuuauuuguaccuauggguuucuuaaaggacuuaaguguuauagggauuuuaugccuaguuuaucaucuauccauuucauuugaucaaaaauuacuaaaggcuuguuugccccuuuugucauugauauuaaagggaacauuuucucuuaccauuuagacuuuugauguagggugcauuuuauagagacaccaugcauguguaacuaaucaagaaaguaaaauacauauuaucaaaauaucgaaagauguccccugccugaaaagguuguaaugugugccauuguuuugauuucuacuccucaaaagaaaaaaaaaagaaaaaaaagauuaauuacaguaccucuaauuucuaaggcauuuucugaagaauguuacauugugaucucuccaagcuaaaucuuagguguguggagaucuuucagcccugacaaaauaagaauagacccauuauaguauccuauucauuugauuuuucaaaaguuaggggaaauaugcagaucuuuucagagccucucauuugguuccuccucauuaggaggcagcaaaugaaggaaagcgagcugggcuguguucagaaugcgucugcagcugcuuaucucuagagagcucggcagugggacuucugcaagcccuugcucuguguauuucuuuuucuugucccugaauacuacauuuugcaggagaaagucaguguuuauaauuuacaaaaaaugggggcauuauaauagaaugugugccucuuaggaaaaacaccugcuucuuuacuacaaaaaucaaaccugccucucacaucugacuuuaaaacauucugaucuaacuuuuacagucacauuuauuagugaaaagauaaugcuauaugaaaaacugcuuaucuaccgaaaaugcuauuuugauuuuugcauuaauuccugaguagucaguuuauauuuuagauuguuuugugaauugggauuucugugaguauaaagugguuuucaaaccauuggugauauugcugaacaucuuccauaaauagcaaacacacacauuucaacagcuuuuuuuggacuguaccgcaguugauaauuucuuuacaagaaaauguauguucuuuauuauuaacaucauuuucccaucuuauguucuggcauuuaaauuaugaaacuucaucucggcauguagacuuaccuuguguugucaagaggacagaaguggcuuuucugcaaagcuaaauaguuuuuacuuuauugucugcuacgaaacagcugcugaaaccagaaaaaugccaucucaucauugggccugggguguccaaaagaggcaggaaaacaaaugacuguagcucccugucugcccuggcacucuccuccuuuuucucguuuucauugccgugaagagcaggagaacaauauucugcaauuaaggauuccauuaaauugaagaaaagagcaaaugggggauguuuguucuccaagcugaaaaaauuugucuggggugggggggacagugguacugguauagagagagguggguggagagacgaagucagggcuguuuguugaauauacuguuaaggacuguuaccauccuaauuaaucaaguuagaaauuacagcuguagucgguuuccccccaauucuuguuaucaauuuucuucucuuuugagacaaagcaaauauaaauuuuguguucauuugucauucguucuuugacuucagcaucucugaaaauaacaauguagcacaaaagcccaguauuuaccuaguuguaauguggguugccaugguguuuugcaaauuauugcaauuauguucaccaugcgagucgcccuugguaacuggcgaaaaaacugauaauccuguuuugaacaaaaggucaaauugcugaauagaaagucuugauuaacuaaaagauguacaaaguggaauuauuuccuaccauucagaaauaguucuugaucggguuugggggagggggugaguaaguacaucugauuacugaaguacaaagcauugaaaggauguugucuugagccuuucauguagucuuaaugguggcuuuuuugucaaauuuacccauuugcggcauugaaagaggcagcugcauuuaagcuggagagacggugcuuuuucaagaguucagugcauggaaaguucucagcaguaucugcaguuuacuaguagccccuggucuauuaaaacugaugugccgcauuugagcccauugcucucaguacuugugaaccccucuggcugaugaucuaauaaagugcucuuacuggacaaucucugaucagcuacuuuaaaaaggaggcugggggagggguggguuagaagaagccucacaggcagucaguccugguacuagccagaagagaggaagaaaguagcuaaaccgaaaggguugucagcauacugagguuuugccauggcuuuugaguuucugugccccaaaacucuuuagcugagaucacauccccccaccuucuucagaagaaaucuuuauuucaguuaagauuggaagagggaauuaggaaugccuuuuuugaaauacuggaauccaccuugauauauguuuuuuagauuguggguauccaaaguuucccauguuacagccagaggucaaauggauuucaucucuuuugaaugucauagaguauuuguggaacgugaauuuggagggagggauucuuuuucuguagugaccaccugaaaacucaguucucaaaacuuuugaaagugugugaaaguagcaugaaagcaaagcaaacuugaacaaguuuguggguuuacauucuguaucaccuagcaacccccuggcucagccagaucucuugucuccccuuaguucuguuuacagacuauucaaacggcccuucgagaccaugaaagauauucaguuucauuaguaccauucucaaggagaaaauaauuaaaguuaagcuaacaaacauugccuggugauagugugaauuccauuuugauuuuuaugaggcaacugcauagauaguucaguuuuaacauuguuauuugguauccaaagacacauugcuuuaagccaugcuaaccaauacauaucuacaaaaaacagaaaaaaacaaacaaaaaaaaaccaaaacaacaacaacaaaaaccaaucaaaguaacuuuuaacuguacuuaagcaaagaaaaauucuauggugaaggacuaugccugcucuuuugauuuaauuuuuuucauuugccuagagacaucuggguggaucuguauuuacauuggauccaggcagggaagaaggugugaagagcaagauaccucucuucaaauugauuaccugccuuuagagaucaaucauaaggaacuguuuucagaucauauuacauaagaaacuauguauuuuaaugagugagcuaauuuauuaaaucauucuaauguuuccagaacauguccugucauuuucgguucaagaacugcuuaugugauuaaauggacucauucuugaaacuuuaguaggaaaaacauucccuccaccuugccaugagcauauucucugcaaauucaucuuggaaacagcccuggucaaaaaacuuuuucaucaucaauaacaguuuuuagaucuuuaaauuaauaugcuuuuguuuguuuguuuguuuaaaaaugcagaagaaacauuguaaagauaacggaagcuggagguuuugcaguaguucuuucuagucuuucccacucuggacauggugauaaaacugagcauugagcuugcuuuuggaguuuguuauuuugaauacaaaaguaugguaguggguuuuuaaaagagugaugacuugaaaugaugauagaaauaauaaacaauuuaucuuagcacuucaucacuaaaauguuaauguaagccccagaguaaccauuuugccaugucauuaacauuggagucuuuuccucuuuuuccauggugaaaugucuguauaugugcuuuaacuugauaugcccauuuauaaucauguuagggagucagucaucacaguuagaauauuauaagucacuugcagcuucacaugaggggaauaaagucuuuuauggaaagauuugugauacaauagagaugaauguggagaagcaaaugcucucaguuuuucguguaaagugaaagcaggguagcucugaaaucuuguauucuuauuauuuguauuuugccagaucucuaacauccacaguacauggcuagguugcaugaguucuuuguguuuuguugacagucaacagacaaagcaaaauuauucuugaaacaagguacuguauacuuaguugugaccuauuauaaccuaagaauguugcuugcuuuugaguugagugaauagggagaguauuuuauggaauaagcuugaguauaccgagugauuuuuuuuuuaaagcuacucauacagagagauacauguucuucaaugaacuuuuuccacccaaaguguaauuuuccauauaaagucauuuuagguauauuuuccccacuagcuagcauggcaacaauuuuaacuguucucuuauuguccuguagugguaaaaaugcaauugcuggcaauuguuggcuuucugugcucacacuguagcaggagauggcuuacacggaugugccucagguacaucuucugauguuuaaacucugauugcaaauuaaaauaguaagaccauaguauugaauuugaugugaggcagagcagaccagguugcuaaucuaucauguaauauacaauuggugagcuuguaguuuguccacuugugcuauucuauguguuuaaaugaggaccacaguuugcauguaaccuaucauaacaguuugggaguguuucauuauccuuucagcaaacugaugacagagucuguccuuacacaaaugguaagaucaauaaguuucaaauagcuuggaugaaaugacagaugacuguucauuuaaagagaucuccaacuuaaaaaucuauuuuaaugauauuuaaaauucuuacauugacugacaugacacuuuccacuucugauuguuugauaauuuuguuuaaaauauuuuuguauuaaauuugguaaguaguuuauauauuuauuuuacuugauuugcccuuucaucuccgacucuggcaccuuucugagacuuaauaaucacucuuugacaugucagcaugcugcagugucaaauauuuaaaagcaaauuuguguuccuguuaaaacuuccccuggagagcuuagggaaauuuucucccaguuuugggugucagugugggucagaaagcaaauauauauuuuuuucuggaaaucccaaaucauaacaugucauucuucagaagcagcugcgggcccauacugugcacugucuauaagaagacccccuuuuuuaaugcauugggcauaauucuguggcagaaaauguugccugcaagggaacuccagaaauuuauaaaugccuuuggaugaaaagagaaucugaugcucuuugaaucugaauaguuuaagaagaagggugguuggugaguguuacaaaacuaauagugauauaauagauuauaaaaucgcaugcaggcuggcagaccuugccccgugacuaugucgccauaacagcuccuugaaaacuguuaggauuuagacuaaauuguaugucaugguugaaccaucucuugaaaaucucugugaauccuaaaguaaagcgaagacucugucuucuucccuugucauuuauucugccucuauaauuucauauuaaguacagcuuuguugugaaaaauaagaaauucucucuuaaauugaccacauucuuguuaauauucuccacucaauuugaaagcaguuacacuuuuaauauuaauuaucauuuauccauuauuaugguucuccacuuguuuuuuucccuuccccugguuugucuguccguccaucugucugucugucucuauaaucuauguaauagccugggacucacgaugauauccaaguuagucucaaacucagagagauccaccugucucugucuccuuaacgcugaaauuaaaacuaucuaguuggccaucaaugggaggagaggcccuggucuugggaagaucuuaugcuucaguacacgggaaugccaaggccaggaagcagggguggguugguugggcagccggguagggggaguguauaggggacuuuugggauaacaaacagugaugcuccucagugcacuuauugaauauuuugugagguuguuguuuguuuauuuuuguguuugauccucuaaacaacagcaauaaguauuuuguucuauagaugaggaaacugagguucagagagagauuugguagguuucaugacuuacagaaaauuauccaguaacauuugggaguacaguguuucauggagugagucugugcacuagugacuggcaagaagaccacuaaacucaaaccagauuauucuuuggggucugaccaguucaaagguaaaauaaaaugcuucagggacaaugugaaccaguguaugguuauuguguaaugaaauaaagggagaagucccagugggcugagaauauguagaagaauggacauuuuauucaagcaauggauauuuuagaaagggauuaugugacaugcaaucucaaagugaagacagccaagaaguagagaggauagugacaaaagcaauccaauggagcaaagacuauuuguugagaauugagaaagcagggaccacaguguccugaaagucggacugaugaguucaucacuugucuguggagagaaaacacagacaggauggagagcccugcggaacuauacuuggccaauuuuuguagugggcgugggagagaaugggcucacgguagccagggaagaggcuacugcagcagaacagcuuaaaaucugcauuuuuggugaguuugaugguaacaaggcuguagaugaaaagucagugugacagaauaggugacuggcuggccauagaggaacccaucauguauacugaagggaauuugagauccaggccuuaccucauuucagaacugugcuccccugucuuggaauuuuuuaaaaaguuuuugaaugccccuguguaccacaucugggugagcucugcaucuuuaaaucccucaaacacaaauguacacaaaugaguaguaguuuguguuuuagguucaacuaucaaggaugccucagagucauuuuagcugagaccucagaaauauaauuuagcagucaaaacugaucaguauuuguaacaguuugguaccuaaagauuuuaaugaauaaugaugaugagauaaaacaacaggugauagagcuuugcauguuuguuuuguuauuggauaggcugacuugaccuccuuugacccuuucauuuaugaacuugaggaagccaggcaacugaaaaugugauguccucauuccaauuuguuguaagaauuugaauguagcauuacacaguaguaagaugacauauuuggacgacauacuucucauagugguuuucuuagauuggacuuccaaggaaauuauucaaaacaaauuucuucuucuauugacuugacaacagauccuugggcuuuccauguuauccuacggggaaauaaaaauguuuaguuuuguuauuauauauuaguuacgauaauuuaaaguaagaucacaagauucuaguaguuucauuugcuuuguuucuguugcccuuuaccaauaacauucaccauaaugauuuuguacuagacacuuugccccauguuuuuucaaagucuuguaauuuauuuuuuaacaauguaaguguuucuugaaaguuaaacuuagcauuguugcuuaccauuuguuuauggaguaaaguguuagcugaaauguacuaggugaaauugaauugaaacaaagcauaucuuggaaacagagccugguuuccccauaaaagaguuuuguuuaaaauguagcauguccaaaagcuuaauuaucaaaguaaaacaugaggcauaaagaauuaccagcuucuaauauuuucuucaccaucaguucucuucacacaguuaucagcauguuuaauuuucaugcauaauggcacuaguuuuuguugucauuuauaaagggagauuaacagauaguaaguacaaacaaacccaaauaagcacugaauagaaaggugacaaagaaagaaagaccucuuuaaugguaauuauaacugcuaggaaauuuagacaaauuauauuaucuguuuucuauaugauuugaaaggacuuuaguuaguaacugucagagagugaguuaggucuuugcuuuuuuaaaacgggugaaacagcaacuuagcaucuuguuaguuggcagcucacuuggugaaucaugaaguaguauugcagugaugaaauuaaguguuuaaaacaucuguaaaggacuuacgcuuuugaacauaauauuuuguaaguuaaaaaacaaauuccuggaccgggugucaugccuacaauuucugcacucgggacagagucaggaagauugugaguuggaggccagacagaaccugucuuaaaauacgcaauaauaauaacuuauuuuauuauuuaaugacuaaguuguauucugguacuuaaugaucucuugucucaaacgugauacugagcuaggcauaaugacacuuugcuuauauccuggguacuuuagaggcuaagccaggaagauuaugaguuucaggucagccugagcuagauagcacaaaccaccaacccccaucuuaaaaguaaauacuaugguaauugguaccuauuugcuuuuuugguguuguuuguuaaaauuuagugaauuacagcuuucuaaggcuagaucuaguuaagcaaugagcuucauaucucaaauacaucccuccuggaugcugaguugcugcuacucggugcagacuaugcuuuccuacuuagaguccaguuucuugaaaugcugagccuggugccccuuugccaguuuuuaacaaaacucuaggugcaugucagaaauuuuauaaggauuuguuugauauucuguaccugauaaguucaaguuacaaucuaaaauaguuuaauuuacugaaugaagguaugaguaaaacuuccuucuguucgcuagaugacuuuuuuuacuguuuaaagauaaguuguacaaaugcacuuugcuuuguuugaaagcucuaaauggagcuagaagaaccaauccuugaugguuuccuuugaguuuguuuguaccuacuuccaugaaagaaugauaaaugaggaauguggucagagcagugagcgagggcaucccucagauuuggaauaacagcacauggaaaugccaugauguggguggagguucaagcaucucaagccacacucaaguguaugcagcuuuuaucuaggggguaggacaagcugcugaaagugcaaauaaggaauggagcuacacaugcuacuuaugccuuuguuaacuaaacuauacuuugacucuggccucaauuuggcauguugguuguucuuucugcccaaguuuuucuuuuccaccuaccaaacuucugguuauucuucaagucagaaauuaucucucagaaugccccaagccuuauagauagccaguaccucccuucuuagggccuuauaggaaugggcacugagaugagagaacauaaggauauaaguugcucaccuaccucagcaccucaccuugcuuggcuuggcuuuacugugccucgguagcaauguauguaccaucaaagcccacaagccuuagggccucaguaugaaugggaaucuacucaacuauuugugauagcuugacuuucuguuuaacauacauuuuauaguaaacauaaugcuaauucaaaaugauagacauacuguauugagaaaauuuaaagaacaggaagggagaguuaacauaagaagaaaaggugacauuauauuuacaggccagagaaauaggcaauggcugccucaaaccucagaaaaauagugcuuauuccaaguuguccuugaaaacauagcaaccagauuuaugccuccagagaacacacauaguacaaacugauguaagucuaauauuuacuaguauuaagcauuucuuuuauaacaagaacacuugcaaguacuuuaaguguguuacaucacuacagcagucuuauaagucauaaaaucaguacuauugacauaccuauuuuauaaagaaggggaacugagcauaguuauauaacuagguagugaucagucagcuuuuaugaaggucacuuguuacuauacacuuggugugauggucuuaacuaaaacccuuugauuuacagguugcauaauaauaaguuuuuauugugaaauuucgauggggggcauauauauucuuuaagaaaaggcaaaaccuuaugggaaucccucugagauuuuuuuuaagguuuuacauuucuuuuuacuucaugugugggaauauuuugccugcauguauauaaguacagcauguguagugcacacagaggccagaagaggauguuggauucccuggaacuggaguuuacagauggcugugaacugccaugcggaauugaaccugguuucuggaagaauggccaguaugcuuaaccauuaagccaucucucuaaucccauguuuuuucuaacuuuuaaguuuagagcauacaucuacuuaacacauccaaagagguagauaauuagguuauuuuguaaucucuuagcaaguuugguaagguugauaacagaaguauuuauuauuuuuguuggucaguggugauuuuucuuucuugugucuccagggcugguugauaugugaagagccaacuuguugcagucgccuucgacgucuuccccuucauuucucccgaaaugggccucuguguccagucugcaugaaagcugugcuuagaccagagguaacuauaaccuaauguuaaaguacuacacaaaagacagcagaggauuguuuguccagccuuuagcucugggaagcagaggcucuauauuugccuucugacgacaucccucuaucacauugauagauuuuuuuuccucacuauccagacuucaagaaaauacauagcuggccaugguggcaugccuuuaaucccagcacuuggggaggcagaggcaggcggauuucugaguucgaggccagccuggucuacaaagugaguuccaggacagccagggcuauacagagaaaccaugucucaaaaaaccaaaaaaaacaaaacaaaacaaaacaaaacaaaaagagagagagagaaaauacaugcuuuauauuuuaacauaucuuaaucaauauuauauuuauaagaaggggaaacauuaauucuuaugauuuacuuauguuucauaaggguuacaacuucauaauuacaaaagagauuccuuguagaaacuuauagacuuaaucaaaucccauuuuguaagcaguagaaaaucuuccaaaacuguacuucaaagaguucaucuugagaugcguuucugcgcucugugucauuaaauuguuuaucagucucuucauaggucauugguucuugagcaaaccuuaguauaguugccugagggaucaugcauacugccauuaaggacuaccaacuauggaccauggaaucuagagaggccucucugguuauuaagaugccuuuccucccaugcccccuuggaguaccuucaauccaaacuguacuuuccaaacuggugaacagaauguugcagauauuuugaacaaaaaggaucucauaacuaguuacugucuaacuauuacuaagguagacaaacuuaaacuaguucuguaagucuucuuggacguuguagugugaucauauagacuauuuuguugaaaagguaaaaguuggagauucauuauuuacuuauuuuuuaaugcaaaagcaacuuuguaguugucccaguuuuugauguaaaaucuuuucucugaaaaagaugguacacagucuaguuuuaggaaaguguuuuguuguauugucuuucuuuucuuuugcauaucuauauguaauuuugauugcugucacaaugaagguaugcuuuguagcauuuuucuguguggcuacuucaugcacuacaugcaauuuaaccacacuucuuacaggcuacuuuuucaauaggacuguaaugaaaauuuuauagugaguguuucccacucaaaugauuuuuuuuaucucaauuguuugauuaggauaguguauuaucaauguaccuaaaaguaaauauaguagugauucuuauugccacauagcuuuguugauggcuauccuaguuuuuacaguauaccaguaccuuauuaguaucccaguuugguuguugugcuguguuuauuuuguuuuucagagacaggguuucuccuuguagcucuggcuguccuggggcuuccucuguagauggggcuggccuuugcuuuugccuccugagugcugggauuaaagcuaugcaccaucaucgcccagcugaauuguacuguuuguagcaaagccuuucacacauuuggacguugucaauaacuuuucaaauaauuggguaaauauuaaaugugccuugacuuucuaaaguuucaauaauuagcauaauaauauaggguuuuaaaauguagaacaugugaaaauuagcuguccuaugaauuacuuuugcaucauucucaagacuuaagucaacagguaaauaaacagaacaaagacacaugcuguagagguccucauuagucuaauuguagagcagugauucucaaccuuccuagugcuaugacccuguaauacaguccuucauguuguugugacccccaaccauaaaauuauuuuuguugcuauuucauauagcuaauuuuacuacugcuaagaguguguguguguguguguguguguguguguguguguguguguauguguguauuugacuccuggggguugugacccacagguucuaaggagaaucauauuuuaugaaucauauuuuauuuuaccuuggagacuuaaaauaucuaacucaucaauuuaaguuggaaauuggguuauuucuuugaaagucagcuaguuugaugcaucaguuuauagugaggagaaaaaaugaaauagcguuagaggauccuuaagcuuaugauaaacaucagugguauugcugauaguaauuuaauauacuagguuaucuugugauuuagcauccuuuuuaaaugagccaacacaagcauuucaaaguaacuugguuuuuucccuuauauucuacccuucuccauacuaugacauuuuaagcagauguuuaccauagucuaagcuacuuauccucaggagaagcuuugauagauuggcugcucagacacgaccuucuggaauuacuauuucagaauguacugauuagugaaacuguccuuaucguuucugaacaggagccuugaaaguaguacucagcuaauuuuucauuaguccauuugaauugcuaguaaugaauuaggaaaguaauacuaugaugcuuuucuccugaguuuuucuacuagcaauaaaacauuaaucuuaccaaagacgcuggagaagcaguuuuacaaugcacaucaucacugcagguucuacagauuuuccaaaauaacaauuuuacaagauuaugcucaucuugcugggugugguggugcacgccuuuaaucccugcagaggcagguggaccuuuuacuuugaggccauuugggccuacagaacaaguaccagaauagccagccaggacuguauagagaaauaguguuucaaaaccuucacccucaaaaaaagaaaagaaaagauuaugcucaucuaguacuuaagcucucaauuacugagucucagcuguaucucuuauuuaauaauaaugccagguguagugguacaugcuuauaagccuagcaauuagguguuugaaacagggcuaccaugaauuugaggccagccuggucuauaaaaugaagugugauucccuccuuuaaaaaaaaauuguauuaaacaccuacccuauaaaauuugcucagcauuggggacguuuauagaucuucuacauuuucuuauuugugaauagaagaauguauaaaaaaaugugguauaucuacacagugagguuuuauuuagcuauacaaaagaaugaaguaaugcaauucuuaugaaaauucauugaaccagagauuaucacguuaaauggaagaauacagauucagaaagaaaaacauuuuauaucuucccuguauauagacucuagauuuaagaauacuacagagagaggauaugggacaucaguauaaauauaauuaaacuacguugcagguauguaugaaaaugucacaauaaauccauuguuuuauacacauaguauuaacaauuuagaaaguaguuuaacauugauuguauaaaauuguuaucugugggcaaaacaaggucauuuauaaauugaacaaaucacaguccauuucuaguaugaaacuagugaagauuucagauagguucaaguuugugguaaaacacuagauguuuaaggugccagucucaucuucaucuaaucacucucuuaguccuggauuacaguuaauuugaauacuuucuagaauugacuugggauaugcaacuuggccuuuuuaagacucauauugccugaguuaugagcaaaaaacagggacaguuuuguuuccagagcuuuggacaugccuuuucucuguuagauacauuaaaauaugcuuucuguauucuuaaauuuucuuuggacgcaugggaauuuaaugguauacaaguuguuguuuauuaaaaauacucucaaucuuaucugcuuuaaauggcuuuaaauucagaaguacaguuuuauauuauuaaauaauaagaucuucuucauuugucguagugacaaagcuuggacuuaacuaaaugaaguaauaaauauuuuaauaaggacgugguguuugguuuucuuaacauagccauguacacagauagcaacugaaccacaggagaaucuguauuguuauuaaucaaaaccaagcuuaaguugaaaagaacaauuuuuuauuuuauuguaaaguagauacaguggguuuuuuuuucccuuuaaucuuagcacucagaaggcucagguagaaagauagcuaugaguuuaaggccagcucagguuaugucauggaauacuucucccuaaaaacaaacacauccauggguggugguguuguuguuguagaauuuagauuucaaagcaaauuaauuuuuuuaccauugacaguucuaauuuugauaugcagcuaaaauaauguuugcacgugauuccuugggucaugguaguaauaaugugagaaauuaaacaauuccuaggguagaaauacuguaguagaguucuuuauucaguuguuuauucaacuaauuuucuguuucuuuuuuuccauuuucuuauuggauauuuucuuaauuuacauuucaaauguuauccccuuuccuggucuccccacaaaaccuccucucccauccuccuuccccuuugcuucuaugagguuguuccucuacccacccacccucuccugccuccacuggggcauccaucaagccuucacaggaccaagguccucuccucccauugaugccugacaaggccaucuuuugcuacauguguggcuggagccauugucccuacaaguguacuccuugguuggugguuuaguuccugggagcucuaggaggcaggggugggggggucugguugguugaaauuguucuuccuaugggguugcaaaccccuucagcuccuucaguccuuucucuaacuccuccauuggggacccugugcucaguccaaugguuggcuguaagcauccgcaucuguauuggucaggcucuggcagagccucucaugagacagcuauaucaggcuccuguuagcuagaacuucuuagcauccacaauagugucuggguuuggugauauuaaaaacaaugaauucacgaaauucuuagcuaaauggauggaacuagaaauuaucaucaugagugugguaaccuaaucacaaaagaacacacaugguauacacucacugaugaguggauauuagcccagaagcuccgaauacccaagauacaauucauagaccacaugaagcucaagaagaaggaagaccaaagugcuucaguccuuuuuagaaaggggaacaaaauacucacaggagcaaauauggagacaaacuguagaucagagacugaaggaaaggccauccagagacugucccaccugggaaucuaucccauauacagucaacuaauuuucuuaaaggauacuuccaggggaaaccauaacaugcccuuuuguucuacauugggacaguccucagcuuucucacauuauccucuauuguaaaauuguugagguccuuucugucaccaucacugucaugcacagcuucuguucuuccagggagagagaagauuauuaccccaaagucauaauaugguaugacuucagaauggcuaugccuaaacaaauuguugguuuaaugaguaagggauggaucaagaauguugacaagcuacuuggguaguguuuuauauuucuacauaaguaaaaguaugacaauaauuguggucucuuaaggaauuaugaaugaaaugggugagggaagaggaccucagagcuguagugggaaaucugaaacauuguugauguuccaguauagaaagaggcuuuuuuuguggaaggcauguuagaguuuuggugugcuuaaacacugagaucucugaauuuuauguauagcuucucuacuaccaagcacauacucaacuuuuauuuuucaauauauuuuucacgcuuuuuuccuacaaagagaaaauugaaauaauauuuuaagguaaacaauauauugccauuugauauauucuuaauguguuacuggcaugucuguccaauugcaaccauuuaccaccccaaaagcaaaggcugugcccauuagugccuaguccauauccucuucuccuccuaccuacaacaaaaggccugucugcucucagucucagcaauuuaccuaugcugaggauuucauauaaaugagauuauaugucacccuuugugucugacuucuuucauuuaacauacuguccauccuuauauccugugugaauuuucuuucuuuuuugauggccaauaguauuuaauuaaacccagauggaugauucaucuguuuguugaugaacauuucuaguuacucuuaaaguuuuauauuuuauuaaguaaaaaggucuuacauaugcucuguauuugugacccauguuucacuuauuagucuuauuuccaaggguaauacugcaugaaucuggacugauauuucucucucuguuccugucuuuaguaacuacuuauucagcaccugucuuaugcucauucuuagaguugguguaugaagcauucagaacuguauacaguccuuuacccucucugaaaccaguacauggcagaauaaacccgccauugccaccuuuucuagauaaauuuauuuggcuguauuaacauucuuauauauacuacugcuaguuuguuuccuaagauguuuucuuagacccaaguguuuuauauagucuucaauguaugacucuuaacugauaguauauuaacaaaguaccacaaaccagauggcuucaagggugaaacuuggauggacauauauagaucauuaguugaaugcuaacacagcauauacaagaucauggguuggcaauuuguaguauuacaaaacaacaacagaaaucgcacauauauauuaucucauuaugcuagauuggagaaguccagcuuauaagugucaucacagucauccugcuaaacuugauaggacagaaccccuucuugccucuccuagcaguugaagaucuuugauuucccuuggcucuguacauauucuauucuaaucugugauucuuuugucucauggccaucuucuucuuauuugucucuucucauaaggacaccggucauucuguauuuagaggccacauuaauucacuccaauuucuucuuaacuugauuuacuuucugccaagaucguauuuuaacauaaagcauguuuauagguaauggagcuuagaacuccaccauauguuuuuaggaacauauuuuuaucuauaacacuuagaaauuguauugaucuaaagguaauggaaaucaaaacuaacaauggcuuaauaaagaacaaacauuuaauuuucaaucuaagacaauacauauuuuuaaauguaaugggaaugccagggcagggagguaggaguggguaggugggggagcaccaucauagaagcaaggagagggaggaucggauagggcguuuccagaggggaagccaaauguaaauagauaaaauauccaauaaaaaaaagagaaagaaauucaguuaugggcuauucaugauuccccugugauucuucuuucaucugucaacaacaacagcagcaaccuauuuucauggucacaacacaguucaacaaugcuauacauacacaggguagaaucgugaaggaaagacuggugagucaaaaauauguucccugugugagacuggagagguucucagugguuaagagcuuauugcucuuccaaaggauccuaguuuaguucuuaacucacuggugcucaucagauagcucacuggugccuguaacucuagucccaggaguucugccacaugcuucuggucucuguggucaccugugacauacacauauuauauacauaaauaaaaauaaaacuuuuuaaaaugugcuuccuagccaaguuaguucuuuaggcaaccuugugcaaguccugacuaauaugccuauuuauauaacaugagccaaaaauuagccacagggaauaauaacuuaucacuaaagaggaaaaccaaucagcacgcugugaaacaaauaccuuccaauaaacuuuacaaagucucucagcacaucacugucccauuguggauaguauugauucugacucugcuuugguugcaguguuuuggcuucaagaguucugauguugugauuagccuccuuucuucuaucucuucuaaaauauugauuaacauguugaaguguguuuaugcacaugucaauggaaagacucuuucuuccagguagauacugcucuauuuucaucagcauccuuuguguagaaauguucuaccaguugcuaauuauauuugcuucuaacuuguaauuguccucaaggguuuugcucaaagguuuuuccuaaagaaaaucuguaucauuuugaucagauacugauggugucaugguuuuauaauuacuuuggcccuggacugagaaaucauggaaucuguccccuuugacuggucauuuaaacagcauuuuaaaaagaaugagucuuuuuacucauuuuacucuagaaucaaguugcucaagaugaugaaucauaaaauguauuuacauaauuuguaaaucgugcuggcugguaagagcaggugugacuauguaaugauccuggucagaggcuugacuaaguaucacuccuacacuuaguacuaagucauauagugugguguacauugcuggcaaaguuuaaaagaaagaaaagaagcucucaugaaauuuuauaugaggaauuuuaaucucucauacuggaaagaaauaggaaaucauucuucccacaaaguaggagauccagacccggcuucaaauaggucuguauucuaguggaggagcuaggguaauucaaccuuccuacacuccagugcucaaagaggaagggaggcccaacagcuuuauuaucuuagaguuccugagcaauaagacgagaugauggagagauaaagggaucacuauuagacuaaagcauugauuuuuuuuuuucaacugggguaucuuuccucucuccaguauauuuugaauggccauauuuguuguaaguaucuguaaaagugcaaaggaugccuuuaacgucuuccauugcuuaggccagaccccaguucuaagaauacuaauacagucuggaaagucaguaaugccaaguuugagaaacaguauugagugcauugauagcuuaugguauaguuugaaggcagaguuuuaauuuuuauuuauuuuauaaguguuuugccuguaugucuuucuuucugugcaccauguacuugccuaguguccuggagccagaaaagggcaucagauccccuggaacuggaguuaaacacaguuuuaagccgcuguguggugcugagggucaaaccuauaucuucuagaagauauucuaguucucuuauuuucuggaccauuguucuagccucugaagacaggggcaucuuagguagagguguaguucaggggcauccuaggcuacaugagacccugaauugacacuaaugaauugguugauugacuaauucaaauaauaaaauuaaaaaucguuuuggagaagcuaacaacugguaugggugcuccuugauugaugggcuaccaagaauguagguuuucaaaaccauugggggauacaggcauauagagagugauaaaauagggcuaccuuaacccuauggggcuuugguugucaccaacucaaagggcauuugccagauuaugaagcuaagaaacaaagaagcucauaaguuugggguacuuaauaugcccuugagguuagaaaaguuugaagauauauguuuuggaauucuggggaguauguaacauagacacacauguuauaaguacaagguaaaauugaagauuuaggaggccaagauacuauuugggaacaagggucauugcuauuaaauuaugguuagagaagccuccuguuacuuaaguauaagcauggcucuagacauugagaaacagcauagggaaguaauuuugucuuuuaaggccuucauuuuccuuauuuguaaaguagaggccuagagcauuggcaaagaccuuucaaaguaaaauggauucugggaagaauccuuuagccuaggagagagaacaguaggacucuuccggacaggacaugaguuggaaugccuacuucuccucuucaucccaccccagaaguaaaagguggcuucugguauccucacucaccagagcacugacuuccuguggaacuggccaguacuuuuucaccuuacgaggcuaaacaccuagcaauuggaacaccccccaucccccacccccaauuggagguuuguugaaugaaugaaucuaagucagacacagcuucuacacugaaaaaaggaguaauagugaggaguugauuucuguuucuagcucuucuuucuugagcaaaaggauuuuucuuuuccccccuuaccggacccaaccagggaugcucugucuagcuccucugcugccccucucuccuucccaccuaucccucucccuucuucgauccuucuuguguuuaugcacauuauuuguuuggcaagugccuugggaacuagcaaaaccaugaggacauuuuccugucaccgauacccucuaaugugucccuuuugaguuggcagcuuaaacugcuugcugaauaaaacauuaacuucuucaccccaaccuuguccuuacucaauucuggcuucacagcuuuauugacagcaaugcuuaucaacccacuuuuauggugggcugaaagagauugacuauuauugugcccagauuaaaugggggaguaaugccaccccugucugauugucuuguaauuggucagaguuauauacaggugcaauuuguaauauuuucaguaaauuaaauuuuuuucucuuuggcuuuuauugauguauguucagaugcccauuagggcuuccuuuuuuccaguggaaauugcagcauguuaauuuucacacaaauuacagcaauagcagguaucucuauuugauacauuauaacaggagcaaucaaggauaauugagugccuuucagauggaaacgggugcauucacuucaauucaaagcgaguccauuuaucgccuaaucggucuuuaaacacuaaauuucuggaacaaaaauucuugucauaauuuugcuuaaguguauuuggaaaucacaguccuuugagcaaggauaauugaaaucaaaucccuuucaauggaggugacauuucuacauuuucccaauugaaauuaauuucaaaaauugagcaugaauaucuucaaauggcaggcaauuauagcuuucaaugggaagaaauuaugcgcacaaaaaaguggagacaucaaauaccgcuucagcuaaaugucuuuguuuccaacuguguuugccuuguaaagauuuacauauauugacuuauuaugcaaccuugagaugcagaucgccuuccuuuuucaucugagcccauuaaaauuaacuaaaauuggaacguucuuguuaagcuucaucaaaacuguuuggaauuuacugcagcugcagaaauguguucauaauagaacuuaacccuucaaagacuugaauucuacccccauuuuuuaaaaaacugcaauccuaacuugagugcauuucauuguuucacuuuuuaugauucaaaagaagaguggagaggaaccgaccggcuaauugucuucucguuuugccagcugguugguacccaugggaucccagguaaaucuguggagcccauccucuuggaaaacugcccugaaggacaacacugaguuuccagaggacacuugauaagccaacuugcacuguuucaaauggaauucuaucaagccgauuuaugcucuuaacaauaggaauagcucuuguuggacugugacaaacuuucugguuuucuacugggguccuuuugauucauuuguuuuaucauuauguuaauguugccauuaagauccaugugcuagaaauuagagaagcucuauauauucuuuuauuuaacaugacuuucuucugucuuccaaggguaaaacuauauugagaacugacucuugcaagcacuuacuuuucgaaaguaguuuagaagcaaucuagccguguuuuacaguuauagcagcaauuguuucaacagccccaaaaaaauugcauuacugaaauauauuucaugggugcaauuggccagggacagggagggcagcaggccauuucuuuuauuaaggucuugcgcaaauguuaugaagagggcaguaucucaagaaacaauuucacagcugguuugcuccuaagccacucaagccuaaaaaugcaccgaauuccugguggaaaaaaaagaaauagaugucacucccaaacaaagacaggugcuaagcugcgggagaugagagaaggggugaaaacaguauccagcuuuaauagcaaaagcaaaugcuagcuaauggcccauucuuaggaacucguuaagucaucucuaagcaaccagaggauaauacacucguuauuucugcugguauguuuccuaaaagugagguguauugcuuugagcuuagaauauuaguagauagucuuucucaccuuuguauuaaccuguugucacaagaccccuucuaccaucuaaggccuucuugauggaauuacuauuaaauugaauguucauauuuauucuguuuucuuuguuuuuuauuuuuucuuuuuaacuuagaauauguuuaauuuaucuaaugcuaacaucuuacaagagauucucccuuccccucuuggcucaccugcugauauguuuuauauaugacaaauuauuuagaguuuauacaaauuauuuagaguaauguauuuuccgaguuaauauuuuuguagaaaauagccauuuaucuuuagauaggaauagcugagcuguugaagcuuaagacaggaaauguuuucagcucaaauuuuauacuuguuaaccuuauuguuugaaguauucauugauguccaguaacuguacuacugccauauaugcuggcuugaugggggucugaaauuccauggggauuaaaaauagcaagaccacaugcugaaauuagaauuuauauuuagaccauauauuguuuuucacucacccugcagaauuuuguuuuuaaggcuauacauugugucauucuuugguucuuauuuuagaagcacaagaaacuccccggaaagccaaacauuaauucaaacauaguuugcauuguaugggucaacacacuggaguuggugugcagaauaaguuuagggccuucauuaccaacaacacauugauuuacuuuaaucauaaacacuuaauuuuacuuuguagaaggggcauugugaaauuuugcaaggaauuuuuggacuuguaguuuaacauccaaaagaaagaccaccaaaaauauguauauuggugcuggucagguugcuucaagaaaggcugccuagugaguaccaagccuuuguacugacuguugcucacacacauacacacucacacucaaacccuuuaccaucucacuuagugucuuuguuugcaaugcuggagucuuuggagauguacuaaaugauggaaacuaagcuuuucaaaacucccuaaauuuuaggguaauauuguugaacuguaggauaggauuucugggccuagaauggaucuugcauccuugguaauuuuugucuacuuuguuccuuuaggcauaaucaugaugauaaccuugauauagcauaugucucccuuggaaugucaagcagagaucauuuugugcuacagagucaugguuauaaauaauuauuaaucuauacuacaguuuuucaaaaauucaguaagcacuuacucugaaccaauauuuaguauagcccucagagauauaauaacgaacuaaaguaaggcccugaaacuuaaauuccuaguguaaggagacugaugauaaauaauaauuaagugacauggcagguggugacacaauacaguaaagaaugcagcugugcgaggaggaaagggauugaugauuuauguagugggggguuaacacaguucuugaaacaguaauauugagaagagaccagaagaaccugaggcaauaaacauagcauauaucugcaaaacgagcccaguggaaggggccggaaacacaggaaguuagggccugagauacaguauguuuaacccauuuaagaaacaacaaagaggucaugugauacaauauaaaugaauaauggggaaaguauuaaaugguauagugagagagauggagcagcauguugagacagacauggacggccuggugauacagauuaaggacuuugauucauaauucuaagagaaauggggaacguaguuucuccuugauccaaggggaagcaggucuguuuaugagaauuuguuagguccaagacacauuuugaaguuaaagcugguagaauuagcuauuugauuuauuuucucucauauaaauuauauagaagaguuuggaggugauacucuuuacgguuuaaugauuuugaauuuaggacuucuauacugcauauuauucuugugugcuaaacauaacaugguaguauguuuggguuuuauuuucagacuuuuagagaacuuugaguuaugcuugacuuuuaauucauaguugagucaacaagggaaauuuucuggaccagugauaaaucccauaaacaaugggaguugcuuuaaauguacaugggcugauccuugauagaagucauagucaaccugaaacaaaaugagccuuuuucagggguauguauauguuccuccaucugcugguaugucuggaagguguaggaaaucauuaacaauagccauuccaauucuucacauaaaccugcguguaaguacuugaaaaugagagaacauuguauaggaaaguaaaauaaaagcuagacuaguugggucaguaaaauauaaauguaucccgaugaaaaggcagaagcuucuacauagaagcugcaggaucugccucccuauuuccugugcaguauauuuagcauucucaguguuaggaagaccagccuuagggcaaaggugguauucccuaauacuuugaaacaguaaguuaaaauagacuauuuagaacagacuaaucuguggguugcuuagauaucucacucuagcugaguggcuccaagcuaugcucuucuuuuaaguuagucauagguuuaaaaaaaagucucagaaccaucuguaaugggauccaaugaucucuucugguauaucugaagacagugacaguguacucgcauauauuaaauaaauaaauagauuaaaugaauagcuuaaugaauagauuaaaucaauaaguagauuaaaugaauaaacagauaaaucuauuuuuuaauaaaauagucuuugaacuggagaaaugacucaacaguuaagagcacugacugcucuuucagagguucugaguuaaauuccacaugguggcucacaaccaucuguaaugggaucugauccccucuucagaguuuguucgaaggcagaucacucauauacauaaaaaacuaaaacagcuuugagguaaaucuugaaauuaagaaaauguugcaagcuaggcuuaucagcgcaugccugugauaccuuacacuaagaagguggaguuaaggggauaguuagaaaaugcaaggcuuucucugucuauauggagaguugcaggcuacuuggugacucugucugaaaagaccaucccuucacaagagagagagggaggagagaauaaauggaugaaugaacauauugggaauauauuccaugucacaggccucaauuuuucucuucaugccaugucuuuccagcaguauuucuucuccauuuacucuggccucucuauaaucuacauguuuaccucccuaacaaguuauggugaaauaaaagggauuaagucacaauguaggaacccagugaaaacaguagcauuguauuacacauauuaaguugcuaugaaauguauaaauauuauaguugauguggugauuaacccugaaaaauaucugaaaugugcuugugaaguugggcaucagaaagguuguagcuuugagucaugaugauauggaggcuagaagauuauuuaaaauaaugcucacagucagcuauuggauggaucaccgggcccccaauggaggagcuagagaaaguacccaaggagcugaagggaucugcaacccuauagguggaacaacaauaugaacugcucaguacccccccccccagucccccagagcucgugucucuagcugcauauaaaucagaagauggccuagucggccaucaguggaaagagaggcccauugguugugaaaacuuuauaugccucaguacaggggaacggcagggccaagaaguuugaguaggugggugggggacuuuugggauagcauuggaaauguaaaugaaauaaaugcccaauuaaaaaaaccauaagaaaaauuagaaggaaaguugaagcaaacaucagcuaugggagaguauagcucagaacacaggguaaaccucagucuguagguaaaacuagucucaauagcuaauucaugguugaguugugugucuauguuuuuaauauauuuagguuucaauugaaugcggcuuccuccauuuacauuauuucuuuuuuuuuuuuuuucauuuacauuauuucuaacagauaaaugauauauaagcaaacacaaacacaaaacacaauauguucaaaucauuccuggaauaucagugacaucaaaauaaagucuuaucuuagaaauaaacauuuguagcagaaucaaguauauauuguuuucucuuggucauuacauaggaucuuacuuucucccucaccuucauaguguacaaaguuacuuuuauuuuuagaaauauugguuaggacaucugucauuuagauaaauaaauuuauugcauauauuaucugucuccaagaugcuagucuugggguugaaauuuuggauuuuugccuuucuguagaagacuacagaacuaagcucagauauuucaagugugacaguggugcuuaaaggugaaagauuacagaauuaguagcagugagacaugaugaaauagaauuaauguaguaugaguuacucgaaaguaagaauuuugauccagaucuuuaaaauugugacuguggacuggagaagcuaacacuugaaacucagauuuuaucaucauuucaguucuaggugagaaaauaauaaugucuuucuagguucuuaaguuuaauauuugaagcaauaacaugaagacccuaaaaaauaaaugacaaaauuagagaugaagacagauuucaaguacuagcaaaugagaagucuauuuuucauuuucacgcggaaaccuaucuagaaccagguuuuagcaccaggugacagcaaaggcuucagcagccgagggaaccccugucauacagagacauuguagaaaccccucaggggauuuucuuuuucucaugauucaggcccuaagugaucugguagggauaaacagaagcugggaugggagucaguaggugcuggaacucugagagauugcuuccuuuuucuaauccacuggcucugauuagaucacacuuacagaaggacaugauagacuuguaacuacagacccagcuuuccaguguaaaacuaaaauaagaaguaccaaggaacuaaauauggugcauaacugucauccaagcacucacaacgagucuuguggcagaaagauuacacauuuuuauuuucuuagauuuacuuucuuuuuacauguauaagucuuugccuucaguguguauguacaccacaugcaugccuagugcaugcauagaucagaugagggaauuggguacccuagaaccggagaagguuguuaucuaccaugugggugcugagaacagaauccaagcccacucaaaaauaaaugcucuuaaccacugagccaucucuauagccuggaaaauuacaaguucaacguuggccuggacuauauaaccaugcacugucagaaacaacaaauaaauuauaaaugaagagggagagacuguaguaguuguaccaaggagaaucacaggaaauaccucuggagaaauggccccauaaaauuucuuaugaacaaacuccugaggggaagcaagggacuucuaauuagcaaaccaaagacuuaagacaaagaaauaaaaacuaucacuuggaacuccaguaaacuacuaaggcagaucacacacauggaacauccagaaaacacuguaggaguuccuuuuugagauuguauuuucuguugcuggaaauugaauccagagccuuguguaugcuaagcgugcacucuaccacagagcuacauuuuuaguauuacuccaaaaguuuuaacaauugaacuaguaccaaugccacagaaggguaaaauucacagaccaauccuaaugaugcuggucuccagaaauugaaguaccauuuugacaauucagcuuaguguuuuaguauguguuuagcuuuugugaaagaaagggaaagagagaaaaaaaaagaaagaggagaguuguagcuacuuuguagguucuucucuagccuuugaaaccccuaacacuagauaggaggggggaaaugguugagagggaagggggcaacauuaucauuauauuacuuucuucugauuaggagguucacguuccuuggaggauguuugaucuuugcagucaggacaucuaauuucuucuuuuaaccuauuugcacgcuacuugaaaaaccucaaccaacagcauccagccagccagccccuucuaucagagcucaagcauauauauccucugaaaaggcuccagaauuucaaaugucacacacacauacagaaacuaucugcagcuggcaaaaccacacaauuaugucaguugcuguggacaaucugaggcagcuccauaucccacaccugggguuaaaaugaaaacacauucuuaacauuucugugccuuuaaaggaaccaaaauucucauacaaagacuuaacagacauuuccauaagacuccagcuauuacauguuugaacaaguaaugaugaucacauuugaaaugaauagaaaauagagucucaggaaagaaguagaagauauagaaccaaauaaaaugaauuagaacaacaauaauaacauucaucauauuaccucaguggaauuauguguccauagacuuggggguagauaaauaaaaaaauccaacauggaggagaagagcaggauauuuagaccagggagaacaaaaguaacagagguccagagacugugagaugguguuaaaacaauauuaacauuugucuuaggguuuuacugcugugaacagacuccaugaccaaggcaagucuuacaagaaacaacauuuaauuggggcuggcuuacagguucagagguucaguccauuaucaucaaggugggagcauggcagcaucuaggcaggcauggcacaggaggagcugagaguucuacaucuucauccaaaggcugcuaguggaagacugacuuccaggcaacuagggugaggaucuuaugcccacacccacagugacacacccauuccaaccaggucacaccuauuccaacaaggccacaccuucagauggugccacucccugguccaagaauauacaaaccaugacaacauucauaucacuauagucccaaugaagaggacaagcacaggguugugagaauguaaaaaauagguucugaaauuuucucaguucuggcauagacauaaacuuaccuguuuaaaagguucagugagagcuggguauaugguuaagaaguugaauacuucccuaggaaaugcuagguucuagauucaaacccaaauaaauaaauccacuauguuauuaucauaaucaguuguuaaaaugaaaaacaaaaauuaaagaacaaccagagaaaaguuacauagaaaaauuggcuggauaauauauuucucaucgggaauuauggagggcaaaaacugggcuauauuuuugaaaugcuaaaauaaauugucaccucauauuucuauaucuaaauuuuuugaugaaagaaauuaucacuugagucagaguucacuaccaucaaaucugcuaugaaaaacaaauuugcucugggaauugcuauucagagagaauaaaaguaaaaaguaaaggaaauuuggacugugaagaaugagggaaccacaguaaaagaguugaguguacuauaaacucucuguuugaauucugugaaauguaucuuauagaugaaaauauuaccauggcugucacugaacauaacuauaauguauaaguuaaacacaacacaaauugggagcaaagaggggcuccacgcggacuuuuaaauuccucuugaaguuauaaagauucuguacuaaguguauacacugaaauucuuaaacugugcaaauaaauaucaauuauaauggauaaaacuaaaagggacucuaaacccccauggaagcaggaaaacaagauaugggacagaagcggagaaggagcagacagaaaauaaucaaaugguggagccaguccauauauauugaucccucuucaaauguagauggucuguauguguguagaauaaugaaaauucagaauauauuuuuaaaauucauuuuacauccugaucacugugcccuuucugguuucccccuucccuggcaucuccccuauccccaucuccucugagagaaauggagguaccucccuagauauacuccuacccuggcauaucaagucucugaagagcuaggcacuucuucuucuacugaggccaggcaagacaguguaguuaggggaaugaauuuuacagacaggcaacagcuuugggacagcccugcuccaguuguucaggacccacaugaagaccaagcuucacaucugcuacauagguguaugggguggggcacuagguccauccugugaaugcucuuugguugcuuguucagucucagagaaccucaaguuaacucuuggucuuccugugggguuccucuugggguuccuauccccuuuggagcccucaauccuucccccaacucuuccauaagaguacuuaagcuccauccaauguuuggcugugggucuuugcaucccucuaagacaccugcuauguggaaacucucaaaggacagccaugcuagauucuugucugcaagaauaacugaguaucaguaguagugucagggauugguguuugcccaugagauggcucucauguggagccaguuauugguuaaccaauucacucaguuucuguuccauccccuguaccugaauuucuuguaaacaggauaacuuuugggucaaaaguuuugugggugauuuggugucccuaccucuccacugguguuucugucuggcuacaggagguggccucuuuagguuccauauccgcacuguugugagccucagcuaaggucacccucauugauucuugggagccucccuuauccuaggucucuggcaugcccucaagaugccccccuguccccugugccagcugcagauuucuauucaaucucauagcuaucucucccgucuucccacaccugaacccccauuucuauccucucucccaccaauucucucucucugccuccuaugacuauauuguucccccuucugagugagauucauguauugcuugggccuaccuucuuguuuaccuuugggccuguggagcauaauguggguauccuguauuuuauggcuaauauccacuuauaagugaguacauguucauuugggucugaguuaccucacucaggaugauacuuugaaguuccauccauuugccuucaaaauucaucaugucuuuguuuucaauagcugaguaguguuccauuguguagaugugccacauuuccuuuauccauucuucaguuuagggacaucuauguuguuuucaguuucuggcuauuacaaauaaagcugcugugaacauaguugagcaaggaucuucaccaacccuacaucugacagagagcuaauauccaaaguguauaaagaacucaagaaguuagacaccaacaacccaaaugacucaauuuaaaaauaggguacagagcuaaacagaauucucaacagaugaauguggaauggcugagaagcacuuaaagaaauuuucaaaguccuuaguuaucagggaaaugcaaaucaaacgacucugagauuccaucuuacgccugucagaauagcuaagauauaaaacuaaagugauagaacaugcugucgaggauguggagcauugcugaugugagugcaaacuuauacuaccacuauggaaaucaauuuggcaguuucucagaaaacugggaauaguucuaccuuaagauccaacuauaccacuccugggcauauacccaaagaugccccacuacacugcagaauacauuuuuaaacugauacaacuuucaguuuucuucaagaaacucacuucacauaugauacgugugucauaaacaaaaagacaaccagacaugguggcccacuccuguaaugucagcucuuaagaagcagaggcaaguguugugacuucuagaccagcccaaaaaaaagaaaaaaggaaagaaagaaagaaagaaaagugagaaaaugccaaagcuauacuauguaaacauuaaugaaauaauguauauauuaauagcauaaaaguuagacuucagaacaaagaaagugacuagggauaaaucagaguaauauauaaucauuaaaaagcucauaauuuaaauggguauauguguaauaacacaguuucaaaauuccagaaaugaaaguuggcggaacggagagauagaugauccauaaucacacuaagucaacauuuucuagaaaauccaagucuagcuaguguaucaauuggcaaaaguaaaggucagugggauacauacuuuuuuguuuagagucuuuauugcuuagaggagaauucuuccuaagccaacucauaaaagcaucccaguagcaacacuuugccugaugugcaugauccaguucuugcugacuugaucuuucugaaaaugcaggcaaggguaaccacauaaagcuggauggcagugguacgcacagauacauugagacaaaguccaggagaacaaaagcacaacacacaauugaaacauuucuuguugucucuguggagcucacuggcagcgacauugauuuugaauuucuagaguuuaagaaaagcucacacaagcuagccuuuuauuuuuucaacagacuuaauuguaucuuuuuuuuuuuuacauaaaaccacggugucaccaggagagauagcucagucuuuauagugcuagcauugcaagcauaagaacaauaguucaguucugggaaacuacauuucaaaagccaggcguggugacacagcagauuuauaauccuugaaguagggagcucucuggccagccuuaucuacauggagaggcccccauguucagcgaagaaccuuaucucuaaaacccaagcugaaugguaccugaagaacaauaccagagauuguccuguuguucaguauuggucugugaauucuugguauggaaguguagcuggccacuauuagcagcuucuugagcacaggagcagagauggugccaaggccacuggaaguaaagcuuaaaggcacagagauguccuguuucucuaacauaaugccauccccaccccuacuccauggcaauggauacuuuuuuaauguuuauauuuuuuuauuauuauuuuacuuuuucacuuuauguccugccccuuccuacucacuuccuccuacaaguuuucucaugauucccccucccuuucuccucugagcagguggagucccucuggguaucccccaacccuggcacaucaaguuucugugaggcuagguauauccucucccaccgaggccagacaaggcagcccaucuagaagaacguauccugcauacaggcaacagcuuuugugauagcccccacuucaauuguucaggacccacaugaagaccuagcugcacuuaugguacauauguguggggaagccuagguccagccuguguaugcucuuuuguuggugacucagucucugagauccccaaggguccagguuaguugacucuguuggucuuccuguggacguccuauccccgucaggcccacauuccuuucuccuaaaagucucuaagcuccauccacuguuuagcuaugggaaucugcauuacaagggggaauaaaauagucauaagaggcuauuggauggaggggacuuggugggaguggggauugggagaagaauguaaggguucaggaucagguguggggagggacaguagugauggccagauggccaugagaaugaauggaaaucugcaacugcaggggguugugggcauggcagggcagcaguaggggacaucuccuggaagagacagagaccuaggacacgggagguauccaagagucaauggggaugaccuuaguuaugauucacagcauuggggauauggaaccugaagagaccaccuccuauagccaggcaggaaccccaguggagcaauauggacaccaacccauucacaaaacccaaauacccaaaaugucuuaaauaaagugacggggcauagaguagagacuaagggaauggccaaccaauaacuggcccaacuugagacucaucccaugggcaagcaccaaucccugacaauauuaaugauacucugcuaugcuugcagacaggagccuagcauaacuguccacugagaggcuccacccagcagcugacucagacugaugccgauacccacagccaaacagugaacagagcuuggggacucuuaaaccaauggauauuucuauguugacagagacuuugaaccuggucuacuagcugaauauuuccacugcuuuuaaaguggagugcuguucaaaacuucauccuuaagagacaccccuagggaaaauucauucacagggcuagugaaguuguuuaacagguaaaggugcuggaugccacacccaaagauguaaucccuuuauucaccaggaucccuaucaucgaaggagaauauugauauccacaaacccauguagguuuucagaccuauauguaguuaauuccucuccuguucaccugcccccccucacccaaugaaaaguuuaaaagucagauuaagacuccucauugggcaaggagaaccaaucuuuucuagggaucuucauuugcuuaaccagguagcccaacuugauagcagagaucucuaagaaccccauggcuucuuccuggccucuuccauggccacaacuccagcuguacagcugaaaccaucauagaaucuccuauggccucccaaauuuggacucuuugauacuccaagcaaauuguuacaccaucaccaucugacacuugguguuuccuagggaagaaauaggaguuuugauaaagaugcaaagaacaauuuaauggaguuaggauaguccuuuuuaaaaguaacuuuuaagauguaauauuugacaauguuuuauuagacaugaaacuaagaucaagguccauaagagaaaucuagaaaucuuuacucugcauaaacacuuaagaggaagaaauguuaagccagagaugagaaaaugguuauauaucauaucuaacaaaggacuuguaucuauaaaacuauaaaacauugcuuugcaguuaacuaaucuacugauaaacucaccagcuugaaugaaucucaagagacaugucacugacuucuugaagccagacucaaacuguguaguaugugacuccuuuuaucuaguagucuuuuuuccccuguauuuuauuacaauuauuuauuucuguuugugugugcaugugugguaagugggagaagaaucugugagagucaguccucuccuuccuuauauggguucugugaauugaacuaaaaucaucaggcuugaugaccaucuugucgaaccgucuugccagcacuauaugaucuugaaaauauaaaagacaauauuggcaagcagaguagugguuaucacagguuagagaauggugugacuacaauggaauggcaagauggaguuuggggagauagugggacuguuuguaguuugauuguggugaggguugaacauuaacaaucauugaacuguauccugucuaguaaguucuacagugcagcaauuucagauuaaagaaaauugagcuuccuuaugauaagaagguaaaauuguacuuuuaaggaugaaucuuucuaauaggagauuauauggagacauggaacaaaagguguuccuuuuaugcugauuaguaggaugaauuaagcuuccauaaaagauuuuccagagcugccaaaaugaaaacaagauauacuuuaggagaucuuucacuggaugucccuacuuagcuguccagauguccagaauucuaccccaaaaagaaaguauccagcuguaaaaaguauguuccaguaaauaaaauauccuuauugguaauguaugccccaaaucacagcucugcgccaccaccuggccccugcccccuaaaagaaaauggucuuuccaaagccuagcugaacuacaugggauaaacauucagagaacucaguauguugaacaagaaaaaucuaguuuuuuggguugguguggguuuugucaaucauaaaguuguguucucgugugcaaucucagcaccuguuuuuauuguuacuacuaucuuauugagauggagcauuggucaauagaauagguaacaagaaauuugcagccugguuuguuuauaucacaguagccagcauucugaaacccuuucaaacauuccuucucauugguuaagggugaucauuuaaaaacaaacagaccacauaaaaagagcagaguuucuaaauuuuuguaauaauaauugaaaauguaaauuaguuucaaucaaguugcuuuuguucuccugguugaaaauuacugguuaagguuauuuuacauucacaaauguuaaacaguguaucugagcaaggugaaauagauuacaguggagucauauuagugggugggaccuccuacagccuugcagaugacugaagguucaaauuacugccaacagcuucugcugaaggcccuacccaccuaugcuagcucuaaagaggagcaguauugccguaaagaugguuucuuuucucuuacuuuauaagggcuacgaucacacaccauuugauauuggacuuacugauugcugauguagcaauuuaccucugugacauuuauuuuuagcuguuuuuuucauuuugaauuuuuagugacagggugucauuucugacuuacuguuguaaugagugaugacacuuaauuuccgauuuucuugcuccauuuucuaugugcuggaauuaaagaaguagugacucuauuccaugguauuuauuacuaacauuaaaagugagugacuggauaugguaucacacucuugaaaucugacauuuaggguacagaagcaagugguucaugaguuugagaccagccuagucuauaaauuaagagacugucucacaacacaaaagaggagaaaggaaaaagcaguuuucccuagaugggacuccagacucuaucgaaaggcaucucuggacuauuuucuaauuuuauguguuuuacuuauguguuuuuuuuucccuuuuuuucuuagauauuuucuucaucuacauuucaaaugcuauccccuuuccuaguuucccuucccaaaguccccuauacccuccccccacccugcuccccaacccacccacucccacuuccuggcccuggcauuccccuuauacugggacauaaaaucuucacaagaccaaggggccucucuucccaaugauggccuacuaggccaucuucugcuacauaugcagcuagagacaugagcucugggggcacuaguuaguucauauuguuguuccaccuauaggguagcagaccccuuuagcuccuuggguacuuucucuaguuccuccauugggggcccuguaauccauccaauagcugacugugagcauccacuucuguguuugcuaggccccagcauagucucacaaaagacagcuauaucaggguccuuuuaccaaaaucuugcuaguguaugcaauggugucagcguuuggaagcugauuaugggauggauccccagugagggagucucuagaugguccauccuuucgucucugcuccaaacuuugucucuguaacuccuuccauggguauuuuguuccccauucuaagaagaaacgaaguauccacacuuuguucuucggucuucuugaguuuccuguguuuugcaaauuguaucuuggauauucuaaguuucugggcuaauauccacuuacuagcaaguguauaucauguguguucuuuugugacuggguuaccucacuuaggaugauauucuccagauccaucaauuugccuaagauuuucauaaauucauuguuuuuaauagcugaauaguaguccauuguguaaauggacacauuguguaaauggauacauuuucuguauccauuccucuguugagggacaucuggguucuuuccagcuucuggcuauuauaaauaaggcugcuaugaacauaguggagcauguguccuuauuaaaaguuggaucgucuucuggauauaugcccaggagagauauugcuggaucuagcuguaguacuauguccaauuuucugaagaaccgccgaacugauuuccagaguaguuguaccaguuugcaauccaaccagcaguggaggaguguguuccucuuucuccacauccucgccagcaucugcugucaccugaauuuuugaucguagccauuuaguggaaucucaggguuguuuugaucugcauuucucugaugauuaaggauguuggacaguuuuuuaggugauucuaaucuauucaguauuccucaguugagaauuauuuguuuagcucuguaccccauuuuucaauaggacuguuugguuuucuggaguccaguuucuugagcucuuuguauauauuggauauuagucccauaucagaguuaggauugguaaaaauccuuucccaaucuguugguggccuuuuugucuuauugacagugucuuuugccuuacagaagcugugcaauuuuaugaggucccauuugucgauucucaaucuuauagcacaagccauugcuguucuguucaggaauuuuuccccugugcccauaucuucgaggcucuucuucacuuucuccucuaaaaguuucagugucucugguuuuccuugaugcacuuagucuugagcuuuguacaaggagauaagaauggaucaauucucauucuucuacaugauaaccuucaguugugcuagcaccguuuguugaaaaugcugucuuuuuucaacuggaugguuuuagcuccuuucucaaagaucaagucaccguaagugugugcuuuuauuucuggguguucaauucuauuccauugaucaacaugccugucuauguaccaguaacaugcaguuuuuaucacaauugcucuguaguacagcuuuaggucaggcauggugauuccaccugagguucuuuuauuguugagaagaguuuuugcuacccuagguuuuuugcuauuccagaugacuuuguagcuaagcaucuuaauuguggagauuacucuugagcacuguaagcaccugcuuuccuacuauguuucauuccuagccucuuuaaaacauuuguacacuugagaauagcaacauuugccacugcuuucucuuuuuuuucuuuuauuagauacuuucucuauuuacguuuuuuucuccucucuuuuucacuuucccuucucucucucucucucucucucucucucucucucucucucucucucucucucucucucucucucucccucccucccucccucccucccucccuuccuuccuuccuuccuuccuuuuuuugguuuuuguuuuuaguuuuuagucuuucugagacaggguuucucuguguaacccuggcuguccuagaacucacuuuguagaccaggcuggccuugaacucagaaauccaccugccucugcucccaagugcugggauuaaaggcaugugccaccacuguguggcuucuauauuuacauuucaaauguuacucccuuuccaaguuuccccucugaaaaucuccuauccccuccccccucaccugcucccuacccaccuacuccaauuccuggcccuggcauuccccuacacuggggcauaaaaccuucacaggaccaagggccucuccucccauugaugacugacuaggccauccacugcuacauauucagauagagccaugagucccaccacguguuuucuuugauuggugguuuaaucccagggagcucuugguuaguucacauuguuccucuuccuauggggcugcaaaaccucuucagcuccuugggucuagcuccuucauuggggcauuuuuugguauugugauaguauuuccugaacaauuacuaaaugccagugguauacuauuuugaggaaacaagggcuaaugcuuuuuugugcuuuucuggaagaaaaugugcaaagcuuugaaguguccuagggcagaaagaggaaaacaaggauaugaauuauguuuuggaauaaucaaauacaaguuuguauauucaagaagguauugaccaauaugcaagaccgucaaaugagauaaguggauagaaaacguuuugagagaaacaugacuucuagggcuccuguuaacccuucugcuguacuucuaaagaacuaaacaguuccagccaaggaaaauguaaaagacgcaggauguuuugguccuuuguuuugaaaguagauucucucucaugcauucuggccacaguuucuccucccagcucccaccaccacugccacugccuucucucuucccuggauccacuccccaccccacauacuugguuuccuucagaaaagaguggacuuccaagagacaacaaacaaaugcaaaaaccgagauacaaauacaaggcaaaagcccucauauggaggcuggacaaggcaacccaauaggagaaaaggaauccuaagagcaagccaaagggucaacaguguagccuaccaagaaaccuaguaagcagcaguguagcauaggguuaggaaguaugaaagaguuaacaguggucauugaaggucccaaagggaccccagggaguguuauaaguaaaagagaaaauuuaacguuaggaugagaucuuggucuggugcgguguuuuaaaugggggagagcauuggugggauaccuuauaaaagguuucccauguaauaccccaagugggcagaauuagagccuaggcaagauuguaguuuuuauuuucugacuuuuccuaaugacauuccuucagucuugaaggcuuuauaaacauuguuucaggaaaagagugguuucuccucccuuuuuaggugagugugcuuggggaaaauacauucaugguuauacauuuuauuccaaagacagucugcuagccaguucgauuuuguuuuaaauuguuuucuguaugguggcuugguuuccuauuaaauggguguagaagagaguuuagguaaacuuucagaaagaaaugcuagguauuguguauaaacugaccuaguuuauaauuaaagaauuaguagauacuguaauuucuguuauacccuaaaaauauuaaagccaguuugcuuuggcuucgguuuugucaaaguaguaucaucugguaagauagaagaacuuaggcagugaauaugcaugaauguuaauguccuuuuuuggguuaguuuagaaauuuuuuacaucugaaaaguauaucuauagugaauuguuacuggaaggauuuuuguacaaagcauaauguaggaagaucaugagaccucuuccaugacucuauuacuaugcuauuuucaaacaacuaccuaagacccaaaugauuggagucuacuaagagauaucuuagugugagaauuacuuuuuaaucuaguacuaugauagucgguuagaauacugaguuuguggccaaauagccugagucauguuugugaacagacuauucauuauuucauugacugagcugugcauagaaggauaaugaacguagucuggcugggaaaacuggauauuaacaagaacuuagucuuaguauugaaucaggagaacacagaaggcaggaauauuaacuugguuuaugccuacugcuuucccuuuuaucaugccaauuauaagauauacugcugauuuaguaauaggauuuaagagagaaagaaauaguuaguuagaccagcagcuauaaaacuuaucuuuguucuaggaccauuaaaauguaaugauggguaucuuagcaccaaagcaaagguauuacaaaguauaacuccuaaguaauaauuuaagccauugagugcccaccauuucuguaugugacaguagccuuuuuucaaacauuuuauguaagccugugauguguccccacaacccucucaguggaugguuugcagauggguaaacucaaacuuagagauuaugacugacugacccaggaguucuuaccauaucuccaaaaucuaccucuuuacuuucuguuaagagcuaaguggcccucucacccaaaauauuucaauauuccuucagcaucauuuuuggagcuuuuagaugcuguacuguacaguggcaucauucaccauaaacuauauccauagcuauaauuuccuucucauaagagcuuauaaaguauauaacuuuaugaaacagugcuauauuaaaagcuagauaaagcaaauacuguagaaauuaauuaaaaguaugauguggccaaauuuaaacacuucaaaaaagaaaagaaaagaagaucacuuacuguguuuuacgcacaguucuaaguauuuucuacacccuaacccuauuuacucuguuuuacauguagggagacaccgauagacacuuuguucaggaucacauaucuaguaaagagcagaagugagauucaaaccuagucuggcccuguuugagguauuaguaaaccuuaaugcacagguuuauguugaguagcauggaaugccuuaacuuagcuugacucuuagcuuuuuuuuuucuuaaacauauaugccacccuuauucuugucugugccagaauuuugagagaauccugaguuuguguuuaggauugaaucccuguccuugaauauacuacaauacaguaacagaacugauacaaaccucaagaaacuaagaccaaagaaguauuuugucccaacgcagccuauuggaaagauaaacauugucagguuauuuccuuaccauaauugguacugaagaaagugguuaccuuuuuuuuuccccauuguuaaaauuuuuuucuuuuuuuuuuuauuagcuguuuuccucauauacacuucaaauuucaaauacuauccugaaaguucccuauacccucccucccugcuccccuacccacccacucccacuuccuggcccuggcauuccccuguacuggggcauauaaaguuugcguguccaaugggccucucuuuccagugauagcugacuaggccaucuuuugauacauaugcagcuagagucaagagcuccgggguacugcuuaguucauaauguuguuccaucuauaggguugcagaucccuuuagcuccuuggguacuuucucuagcuccuccauugggagcccugugauccauccauuagcugacugugagcauccacuucuguguuugcuaggccccagcauagucucacaagagacagcuauaucaggguccuuucagcaaaaucuugcugucuuaugcaauagugucuguguuugguggcugaauaugggauggauccccgggugguguagucucuggauaguccauccuuucgucuuagcuccaaacuuugucucuggguuaccuucuucuuauuugcuuauaacauuggcaacuucuuuuguuugaccuuggcucuugaauaaaguaccaaaaauuuuaaaaagucuucuuggaaguaccaguuugguuuauuucaggaaacuugccaaggguaaguguuuauagcuaacaguuauaauguugccauuugcuuagcacuugcaguauuccaggugcuacauugaguguuuccuacauauuacucacagucauaacagugccuugaggaacuguguugccacccccacuuacauuuccaaaugagagccuacuuggccucuaggagccucuguauuuucauuuguaaaacuaagaaagccucuugauguuccaauagcaauuucuaaauccaaaugaaaacauuuucaaguauauacuuaaagacuuaauguguucaguuaguaaacuuuauuucugagaacucaaaugcugacauuucucccaucagaaauagauuuuuuuuguuuuuguuuauguuuuaaauguuuucuuagcauuuauuaacuauacauaauguucaguuguagcauuuucauacuuguacauaauguauuagaaccaccuucuuucuauguauguauguauauguaucuaucuaucuaucuaucuaucuaucuaucuaucuacuuauuuacuuacuuuaucugcagggguuaggacucacaucucugucgugcaugcauacagaggucaaaagacaacuuugucuuuuccauggucuguuuuggaaucagacucuggccgacaggcuuguguggcacaugcuuuuaguuguagagccaucuugcuggcccauguuuguuugguuuauucaagacagaguuucucuguauagcucuagcuguccuggaacucacucuguagaccaggcuggccuugaacucagaaaucugccugccucugccucccaaguacugggauuaaaggcgugugccaccaugccaggcuguuuuuuuuuuuuaagugucuacuuuuguagccuugaacuuggcacccuauuggaauuacagucaugcacuacuguaugcaccuuugacgcaaauuuuuagggaagcuuuugagaauuaauauaaucagaaauuacaagguuaaauuggcagaauuggagauuauguuucuagggugcaaugaugcacauuggaaagccuuuuuauuugguuuggucaguuucuuauccagccucugcuucuagccccaagccaguguuccuuuuguagucugaugauuaaaccucacugaccuuugcuuggcuguguuuugaauaugacaucacacuauccuuacagcuggaaggaagguaucuagugcauaugaauagaugaccucuggcaacaaagcuaauauuuccaauagaaaacuagccugggggggcacaaaaaaaaccaaaaaccaaaacaaaacaaaaagcaaaaaaaccaguugacugggagaaugacuaguauuuggaaguaugugaaugaaaaguagcauugggugaucaagaggcuuagacucugaauaccagcuagcugaaugacuuaagacaaguccaguagccagagucucuacucuuccuauaaaauaaagauaaucugaauaguuauuuuacaugcuuacgauuaaauacaacagaggagacugaucugaaaauugucuugucauccuaaacuucaagaccuuuucacauaguuugacuuaaugcauguaaagcauuugggaaaaucuuuguugauuucaagcuauauggacauaugauggacuuucucucauccagacaagauccacaucuuuugccaagauauaagaugcuauuuggccauauaauacugucucuuucuuaagucuagcuaugaauaguuauucccauauugagucuacugauuuuucaaaacugacuagauacacacuguuuuuuuuuauuagaucuggaaucauaaacaugauuuuccuugcugaguuguauaaaauauggaaaauaaucccaguugcuucuggucucuccuaguuaugaagauugaauacauuguaaaacauuacauacuguauuuuauaaguuaaaggaauauaguuuuuuauuuauuauaauuaauuuacauguagucaucaaauggcuguguugaugaaauauuaucagaaauuuagaaugaauauggcugucagggacuucucaauguaguaucagaaccaaaucaaaaguuauaaaagcuggguguggauguacauaacuguuaucccuacacuucaaggggcuggugucggagaauuugcaagccuaagcuccauguaacauauuccaagccagcugggucuacaaaaugagaccaugucucauaucaagacagaauauuauagaaaggaaaugauaguagguaaaaggugaauggagaugucuuuaacucugauacagaagaugugccuauagaacucuauaagggcacuugccaucaagccugauggaccaaggaaaccaaguggaaagggagaacuuacuccugccaaucugaccucugaucuuuaugcaugcaggguagccugggcaugcaugcacauacaaaagaaauaugauaagacaguaaagaaaaugcacccacacuggacuugacauuauacuaugguuuugauuuuuaaagacuggguuucucuauguaaguaacccuggcuguccuugaacucacuuuauagaccaaguuguccuugaacucacagagauccucuacuugucucucccuucuggaugcugggauuaaugguguauaccaccauucccagcucaguuuauacagacuuaaacuguugccuucauggucuuagauggaguccuagcagugcuuggcauguccucaguuaguugaaugaauacuugcaugaugcuagccugauugauuaacaucccagaucuuggaucagccaugcucaccuuauuccaugugaagcaaacuuguucugugagguuucuuagcccagacuucaccuuaacuuguagguaggucaaugaaguugacuauauuuucaucccaaucucauuccauuuauacuagugauguauauuuauuucaguaacuugcuauuuacuuauugcaaugacaacuggcuguuuaagagcauuuaucaagauauuagaaagcugaucaaacauucuacaugucaauuuuccaauuuuuuuugauagagguagaauaggaaauucuagaauuuucuuauucuaaugaaaggcagauauuuggucaguugugccaagaaauuaccagugacacuuugcaaauagaaaacagucaaguuauaauuuucugucucgcuuauaaguaaaaggacauucuuaaaacuacccaaccacaggaaccuuuuuucaaauaauauuucauauagaauuguaaaagcaucugucauaugcaaaacagauaagagauacucuuaacaauauagaugucuguuuuaacuuaauagaauuuuuaaaauuccaucaguggacacaccaguuaauauguuggaauuagaugucuuaaacguuuauauauagcagauaucuacauauucauuaaaaauuuaaugucuaauauauaugauauccuauauaucagcauaccauuaaaguuuuaauuaauaaaauuuaaaacuaaacauuuggacaagucucugaagcauacaaacagaaccuacuuaaacaguacuaauguagccuuaccaguauguacuguagauguggagacuaaggcucugucuuaagaaucuuauucucucuucauaguuuacuucuuaauguucuacuuauaaaucugauauccaaugauugauuaccuuaguaguucuagcuuaaauaaaaauuuuuaucaucuuaaguuuguauaggaaaccaagaugaugacuuucaaaucuuuacuugaaagauuuauuuaaacuucauuguauuaauuguacaucuuuacacguaaaagaaggugcagauucaaauauuuuuaaacaucuuuauuuuaugugcauugguguuuuuccuguauauaugucugugugagagugucagaucuuggaguugcagacaguugugauuugccaugucaguucgaggaauugaacucgggcccuauggaagagcagucagugcucuuaaccacugagccaucucuccagcccucaaaugauuuucaaguguuaaauagaaacaaaacaucacaaaagaaaacccuuuguguagaagacaguaaauucuuuuucugaauagaggucaguagaauugucuuccauccccauaaagacaacauggccaauacuugguuauuuugacaucugugauauugaaaccaccccugucucuucagauggaaauugccaugugcagaaugacuucauagaaaaugguguacauucuauauaaucuucuaacagcagaaagcgaccaguggcacuuacccuaaaaauaaauaaauaaauaaauuacccgaaauuugcagcacauucauauucaauuucaucacagcagaugcucauuaguauguuguuauuaauugguauucacuuuagguuuuguuuaaaaugaagauaauaauuagguuuuaauuacugcaucauucgugggggggugucuguggggagagggaaagaaaugccucuuaaagcacugaaauauuuccuaaugcuuauucagcaacauguacugccaacgacugaaaaaucauauuuauaaaaaauaggauccugaaaugaagaaauuacuguauuuuuuaagcucaucauuaucgagaacuugcuguaaauuguucgauggacauacugaaucaugauaaugcgugccaccauucuuucuaaucaaauuaccaaaaagacuucuuagaaaaggaauccucacaagcggcugauuaaugaagugguggcaauguuuuguauuagacuuaauugaaguaauccaaauaaguuauuucuguagccuauggaaauaauuucuuuugcaaaguacaguaguguuggcaaaucaguauuuuuuucucacccucuguuguuccauauuugcaaaauagcuaaguuaacauagauuuuugcaaauaagguggauaggauacugauuugaguggcaagaaaaccaagaaagcuugucucaaccuuuuugucaucaagacugauaauuugugcaauagacuuaaagguauguggaaauugaagguacuagaauuugaaaggcaaaucuucaguagaacuauauuaaugacaguuuuuaauuuaguaaugaaaagggccauuuguguucaagaauuuaaagguucuuuaaauaaaauuuucuggaguacuugcagugagcaugaauuauuggauuuuauaccaguccaaaccuuccagaaguuuacaguuuaauucauuuauccaguuggugcuggguacuugguuauauauaucuuguuacuuuaaaauauuccugaguagucuauuaagcccguuuuacagaugaaaacuaauucaaaugauuuauuauuguuagaguauuaggcaauauguuaagguggaaauaagcaaugcaggacagguguagaaacuuuuccuuccauggucauugaagggcagcagcacaccagguucuaaaccaggcaccagcagaauagaggggaaguacaucugauagcuggcuucagaagcucacaucuucugagaccuaagggcugcuagacuacagugaagacuuccacgggggcaugaguucugcaucagagugaggaacagagugagucauagggaugcagagaaacagcuaggucugucaaguagaaaggaagcaaacccaccauggagacagaaaccacuuucagcaccauucuuuugccuuuuacuuucuauuacauuuauuuauuauuuauuggaggauucaugauaaugacauauuaugaaggccagaggacaauuuauggcagucaguucucucucuuuccacuaucuagagcccagagauuuaacucagguccucaagccaucucgcuggccucagcauugccauucuguuauuauuauuauuauuauuaauuaauuuuuacacuccauauuuuauucucccgccccauccacccucugucuguuccacaacccauaccuccuccccaccccccugccuccauguggaugcccuuacccccccaccccacaugaccucugaacucccuggagccuccggucucuugaggguuagguugcaucaucucugaaugaacacagaccuggcaauccucuacuuaguauguguguuggggcccuaauaucagcugguguaugcugucuguuuggugguccaguguuugaaacauccaggggguccagguuaauugagacuguugguccuccuauaggaucgcccuucuccucagccucuuucaucuuucccuaauucaacaacaggggucaguugcuucuguccauugguuaggugcaaauaucuucaucugacucuuuaaggugcuuccugggucuucuggagugcaguaaugcuaggucccuuuuugugagcacuccauagccucaguaauagugucaggucuugggaccuccccuugagcuggauccuacuuugggccuguugcuggaccuucuuuucuucaaguuccucuccauuuccauaccuauaauucuuucuggcaggaacaauuaugggucagaggugugacugugggauggcaaccugaucccucauuugauguccugucuuccugcuggaggugggcucuauaaguucccucucccuucuguuggguguuuucauguaaggucccucccuuugaguccugagagucucuuaccucccaggucucuggugcauucugggggcuucccccaacuuccuauuuccugagguugccuguuuacauucuuucuguugggucucagggcuucauuccuuuucccucacucaauaccagaucagguuccccucucaccccacucaccccuacucuguccacuuucccucccaggucugucccucccuccccacuugugauugcuuucuucucucuuucaagugggacugagguguccucacuugggcauuucagcuuguugagcuuuuugaguucuguggggguguauccugaguauucuguacauuuuuggcuaauauccacuuauuauugaguacauaccaugcauguccuuuugggucugaguuaccuuacucaggauaauuucuaguugcauccauuugccugcaaaaugccuuccaauaccuguuauacauggaaugaauuaaucgauuguggaauguuucauggccauuagaauaaaaguacagauaaacaaaauaaacagggaugauagagaggaagaaaaacauaaaagaguuaugaacuguuuuauuccaggcacauacaauuuuuuagugguaaucuguuguauccucaguaaaacaugaaauacuugagcacaaaacaagagcuguacuauuucucugggcucugucacagaaagguguuccacuuucugcaauacacuuaugcauauauaauuuaguaaaaggaacaaauaaugcaaacgaaguuuaccauugccuuacauuauuuaaaccagaacauauauccugucuuuaucuggaaauaacguguuugaauaagcaagcaucuucuucaaaaaugauuauaaugaaauuuucucaggcuguuuuggguaguauaaauuccuuuuucucaagcuagguuggagagaaucaaaguccaugguucuaaaaggaucuccaauacaggcaauccgaaacacagcagcucucaucucagccugcccgcuugaacuucccagggucccuuaaaaaugcccauauccagcacucuaccccacauuucuauuuaguuauuccaggggugagguuugagcaucaguauuuuuaaaagcucccagggcaacuuugauguguaaccaagugagguacuagugauguggagccucaucauaaaucucaagagaccgaccagguagcaucaauaaauggaaacaggacugccuuuuugcuagaaacuacuuuugccuggaguguaaaauuuccauuguuucuuauguaauaggaucacaggacucaaaagcauugaaguuugauguagacgucaaaaacauugguauuaaaauacuccuuucccuucaguucuuccauguucuuuucuaaguguucccccuaugccagguauaaaagcaggauuauuuucccaucuguaagugcaugugggcaagugaguaugcccauggccauacuuauuacucugauaaugcuccaaguaacuaacaugaauauggguacagcagcuacuucagcucagcauuggccuuacuaaaucacagccgcuuugguauguaauguucuaaauguaaagggacccugaaagaagccuaggcacuguguucagugcaguuuucaagaaagaacaaaaaaaucgaacauuuuaaaccaggaaguggaaauuggagaaagaaauguuaaacuaucuuauuuucuugauguauuuuuucauccaaucuuguacagucaugaugagcauuaagugugagggugggccaggcggggagaacccagcugagagucuuagagaaaacuggagagugucagguuucuuguuuagaauuuaucaucaaaagcaaaagacaaaagaggguaaagauuuuuuuuuuuuaaucucuggugcucauaaguuaaugguccaaaaucaagaaaacaaaaguagguguuauucuuguucauuuaagcuauaguuuucucuguuccaugaguguucuuuaaaaccacuuaauuguauuugacauugaaaaucuaauagggucuuuuguuuucaaccaguuuacuaauugcaaaauaugucaggaaucaaaagggcaggagguguugguauauuuuuuaaaaauauauaacuccuuuuuaauuuuuccucuauuuuccuuauccauuuaggcagugacuuucaauuagccugccuacuaauaucaggucacuaaacuccauggcugacgcuuuauucuuucauguggguugucacucguuugcuucaguuggcuggcaaagguuguuguauauccauuaccagcaacacagcacuuugcauuucugaauugacaagcagcuauauugacccagcgcuuauuaugggucaacagcugcguuaaccaacggaaggacugaggggcaauuaaaaugaauuggcaaaaauauaucuuccuaauuuacuccaauuuguuauuuaugcuaacauuguauggcuucuauggugacacuaaacagaauggacccaauaauggcaauuaacauaaaaauauaauggcuaaucaaauugacagcaacuguuucucaucaucucgacacacaauacauuaucaaaacaaacuauuaugaaggagguaauuucaguguucuauucaaccugcagcaugugugcagucagggagauguguaccagcaauuacugcugaaucuaaaaaacuaaacaaauaacuuaaucgcugucguccuccuuuucccccccaggaagcaguaaucaggauucgcuaaaaauaacugguguauaauaguauaaugaugaugcauauuguagaauagcuaauaagaaauaaaauaagcuucuagguguauacgguuuaaaauagguccagguaaagaaaggcacauaggagggaaugcacauacgaaaaaaaaggacaauaaauagcccuggccgaugaauaaugccaugugguuuuauucuuacagcccaauauuuauagauaccauuugucauggccaaagaagcuuaaaauacacuaaacuuaguaacaaguuuuagaauggaguaagcaggaaggugagucaugaucucuaauaacugaauuucaguuaccucuguacccaguugauuuggcuguagcuuuuucuuauugacugccaucugcgauccuuaaauauuauacuuacccuuaagaaauucccuucagaaauagugucuuuuccauaucaggaaguagauaauggucuucuuccuagucaugugucauucugugcgugccacuuggccaacuuuaugaaugguacaaacaacuuggcuguuagggccauuggaugauuaguuucauaaagauccguaaauuacuauguaaaucagauagauaugugugcauccuuacugauguugaaccuaguacauagcagguacucacucaauguuggauaaauaguguguuauuccaagacagcagggaaaauuggugauguguuuuguuauuugagcuucuuauuugauaaguucuaagugucugauuguuuggccuugguaggacacccccacccccagccaagauauaagcugauuguucuccagcuggaggguaucauggguaucuggcuccacgggagcauggaaagaacauuucuagaauagguggcuuaaaguaaguagaauugcauuugagugccaucacuaaauaauucuccuguuacuuguugaauuuggugcaugugucuuucccuucacacaggaugagacacaagucuuuaaaaggacauacauaguaacucgaaagcuaggaacagcagcagucaacauauguugcugaaugagugaggaugcaggcacauuuccuaaugcuuuguuaaguuagaacgugcuacugcuuugccaugguaggauggcaauccuguucuuucaugcuacuucucaaauaucaucuauugcccacuucagauuaacacagaacaggugggcuucuuaaaugccaacauuguaucuauaagccauuuguuggcgaaggcaauguauugccaccaugagucagaaaauugggcucauaguauagcaauauauguuaaaccguuuccagaaauuguuuaacuuccugcuagcauggacaggucccaguuaggaagcgcaguaccacuuuucccaauuaacagugaaaauugucacgggugcauaggaauuugcaauuugacaaaaucaguuuuuugacagcagggguaaucggucugcagcuuugcaaguaguaaucugugagccaguggcaggauuuauucugaauugugaaagguaccuguguuaugagggggacaccccauuagugugauccucuccuuacucacccucuuucuuuacagaauguugcuucauauggaaguuaaaauuggagaauccagucugcugagagugaucuucauccccccauaguaguauucauuuauuuucuguuauauugcaguauucugacaaguccuuguacacccagcugugcuuuuaccgguacauuuuugaugcggacugugcacuggaaaaacuuacugaacaugagaaagguacguuaaaauacuguaauuaccuuugaguuuaaaguggaaauuugcaucauaaaagccagaccuacugugucaggcuguucacacagcaucacauugcugucucagaagcaggcuguaggggccuauaugaacacagggauccccuacaugaggggcgguggcauaggaauccccagcuuuggcccccacagccugucuuacauuguucucuauuaaagcaagcuuuugggggaggaacgguacaaaaaggacucuuuaaaugcuauauuuugaaaaugcuauuuucuauagaguuuaguaauuguaauaaaguaagcauaggcaacgugaucauugggccuacaaaaacuagauauuaccacaaaaaaauagaccuggagugugucuccgcuguucacuaaaagccuagguucauuuugaaagagaggagugggguggaguucuuuuauugacuccauccuaagagaauguauagguaccucaacccauaugaucagaugcugccuggagccuucuguacccagcauuuccuuccacaagacuugcaggcacugugggacuuaaugggucugggaaaagcuuuguuacauaacuuaaaguauuugaaaaugucaugacaagugcauguuuuuuucuccuaccugaaaaucacauugacaacuuuucuauuaccuguaaaaaauaaaaaaggcaaauuuacacauuuuucuuauuaguuaccuacagaguguuuauguuguuugucagcgaauaucaauucagggcuuuguugguugguauuagggcuggaggcaaccucaacagcauauaaaaaccuacaaauauggcuggaguuuuuucacauaaaaauucccaugcugcccuugauuuggucucaauguuuucaauucuagucauaaguaacuucaauuuuuuuaaccuaugagauacucuagaaauuauuuuuuauugccuugacuuccuuaguuuaucuguccuuggaaagaaaauguuuuuacaacuaaaugaagaucuuuauugaaauuaguauuuugucuuuggauauucaacagccacuuugucuccacaacauguuuucuaugacauagagcuuauguagacaagaaguuccuucugcccauuaauaaauaggcuuagugacauuuauuaaugucuaguaucuagccuauuuuuacuugugauauuauuaauguauguucuccuuuugcccccaugggcuuuaagguacuuaugaauugggaaauuugaauccugauucucuggugacuacauuagcuucucuuggguuugugacuucuuucugggugugucagcauauaaacaccugcuucccauaaccucuuuguucuucuagccaauguagguuauucacuguagauuagcuuguucccagcaccugggaggcaaaggcagguggaucucuuaggaguucaaguccagcccagucuacaaagggaguuccacgacagccagggcuauguaauagacuuugucucaaaagaaaaagaaaaccacuguccaauacaacuugaauagaucaggggaaauguucccaaauaaaagagaguuuaauagaaguuguagucuaugaggaaaaugggaaauaagaauacuuauauaucagggagaacaauaauaaggagaaaaauccuuaauguauaguacuauaacauauguaaaaucacuucucauuuuauuacuugaaauuaaguucucuuuuaguuugcuguucaagggauucuuuaguauaaaagugaauuuuaaacuuguaggaaccaaagggcaaauauauugauguaauuuggaccaaggccagaacacaguagauguuacuaucagacaccaugugaaaaaugucaguuguagcacaguuacauuguggucaaugcaaucuaagcaucaucugucaacaagugcccugugacuggugugugaaguguuugcuguagacucugcuuuccuugcaguuccuagcaacguuuccuucacuaagauugucuuaccauucacauuagaaagccuauguuuuaaagguuguagcuggguggugcuuuuaauuuuuguuugaaaacucagcaauuugacuugggagaaacauguacaaauuauuugaaagagguuuauuuacuuuuuacagugaaaaguagcucugucaaagcuuuuuuuuccuuucaaaugaaaguuuacagaccauuaguccauaaugugaauuaaccccauuugguauuuuccccuuuccuuuaaaauguuaaaggauuguuacucacuuuggugaaguguuuacugcaugcucacgguaacuacauaacauuuuuuaaagucuuauuucugugggacauuggcauuauugucguaacugcuccagaauguacacagaugacauaauggguccaagggagguuuuagaacauuguggcaauaugugaaguaaaaauccauuuccaggauggcagcauaaaauggucacauuugacugccucauccuguggugccuuggccugaauacgaauaaaugagcaguuuggggaaaccagaaucuauucacaucuuugcccagguacuugaauuaucugcuuuuauaaaugcaggaaagaaaaaggucucuuuucccugcagaaccuguuuuuauuuauggagaaauaauaaacacaacauguguagauuuuauuauguguugagugugaacucuuaugucaaugaaagcagaauaaauggcugauaaucucugcccuggacaaccacugagucuuuuguggaaaggcagauucaucaggugguaaauaugauauuauuaccacuaaccugaucaacuugccuuaagcaaagagagggaacacuaauugcucuuucaguucaggcuuuagucuauuucuagaaagaaguuuguuaucugguacuguugucucuucuuaaugcuuagccauucuuauuguaucauuucaugggcauaauacuaccucaaggcggcccgugaggaaacagcacuggauugaugaacaaauugaauuaaagaaauguuuccaucuuuugaauuccccugugaccuuuuugaguagucucaaguguuuuauuuugcuuucucuuucacuuaaguucaucgagacaggacugcaucguguagccuaaucacuaaauauuugauuaaagaauucccagaggaaaaugaggucacacgagugauuucagggauuugggaaaauuguuccuaguaaauaguacuguuuauuacugguaaauggcuuuaagaaaagcagaacucuguauugucugcuuugacucaggugugccauaaauuaaacuuauaaaacuuccuucauacuuuuacauauugcuuauauagauuccacacguugcaaauaacuacaggcaaaugucugucauuuggcugauacaaagcuugaacucgaagaauaucaguucuuuggacugaugagugagccaagcugacugcuucucacacuuguucagggcccuagucuuaucuugcuaucagcugagcaguuugcccauaaaaugagcacagcuguauuacucugagaaaauggucuccaaggaaggcagugauuaguucuaaaacaugaaggggauuauaaagguacucucuuucuugaaaccagaagauaaggauuuuacuguaggaauuauuugcaauuuggagaugucuaagcaucucgagucagguugccuuucgguauuaaggauuucuauuucuuggacugcuaaagucaacaugcaggaaggcucauuauugcuagaaguacugaaaaaaaaguagcaaggaaccccuggagucuucucucagccaguugacauccuuagaauuugcuugguucaguccuucagggcaguggaaauaaagcugugucacggagggccugucugguccaguuacuuugcucuuaagcccaugaguugaguuguuucucuggaaacuugaauuuuuauuguauuucauucauugauuacuucauucacauucaugcagagcauacaaguggagaucagaggagaccucgcaggaguuacuucucgcuuucuagcacguagguuuuaggaauugacuucagguugucagucguggcagcaauugcuuuaacccaguaagucaucucaucagccccaaaagaauuuuuaagaaaggcguucucucuguuuucuggcuuuuuaaauuguauuuuguacagaguauuuugaucauauuuaccugccucccccaacuccuuccagcucccucucccaccucccuuccccagcuucccaacguuguguccuuuuuuuuuuuuaaagcccuucaaguccaguuuguacugcucauauauguuuguggaugugugaccuuccacuggaguguggucaacuuacauacauacucuccuuggguaggguugagaauugauaccaccuuccuccaugcuggaauaugguuugauuugaacuuguacagguccugugugugcugucagaaucacugaguucacauggauaacugcucuacugggggagccuguuuacuuguagucauuuauagaucaccucuggcuuuuuuuccccagaaauuuuaguuuuaauaacuaauaccaaggaaaguauaccuauaaaguacguagaaaaguaaaaaucugacucaguauuuuucuuaaaauuaucucacaauuguggaaaugguuuucuauauaaaacagauuuuaagcagauaaugcuaaacucagguuuucuuucuuuguauuuuuuuuacauacaacuaaugcuuugaguuguguucuuuuaaguguuuuauuguguaguuuaagggaauuuuuaugauagacauucauaaguuagcaguucacaacauguuuaagaaacaauuguagaaauauggaaagaauuuugaagccagguauccugguuugcuuuucuuuugcugugacuuaacaccaugacaaaaagcaacuuggggaggaaaaaggguuuaaugucagcuuucucuuuuggggucacaauucauuauugaggaaccaugaagggacguugcuucuggcuuccuggcugacuuauauacaucccaggcucuccagcuuacggagucugcugcucaacucaauuauuaaucaagacaaaccacugcagauauggccauaggccagucugauagaaacaguucuucaguuaagguuuccccuucccgagugacucuagguuaugucaaauugaagguagaaaugaacuaguccaccaggcugccuaaggagguuaacuacaaccaggaaaacacauggaauaaauaaucucauaccaucaaaaucaaaagaaauacacauggauaacaacaacaacaaaguagaaaagugaaugguugcugcuguuagauacuacacaaguuuacucuuaagugucaagaggaaacaauuuguaauguuaaagugcaaaacaaguuuuaaugauuugcaagaugggaaaacuaguaacgaacacuaaaauauucuuauaaucauuaucuugguugauuguuuuuaucuucuauuuuuaaauuauggacaguuucauacauaucuaauguauuuuaauccuauuucccuucccauucauuccucuuggcccccuccugcucacccucuuccuuccaacuaagauccccuucuacuucugcauaccuucaugcaugcaucacacugaauuuaaauaggguugcugcaucagcaugggcagauugccaaugacuguacugcugaagaaauucucuguuuccccauugcaucacaaccauuaacugagucccuccuccauccauaacagcaguugacagguucaaugcugugaagguaacuacagcucuuuaagugcaaggcccaugucguggcauggaccuuuuuacuuuucuguaauuuucaaguuauagacagcuuuuacaauaagaaaaauucaaaacgcuacaauuuuacaaagacuuuuacucaucuugcagugguugcucuaacaauucacaauuugaggagugaaaacaacauaaauaaaugcaaaccaacugguuuuuccuugcauuuucccaagugugaucagcggacuagcaguauuggcaucaccugggagguuguuagaaaugcaaacuuucaggccucccagaccugcuucagcaacaccugcauuuuaacaagauccacagauaauucuuagacaugcuaagguuuguaaagcagggaucuaagacauauuuccuccuaauaacuaaagccuacuuccauuuuacccauucauugcuuaauuccauccuuguacuuaaacucugaaaugacaaauaugccaacuccaggagcucugcucaaguuuuaaaauggacuuccuaucacagccuggacuuuaaaauauauucuguacuuaugcugaaaauguaguagcuugaugagggguaggggcgugacaaaagcaagaaagcaugagcucuauccguuuugcuucuucauagcuagaaagaacgggggagaaguaaauugggguuuucaaaauagcuuucaaccucucaggauuauaagagaacgauagcagaauauagguccacgcccauuucuugugagggccacucgaugugcucccagacugaaguuucacuguccaucuucuggaccucguuacaauguugacuuagcacacuaguaaagauuuuaaguagauuuuuaaaaaaaagugaaaugacuuuuuuuaaguggacuacuaaaaaauguuugcuugaaauuuacuuugcucuggcagcugauuuuuauggucuguuuuuugcucacuacagcagugacaaagcauauagucacgcugcuuuguugcucuggguacugccuguuuuguuuugaacuaacaguguagccaaagggaaaguacauuuuccaggaaaauugucaccuuaauugcuuugcccuuagcuaggagugucuugguuuuguauauuuucucucauucuuuuuaguauaacuaagguaguaugugaaaguugccauacauuugggcagcaaacuuccagauucuaauugugugucuuuucuuuaagcccauuucuguaaauacgcacucagccuuugcauuuuuauguacucagggacccagaggcaugcuaugaugacagacaugugacucguuuuauaaagucauuuuccuauuacuguccuuucaauaagcagcuucccuuccccuuuuauagugccaggcacagcagcacaaacaagggcaccaggguugcagugacuaggugagaaagcagugguugguggccuccauuugcaaaacagucugugaugcuuuuuucuuuuuagugguuaagaaugagaaaggccugugaagauuuuccgucauguacuuuuaagacacacuucuaucaccaaugagagaaaaaaauauuaaacaauuuucaagcaguuagaucauaauguaagcuaaucacuuuauuuugaagaaaaguauuuuuaaacaguugaguuggugaauuuacuucuaaaauguauugugcuuacacaguagaugguuuuauuuccaugauguuuuuuacuacauaauuauacaucuuaauuacguaauuacuaucauaauuauuauguaauugcauguacuuccacuaauuacaaaaucaggaaguguaauuaucuaguaaaaacuuuaugaaauuucaugcacuaaaaauuacuuaaaaggcuauuccaguggucuaauggaaggcuuuccauacuuggucuuagucaugguauuagaacuugaacucguaggccagaacaaggacagccacagacaauaaagugagucuugcaguaugggucucuuuugaguugacacuaaggugcauuucacgucuuuugauuucagaguuaugguaucuuaaacagaguaccuguuuaagauagagucacaauaucucaguguuaaggaagauucuuaauugaccaauagaaugaguaaucaaggcauuagguuacacaauugccaggccaucaguaacaacagcucuuauuucacuacuucuaccuuuaaaagaaguaauaguaacaggaaguauucugcuucuuucauuuagagauaauuuuauccaguuuauguuuauacuuucugagguuuaagaaaacauaucagaaaagcauauccuuuuuucuacuaccugaugucaagcagcuuuucagacauaaacauaaaugcacaaacauguaacaucagacccuaaauaaagacagaagguuuaauucaauaaagcuaugaugccuuuaccauucaaaacgacauacaaauugcacagugaaacaauagucaugacagcaaauuagauaugacaucuaaauuacacuacagagagaaaucccagaaccauuuuggucuguaggagucuauuuuagcccagguuuaaaacccauccuagagacugcuuuauugucuaaguuggacaguguuguagaagaguaauuggagguugguugaauuaauugcacuuuaauuaggaggaaaaggcuuauaauacuuaugguagagaagagaguagauccguuaaguaucaugguagcauguacuguaaguuucagaaaugcauauuaauugcuucuuggcuuuugggugaaaaauaggugauauuaagcuauugauauuuuuguaacauauauuaucuguuguuaucuaaauaaagcauuugggagucagauauuguuacacaaauugucuuuccccagauuaguguuuuuucucuaaaugugcauugagaaagccacugaaaaucuaucacaguuaauucuuuuagcaauacaaccuuaaauaguaaaaggcuccucucuguagucacauggcauuccauuuuucucuuggagcuuuccaaagaagacuuuucuuuguaguuuuauccauuauugacuuuguuugcuaguuuggggauuuuugucuuuugucuuuuagagaugggguuuuucuagcugacuuugugacuuuucauaccaguuaaaaguuuuaauagauaugacuuuuuaaaugaacaacgugcuuugagcaaauuggagaauuuauggccuuucagaaauguuuucuguucucagcaauauuugggauuuauagagguuuaaucuaauucacaugucugucucuaugcauuagauaauaacucuuuuuaaaugaccuguucuuucccucacuuaccccuuucucccgacaccugaucaccaccugaguuucccuccccaucccuucccacccaguucccuccauccauccaccuccgaugucuauuuuacaucaccuucuaagugagauucaaacauccccucuuggucccucccuguuacuuaguuucuuugggucugugaauuauaacauuguccuguacuuuauaacuaacaucuacuuauaagugaguauagaccaugcaugucuuucuaggccucgguuaccucacucaggaugauauuuucuaguuccauccauuugucugcaaaauucaugauaucuuuguuuuuaauagcugaguaguacuccauuggauaaaugaaucacauuuuuguuuuugaucaauuuuucaguuggggaauugaauuuuuucaauggaaaaagguucguuccaauuuccggcuauuaugauuuaggcugcaaugaacguaguugaacaacuguccuuguauugguggagaaucuuuuggguguaugcccaggagcagcuuagcugggucuucagguagaacuauucacaauuuucugagaaacugaaaaauugauuuccaaagugauuguacaaguuuacauccccaucaguaauggaagaguguucccuuugcucuauaaccucaccaacaugugcugucccuugaguuuuuuaucuuagacauucuaacugguguaaaauggaaucucaaagucauuuugauuugcauuucccuaaugacuaagaauguuggacauauguauaaguauuucucagccuuuuuagagucauguguuaauaauucuuuguuuauauguagcagaggauggucuaguuggccaucaaugggaggagaggaccuuggucuugccccauugccccaagaucauaugccccaguacuggggaaugccagggcuaggaagcaggaauggguggguuggggagcagggcagggggaggauauaggggacuuuuggaauagcauuugaaauguaaaugaagaaaauaguuaauaaaaaagaaaaaagaguucuuuguuuagcucuguaccccauuuuuaaauuggguuauuugguuuguugguggucaauuucuugaguucuuuauauauuuuggauuggugaagauccuuucccaauauguaggcuaucguuuuguccuauugaugguguccuuugccuuauagaagcuuuucaguuucaugaggucuuagagccugauccauugguguucuguucaggaaguugucuucugugucaguguauucaaggcaggugcccacuuucuguucuuucagauuuaguguaucugguuuuauuuugaagucuuugauggauuuggacuugaagacuugaauuaauguuuauugcauucuuccaggucuagccccaagagccuuagugccuuccuuugaagcuuaagguuaacccaacuguauucaaaaaaugguaauguuacuggcuaauuuuagacauugaugauauacuuuuguuuuaagaaaugguagcaaaacaaaacacacaaguaagaucacaacgccaggucuuuguagaagucuguuuuucuauucuguaugcccugaacuuuguccuaaucagcaaaauugucuaauaucugcccuaugugguauguaaagaacauagguauaacaagaccugguuccuuuuucuagaaguaaaucugcuugugaccacuugcuuauucaugcacuuugcccucuauaugcuggcuuuuuauaggagauagugguaguauuugcuuuacuuugugaugguaaggguggagcccaggccuuggugcacgcuaggccaguucucuaccauugagcuaccucuccagcccuuuggacuuuacuauuuauggagaacauuuacaucuguugguauauggauaauugguguuuuucagaugagaaaaccaccucaaagagacaagacggccucuuaguuggcaaagcuugagagucuuaaagucacugucucuucuucauucuuugccauagcuuuccugcuuuuaaucuaucugcuagaaaaaugucacccugacaucaauguuuuuuuuuaaagauuuauuuauuauuaucucuaaguagacuguagcugucuucagacacaccagaagagggcgucagaucucaauacaaaugguugugagccaccacgugguugcugggauuugaacucaggaccuuuggaagagcagucagugcucuuaacugcugagccaucucuccagccccggcagcaaugauacuaauagaagaaaguaauccuaaagugucuuaguuucuaaccauaugccucagaggagguuuccagguagagauggaaucugaauugggccucucagaguaggugagguuuuaauaagcacagauguagugguuuaccuugagacuauguucugucuguuuuucauuacuuaucuagcuuguacaaaucaaagaaccccccuugacaaaugcuuggcaauuuuaaugcaucucugaauugcaaguuuagccuaaaagugcuuauuaaagaagucaaucuaugugcaguuuuaagcccaagauugaacacuggaagggcaaucucucuucacuccccacuguaaccauuggugguacuuucaaagaaauugauccauccuucaggauauaucugucaaaaguauaucaaaauguuuuuccaucuuaaauaauuuaacucagaauauaauaauguaaguauuuugacaugaaaauguuacauacugugauauauccacuuaacuuaaaacaugucuuuaacuuuaaaagaaagaacuaugguaaaacaaaacaucaaagaggaauuaagaaggauagauggccacuuaaugguacaugccuguaaacugcaugcuaugcaaagauggcaaaauacaggcuagccucaacuacuauggauacacugucucaaaaaaaaucaguaaaagugaugaaugacaguucuaguuugauuuaguugaaaguuaaacccuauuggcauuaugacuauagacuauaaaaaauguuuucuuuaaagcaugauugaugauaauagcaugauaaaagccuuaguauaagaaaaaccuguuucugaaaucaguauuugcugaugaacugauuccuauauuuuauuggucuuuauauauugucuugccaaaugaagucagugcugaagagucaauuaaauucaaaauaaaagaaagggucagagcccgugucuauauucaugaaauuauucacaggagcauagucuggucucuguuagugaaagcuuuaucacuuucaacaaaugugccacgguacauuuauuaguaugcuacaaagaaauuuuugaaauaauuaagacuaaacuacacuugucaaaauaaaugaaugaaauacaauuuugaaucaucuuucuucacuuauugcucauuugcauaauucacuaacuuacacaggagucuuucagucauuggugugaauuagcaagguucugcuguuucuuguuguaugggcaggaauuaugcugucauaauuagcuauuccagacauggacuaacgggaaauaccaaagggcacagcacaaucugaaaaggcaaggcagggaaucuaaagagaagagacagucaaagacacccaacaaauucaagcugguagacuacagggaauucugaaugaaggcucuuaauuuauuuugagaauaagaaaucaguaguaugagagaaaucucaaccagauuagcugacuaagccuacuuaacaaaaugucucuguggugcguggugcauggugcaccaggcuaaccacuucuguuuguuaaucaccucagcaaauagccugcaaaucuugucauggauauauagugacuuuccauugagguauuuacucuuugauggaguacauuuauaccagugagaucuguaggugcagauugcuuuccguauaugugaggcucacuccuuucacagcccacuugcuccacucuuuuauagaaauuuugauauuuuugugcugcucccaaaggaaugauggaaacugaaucccuaaacagcacuacaucuaauaaaucccuucucuccagcucuaugaaaccuguauguucugcucuuuaaaaacaaacaaagaaacaaaaacaaaacaaacuauuggcagcagccuuuaagcucuaguauacccucccaucccccuuaaucaaccugaaauaucucuuuagauuugccuuucuugccuuauucugaaaaaauacaauuuuucauugcaauagcaugucacuguaaguuaauagaacacguuggaaauucuuggaaguauuguccucaagauguuauuuuuaguuugguuccaaaaugguauaguauuuccauagaggaacagagaacugaaagggacaauugaaggguuagcugggaaagccuaacuccaucccauuacugaaguagagaaacagauaacucuugcccuuuggccuugguuuuaaggaaucauacagacacucaaccauuguguucaguuguaagaaacagcuucagguacacuguguggaugcucugucaagucucccaccccuucuuccuucaauauucgcugaguacuauaaugacuggucuggccuucucagugacaguauaggauaauugaguuguggagccagcccuuagcauauguuuuugcuuucuaucccuuccuauacaagaaaccuuagaaucuauaacuuagugccuguguuaucucaccuauaaagcaguaaugugaauggcacauccauuuaggauuaaucagauuaauaugaaccugggaaaucuucaaaauauuuaauauauuaaaggggaucauauucaaaugccaagaacagugcuuggcacaugcuaagugugccacaaaugucaguuuauuuugucuaaauaaugauugcccuaaccacuauuacaguauauauuauuguacuuacuguaauuuucuggauucuacagccuauucuuggcuauauuuuguccaguuuaauaucaccagcaccucauauaacauuagauacaggagaaaauauuucccucaaauuuauccauugguaacaguaugaaagaggcauggucccugcugucaaggagcuugaaaucuaucuugaugauuuguuuucugguuuaucaaaaugacauuugaaaacaccaauauaguauuauaaauuuaagucuccauugccuuauuuauggaugaaauugaaacuuaaauaauccacaaacauuccaguucucucuagaugugugccuuuggcauguuuugcacuaguauaaacaguuggaaauaaguugacuuuguaggaagaguaaagaauagugguaagugguaaggucagccaaaccaaauucuaacuccuguacuguagucagcagaauguuuaaguagcuuaacugaguuuugcgcuuuuagaauugauggacccaaacaguuguauguuuagacuguuccacaggggacuucaaugcacacucagucuuuagaaucucugaguuagugaaacucuucagacuuuaauauugcuucuugucaaauaugcauuaagucuaacuuggauauagaaaagaagacuagguggcaucuagaaaacaauugaaauagaaaggaaaaaggaaaauaaagugaaacaaguuauuugcuagauaaagagagcauuuuggugcaugguaauguugcaucagagauaaagugaaggaaaaaaugggcuggggaaaaguaagcaagaagaaagaauugcauucugguaaugaacaaacugaagaugaaauaaaugcauuucuacaaaauuggcucuaaaacacauguuauuuucccucauuaacuuaugucauaaaggaggaaauggcugccagagaacaugggaaauccuugagaagacuugggaagggcaagucuuagagacaaaccuucucuuacucucccuuucccaugugaaccuuaggaaagcauauacagauggcauuguagguuuguaaacagcagcauuaguaggcuugggcuggggagaaaauaguaagcugauaacuggagaguaaccugcaagacauacucaaauacaauaaucauuucacaauauaauggcaggagacuaaacaaccuagaaaaucuauuccugguuugcuguugacuuacuuuguggcaugagcaaaccauuauuacucuuugauuugucuuauuuguucaaaagaagaaaaauaaaaguguuuaaaggcacucugaaauucuuugaaaggagguccacaagugcaaagcaggugguguucugguaugauuuugguuuucucaugugggucacagaucuuucgauucuucucauugaugaauuauaaaacacuucaucuauucucuuucaaagcauugauaauaguuucguucaucuuuuuuucaaccccaauuggaacauguguccaaaauaguucucauuaauaaaauauaauuaccaaauuaaaucuguccuauuacuuucuauuguuuuuucccuccuuuaaaaaugaaguuaccaacaacuacuaaaucagaccuugauuccugccaaucuucucuugaaaguaacagugcuuguuuugaguaguuggaacuguaaguggcauucagcacacagugggguuguaaugcgauuaugaaguuuaccaaguuaguaauagaugagcacaauaaacccucucuuuguaugagaaauaauauuugaauuaucaacugaauaaaaaggccacaaaugcugguuccuuggggugggcauaugauaaaaauaaaauaguuaaauauacuuggaacaaaaaagguguguauguucccauauaagguauagaaaccuuuuuaaauuuaaugggcuuugaauuauggagagaauuaaaagauuugcuuugcuuucugacagcuuuuccaauuuacaaaauaaccccacauuucuuaacucauuuaucacuagagacuuugcuuuuauauaaaauacuguauucucuuccaguuuuccaguuauuuuccaauggaauaacaaguggggggugauuuuaaauuuuguuuuguuuugaggcuggguaucuauguugcccugguuugccuagaauucauuuauagaauuuguggcagucauucugccucccaauugcuagaauuacaaaaguaugcuuggcauaaagauuuuuuuaauuacaguaaaaccugagcauaaaaaucauacaauauguuuuucuugguuucuuuuccuuugcaaauguuaauauuuuaauaauauuguaaacuuccuuucuauuuccuuacuauuucaaugaggaauagauuacaugcaguuauuuuuaagaguaucugagcucaugugacauuaaagaagggaauauaauuacuaucaggucuuugaaaacacuggucauacacuuagugucagcuacugccaccuauaacauucuaaguguguuuaguuaaguggaaaauuacucuagagccaaguuuugugccagugagacagcucagcagguacaaucccuugugugcagaucugacaagcugaauuugaucccuagaugucacagagugacaggagggaacugauugagaguuguccucuagccuccacaugugcaccauggcauucagaugugccccccccacacacacacacacacacauacacuugaaugaagggaugaacaaagaaguaacauuguuuaaagccaaguuucuuccaaaaaaucagcgucugacccaucuaggccagcacuccugaaugcaacacagguggcaggagcagaggagcaacuaagcgguuaccuagaacgcaggguuuucagucuguuauggcuccacugaagcccgcucuacucauucuuguuacugguaugauuuaaaaacaucugcaagugugcuuuucuuuuucugaaaaggaaggaaugagaagaaaaugaaaccauaaaacuuggauuugaaguagugaaaaagucagaccaauauuaaaaaugcagcaacuuaucugagucauaaagauccuuauuaugaaagcauuuucucagacuuuacaaaccaaaucacauagaaagauaacaauagguaaaccuuuuaaaagcauugugcaaucuucagagagcuugcaccucuccuucauucucuaauucuguauaucuguaugaguguaagauaagcacuauauagugauuuuucucauugagaaagcagcacuauugaagcuuauucauuuguccaaaugagcaguuugucuagauguacaacuacuaaacacuggcccauaagugugacuuguuuucauucuauuuguugugaguggcagaguccaaucccaguuucuacagugagagaguuauucuauaccuaugcuguccagugccauaaccgauagccauggcacauggugccauuuauguuugaauguggcuaacagagagaaaacuguagguaaaccuuuuuauagccauuuguauguagugcgaccgacgaacugguuuuccagacuuauuugguuuguaauuugaaaaccacauaugacuagaagcugcuuuucauggccgcacagaacucuauauauuuuuuucuccuuuuuuguaagguuucuguauggucuuuugcuauuacuucuacaaguggcaagcauaugccccaccaagcugaacauaagcuaaauauuuucaguaucugcauugguuuuccccauaaaagcacucuucacacauaaugacuuccuucagaacaccuuuggagguuccaguugugacguuuuuuccaugcagacucucccaagauuccuaauugagauaaagaacacaaucagguauaucuagaaauuggauacaugaaagugaccaagacagucuucuacccuguucuuguuuuuaauggucuaggggaacaagugucuguuacugcaucauguaggaaacuuucucugguuugaauugaaugagagugauuuagaagagguggacccuuagcuaagcucacugucacuuguguguaucauuaaaucaaaaaugguauugaguuaaacaacacugagauuccaccucacacuggucaguauggcuaggaucaaaaauucaggugacagaagaugcuggcgaggauguggagaaagaggaacacuccuccauugcuggugggauugaaagcugauauaaccacucugaaaaucagucuggcggugccucagaaaauuggacauaguauuaccggaagauccagcaauaccucuccuggguguauacccagacgauguuccaacugguaauaaggacacauguuccaguauguucauagcagccuuacuuauaauaaccauacgcuggaaagaacccagaugucccucaacagaggaauggauacagaaaaugugguacauuuacacaauggaguacuacucaguuauuaaaaggaaugaauuuaugaaauuccuaggcaaauggauggaccuggaaggcaucauccugagugagguaacccaaucacaaaagaauucacaugauauguacucagugauacguugauauuagcccagaaacuuagaauacccaggauacaauuugcaaaacacaagaaaaucaaagaagaaggaagaccaacauguggauacuuaauuccuccuuagaauaaggaacaaaauacccauggaaguaauuacagacacaaaguuuggagcugagaugaaagauggacuauccagagacugccccauccauggauccaucccauaaucagccaccaaacccagacacuauugcauaugccagcaagauuuugcugaaaggacccugauaaagcugucucuggugaggcuaugccagugccuggcaaauacagaaguagaugcucacagucagcuauuggauggaacacaggguccccaauggaggagcuagagaaaguacccaaggagcugaaggggucugcaacccuauaggaggaacaacaauaugaacuuaccgguaccuccagagcucaugucucuaguugcguauguaucagaagauggccuagucggccaucauugggaagagaggccccuuggucuugcaaacuuuauaugccccaguacaggggaauaccagggccagggaguggguggguaggggaggaggguggggggaggguauaggggacuuuggggauagcauuugaaauguaaaugaagaaaauaucuaauaaaaaauugaaaaagaugguauugaguugagacauauuuuaauuguagagguguuaaaauugaagaaaaugcaacuuaaaauaugugagaugguuugucaguggguuuugccuacauuugaucagucuauaagaaggacagcauuuagauaugauggcugcugcuaguugacccugugguuaauuaaauccuccaccuucaccaaaaccaguccagcacccauuuccuacuagacguucacugucuucuauaaggagccucauuccugauaagaaucaacugacgggaugggcugaaacucuaacucagaucacuuucuuuuaaacauuuccaugucuuccauaaauacaggccaggauauuuuauuaucauaacuggcaggcagaacaagcuuaaccaaucaccuucuaguacacagguagcucugcagcauuccuuuuuagaauaccacaugcugaaauucaaauuaucacauuagcuauccaaacgcaccauuuguuuuuaaauacugggguguuuacugaauuuuuucccucuucaucuccccaccccauuucacugguacauugucacugcaaugacagguuuauuuaugugccuuaauaucuacaucuuaugguuuuuaaauauguaugcauaugucugcauaacugcucucgcucauuuccugccucucugcuugggaccaaacuagagccuugcacauguuacauaacaguacauccuguauauucuaaaauacuaguucuuggggaguaguuucaugucuuuuuuuuucaauaugaugccaucuugaauuuuaccuuuauucagauuugaacuauuuaaguacuucuaaacucccgccuuaaaacuccagucauauccuggaaauugaacaugucuucugaaauuuacugccuucaaaauaaaugugggagucaauacaaacagaggaacagugaagucugacauuuaauggcauuucagacacugcuguguaaaauucuaaaauauggaucaauucauauuucacacuuucauaugaacuuaauuaugaauuuggaauucuugaugauauccuauguguuuugguagauaacacugauuugauccgcaugaaauuacugcuaucaaaccccuuuuacccaauaaaaccugaaaaguuuacacgaccuauucuaauauuacggaguaaaccagcuucuauaaauggcuugcuuugcuggugcuguuuuuccuuuguuuggguuuguuuguuuggucuuuguuugguaugguauggcuuggcuuggcuugguuuguuuugguuagguuuccuaaaauaggguuucucugggaaauaacccuggcuguccuggaacuugauuguagaccagucuggccucaaauucacagagaucugccucccucuuguuucuccuuucuuuucuuucaguuaguacuuuuauucccacaaccuuuucuugcuaauacauccuucuguaucucucaauuaagacuuuuagaucccccaaaccuauuuagcugcagaauuaauaauacaaagaagcugguuacuuagugaaucucaugaugcaaucagaacuugccaguucaaguguuuggcuuguuuugagauuuacauuauuccagaacaguaaugucacuaaauauauuuacuaaccaauaaaaaggucaccauagucccucuuccuuuucagaugaaaaaaagcagaagugccaggcaaugaugguguacacauuuaaucccaacacuugggagguagaagcaggcucuaugaguuugaggccagccuggucuacaaagcaaguuccaggacuacacugagagacccugucuuaaagggaaaaaaaaaacagaaugaaagccagcuacuuuucuuuuccuuuuuaauuaaauuauuuuauuuauuugcauuccagucauugauuucacacacacacacacacacacacacacacacacacacacaguuccucaucucauuccuccuccccuugccucugagagggugguccccuuccacuaagccucccccuucccuggggccucaagacucuggaggauuagcuaaggugaguccaagagugucucaccuccauggucucugguauucuccagagggucccccgacucccuaaggcugcuuauuuauuuccauuuauuuauuugacccucuaggcuuauuuccugucccccucccauaucugauucuguucuccuauucccaucucccugccccuccaccuccugugauuaucacccacccccuuucuaaagugugguugaagccucacuugggccuuucugcuuguuacacuucuuacagucuguagauuauauccuagguauucugugcuucuuggcuaauauccacuuauuagugaguacauacugugcauauccuuuugggucugaguuaccuuacucaggaugauaauuucuaguuccauccauuugccugcaaaauucaugauauccucauuuuuaauaucugaauaguauuccauuguguaaaugaaccauauuuucuguauccauucuuugacugagggacaucuguuucuagcuucuagcuauuacaaguaaggcuaguaugaacaugguggagcacauguucuugugguaugggggggccauuuuugggcauaugcccaagagcaguauagcuggaucuuaggguagauccauuuccaauuuucugaggaaccgccagauuuauuucuggagugguaccaguuugcaaucccaggaacaauggaggaauguuccucuuuuuucacauccucaccagcaugugcugucacuugaguuuuugauguuagcaauucggauugauguaagguagaaucucaggguuguuuugauuugcauuucucugaugacuaaggacuuucaacaguucuuuuaagugcuucucagccauuugagauucuucuguuauaaauucuguuuagcucuguacccuauuugaaauuggauuuuuggagauugaguucuuuuuacauauuauuagucguuuguuugauauagaguuagugaagacuucuuucccaaucuguagguugcugguuuguuugauugacagugucuuuugccuuauagaagcuuucaguuucaugaggucccauuuaucaacaguugauuuuagagccugagccacugguguucuguucaagaaauuucccccuguaccaaugaguuugaggcucuuucccacuuucuccuccuccuccuccuccuccuccuccuccuccuccuccuccuccuccuccuccuccuccuccuccuccucuucuuuuuuauauuguuuuuuucuuuuuuuccaauuuuuuauuaaguauuuucuucauuuacauuucaaaugcuaucccaaaagaccccuauacccuuccccccacccugcuccccuacccacccacucccacuucuuggcucuggcauuccccaguacuggggcauauaaaguuugcaagaucaaggggcaucucuuccuaaugauggccaacuaggccaucuucugauacauaugcagcuaaagauaugagcucuggggguacugguuaguucauguuguuguuccaccuauaggguugcagaccccuuuagcuccuuggguacuuucucuagcuccuccauugggggcccuguguuccauccaauagaugacugugagcauccacuucuguguuugccauagccucaccagagacagcuauaucaggguccuuucagcaaaauuuugcuggcauaugcaauugugucuguguuugguggcugauuaugguaugaauccccagauggggcagucucuagauggcccauccuucaucucagcuccagacuuuuucucuguaacuccuuccauggguguuuuguucccaauucuaagaaggcacaaaguguccacacuuuggucuucauuuuucuugaguuucauguguuuuuugcaaauuguaucuuggguauucuaaguuucugggcuaauauccacauaucagugaguacauaucaugugaguucuuuugugauuggguuaccucacucaggaugauacccuccagguccauccauuuaccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaauggagcauguguccuucuuaccaguuggaacaucuucuggauauaugcccuggagagguauugcgggauccuccaguaguacuuccacuuucucuucuauuagauucaguuuaucugacuuuaugcugaaguccuugauccgcuuggaguugagcuuugugcauggugacaaauauggaucuauuuucauuuuucuacauacagacugccaguuuaacaaguccauuuauuugaagaugcuuucuuuuuuucacuguauguuuuuagcuuuuuugucaaagaucaaguguccauaggugugugaguuuauuucugagucuuugauuuuauuccacugaucaaccugucuguguaucaacaccauguggucuuuuaucacuauugccuuguaguuguaguccaucuugaggucagggauggugauucccucuggaaguuccuuuauuguugagaauuguuuuggcuauccuggguuuuuuguuuuuccauaugaaguugagaauugauuguucuuuccauggcugugaagaauuguguuagaauuaugauggggauugcuuuugauaagauggccauuuucacuauguuaauccuaccugucuacagcaugggagaucuuuccaucuucugaagucuuccuugauuucuuuuggcggggggggggggggggagggggauuuaaaguucuugucauacagaucuuucacuugcuagguaagaguuacagcaagguauuuuauucuauuuguggcuauuuuaagggguaucauuuucuuauuuucuuucucagccucuuuaucauuuauauaaaggagggcuacugauuguuugaauuaauuuuauauuccaucacuuugcugaaguuguuuauuagguuuaggauuucucugguagggcugcuuauauaugcuaucauaucaucugcaaauagugauacuuugacuuucuuuccaauuugugucuccuugauaucuuuuuguugucuaauugcuuuagcuagaacuucuauuacuguauugaauggauagggagagagugugcaaccuuggcuagucuuggauuuuagugggauuguuuccaguuucucuccauuugauuugauguuggcuguugguuugcuauauauugcuuuuauuauguuuagguaaugugccuuaaauuccugaucgcuccaggucuuuuaacaugaagggguguuguauuuugucaaagacuuuuucagcaucuaaugagaugaucaugugggguuuuuuccuagaaauuguuuauauauuauauuaccuugauuaauuuccaaauauugaaccaucccugcaucccugggauaaagccuacuugaucaugauggaugaucguuuugauguguucuuggauucgguuuucgagaauuuuauugauauuuuugcaucgauauucauaagggaaauugguaugaaguucucuuucuuuguugggucuuuguguggauuagagaugagaguaauuguggcuucauagaaugaauuggguaguguuccuucuguuucuauuuuggugaauaguuugaggaguuauugguauuauuagcucuucuuugaaggucugauagaauucugcacuagaaucaucugucccuuggcuuuucuuucuuucuuucuuucuuucuuucuuucuuucuuucuuucuuucuuucuuucuuucuuucuuucuuucuugggggguuuuuaaugacuucaucuauuuccuuagggguuaugagacuguuuagauaguuuaucugaucuugauuuaacuuguacaugcugugugucuagaaaaucauccauuucaucuagauuuuccaguuuuguugaguauaggcuuuuguaguauguucugaugauuuauuuaaaauuacuccauguuauguuguuauguuucccuuuucauuucugauuuuguuaauuuggauacugccucugugcccuuuaguugguuuggcuagggguuuauuuaucuuguugauuuucucaaagaacuagcucuugguuuuguugaaucuugugucauucucuuuguuucuaacugguugauuucaaccaugauuuugacuauuuccugcaguguauucccuuaagguguguuugcuucuuucuguucuagagcuuucagguuugcuauuaaguugcuuuuuugggaucgcuccaauuucuuuaugaagacacuuagugcuaugaauuuuccucuuaacacugcuuucauuguguuucauaaguuuggguaugaugggucuucauuuucauugacuucuaugaaguuauuuauuuauuuauucccugaugguugagcaaagaguuguucaguuucuaugaauaugugacuuucuguugguuuuguuguaacuaaaaucuagccuuggucuguggugauuugauaggaugcauggaaucauuuuuaucuucuuguaucugucgcagcauguuuuaugucugauuauaugaucaguuuuggaggagguacuaugaggugcugagaagaagguaugaucuuuuguuuuaggaugaaauguuaugcagguaucuguuaaauccauuuguuucagaccuacuauuaguuuuacucugucucuuuuuaguuucuguuuugaugaccuguccauuggugaaagugggguguugaagucucucacuauuguguggguuucaauguguguuuugagcuuuagaaaaguuucuuuuuuuuucuuuuuuuuuuuaugggggggggggcguuucaagacaggguuucucuguauagcccuagcuguccuggaacucacuuuguagaccaggcuggccucgaacucagaaauccgcgucgagugcugggaucaaaggcgugcaccaccacgcccagcuagaaaaguuucuuuuaucaauguggguacccuugcauuuggggcauagauguucaagauaaagacuuccuuuugguggauuuuuuuccuuuaaugaauauuaaguguccuuccccaucucauuuaauaacuuuuaggugaaaguguaauuuauuggauauuagaguggcaacuugugcuuguuucuuuggaccauuuacuuggaaagcuuuuuccagccuuuacuuugagguaguaucgucuuuguuauugagguguguuucuuguauguggcagaaugauggauccugcuuauguauccagucucuuagccugugucuuuuuauugggaaauugaguccacugauguugagagauauuaaagacagaugauuguuaguugcuauuauuuuuguugcuggagguaguauuuguuaucauucucuucuuuuggauuuguugucaucuguuuaguuucuuguguuuucuuggguguaguuauuucucuuuguguuggggauuuuauuccaguuuacuugguagggcuggauuaguagaaauauauuguguaaauuuauuuuugucauggaauaucuugguuucuccagcuuaugguaauugagaauauugcuggauauaguuuuaugggcugcucuuuguguucucuuaaggucuggaugacaucuguccagaaucuucuggcuuuuaaagucucuguagagaagucugguguaauucugauaggucugccuuuauuuguuacuucacuuuuuccccuuacagcauuuaauaucuuuucuuuggucugugcauuuaguguuuugauuauuuugugaugggaggauuuccuuuucugguccagacugguuuucuguaggcuuguucauuuauggccaucucuuucuuuagguuagggaaguuuucuucuaugauuuuguugaagauauuuccugucuuuuuuaguuccauucuucacccucuucuauuccuauuauucuuagguuugauuuuuuuuuccguuguguccugaauuuccuggauauuuuggguuaggagcuuuuuuacacuuuggauuuucuuugaccgacuugucaaucaaugucuucuauaguaucuucuaugccugagguucucucuuuuaucucuugaauucugauggugaugcuuauaucuguagcuccugaucucuuuccuaaguuguccaucucuuggguugccuuccuuucuuuauuguuucucuuuccauuuuaauucuuggaccauuuuguucaauuccuuuaucugcuugauuauauuuuccuuucuuuaagcaauuuguuucuucuugaagagcuucucccuguuugccuguguuuuccuguauuuuuucaagguaguucuuuauauccuccuuaaaggccucuaucaucuugauaagaagggauuuuaggucauuaucuugcuuuucaugcauuuuaggguagcuagggcuugcugucaugggagaacuggguucugaugguacgaaauugcauuagguucugucguuuaugaucuugcacuugccucugguuaucugguucucucugguguuaaguggucuuaaucuauaagaccuuauagauuuagauagguuaucguuauuuggcucuuugucuaaaaaaagaaaugugauguguuaaauucuuaugaaugcaaaugauuaaauaucgaauaucauuacucuaaguaaucauacccuucucuccauuuguguuuauaaucaccugaucucucugacaaaugguguuuauuuauuuaguaauuccauaguuuuguuacuaacgggccuuuuuuuccuuaaguucucucaguauuuagugauaacaaauaaauaaaaaaugaaauuuaaauuacuucuuuguaccacucagcucuuuacacaugguacugacagugaucacaauaaccuacuaaauagaugcuguuuuucacuuuuagugacaugacaugggucaacugaagguauuuuguagguuguuaaauuaaaccuguauuuaucuauaauuaaaacuuuccaaaaucuaaaaccucuugaucuuucucuguagcuuacuuuccagcuauuuaaaagaaauccuuaaauauuuauguauagaauaagcauugauugcuuaucauauaccaaacacagccagaguaucucuuuuagauaauuucagacaguacucugucccuuacagaaagaauaaaaugauguacuuguuggaaauagaaauucucuaagaugacaguguuuuuacugagacuugaaugauaaauagacgaucauaggaaauucuggaagcaggacauucuacacccugagaaagccugagguaggaacaucuuaucacaucuagggauagcuggaaucuggaauagaugacuagaaacaagugacagaagauggaguuggagauagagacgguuuggauuucugaagaaggacuuaaggcaugagaacacggucuucagugcaaugggaagcucuuugaggguuauagcuaucagcauugucugauacaagauuuccaaaugauugcucugagggcuaacugcagcucaaagauagaacacaugucuauaauaaaagaugacucuggcuacuggacccaacuguaugcauuucuacugugguagcauuuuggaagcacaccaccagcaauagcauaccuauuguccaacucuuggaaacaccauaugcuuuucauguaaaaggcaagugguacucaaaguccuagcagaaaauacuaaagcuuaaaaguuaucuauuaaugagggaguugcggacgagcaccacagcugauggcaugcugcaacagcauuuccaccugagcauauugguugcugcucugcuaaacagaugugggaacuuaaaggcaaagaacagaauuaauuuauugguggguacacauggcauaacaugcauguagagaugauaggaccacuuguggaauugguucucuccuuccaccucauggguccuaaggagcgaucucuggucugaaggcuuggugacaagcuccuuuaccaaagaagucaugucaccuguccuaguuuuaguuuucuuuugguagauuugaaauaugucaccagcuuuuuaaaauauuaaauaacuuuuuauuuaaaugucucuuaaacuuugaaugugcaaguuagaauuuuagugaaaaaaaugaaucuuguuuggguuuguuuuaaauuacuauuuuaaaaaaauacaguaaagacuucuggugaugguagaaaauauuaauuccuuuaaaaauaugucuguguugcuaaauucacauuugcuuuucuguguuuuugugaacaacugaucaaauuagauucgucacucuuggcuuguggugauuugaaauugaaauggaauauauuaaagcagccagccacacugauuacauugcaagccucauuuaauuucauacauucacacauuacagugaaaggcggguuuuuuuuuaaugcaugauugugacuguaccuugagcaacuccaaaggucaucuguaauguaugcauaauuuguuaguguucuauaucugauuugugguagguguuccucagccugauuuguacugguaguaaauacgguaagcaugaaaagucaagucuguaagaaguucagccugucccauuugauggcauugucuuauuuuucaucguuggccacuagaccacauaaaauagcugucauuuuuaaauagagaaaaugcucguacuaaaccuuuguagcacaggacuuaaaugagcuauucuucuuaagagggcaggcuggcccagguggaaguuuuaagcauauuaacuagcauuccuagcagcaccgcucaccucuacuugagcacuucuuuuuuuuuuuuuuuuuuuuuuugccuuccuauucuauaacagugaguucugcuaaguucauugucccccaaagaggacaaaggaucuaaccaaguaucccacuacagguuuuucaugacucagccuggcuuaguuugacuuagucuuuuaagacauugucaaaaauagcauaggcuacucuagauguuacuauguaaggcuggccuugaacccuucuguuucccaagugcuagaauugcaaauguaucacaauacuuauuucugugcugcacuuuuuaugguauguaauguuuuuuaacccugucuguggcucaggaacacacguugucuuagcccauguuguccaaaaguuaguugcaaauggggguuaauguucugcucagugggaaggagaugauagacuuucaaggacuuugaguugcuuugaaaguucuacugcugaguugccuuuuguuuuggcuauggugguggaaacuuguuuguuuccuucugccauugcuugcaguuuagaguuuguucagagacaaauagauguuuuugcuggaugugaacaccaauuugcuucccagaaaccagaagcaucuaaaagcauuuuuaagaagugggaauucaugaaauuccuaggcaaauggacggagcuggaggauccugagugagguaacccaaucacaaaagaacucacuugauaugcacucacugauaaguggauauuagcccagaaaccuagaauaccuaagauacaauuugcaaaacacaagaaaaucaaagaagaaggaagaccaaaguguggauacuucauuccuccuuagaguagggaacaaaauacccauggaaggaguuacagacacaaaguuuggagcugagacaaaaggauggacuauccagagacugccccaccuggguauccaucccauaaucagccaccaaauccagacacuaguguauaugccagcaagauuuugcugaaaggacccugauauagcugucucuggugaggcuauugccagugccuggcaaacacagaaguggaugcucacagucagcuauuggauggaucacagggcccccaauggaggagcuagagaagguacccaaggagcugaaggggucugcaacccuauauagguggaagaacaguaugaacuaaccaguaugcccagagcucaugucucuagcugcauauguagcagaagauggccuagucggccaacauugguaaaagaggccccuuggucuugcaaacuuuguaugccccaauacaggagaacaccagggccaagaaguaggauaguauuugaaauguaaaugaagaaaauaucuaauaaaaaauugacagugauauuccugaauggggaaaauaaaauaagcauauccucccuaaccuuucuucucuugauuggaaauuacauuuagguuuuuaaugaacuguaagccaguaauuucuaggaaaguaauagauauuuaguaguauagagaaaagauguauuuuauuauuuauuauuucuuuuuauuuuacacucaagauuuuauuccccuccugguacacccuccaacuguuccacaucccacaccuccuccccaccacaccccaucucaacaugaauacccccacccuccacccuaccuguguauuauccugugaaaauauuugauguuuacauugauauuaaagaauuuguuuuguuugauaaacacugaaggaaaaugggugaaaugacaguuuaucuccaguuuccucaaggaaguaaacaguuugguuuaagaaguguggaagaauuuaguaaaguuguucaaacuuaggacugagcaauuucacuuccaguaaauacccuauugauauuaaagaauuuguuuuguuugauaaacacugaaggaaaaugggugaaaugacaguuuaucuccaguuuccucaaggaaguaaacaguuugguuuaagaaguguggaagaauuuaguaaaguuguucaaacuuaggacugagcaauuucacuuccaguaaauacccuacaggcacacccucaguuaccaagccaggcauacuguugaguacuaagucauaggagauauauaaaaguguguauuuuauuacuuauuauaguccucuauguaaaccauuuauagauuuaaaaaucuauaccuuauaggucagguaauucacauaauuuuuaaacuuuuaauauuuuuugcauguaugaguguuuugcuaauguaugugucugugcacucauaccuaaugucuguggaggacagaagaggccauccuaucccuuuuaacugcaguuacagacuguugaaagccuccauacagguucuggaaauugaauccuggucuugaaaaagaguagccagugcucuuaaccauugagccauucuccagcccccuguauaaauuucauaugcagcaguaguauaauauuuaauuucuaugcuuaggugaaauguagaaauauaacaugcuuauagaaaggacacgugucaaauucaagagaaguguuaucuauuggcaaugagagucaagcagcugagacacagacugaccuauugaugauugugucuuagucaggguuucuauuccugcacaaacaucaugaccaagaagcaaguuggggaggaaaggguuuauucagcuuacacuuccacauugcuguucaucaccaaggaagccaggacuggaacucaagcaggucaugaagcaggagcugaugcagaagccauggagggauguuuuuuacuggcuugcuuccccuggcuugcucagccugcucucuuauagaaccaagacuaccagcccagagauggucccacccacaaggggccauucucccuugaucacuaauugagaaaaugccuuagaguuggaucucauggaggcauuuccucaacugaagcuccuuacucugugauaacuccagcugugucaaguugacaccaaacuagccaguacagauuguaaacaaaaaaggcaccuggcaugaucuguuuuuaaaggucacuguugcacucuaggauaacaagaggagaagcaggagagcauuuagaggcuaucaauggaguccugguaagacagaaguggcuggaagugcaaauaguacagguuuacucaacccuggaacuggugacauuuuaaacuagauaauugguugccaugagagagacuuuucuguguaauauaggauguucaguaacaccucuucuccaguucugacacccaaauaauguguucagauugccugguugagaaucauuagccuaagcaguacauggggaaauucaguuuggaagagaucagaagaagcucaagaaggaagaccaaaguauggauacuucgggcuuucuuagaagggggaacaaaauacccaugggaggagauacagagauuuaaacuuuuuaaagauugauuuuuauuguucuuaaucucugucucucugucucucucucucucucugguauguguguuuguguguguguguguguguguguguguguuaguucuggugccuauagacuucagauucucuggaguuacaggcaguuaugaaccacucaagaugagugcuaggaauauagcucagguccuccacaagaauagaaugucuuccuaacugcugagccaucucucuagcccuuaaaagcacuuugauuccguugauugaauuuuaaaccaugcaugcuagccaagacugguaauaaaguauggauuauuuccacuaccacucgguaaaaaaaucucuucaaauucugugcaugucacucucauuucauaggcaggaggaggguuaagaaaaaugccagugccaccaacauuaugucacuugucccaaaacaaguuauuaaagaauuccgggcugagcuucugacccuguuuucuaaucugucuauuuuggugccuuugguuauaucaugucuucuuuaaguaugaaaaaaaaaauaaugcuauaaaacgcuacauauaaaguuuuaauaauuuaguuuuauuugcauuggugugagguaucagaugcccuggaacuggaguuacagauacugacaugugguugcugggaauugaacccagguccccuggaagaacagucagugcucuuaaccacugagccaucucuucgggcccacaugcaagguuuuaacaucagaguucuaaacugcacuuuaaaaggacaguaguaaccugagugcauguuacucauaaacaugcagcuagacaacauggcaagucgauggcugcuauaucuucauuccugucccauuuuuccuacaacuacacuuagggugcucuucaguaguaguauguauaaaggauggucuccaaaaagagacugacagccuuaauuuguuugaugugugcaaucauaguccacguuaaauucaaaaugcuuguccaaucaaggauucaauauagaaaagaggcaguaacaagcaugcugcacacuguaauaaagaaaucuguugauugaaaacaguuuguauauuuuggaaaugauagggaauguaauugguaagaaagaaaaggauagggcuucauaaauaauaggaaauggagcauauuuuuuacugauaaugcuaacucgauuuaauaacauuuugguguugaauuuuuguauuccagaaaauaaggaagguggcuccuuuucuuguacucuaaaugucaugguuaauggagugaccuuuuuuaguuuuguuuucaaugagaacagcucuaauggagugaaucugaggcaacaaugagugauacgcucuggcucccgaagaaccuucacagaaugagacauguuuauugccauuuaaaaaucagacauuuuaaacuguuuuagguacaaaugcuuugucaauguguguuuaugauagauuagggaagcauagaacaaacuaauggacauccuccacucccagcucucucuuacacuccuccuuggauugucauauccucauaguguagccuuauuguaccugaguaacaauuuguacgcugaccauuaaguggcuguagugauuuacuguuuaugucaugcucaaauuuacuuuucuaugacugcauagauauauucauaaggauucaagucacaccauaaagaguugauacuaacagcucuccacaggaaauauauuauugacuuggacacuacuggcuauacuugggaugaguuagauagaacccuuuuacuacaaauuacccuuauucacaggcaucccauuggaccugcucacauaguuguccaguuucuagcuuugucuucucuggcugugauuagaaagucugugaaagaaagaauucaguaguugcucaguccacaaggcuauaugucuuagcugguccuugguauaugcuagaaucccaaagaagugagcuucaaugccagugaagaaauggagauauauauauauauauguguguguguguguguguguguguuuuacaggccagccaugaguacacagugagucaaaaaaaaaaaaaacuggaggaaagaaaacaaugaauaaaauaacauuuuuuaaaaauugacaguaaucguuuauuccauuaugagugacuuuuuuguuggguggcuugauuugagugcugagauuaaagauguguaccaccaccacugcacuuggcuuaacuuaacuuucuuaaaacauuuucuguuaaauggcuaagacugaguaauagauaaaggauagugggaagucuaaggccauaaucagcauccaucuggcuucuaguggaggccucagguuaugucaagauacagugaaaggcaaaagggugaguaauuacauccagaaaauagaacauaaagaguauuuuuaaguauuuauuuauuuacuauaugugaguacacuguagcugucaucagacacaccagaagaagguaucggaucccauuacagaugguugugagcuaccaugugguugcugggaauugaacucaggaccucugaaagaacagucagugaucuuaacugcugagccaucucucuagcccaugaagaguaucuuggcugauucauuuuuauuguuggugugauguggugugguguggugugaugugacccagugucacaugggaagaaauaucagaggaauucccagaucagaauggcuuguagucaugucugugagaauuuuuaauuauugauuaaugugggcagagccaucccuagauaggugaccccagagcuuuguaaaagaaaagccaguaagcaacauuccacucuaguuacuacuucaguuccccccaaguugcuuuuugucauaguguuuaucacagacaaaguuuggggcuaagaggaaaguauggacuaccccaccuggggauccaucccauaaucagccaccaaacccaaacacuauugcauaugccagaaagauuuugcugaagggacccuguuauaacugucucguaugaggcuaugccagugccuggcaaauacagaaguggaugcuuacagucaucuauaagauggaccacagggcccccaauggagaagcuagagaaagcacccaaggagcugaaggggucuacaacccaacagguggaacaacaauaugaacuaagcaguacuccccagagcuugugucucuagcugcaucuguagcagaagauggccuaaucggccaucauugggaagaaaggccccuugguauugcaaacuuuauaugccccaguacaggggaaugccagggccaggaagugggaguggguggguaggggagcagggugggagaaggguauagggaacuuucgggauaacauuugaaauguauauaaagaaaauaucuaauaaaaaaaaguacauuaguauauuuuuaguauuuuaaugcaccuaguaggcauauacaaacgacacauucuuaaguagauguggguaugcauaagaaccagggauuuuuaauauuugcauauuauuuucagcccauuauuuuagaaguccuuuacccauccauuuucagcagauuaacuuaauuacaaacuaauuugauuucauugacacuuaccugaacaaaaacuucagugucccucugaacugaaguaaaccagcucauaaaagucugucuaugaaaccauugucuguggcucagaguagaaauacaagagggccugggaauaugcuucagugauuaagaguauuugcuauuuuuccagaagacccacaucauagaaguuccacuugaaagggauaaccguguggaguccacucagucuugaucccuuucuguuguggacuggcccacacuuaggaggaacuguucugaauccuauacauauuuuccucaauuacauuuccaaugcuaucucaaaagucccccauacccucccaccccacuucccuacccacccauucccauuuuuuuuuggcccuggcauuccccuguacugaggcauauaaaguuugcaaguccaaugggccucucuucccaaugauggccgacuaggccaucuuuugauauauaugcagcuagaaucaagagcuccgggguacugguuaguucauaauguuguuccaccuauaggguugcagaucccuuuagcuccuuggguacuuucucuagcuccuccauugggagcccuguguuccauccaauagcugacugugagcauccacuucuguguuugcuaugccccggcauagucucacaagagacagcuacaucuggguccuuucaauaaaaucuugcuaguguaugcaauggugucagcguuuggaagcugauuaugggguggaucccuggauauggcagucucuagaugguccaucccuucgucucagcuccaaauuuugucucuguaacuccuuccauggguguuuuguucccauuucuaggaaggggcaaaguguccacacuuuggucuucauucuucuugaguuucaugcauuuagcaaauuguaucuuauaucuuggguauccuaaguuuugggcuaauauccacuuaucagugaguacauauugugucaguuccuuugugauuauguuaccucacucaggaugaugcccuccagguccauccauuugccuaggaauuucauaaauucauuguuuuuaauagcugaguaguacuccauuguguaaauguaccacauuuucuguauccauuccucuguugaggggcaucuggguucuuuccagcuucuggcuauuauaaauagggcugcuaugaacauaguggagcauguggccauugguaccuuucacaccacacacacaacauagacugccauguacauggcucaggaaaugaagcagagaagcccaucucuuacuuguucaucagaauuacaaaaggcuccagugagauagugaaauuggaauugaaugagacacaaucaguuguuuaaauuuaaaaagcaaaacaaaaccuuguagcccuggcacucagaaagcugagguaggaagauugccugggcuauguaguaaggcauuauuuuuauaaaagagaaguaaaaaaagagcagccauuaugaccaaaaagaagaguucagggacucucagaacccagggccuagacaaccaccugguuuguuccugucucccacgucauuuucucccaguacaucauucuauuuccuuucucuuuugugggagauggauuuucuuugcuugucaugcuccaaaugugcuuauucuguaguuuccagcacuaguaacgugaacuagaaaaaggaucugcguacuugucugaacaaauucugaauaccuggagaaggccagcagcagcaccuuguacugauuggcaagggcucacuguauggacagggaaggagcccaguugucagaaaugacugccacaaguuuauagcuugcacuaauauaaccaagguccugauaaaccuuucugauugguucugacaaagugaaaauuuuguaaaaaacucuuucugagaggccaaggaaucuauagaagccagcaggcuugugagaccaguccuaauguuuucacuaacaguuagcuggcuugaugauaauuagcugauguaguugacaugcuaucuaguucuucuguuuuccuugucauucuuucaugcucagugguagagaaggaaccuuaguaaacaaagaagcuucuauuuccaccaaagagcaaguagguaaugucuauugguauaucugguaaaaacaugcgauacuacgaagagacuuccucuaaauuuucuaacuggcuuaccccaccagcuuugagcuguuucuauagaaaagcaacucauuuugguauucugaguaauuuuuaaaaaauuaaucugcuauugaaauguaaaugaagaaaauaccuaauuuuaaaaaggacaaaauacauauuuacuuugucacuauuuuguuuuuauuuauacuuuauuucuuuaaaauuaauuuuaguuaacagauaauaacuguacacauuuaugggagacuuugugacaauuugauacauguggauguuauaauaaaaucgugauauuuaacauaaaaauuuuaaucuguauaugugugugccucugcauguauguguauguguauaccuggugcccaucagaagccugaagagaaagguuuaucaggaccuuguuaucagugccccuagaacuggaguuacuaaugguugugugaugcuauauggauacuacaaacuuaacccugguccucggcaagaccagcucuuaaccacuucagaguucuuucuugaccuuugucaugguaccucucuagucgauucucucuccuuccuugggauaucaaggauagagccuguaguaaccugcucccuauccagcguuguccaugcaaugcaaguaauuuuccccucuuguuucucacacuugcuuucuucaugaccucacauagucaggagucuucccugggagguugccaucuuucuagaguaaccaucuaucauugaccaaaagaaagcuaccauguucaucgucuuuuauuaguauucccucuccugacagugcccauuuuuaaaaagagcaagcgagagaucaugaaguaagaguuugaauggguauuccugggcccaguuuaugugaguuucuuacuuugcaucucuauucagauuuucuuuuuucucauuaauacuacccuucaagaauagguauaucauuugugaaaaguaguaacuaucauuuuuguaacagaaaaaaaauucccccuaaagagcccugauauuuauugggcauacaugaagguaauaagcuucugcaacagagagaugguuauauguggauggggggguaggggcauugguucuccaccagaaugauuuuugucuccaagggaaaguuuaguaaagucuugacgugguucauaguuccuugucaaaguucauuuugggcacauaguaaggaaucacugagcuagcucacaacuguaauuccaaagcagcuugggagacgaagcaagaagaaugucaugaguuugagaacagcauggacuacauaaugaaugauuuccaggccagcccugagcucuagaguauggcccuggguuuaacaaaaacccaaacauaaauacauauacagcaaucuaaagugucagcagguugacaaggcccuauuuugggcuaguggggaggauaaacagagugaguggugcagaggguuuggaggccacuauguugaugcuaaggaaagccuagauaguauuuugccaauucaaauagaacuaguaacaguaaaugcagcgacaaguuuguggccacaaggaaaauagucuuugcauaauuaauacagaacaucagcuguguuaugucuguauggaagagaauuuuacuuauuaaauuuacuuuaacauaguaagcuuauuacauguuuaaauggauauauaugguuugcaaaacaaaggaguagaagauaaaugucaguuuagauuuuugaaagcccauuuaaccuucuggcuuaacagaaagcagcuaauguuuuaucucugcuuuugcauucagucugugacagcagcacacaucaugggagccuuuggaaauuucacuguagacccaugagagaaugagggccaaaaagccaauaaugccuuggaauacuuuugaaaauauuuugaucuugaaaaccccugcaugagacucagggucuucccaagguccauccuauccccacacuuagagaaaugcaauucuagagcuaagagagaaugaaaugugucugcuuuuucacugaucuucucauugauauuuagcauucuucaaauauaaacgggggccucaaaauaccuuggaacuagcacuaucugugacuuagucaccaauagaaucagggcauuuuuaggucacauuauaguuguugcagauaacuaaaauaccauguguauucaucauugcuuugaaaucucaguugccacagugcuacauuucaugugcaguaccuuaaugaaaacauacauuacuacacuacaguuaagauuuuuaaauauaugauaaauauauucuaguauaauugcuuuacucuucaauucugguuuuaauuuuaauccugugauguagcuuagugauagagcacuugccuaguauauauaaaacuaaugggaucugagaguucuaauaauucuuauauuccuugauauaguacccuguucuagaaagcuaggcugccagaagaacaucuuuugacuauuuggggaaggcaguguggccucaaaacaagaugaaauuggugacuguuuuaagaaugcaagugcugaaccccagguagggaccaccugagaccgaccuucuagccacucaccuugcugcuccaggacugcauggacuucuugaacuucaacccuggguagggagcccuucuccccagaaccaguccuccugccugccuucuagccacuuaacccacuauaaugcucuaggaccacauagaguccugcaaccucauucucagguagggacucuuagccuacccucagagccaggcuaccacccaaccuaccaagaugcuuuagggacccccagccaggccuccaccccauccaccuccaccuaaagauaguauggcaucaugcacccuacucccacagagcacugcaacuagccccaaucaccaugaccuuagccccugccaccuaaagaccacauguauaacuggggaaucuucuaagcauaaagaaaaaucuguucucgagcucagaaguuuuaucuaccaguagucgguuugagacuacacaaagugaccacaacuaaaccuugaucaccauucagcugauccacaaccuuacaaguuggaacaauaacagagacaaauaaucaggaugagaccagauauccauagcagaaacaacacuaccaguaccaaaacucuaggugucuaguucccaccccaaaaaaugcaaacagcaaggggaggugaagggggauaggggauguagggggaggagacugaguuggguuuuaauauaugagagaagaauaaauaaaaaggaaaaauacaaacaacaugaauaaccaaaaaauaugucuucucuagaaauuagcaccucuacuauaauguucccuggggaaagcaacuuagcugaugcacaagacagugcuuucaaaauagcaacuauaaauauguucaaggacuucaaagaggauauaaauaaaugccuaaauggaaagugcaaaaacacaguugaaugaaguaaugaaaacuauucaaguuaugaaguuggaauuuaauaaagagaauaaagaaaagccaaacaaaauucaaaauggaaagaaagcucagaaagucagacagaaagcucugaggaagcuaucaccaauagaucaucacaucaaguggaaucgagaauaucagaucuugaggacauuguaaaggaauugggucacucagccaaagaaaagaaaaacacacaauagaacaugcaggaauucugggacaguaagaaaauaccaaaccuaugaaccauagguauagaaggcauagaaaauauuuucaacaaaaucauaagagaaaaauuuccaaaucuaaggaaagagagauauguugagcuacaagaggcauacaaaacaccaaaauaggaccagagaagaaacuccccacaaaaucaaauaggacaaagaaaagauauuugagaucuacaaaagagagagaugaaguacuauauaaaggcaagcccaucauaauaauaccuggggcuuuucaaugaagacuucauaagucagaagagccugggcugauggacuauaaguccugaaagaccacagggccacccuagacuaugauauccaguaugacuaucagucauaaucaaaggagaaagaaaaacuugccaugauaaaaaaacauacuuaaaggaauuuauguccacuaagccaacucuacagaagauacuagaaggaauacaucguucugaagauuaaacacuccuaauagagcacaauuccagaauaguucaucaaaagaaguuuaaaaacaacaauaacaggaauuaauagacauuguucgauaguaacucucaguauaaaaagacaaguaacugaaugaagaaaguaaguucgacugacaauaauuugcuuuuguacccccaucuauaugcauagcuacaacuucaggucaucauaaaguguuuacaacaagcacacauaguuuuuuuuucuuuuuuuuauuagguauuuuccucguuuacauuuucaaugcuaucccaaaggucccccauacccacccccccaauccccuacccacccacucccccuuuuuggcccuggcguuccccuguacuggggcauauaaaguuugcaaguccaaugggccucucuuugcagugauggccgacuaggccaucuuuugauacauaugcagcuaaagacaagagcucccgaguacugguuaguucauaguguuguuccaccuauaggguugcaguucccuuuagcuccuuggguaauuucucuagcuccuccauugggggccaugugacccauccaauagcugacugugaucauccacuucuguguuugguaggccccgguguuuuuuuuuuuuuuuuaaaguguccugugccuuauauaaguuuuaaaaagggucccuuaacaaguucuuauagauucaccuaauaaacuucauuuuucuuuauaaauuuagugaccucgaguuagauagcuaagauauuucugucuuuuuaaaugcuaauaaaucuucccaaguacuuaugcaacaaaacacagaacuggacccgcccccaaaaaaaugcuucuaaaaggggauacaggauguguaggagacuugguugcuugacuuuuuuuuuaauaacauaaagaaacaaguugaauauggggaacuaggaguauagcucaguuuuguagaaugcuuaccuagcauauacaaagcccugacuuaaaccuuagcuucaccuacaacugaggaagcucaccuguaaucacuuuagagagcugcagguacucccagauaaccacgaauguaagguuauacuugacugcauaguaaaugagauggcuggcugaaauacuugagacccugccucaauaccuacaugaauuuauaaacaaauaauuuaggacagaaaggaaauggagauggcuugguugggagauggguaugaucugaaaggaguugcaggagagcaaagugugaucagaacacauuguaugcaaaaagucuuuucaauaaaaguugaguaugacuacuuggaaagaaaaucuuuuuccuauccugaaaagcaaccacuuguaaauccugcugcuguucuuuuugguauuuccaaacucuuuaucucuaacagauacaaaauacauugcacagucauuuccaccuuucuauacccuacaagacuuggaugcccauacaugccuucuucauucagguaugacccaaaguguuguguuguugguauauuggugagcauagcugcccaguucugguagguuaauagacaguaugaacauaaaucaguucuuuuucacccuuucuaaguuugcccuuaauccaguucacacauagcugguacucuggacugaugaccuucauggcuugaugcccagcaguuauccuggagacugucuggggauuaucuucaugcggcacugauuuuggaggccuuauguccuagacucuguucuuuuuguuuacuuucucuuggaacaugguaagggauauuuuccaguagcuccuugaauugucuuuaaucuucucugauacuuuuuaguacuuagauacaacuuuguagguuagaauuuguuuuuugcuuuguuuuguuuugcauaauuuugaaaagaguuauauuggccuuuuuaauauugcuacugagaauuugaaagccuuucucagcccuaauuuuuaaauuuguaauauuuugcauuauguuggcugguugcuugcuuccuugcuuauuguccucagaaaacuguaaaguuuucuuuguaccuagugcauucacauucaaggcagugugucuuugucaucguuuuccuuugugauacugcccaccugauggacucuuuccaauuuggaaagucgagccaagcuuuuucuuauuuccucaucaugauuucuuuuuuuuuuucccccugcuuuuauuguacaaucaauacuauaaaauuuguuuugaguuuuguaacuuuggaggauuuuagauauguuguguuuguaauucauguagagugaaaggauuguguugaauaaaugugggcguaaaugcaaaaaagggggcauagguuauaauuuauuauuuuaagggacgaaagucaaccaauacuugucaggaaaaagaaaaguaucaguuuacauagauuauaauuuuaagggaagcucauuuagugucaggcauagcuagcuuuaagaguaucaagcaauauaaucucucucuucccauuagcuuucuauuugcauaugucauugugacagaugcugaaaauccaagcacuguauuaauguuaaaauucuuguaccaucuucgaccauggcuuuguaagugauuucagucaggggacuuuacauuccagaacuaucuggugaagaaagagauucuuuucacugaugaauaaaaucugguuucuguucaauauuggggugcagugagcgucguccuauuccaaacacagugaucaaccagcaucaccuaauauugggcacagauguuuuucauagauaagaaugcuuuaugaaaccuacauguucacccuaggaagcaugguccucuaacuggaggcgauaagaagccuuagcgagaguuugaugagacacugcaaaacugagcacagagaguugcuuggugcaaacuccugaaaagggaauccuagagaggauagggccugccacauuggaacuucucuuaaagaagguuauaagucaguguuuagggaaauaaagacaccaaugugaguguggagugaagaccauggaggcuguagagaccagaagucaugcaaaggcaauagcucagcuuguuuaaagcaaaggagguaugaaacucaggauucucugccucaccagguuuuuuuuuuuuuucagcaaauuuacauuugcuauuuugauuugcaaugcuccuugaguguuccaggacuaaaucagagcacuguaagggggaaucuaagacuuaguauucagcaaagguuugaugacuaaagauggaguagaaagacuucaggaaaacaucucucaguuugguaaagcagagacugcugagguagaccauccuuaucuccucaccuguugacugaugaccagaauagccugaagaagauauugcuuaugaagcagcucacguggcuguugcuagacagagagacuuuuuuuuacaaauccuguccuguuauaauguugaugaauaagaucagauauuagaaggcugcauugauaagguuaguacagggcauugucaaaugucagaaaugaaaaauggacgucuacagaagugugagaaugaguucggaaaaaggaagaaggcuuaguuaaggacaacguaccuccuuuguggcccuaucagcuggugccgacaacauggagaaggaccauugugcuuccaaaaggccaggguuccuguuucuaauggggggcggauaugaauaugaauguauaagugggggaguugaguguaugggguguuuuuguguguaauaguguauguuaauaugugagagagggugcaugugagaguguguguauguuuguguauguuauucucgcaagaauaacuuaauuaaauuucugcauccugucauauucaggcugaggugucaguguagagaacauggucuuauuguucccccagcuuguggcuuggcaaguagacagaauacacaggcaggccugcagaauggaugaacagaauagaggggagcagagugucccuggccugacuggacaagguuuagaggaaucuugccuccugggaggcucuugguagauuucccugaguuccacucccaugcuuauuuggaccacaaugcagacucagaacacagcaugacacuugcaugauaauuuauuuuuaaagggauuauaaguguuuaaccauuuaaggaagaaaucaaagcucuuugauuucaaagaucuuauaaucagcuaccaacaacugccuuuucuuagaaauaagcuagauuacacuuuaguacaagcuugcaccaaguauuuguuuucauuuaguuacugguauuuucuuugagagaauauaagacauguuccaaacagucauccauuuccaagccacacugagcgaccaggucacaucucccccccccccccccaugagagcuucccacugacacagaguugcucuucccucucccuugaaauauucauccuguuuuguuuuuguuuuucauugaauuucacuuuuuuauuggauauuuuauuuauuuacauuucaaauguuauccccuuuccugguuuccacuccaggaacccccuaucccauucccaccuuacuucugugagggugcucccccacccagccaucuacccacucccaccucaccacccucacauuccccuacaguggggcaucaauccuucacgggaccaagggccucuccucccauugaugucccacaaggccauccucugcuacauaugcagcuggaaccaugagucccuccacaaguacucuuuggugguuugguuccugaaaguucuuccuauggguuucaaacccuucagcuccuugaguccuuucucuaacuccucuauuggggacccccugcucaguccaaugguggcugcaagcauccaccucuguauuugucaggcacuggcagagccucucaggagacagcuauaucaggcugcugucagcaagcauuuguggcaucugcaauagugucuggguuuguugucugagugugggauggguccccagguggggcagucucuagauggccuuuccuucauucucugcuccacacuuugucuccauauuuccucucaugaauauuuuguuccucguucuaagaaggauugaagcauccacacuuuagucuuccuucuucuuaagcuucguguggccugugaauuguaucuuggauauucugagcuuugggauaauauccacuuaacaguaaguguggucuuuugugacugggauuuugccuaagaauuucaugaagucauuguucuuaauaccugaguaguccuccauuguguaaauguacaacauuuucuauauccauuccucuguugaagggcaucugaguucuauccagcuucuggcuauuauaaauaaggcugcuaugaacauaguggagcaugugucguccuuauauguuagagcaucuuuuggguauaugcccaggagugguauagcugggcccucagguaguaguacuauguccaauuuucugaggaaccaucaaacugauuuccagagugguuguaccagcuugcaaucccaccagcaaugaaagaguccuccucuuucuccacauucuugccagcaucugcggucaccuaagucuuugaccuuagccauucugacuggcgugagguggaaucucaggguuguuuugauuugcauuucccugaugacuaaggauguugaacauauuucuuuaggugcuucuuagccauucgguauuccucaguugaaaauucuuuguuuagcucuguaccccauuuuuaauacaguuauuugguucucuggagccuaacuucuugaguucuuuguauauauuggauaauagcccucugucagauguagcacugguuaaaaaaaaaaaaucuuuucccaaucuguugguugccaucuuguccuauugacaguguccuuugccuuauagaagcuuugcaauuuuaugagguuccauuugucuauucuuaaucuuagagcauaagccauugguguucuguuuaggaaauuuucuccugugcucauguauuugaggcucuucuguacgcacuuuucuaauacuuucagugccucugguuuuauguggaggucuuuaauucucuuagacuugagcuuuguacaaggagauaagaauggaucgauuugcauucuucuacaugcugacugccaguugaacuagcaccauuuguugaaaaugcugucuuuuuuccauuggguaguuuuagcuccuuugucaaagaucaagugaccaugguguguggguucauuucugagucuucaguucuguuccauuggucuuccugccugucucuguaccaauaucacacaauuuuuaucacuacugcuuuguaauacaacuugagaucagggauguugauucccccagagguucuuuuauuguugagaauaguuuucgcucuccuggguuuuuuguuauuccaaaugaauuugcaaauuguucuuucuaacucuaugaagaauuggguugcaauuuugauggggauugcacugagucuguagauuguuuuugguaagauggccauuuuuuauuauauuaauccugucaauccaugagcaugggagaucuuuccaucuucugacaucuucaauuucuuucuucagugacuugaaguucuuaucauacagaucuuucacuugcuugguuagagucacacccagguauuuuauauuauuugugacuauugugaaggguguuauuucccuaauuucuuucucagccuguuuauccuuugaguacaggaaggauacuaguuuguuuguguuuauuuuauauccagccacuuugcugaagucgacuaucagcuguaagaguucucuggaggaauuuuugggaucacuuaaguauacuaucauaucaucugcaaauaguggaaaggacuucuuccuuuccaguuuuuauccccuugaucuccuuuuguugucgaauugcucugucuaggacuucaacuacuauauugauuagguagggagaaagugggcagccuugucuaguccuugauuuuaguaggauugcuucaaguuucucucuauuuaguuugauguugguuacugguuugcuguauauuucuuuuacuauguuuagguaugggccuugaauuccugaucuuuccuagacuuuuaucaugaacagguguugaauuuugucagauacuuucucagcaucuaaugaaaugaucaugugggggguuuuuguuuguuucuuugaguuuguuuauacagcggauuauguugauggauuuccauauauugaaccaucccugcaucuuugugaugaagccuacuugaucauggugaaggaugguuuuaauguguucuuggauucguuuugcaaaaguuuuauugaguauuuuuaaaucaguauuuauaagggaaauugguauuaggucuucuuugaaggucugauagaacucugcacuaaaccuauuuggcugugggcuguuuuuugguugggagacuuuuaaugacugcaucuauuuccuuugggauuauaggacugcuuagaugguuuaucugaucccaauuuaacuuugguauuugguaucugucuagaaaauuguccauuacauccauauuuuccaucuuuuuuuaguauaggcuuuuguaguaagaucugauuuuuuaaaauuuccuugguuuuuguuguuaugucucccucuucauuucugauuuuauuaauuuggauauugucucugugcccucugguuagucucgcuaaagguuuaucuaguugauuuucucaaagaaccagcuccugguuugguugauucuuuguauaguucuuuuuuauuguaccuggaugauuucagcccugaguuugauuauuuccugcugucugcuccucuuggauguauuugcuucuuuuuguucuauagcuuucagagguacuguuaagcugcuauuguaugcucucucuuuuuggaggcacucagaucuaugaguuuuccucuuagcacugcuuucauggugucccuuaaauuuugguauguuguggcuucauuuucauugaauuuuuuaaagucuuuaauuucuuccuuuguuucuuccuugaccaaguuaucauugaguaguuuuguuuggccuccacguguauaugggcuuucuguugguuuuguugcuauuauagaccagccuuagucgugaugaucugauaggaugcaugggauuauuucaaucuucuuguaucuauugaggccuguuuugugaccgauuauguggucaauuuugcagaagguaccaugaggugcugagaagaagguauauucuuuuguuuuaggaugaaauguucuauagauaucuguuaaauccauuugguucauaacuucuguuaguuucacugugucucuguuuaguuuuuguuucccugaucucauugaugagagucagguguugaagucucccacuauuauugugugucgugugaugugugcuuugagcuuuaguaaaguuucuuuuaugaauguggaugcccuugcauuuggagcauagauguucagaauugaaagaucuucuugguagauuuuuccuuugauaaguauguaguguccuuccuuaucuuuuuugauaacuuuuguuugaaaaucgaauuuauuccauauuaggauggcuacuccagcuuguuucuugagaccauuugcuuagaauuuuuuucuagccuuuuucucugagguagugucugucuuuaucacugagguacauuuccuguaugcaacaaaaugcuggguccuguuuauguauccagucuguuagucuaugucuuuuuguuggggaauugaguccauugauguuaagagauaauaaggaaaugugauuguugcuuccugucauuuuuguuguuagaggugcaaugaugucuguguuacuauauucuuugggguuuguugaaagauuacuuucuugcuuuuuccaggguguaguuucccuucuuguguuggaguuuuccaucuuuuauccuuuguagggcuggauuuguagaaagauacucugucaauuugguuuugugauggaauaucuugguuucuccaucuaugguaauugagaguuuugcuagguauaguagccugggcuggcauuugugcucucuuagggucuguaugacaucuucuggcuuucauauucucugggcagaagucagguguaauucugauaggucucccuuuauauguuacuugacccuuuucccuuacugcuuuuaauauucuuucuuuguuugguguuuuaacuauuauguggugggaggaauuuauuuucuuguccagucuauuuggaguucuguaggcuucuuguauguucaugggcaucucuuucuuuagguuaaggaaguuuucuucuauaauuguguugaagauaauuacuggcccuuuaaguuuggaaucuuugcuuucuucccuaccuauuauccuuagguuucaucuucucauuguguccuagauuuucuggauauuuuggguuaggagcuuuuugcauuuugcauuuuuuugacuguugugucaaugcuuuaugguaucuucugcaccuggauucucucuucagucucuuguauacuguugguauugcuugcaucucugacuccugaucucuuuccuagguuuucuaucuccaggguugucucccuuugugauuucuuuauugauucuguuuccauuuuuaaauucugggugguuuuguucaauuccuucaccuguauggcuguguuuuccuguaauucuuuaagggauuuuuguguuuccucuuuaaggucuucuagcuguuuaccuguguuuuccuguauuucuuuaagggaguuauucgugucuuucuuaaaguccucuauaucaucaugagaugugauuuuaaauuagagucuugcuuuuuuugguguguugggguauccagggcuuguucuaaugggauaacugguuucuggugaugcaaaauagccuugguuucuguugcucaaguucuuggcuugccucuugcuaucugauucucucucuuguuaguuggucuuguugucucugacuggagccugucccuccugugagccugugaacuuaggugugacagcacuccugggagacuagcucuguccaagugggaucuggguauggagagcugugccacagggagcagauggagaccgaaaggauccuguccuuauuugcuccguuguuccugagcccuguggucuccuggcaggucccucuuuggccaguuauuggagcaaaaguguuggucucaccuguuaacguaggaguggcacugcucuugggagagcugugccacuggguuaacuucgggccucaucaugauuucucuaauggaauuguuugacuuuuucauuuugcagugcuauggaucaaacucaagaccuuuuuaaugcuaggccaauaugucuaucauucaauuaggccuuuuuuuuuuucuaacacugguugguugguuuuguuuuggaaauuguaucucuuauaacccagaguggcuuugaacuccugauuuucauguccccaccuccucuacaacaccauaccuaguuucuuuuguaaggauaggaguguuuuguuguguuuuaaaacaguguuccauguaggucagacuggccucaaacucaaaugaguagccaaggcugaacguaaauucuugauccuccugcuugucaucaaguucuaggauuacuaacaugaaucaccacagccagugaggaacaugcuguauacaauuuugagaauaacucaaagugaugcccccaaauuuguuccaguugucucuacaacuucuuuaguggauuacucauaauuuagugaaauuacucauaauuucaccaauguuuauagcucauuaucacauaaaaccuauugaaauuugguuauacugugagaaaauuuuauuuuggaggcuuuugaaaaaaguccaggauggcuucuaacccacaguauagucuagacuggucucaugguaauccuucugaauaugauuauaauuacaauaagcuguggcuguuuccucccuuuauugggggggugguaaaugaggagguuauuuguuuuuggguguuuuguuuuguuuuguuuuguuuuguuuuguuugaggcagauucuugcuggguaaucaagguuggccucagaccugcagcagccccuaacucaaccuacugaaugguaaaauaacagguuugcacuaccucacauagcugagggaaaguuuguuguuguauauuggggaagaggaguacauauaugccauggugcacacauagaagccaggccagaagucacgucucuucuuuuaccuuguugagguaaggucucccuugcauuuugccaucagguuagcuggucaguggccuuuaguugauucgucuccacacucuauuucaguguagggugguagaguuacagguugguauugagauaauuguauacaacaugauuuuuaauuucaugaaauaaauauaaauuggucacuuaacauaaaacagcaguaagaaacacaagggaugaagccugccaguauucuuuucccuuuauuaauaauuaauauuagcaauaauuugccgcuauuaaaaacuacaaagauuuaccuguuguagaagaacuuauauuuucuuuauuaggcaguuaacuuaauuuuuacaaaacugacauuguugcuaggccauuuuuaccacaaguuaaacauugacccauuuugcuuuggacugagucauaccagguuacugaaaccuaaaauaaguauguucuaagcauuggguaaccauuauaagcuauuuagaacuaagagccacguaaaacauguugacuccuuccuuccuacgucccugagaagauacacuagacauuaagacacuggaaguacacuauauaaagaagcaugguggccaaauggcaaaaaaccacauuccguacaaucuguuuggccccaaauuacugacucuuguucuauaagucagcuuaucuuugcaaacagcuuuauaaacaaaacgaaacacaaugugucuugguuugauuugacuguauaucaggaaguuaugcugcaguaaggguucugcuguccacuuguuuauaaaguguacauccugcauguaaaagaaauguggauaauacaacuuagaacaccuaaagagugcuuucauuuauguuaaucaaugggcagcugcugccauuuauccaggcccugucauacaguuagcuaagcaggaccacaggggccuagaacaagaauuaagagucauacugggaguggugcugccucuguuuaggugaaaagccacuucggcaaguggaauaagauguacagagucgggugagauuacgagggacauuuuuccucuugaguuuggaaugggaaaaugagcuacaccccacuaauaucaugcacuaugggaagagaucuugacccugcauuuuuccauuucuuccccuuauuagaugguaauuucccuuuagggauucggguuucucuguuauauccauuaauagggagauggaaagagagucgaaaauuaaaaucauuuuauuguaagugucugugccuuuucaacucuguacuucccuguguagaacuaagucagaaaaucauucaagugaagacuaugcauuuugauguuaagagauuccacucuugcaggauagacaaccaguuaacaacaugaaaugagguggugaugguuuuugaaaugaaauaauguucgauagaacuucaaguuucuaucugaaccuugaccacacuguagaaaccuuagaaggaggggaguucugucaagcaccggauuacacagggaagaaaaauuagucuaaauacuaagggagaagccuguguucuuuugcaugauauuuagcagcaagagcaaggagagggauguuucuuucuuuguguaaugugcaguaguuacaauaaacacaagauuuccaaaucucagaggacucucuugacaguugcuugauaacagcuuuuuucauuccauaguuuugacaguuuguguguguugccauaucuaguguaaacuaaaacaucacugucauucugcuuuucuuuuguauguggcucuuuuuuucccccgucuuuaggauaaugaaaaagaugggcuuuucacuuguagacuagaguaaggcaaguugugugcggagauuagcguguguuuauaaauuuugaaagauucaaguugacagcagaacacugcuuuaaauauuuuuuuccauauugcuucaguaaaauuauugguggguuguguaaguuuucucuuaaucuuuugauaaauagcaaaucguaggcaucuguguggggaccuauauuacuuaucagugguuacugaaaaaccagcgaauacaauaaacaucuagagcuccuggcucugcaguccuagacaaaugguaaguaauccgccuucuccaccucaucacuccucuauccucaaggaugcccugucccaccugcuucuguuggguuugcgguuagaaugccucacugguuugauuccacaauaacaggaugcuguugacguuguauauuuaccuggucuuuguuuuucucaguaaaucuaggagcuaaauugcaucugugcugugagagagacugaagggauagguaagggaccuggaacgugagucaggaucagagcaguauuuucucaucaaacaaacucuuauccuccaauccaggaaggggucccauaccugagacacaccuacacaaacaccccagcaaccuuugaguuguagaaaucuccaugagguuauuuugccaucaaaccgaauuugcuguaguguagcaaaguucccaaugccgucaucuggcauguuacagacaaauuccaauuacuuuucuacuucaagcuauuguuaaacacuacaagcuagcugacaguaaaauuauaaauacagguguugucacgcuacacuauaaucagaauuuuaauuugaauuuucauuuguaaagccuuuuuuccauaugaaaauaggaauagaauuaguuuuauugacaguaaaaagacauuuugaaagcuucuuaaaucauuaccuguauuuagcagggggaaaaauuguauauguccauguaaaaagaagaguuuuauuaucacauauuuacucauuauauuuggugguaaauaaaacggggaagauguguuugacauaugauugauggaacucacuggguuuugcuucaucagaacaauagaccgacauaaauauauauuuugcuuuuguuuuguucagcuguuacuaaugcagaccuguagacaaaaucuucuucgagcaaauuaaguacagccuguugggagucugcaugcuaugcuguaaacuuuuuauuuggcaauuuucucuucucacccagauuccucaucuguggaacucucccccccccccaaccccuugcguggugguuggaguggguucccccuucucaagucccuuuuuuucccucaaggcauuuagugucgugucugccagauuucagugaugagcagcgaauugcuuuuaaagugggcauuaugccaguucagcagcacaauggaaaaccaaucuuccaccauucuacuuuugaugcuguuauuguagcauuuuagauaacugcugccacaaaaaaaaagaaagaaagaaaaaaagaugugcucaauugcuaccaguuagucaaguuaaauccagaguagcauuaaaauuacucugaaaacuguuugucagaggucaugugccgucuguggcugccacgcauaggauggauauucuguucggguggggcuuucccccuuuauuauuacugugacugaccagcucuccaaauagcccuucacuaccuguuuacuuauugucuucaccuccuuguugaaaaaaugugucaagcagaaauguugaaaaguuucuuuaaagugcuggaaauagcaggagagugaguuguucagggugcuagaguuuguacagugugaaagcaaaaaaaaaaaaaaaaaaaguagggggagagcaggaacauaauucucugguuucuauagcaagauuacuguuuucuucuuuuuaucuucacuuuucaaccacuggguucacuguucuaccuuuuuuuuuuuuaaucgcacaaguggaauuuauccucucucuaucucagucuccucccccuuugcuggcuuugcuugugaaugaaagggauggguacuauggcagcuguauauguuguauuugauguauuuuagagugagucauauuuuagaauucaaggccaauagaugggcuauuuagaggauagcaguaacaauauacuucacgccugcuuugcgucuucagaauuuagacuuuaaaauuacauaaauaacuccaaucugugcucaaaauaauugacugaugauuuauuggcugcuuugcagugauaauaaaagcaacucagucuucugaacuguaugucuucuaaauaaugucucuacauucauaugauggcuuguggauuuuucucuuugucuuaaucaugucuguaguaacaucaaacauuaagccccguggaggcaggccuuuugucuuuuguuguugcuguucuuguuuugguccauucuuguguucacaggacuuaaagcacauacuagacacucaggagauauuuguugaaagaagcaacaguucaugcguuaguguguuuaagugugguauauuuacuuaccuauggaucuuucucucuaauuaaagugauaagcuaugagaaauauagcagacauguuagcuuacuuuuuuaguuucccuuucuucccuaugauaaauaauacaugacaccaguaagaacacuaaauggaaaaaccaaaacgcagguuauuugcaagugaaggauauggucauuugaugaugaaaauaagaguagaaggacgguauuggucaguaucaugaaguaucuauauuaucuaacacacaugcauauaauacacacaugcacaaaccccagaaaaaauacugugaugacgugauacuuuuacuauuuauaacuguagugaacgcuauucacuuagaccaccuaagcucuuuauacagaugguccuacuaguggaaacgacuucauacaugugugaaaucaguuacagcccuugaugucuaacuuuagcucuuuaccuuuaccucuucuuuggaauuaugguuuacgcauuucugaccaaccucuacuaccaucucuacugaagcccccugcucccaucugcaaaauuaggccuauaggucaaaccuaggcuucugagaaugcugugacuuaauauaaaaaacuguacagcguaggauacacacacacauacacagacacacaguacuguucuuugaaucauugaauuauaaaugugacauagcuuuaaaggguuagcaacaacuugcaaaucaauaagacacaguuuauaacuagguuugaacuaagcauagaaaaguuaccuugaccuaaggauauagccaagcuaguaucagagauccuauguucaaucuucgccccacaaaaagaaaaagaaagaaaucuauguguuuaaaaugaugagagugaaaaugcacagcaauguagggauucuuccuugguagcuaaaaaugugcauguuaaacaucacaaauagggaugucaagcgaguuucucuaggcacuugcauacugcuccagaagaaucccuugguaaagccucuuuuucuaaacaacagauaaaagacuuaggcuuuacuauaagaguuauacauuucuuuaagaagagucuggaauguaaaauacaacauuuucuaguguucuaucucugucuccaccaccauuuaaccuuuaucuaauagcagucaaaaagacaaccuaaaggauucagauuuuuauuuuaaaaaaauguaaacacauauaaagcagaacaauuuuauaucacauggccuagugaccgccauuguacacucacagaaguuaugaguguuuauccuagcacccuaugucaacacuagaugacauucuuuuaguugcccguaucaaaaagggaaaucuuguaugaguaugcuuaggagaccuuuuggauuguuuuguuugguuuggguuuuugcuuuguuuugauguuguuguguuugguuuuuuuaaagauauaucauaggggcggggcuggucgaggcagccagugccugccuauaagcguauaaucccaggacuugagaggccaucacaggaggaucaucacaaguuugaggcugggcugcguuaccuagugagacuuugucaaggaaaaagaaauagcaaacugaacaguagguuaaaagguuucuuuuuuuuuuucuuuuuucccuucuccaaagaagauucacagaaaucauaaacuagcagcauagccuuacagaaagucuguuuggucuugcuucccacaugaaucuggugauucuccuguucagcuuauagaaucauugucaugauaaaaaauaauaggguauuucuuuccgcuuuguucuuuuugaguguuuuguuggggggggggguguuugcuuuugagacaaaaucugcuguguugccaggaugguuuugagcuccaucaagagauccuucucaccccagccuucugaacagcgugaucuauauacauauauguauacaacacaacaccaagcuagggcuuagaucuuuugaacccucugaaccagaaauuaacagacucuuucucuauagagucaguuggugaaaucuccaguuuucaugaccagauagucucauuguucagugucaccauuguacuuauagacaaaauaaacaugagcaugguuguaucccauuaaaacuuuauugacaaaaugaaucauaguuugauaaccuuuguucucuaauugagaaauauggacaauaaaaugucagauaucauauuauugcuuuaaguaagcaaccccucauuugggagucacucaauauggccagugguugcccagccuuauaaaagaggaauccuaagggagaccaugucuuuucagaggaauccacuucuuuaguaguuuguacuucaaucuuacugaaguuuugcuacauccuaaaagaucaaauuaaauucaccuaagcuuauauuuaucaguggcuucacugaggcaacccguucucaaaagccccaagcauuuuuauuaacgaaccuuggugcuaacugucauagagauaggaugccaaaaguagaguagagugcuggccccaauucaccuucccaggacaagguuucaguaagaaagagaguuggaaaaagaaaggcaguaacuaucuuggugauuagccaguuaagguuucaagcuauauggucaauuuugaaguuaguagggaauccuguuugaagugucacugaucuauucugggauguaauucaccacagucuucagguuuccaagagagaaaaaaaauccauuggcuuaauggaaaauuguauuccugauaggucaccguguauuguuuuguacaauuaaagaagguaaagaguguuaaccuuaagccaggugauggggguugcugcguggugguggccuuuaaucccagcacucaggaggcaggggcugguggaucucugaguuccaggacagccagggcucacagaaauauucugucucaaaagaacaaacaaacaaacaaaaaacaacaacaaaagggugcugaccuugacacucugaaaauacuggguguuuuuuuuaaguaaaauacauccauaaagucugaagacuacugacauguaauaaauugucucaaaaauaucuugcuuaaauguagcacuuguuucuguuagaaaggaaucugaacauggauuaacugagagaguaguauuucaggcuucauagauaguucucuaauaagcugaauuaccuauauuuuguucaauugauguuaacuauuaaauacaggcccuuggacaucuuaaggaaguauuugaucauuaaguuauaccacugccuccugcuuuuuguuguuguugcuguuuaguugguuacuuuuuguuuguuuuauuggggcaggaucuuguuguguauuucugaggguuacaggcaccacagucacccagcucuuaauauuuacauuguaucugaugagucagaucacagaccauauuuauuuuacauagacauuaaagucaguguagccaaaauaauguaucugguacagauuuuaccuuuguaguuuccccuugaauaauggguuugaugauaagcagucauuuaaaugucugcugugacauuuucuacuuccuuucauuauuauuuuuaccagaauaacuguuugguuuaaauuaauaaaaacgggaauuuuuuuucugcacaaagcucauuguuuugggguauagcaucucuuaugugcaugauaucuaacugaagaggauuguguaccaacacaugaacaaauagaccccaagaaaaacugagagccccuggaauaguugaagcugcaucugcuuccaaaguagagaagagaaagaguaggguguaggggaugacuuggaacacccucuuuccaggggauaucuauggucuauauuggaacagguaaggcuuucaccaagaucuguuccuguuaguaccuuuacagguaacuauaguccaccugugguuccaucuauuuacauuggucacaacuguuuccaagucacuggaaugugcucugagaacagaaggcccaaugaaaaauaaagagauccagaggauggguagcaaagaaggccagucuugugcucuuagccccugucccuaagagggcaaaugcucagguccaggaaauguaaaagccauucccuuggguguccuuuuccacauaguugcuacacucuggaggcuuuuuccucccaccugugauaaaauaauuauuugcauuuggguccauagcuuuuacugccuaucuauuauuauucauugucauugguuaacauuugucaaacauuaacagggucucaaaaacuaccaaagugcucuagucuuucaaucuauacauucauuaagaugaagaaagauaaacagaggcuugauguucagaaauaagagcucagaaauuccucuacaauuugauuaugaaccaaccccuaaucaugugauacauuuauuacauaaguauuuucucucuguucuacuugguugccuuuucuuccaagaguggccuagccucaugugcacccacccucacccugcaaucucuccaaaguauaugaauuccaaaucuuguuguuauugcugucaccaaacaguauauucucuuuuaauguaugcacccaggauuaaaaaccauguaaauaaacauuaagccaauguaugaaucaacaguaggaauaguauaugaacaaugaagauguuauauacaguucuuagaucauguugcuggcccaagacuuggaaaagugggucuucaggaagaauggugaugguaaacauguuacuuugauaguauaaagauguuagauaauuaaaaucagacauuaccaauauaguuguagucuaggcucuuauuugggggaaugauaagacucuggaaaugggauuggguaguggguacugaccuagacagacaugucauccaacuucccagagagucuaauugacucuuucccaguccccaauccuuagccuucuuugagcaccacugaucucagcuaaccuucugcucuugucuguccuagaacaccagcugagacacuaagauauuuucuuaugacuauguguauauuuuaaaacguggugcucacaucagguuugacugcaguugcugucuaccccauuggcuuuguuuaaauuacaaguuuguacagcaaauaccuguaggauuugggcaaguuaccaugacagucgugggugaguagacaaacauguuuucuguugggacaguaacugagaacucuaggccuuugguagaguugauccauaaucaacugaguuucaugacagagauggcucauugaagaucaauauuuuguugcuacuuuuuccaucgacauacaguauagaaccauuagggggaaaagcuaguuguugaauguaacgagagccgaguccugauaguuaaugguguacauacaguacucuuguaugccacauugauggcucuuuuuaaacauuaggggaguuuuuaaagaaauugcaauaaagucauuguaauucauagaacaugcuguaauacagagauacguguaaaauacaaucuguguaccugauugcagguaacagaguuaaaugugccagcaauuucaaacacaguuugauauuuccuauaauaaaauauaaugcaaaaaauuaaauauccaauaucaauggauucuaaaugguuuugcuauuucuuuuuguccuuucccaugaagaguaauuuauuucccuuuuuaaagugugggcagaaugauuacuagcgcacuguaauguaauuguguugcauugauaaaauaaaaauuguccuuuaucuguguccugauaauguucaauuuacaggcuggcuucucugccaccucuucagugcuuugaguauuccaguucuccucccuuccugcucugagagcgcacagaacuguuugaaauccacugguacaauugucaaaucaauuauucauucucugcaauuaugcucgcacaaagaacauuuugcuggucugaaugaugauuaaauuaacagcuauuccagcugccugauaacaucuaauagaauauucauaagcccaaaauggaaugaauuaucuccauuaacuucaucaugcucacuuaauuacaugcuuguuauuguauuuacaccuuguuagauaccgcugaagcugauccaguggcuggccgggaauuggaagcgucugucauggggcaguuggagcgcguuuuguaggaaaugcuauuuauuuuaaaugcuccaccugcugggagccgagguuagucagcagcacugagaugaauugggaaacgggguguaaaaagaaauaaugugcuucugacaggcuccguggcuuuuaaguugcucucauucagccacuucacaaaaaauuauuuuauuccaucucucagugaugaugacaugauugcuuuuggguaaucauuuaccauucugauuuuauuuuuugaaguaaauugucugaaguaauagguucuuggaauuacagcgugccuugcuuuuuucuuagaacuuuauuuaagcuugucuuccagcauuuaacccgaguccccucuuucguuugaucuucuaacuuuauuuauacaacagugcuuaaugauccugcacaauguguuuuccccuucuccgcaccccccuuccaaaaaaaaaaauucuguccaguaugguugacaguacuuuuuauaaccucagcaagggggcugcaugggcaauuuucuuccgacaugacaaauacaaacacccaaaacccaacccugauagaaucacuucauccaguugaaaggaaauuuuugaucucuuucaaggugacucuuucuccacugaaacaugguaaggggcacgacucucacuuucuauuuuuucuccauagacauggcauucuuuacaucgccucgcccugucuccucccuccucaagucacccucugcucuuuuccaaacuuccacuggccagcagcuccuggugguggggccccauugcaccuccauuugcuucaaguagaaagggucacgguucaccaccaccaggcugcagaaagccuguauuuauugaacaugaaccagaccaaugguggagagauuuauaaucacacuuguaaauacuugucagaugagucucguagagcacuugagcugaaccacagauaguuuauacuguuugaaggcuguauuuugguaucaacagaaaaggggaaaaagaaaacugaggauaauuguuuauaaguaggaguggaaaugaauaauggacuaacagagagacucuucagccuucagaaauauuuuaguaucuaggaagugauuucucagacaaaaauggcccuccaggcauugccuggcggauaaauguuuugcaugcugugugugccugguacugugccuucuacucuuuucuccagacaagaauugacucaacgauuauauauuuuaauuucuugcuucuguuaagaauugcuuagggcucuaaauguuuuucucuuugaaauacggguaucauuugagaucuuucggacaacuauacuuugucauggacucuacuguggauugauaggagaaaggcagccaggcuagauagaggccccagcagcucucuggagcuuccauggccuuaaauugcagagagcaccaagagaugcaguuucucucaaaguaccucaagucuccuaaauuccacaccugaaggcaaaauaugcucacauugagggagggaggcuauggauuagaaaaggugggagagcugagaaccguauggugggaagucaugcaauuaaaaaacugacugaaauuauuaccugaucuuauaauugacagaauauuuaauucagauauaguaaauugacacaccucuacacagagacaauuaugacugacuauauaacaccugacagaaucaauuauaacugacuguuguuugauaccuuugcacagaaauaaaugaaacagacauucagaacagagacggcugcugccugugugccuaagcuugccuuaauuaaaauaaaauaaccaguaggcaguguuugaaaaugucuuugccuaguucaauguguuuaagaccaaaaaugguuuuaugaagaggcaggcugagaagagaucugucuuuuacuguacugacacuggacuggacaauguaaccuaguaauaaguuuccuuagagagcucuccuguuucuuuuguuuugauuuuuuuuucacauuguaagucuuucauuuaaucagaugacuuuaaacaaaaccucuaaggcaggucagcccucagaugaacuaguuugucuugcaucaaaaguguuguaacuuggguaaguuuguauuccagugaguauaaauaaaguuuuauauuagcaaugcauuguuuugucugauaaaauauuuagagaauuauuacccaggcuaacuuuuugcuauuguuuucuuagggguuaggaugagaaugcuuuugacaguuacuguaugacugagcaaucucugcauguaggaaauaagcacugacuacauguugcuccaagaguauuggcaagaaaacuaagaaaaagagguuguugugcuuguagcuaaggaugagugucuuccaaguacuacuuuagaucaugagauggcauuuuccugguauguuuccacauagaaagaacauuuccuucucugucuuuuaagaaguuuggauuuguggagcaagagccacaauuagagguaucugguggggcaggaugccacugcuaugugugccucgucaacuguccucuuaaaauauuuuaccaguguuguccugaguccugaucauagcuacacucgggaugccgucuuuaugagugcauucaagcacuagggcagcaaaaggaagcagcagucuacugaccaugcuaacuggcugucagccuuuacccucugcuauuuucuuuuaaguucuaaagcaguggguagaauauugacagaaaccagguaacaguuuaguguaaagccuaacauggaugcccugguacccaaaaaacggaagaggaaaacugaacaaaugacuucuugcccucccagccccuaugauguggccugugacagcuuauccaguucuguuuccuagaagaccuuccauaagcuauugauuaagcucucauuggggaagcaagugggagcuuuuaucugcaucucuaacugccaggaaacagugccugggcuguauugaccagcuaugggauaugcuggcggucacaguugucuuuuacgaagaagcgcucccagugaugcugguugucauucugacucugcuguguggcagcguaaauaguccccuuucuaaccaaccuggugggaaaagucaauaucccaucagcaaaggagguaaacacaucaggagcuauguccucucuuuuccuccccugcucuguauuacugcagcucuuuaaaugugcucuccccagucaucagaugcauuugugucauucacaugcacaggguugcaggccugugguuuuggccugcuggaagcgggcacaaugguuggggcuuuuguuguauauugccagaguccaauaauuagaacuuucaaauugucuuuguauagucaguuaacgauguggcccccuccccugcuucuccuuccacuccuuuuggacauuuaaauccucuacaaaacuucuuagguuuguuuuuggaacugcauugguguaacuuagaaaagguugugaacaaauguggauguguagcuaaggaacaaaaaucuugaggcugaguuucguuuccagggguugucuuggccuuauggcugaucuguuguuucagcggagccuuacuuucugugauggaugugaucccacucuguauuuccuuccugguccuuuccaauuucagggugcugagaagccuuaugcccccccccucaacucccagccucaggcaccuggcauagaccuuggaaucuucaacaagcaguggugugagaggggacacaaaagugaccuccuccaaauauugguuggggguugugguuagcugaguuuccaaaucugcaucucuaaggaccugcuuaccacuccucugcuauaaaauaaagucauccauuccaaacagcucacggaguucuugagcagcuaugaacaaagaccauucagggcaggggagcuucucccaaaagaucagaccugaacagagcagcgcugcugcuccuuuaaaagaaccaaguguagaaguagcagacacuggaaaggaaagaaguuaaggggagugauuccucuggaugauagaacaauccucagaauaggaaggccaggaauggacagguaaaagaagcugggcauauaggcagggacgccagauccugaguuuguacaggguggacaaaaagaaagguuggcaaagguaucucaucuccccucuccucuuucaguaagguuuuauuuaacaaaaugggccgaugggggauuacaagaaucuccggaggccaaacuaguagggacaguuuaguuugggaggcccuggagaauauagcuuucuucugcauccagauucuuacuacagcgcauacauaugaucaacagcacagugaacguggugucuccgaggagcacauggacaugcaccugcaguucacaucagcagaggugaccuggccuggccuggcuuggccuccuaggcaguuggguucugaaaagggcagugucagguuuucacagaaaauucugagauaccauugacuuuggacugucuccagggucgaaagaacacagaaaggcccauuagguuaucagagacaugcagcugcuaucaaaccugcaccuuucucggaaaagaaauauugaaugucuuugaagaaacuauccgagagagucuucuaauccuuuuauuuuuauuucacuuuagauaaauugaagaagcaguuuuucccucuccgaguucuucaggacuacagaaaagucaagaacauagcagagcaguucuuguccuggaguggcuacucugaagugaaccucagcaagcucuucgccaauuacgcugggaaguccugagagagccgggaaggaugcaaggaggccagcugcccaaucugagcugcugaggccuccgccugcccuaacugcugcaccacuaucuugcuuuucuuuugaggacugcauacuguguugauguugauguagauguggaccagggugggaguaucaaaauacuuaacuuaccaaauaguuuuuauagcacuauguacaccaaacccuuuccuaaguaucuaaagaccuauaucuuacugcagggcagaaauugcuacuuuaauugagaauaccuaagauguaagugaccuucaguuuacccuggggcuuuaucagagacaccccuaaaaagaguuuuauggggucuaauggaaguucuaacauuuugcuuuuucacaugucaguuaaacccagucugugucuaaauacuuguucagcuacuggcuacaagcauggcugauuucagugcugucuuucauauaaguggugcaggugguagggagguggugguggagggauuuagaaaguuugcacuuacuaaauacaaaaagcaaguuugcuuauugaauuguucaaaguucaacauucaccagauguuucacucacauuccuucuauuuucccuuuacacagaauguucaaaguguagguuuauacaguaggaaagcacauuuuaaauacuuuguccuaacauuucacaaaauuuauggugagguuguaguaaggaucacuguuccauucagaagaaugggacacagcugacaggauccagugcuugcuagauuucaucaguucuucagaauagugucucuuugaagugauaaacaauauuacaauauggcagccuuaaauacuuaucuauuugucuuuuuauaaagaaaaauguauugugaucuguaccuaagaauaaaguuuccuaaaggaaaaccag

SEQ ID NO: 9611 - RNA, 95134 nt, Mus musculus
aaagugugacucugcgucccuuuauuuauaaacaaguugggaauacugugguccauuggggaucaggagacuggauugggucuagggguuucagugguaggguuggggugguuccaguaguuugcacuauucagcaccagagcaaaugcuugggcauaagaucauucuugaauccagacaagcccucggcuucuauguacagcagaauuuuaaguagauaggcuucuuauggcuuuguccccagacacacugcagcgacacaacagaaaacuagagaagaggagaaguaaaaaauuugccuaaugagcucacuuaucucuugcucacuuccuuccuuccuuccuuccuuccuuccuuccuuccuuccuuccuuccuuccucaucagaugguuaggacaagacuggaguugcugaguagaugccugaaaaccagucucaucuguggaguaggacugggcauuuuaaaaaguccugaagacugagggaaaauaagccauguucuuccuguggccacaacccaccaguguaaccgcaguaucuuguagccuaggucauagaauggcugagucucccccacccacagcaugucagaagccacacugugucugucacaagccugguuuaucuuugucucuggguuauccugacaauuuguggcagacaugggccauacaccauauuacaacuacaccccuguuguuuacauggagagucagcacuugguuuccagggguggggagagauaugagaauugcuaauaugccaaagaagcuggagaggccaggaccccaccugcugcauggggauccacuagccauggaaggauacaauaggaagccuuccuccuuccuagugaugccuggaaggaaaguagaaaauauaaauccucccauacucaccaacuccagugucauuuuuuccaucuucccauucccaaccuuagggaauggguucucuaaguagcuucuuuccuuucauggaggaaaaggagcccauuccccggcuucuaucccuuuucuuacuucuccaagccugcagcacguguuaugcugucauucgauccuuaacucgcccuugaccaugagaauugccugaagaacccacacaaagugcagucauggcuccucccagguguggggggugguaaaccugggucagggcugggaaggccugugagauggucaagaagggccaaagguuggcuagcagaauccgccccauuucuugguggcaagcucguggcuuugggaaggugaggagaugcuguugcaaacugagaaggaaguuuaaacccacuuaagugucuguuuguaccugggaugauucugauguuggucacuucccaucauucacagcuacaguggcacucucugaugagucacguauguggcaccuggcaggaugguguguagggccugcaaaauuauacucaccugauaugucaccucuacauucucugccucagagcaagacuuagguaaaaguggaccuaucugcccugggucauagagccagaacuuuuuaaaaaggcuuccucaacagagagucuccgcacauacaaccagaaguggcuuaagagcguagaugguuuuagcuuucuuucuuuccucucucuaggacccucuucuccucuucuucauuugcucaguugcucuccuugucccugcacugccacaagugucagcuggcugaaauagaaggcauacacgcacaauuuguccuggguacauggugggaggcugaggucaaaccgauaccguggaggaauggaagcccuugccucuggggugugauucuccaagagggccuugacuaugaaaagaaguuucuuucucgcaggcuggauucccagcgaucccccaucuuucaugagcacuuuacaaacuucuggaagaaguaccaggaacaaggaggcuccagguugccuuagcaacagucaccacugaucuucaggugagcagggagguaguuugaccccaacacaaaggggaaagacaggguaccuuucuucaugaguugucucccuaccccccccccagaaugcauguucccaaagccucugaaggcaggggguguuucugucacuggagguguuggacuuugcccaccaguuacauguuaaggccuucacuuagucaagcugcagugcugucuuucugucuuuacuaggauacucaggaaauucuauuuguaccuaagagauuagcucuaaaccuugacuggaccugcucauucccugcaugugauuagggaacagcggccccauguaguucuccagucaucugagagucucuaucccauuuggagaagcaagggccagaaauaacuucagugucucucagaccauucaaaagauugagccuucccuuuacccaaaaugucaugggugaagaacaacaggaauuuucugggacaaaacauuucuaccggaaucuaacauuugauugagcuuuugacaaagugcccaagucaugagggaaccaggcgguucuugagaucaagcauuucagcagggugucaugggggagagcaggagagggaucuagaguccaacaccaccaccauagauucauauugcauaugggauacacccugggguggcauauuggaggauacauagaacagauacgugcagguagcacccccuaucgguauacuaaguguuuguuacaucaaacuguuauucgagucuaugaacugugauguggucagaaauggaaagagcugauccuuuaagaagcuccaagagauauuuuucaucuuccauacauggagccaaagcagcgcagcuccugcuaagaagguuugugugguuauuucuuuuuuagauaagacgggcuuccuugcugugauucccaucaauucagguaauuucuggaaaacagucuccucaugccaaagaugaaaauguacagccagaagcauggcaggccuuggguggaguucaccuugacacaacuguccuuugagugagagauuaagggucacacuuuucuaucugaccaacgcgaagcugcgucugaggcaggguccugaaaugggaaaggguuggugcauuccauccagccuuaguggcuguacugggaaggcugaacuuugcccauugugggaagggaauucauucugggagagcaugggugacagggggcaacgugcaaggcucuuugaggacuggagagggcagggcgaggcagcagccacaucugcggguggcuuauuggcuacagauagauguguggaccaaagcagaacucaucccacuucauggaguguucugcaccuuuccauagcagggcuaaagugagggugcuucuaggaugcuaacaaggucuguguggguuuucaggucagaaaccuccaugcugagcccaggccagacugaauggagaaggaaaaagagcuggcccuaguaacucccauggcagaacucccgucucccagcagagcugcagcucucaacaccacccaggcaucccgggagcccuucccauccuguguggugugcucuuguugaccaggcaccuuuacuucucauccucaucccccucgcucaugcugcugauggaggcugaggcugcuuugggugaggaggggggagaggucuuguuugggagccaggagaagguaggagauggagagcgagaaggggaccggcuccgggucgggcugcucacaggacucugcuucggagauaaugccugcagcauccggcuacuccucuccuggaacaucugcuucuagagagaagauggagagaagauaacuuaacacagcaauucuggguacggcuuagacaaaggaugagcaggauggagagccgugucaccagaacaccuacucccacagacuuggauggcauuccauauugucaaaggcuauagggggaguugaaugaaaucuggggccaguaagaaauuuauaccuaaaguuaugaucccugcugaugaaugggacuuuucuuucaucuguacaauuuaaacuccaggcaaaguagcaauguuauaaguagugguagauucuuguaaaauuaaacaaaaaccuuuguccuuaaggaugugagaagaaaucacacaacaagcaaaaagcgcgcugcaguagagaaacguaaggcaggagaagaucccacggcaggcauggugguucacaccugugugccagcacuugggaggcagggagaguuugagacaagccuagggcuacaacagacgauuuccaaaaaaaagaguucccacauuggggcacugagcuacaauuacuaaugggcuucccaugaaagaccuugcugagaaauugcuaucugggcaaaagcucgaggagaggagggaggaccaccccagcagugaaagucaguggcaagccaauugcagacagauagcaagccaugugucaggaagaacaagcugaccacaggacuggaguagggucugcuaucuggagggcaugaggaagaguuacguggggaucccuggagaauuagcagggggaugucauggaggcucuuggcagccacugugggaacuauguuucccucuguggagaaccacucaggcagguuuaaaggggcagcacucucagcaguggagagugugaggggaggggaaaguggguggcuugugggagagcaggccagagaaauagugugggggaucgagucacagaagacauucucugggggagaagagaaacugcugaagagggguaagaaaaagaguaacaaaauuggcuuuuuuucuuugcugauuaccuguuucuacugugcugagaagaagcugccaucaagaguauagguagguacagggagauuaauuaaucucauugcuguaagagucuaaaauaaggauggcaccuagcucagagugaugggcacgaagaugacaagaaagaaauguccagcacgucucccacaguuaaggucuauuuaauuagaccucuguuguguacacuucuuuugaguuuugacagguagauagaguuguguggcucccacuacagucuaggcauagcucccacauggcccuuugucacugccucuuaucccagacucugaccacagaucugguuucucuuccuuacguuuuuacauuuaccagaauggcauuaagauggaacccuggucugguugucaagccaacaggacucccugacagaugacauguggcacaggaggaaacaacaucaagggacucuagcuucuagcuggugacacuggaaugcagugaugccauuuucuggguugaggaagacugugagauagaaggagacuuuacugguaaaauaagauuuucccugugaauuuuuuugggagggagaguuggagggguucuuuuguuuugcuuuuugaggcagggauucauguagcccaggcuggccucaaauucacuaaucgaagcuagccuuagacuucagaccuuccugucccugccucccaugugcugcaaguacgggugugggucuuuuucagucuuugagacuucaagcauggucucccuuucuaaaagaaagggaagagaggggguagguggaaagggugggagaagagaagauuaaagaaagaaggcuuaggguauauguuaaaugaaguaaaaauggucaaccucacuaguaaucaaaggaucagaaaagacugcauuagcaccaugcucuaauuaauugagcaaaccagccagggaagaaacaccuuugacuauaugaaauugcuaaauuuguaauccuuaauuuguaauagcuaguguggaugagggcacagggaaggggucacacuuccacuaccgaugggaggaggagaacacgcaagcaccuaccuuccuagagguaauuugccagugagagcaaauucuuccuucaucccuccccaccccccaggaauuacagaugugaguaaauacuuaggaggacagaugcuauaguguuauaacagagaaaucaguaaacuucuaaaauaaguuagagaaauguauaacuccaagaagauaugcuaggcaacuggcaaacagguucuuuuuuaaaugugugacacuccaugaccaccuggugccagaggaggucagaagagggcuuuagauccccuggaaguggaggaugguugugagccaccauauaggugcuggguucuccgcaagagcaacaagugcucuuaauuuuugaaauaucucuccagucaggaaaaucaguuucucaaagaauucuuaauaacacaaaaaaaugcuucugaaauuuugaaauuauuuuaggaucauagggucugcaugauuuuaguguuauagaagaaaugcguacaguguuccuggagaagaucugugcaaagcacggccagggaguuugucauuuccuuuuaguccuugggggaggggugaguggggguggaggugugcauuuuacugugaagugaacccagagccucauccacuugaggcaaguacucuaccguuaauguauagcuccagcuccccuuauuuuucgagacaaggucucacuauucagccccggcuguccugagacucaauauucaguccaugcuagccucgaacucagagauccgccuguccuugccucccaaaugcugagauuaaaggcaugugccaacaccacuuuuuuuuuuuugagacaggguaucucuaauauucccaggcugcccuugagcuugcgaauauuuugccuugcucccucgggugacuaggaucacgauccugugccccacgccuaucuagucaccuccuccuagcuugucuguaaugaauacacuaguuccacgucuguggguucaacugucugcauaucaaaaauggcauuuacauugaacauauaaaaaaagacuugcuagcaauuauuuccugaacaauauaauaccuaaugcauauuauugacaucacauuagcuauuauaggucaucaagaucuuuaaaaguguagagggagaugugugcacuuuuugugccaacacaaugcuauuuuaucuaaggggcuuguacuucuacagguuugggucucugaagaaagcccuggaccaaucucuaacaaauacaaagggauagcugcugcauguugcuugugccuuuauaaaacauauuaugauagggagaaagaaacucaaauagcccggauagggagauggggcaggcauuucaauagugauauagcuaggggaacagaaagacuugcagcacaucguuaacgccuccucgugcucacuuuccuuccaaagccccagucuaucacauuuuagagucuaaaguuucuucuggaaaacauaauagagaaaccuugcugaucacugagauucuucccagauugaaaauuccaccugucuacaaauacagcaauuauuuaccuuccauuaagagcacugauaauucugccaaaagacagccaacccccgugaaaucaaacagaaaaaaaauagugcaguacaacggcauuaccugagauuaagcccauuuaugagacaaaaucaaaugccaaaaggauuggguagccuauuauuaacaguaacauuaaaaaaaauccuugaacuucuagcaggcacuuuaaaauauguguuuuuauuacuauaaucuuucagcguauuuuuaguggcagccauuagccccccugcugguaauggauuguccgcauuuccauuagaagcccacuuucuaagaaaucuacaucuugucuacucuaguuugaaucaagcucauaacuugagaauauucugccuaaagggaugaaagaauuugaaucuuuaaugacaaacaauggugucacacuucacaaaugugcuacccaggcaaaagcagccgggccuggacuugcagguucuccgaucuguuucggcuggacuuuccagggugguuccacuacaaaggagcugaauugaauccagucaggagacaguucguaacgagcuuccuggguagaaaagcacuuuagaacuauaacaaauaaugaagaccauggcaugacauuuucaaagagaaaagguauuuaaauucaaucuuucauuguauuaagagguuuccauuuagaaaguuuucccccaagaaaauaaucucguuuauaguccuauccguguggaaguaauuuucuguuucccuccuacaaaguuuucccuuuuaagaaguauuuaauaucuagugaggcagugaauaucuugaugaaugccuuuaaaggcauuuguguuaccuauacauccuagcacaugauuuaaagggaaaugaaaaaauaaucuagucugaucugauucggaccucugauaagaaagaugaaacccaagaagacagauguuuccauucuggccagcugaauaaacgucauuaucauuaccagcggcuaacccuccacuguggcugacguggucuugcugccaggcucuguuauaaggacauuguuaugaaccaauucaauccucgugacaacucuaggaggcagcaaagcuuacuuuuuccuuacggaugaugugacugagguguagagaugcagaaaaacuugccugggugggcugggcccuagacugggucuggggccagggguacacugggcuggggcugggcuggggcuggggcuggggcuggacuggggcuagugucagucauggagcacuggacuaguauguagacggcacaggguauaccuuuauagaaggagcuuggaaaaggacucacucggggaaacaacaacaaaagaacuugcccaaggccauacagcuaagaaaugaguuggacuccugaccaccucuccugucaggcacguugggaguucaaggcuuuucagguuuacucccacuuuauuuguauauuugcuuaaagaauuggcuaucaaagagccucaaguggaaaggcugggaauguggcucaccaguaaagcacuugccaaguucugggcucagcccccaacacugcaaaaagggaaauguuuccaguaugaacucuagugcagacauacagacuucauuuucuaauucucaacaucaaggugauccuaaaaagaaaugagcagugugcuugaagggaaaagacagcuauuuuauaaacaagaguacaaucuggcaaggaugcggggaacguugacuccuugugcaccauuggcgggagugcaaagcaagagcgcuacuguggagaguggugugcacauuccuugaaguguuagacacaaagucauuaugugagccagcaguuccauuucuauguaucugcccaagaaaccugaacguggggcuccaacaguuacguguacaacaccaaacgauucauaagcaacaucauucacaucugccgaagguggcgacaacccaaggauucaccaacacagcaauggauaaagcaaauaugguguuauacgggggaauauuacucagcuuuuaaaagcugccacaacacugauccaugcuacaaugugggugaacccugaauauauuaaggauuaauaagucagacacaaagacacaaauacuguaugcuuugacuuauaugagguaccuggaguaaucaagcaaauucagagagaaaggaggguggcuuucagcagcucgugugcgggaagucuguguuuaaauggugcaguaucuaucugauccgguggaaauguucugggggugguugcuggugaugcuucuguacugacgugaauguaguuaaugccaccauuugcucgaacacgguuaaaauggggcuggcaguguagcucaguggcagaguaccugagcaugaaugagacccugcuuuugauacucaggauugaaaauaaaaaaguuaaaauggcaaaauuuaugauauauuuaaguauauaugcuacaauuaaaaaaaauagaaguaagccuugcaaacaacauaauuguauguaacaaacggcacauaucuauuugauuggcaugggaucucuuuggucuaaggcaagaggauaaacauggucuaagcggagcaaacauggucuaagaugaacuaaaaaaauucacauuagacuuaagaucuuuggguguuaaagaaguggacucauguuugguaaaaauaaaauagacccaguucauuugaaacaggagagcguuuuguuuucagagaccaugaaggacuauaguggcagaucaucuacaacacgggccugugguuaaggugcuaagaguuaaauguuucugcucugugaauucagaugcuucgaagaaaaacaguagagcugcuuuaagaagaugaauacccaaagcaaaaccugcaugcugggcccuuauucccuaacccagaauccuucacuaaugccauuuuggagacagccagcaucucccguaacauaagcaaccaagcuucagugugaagcucacuuagagcucuucuucugagacaauguuucauucagagguaauacucacaaggaaagguaauacugagucuuugucugaaagguguuacuguuuggaucuggaccauccacgggguguggugaacugcgggugaacccuaccuccuuucuucuccccuggcuuccuucccugaggugccaugaggugaguagcuuccucccacagcuuuccaccaugauguaccucccucgcuacaaguccaaaagcaacagggcuagaagccucccaaacagagagcccaaaucacuucacccucaauaguccccucccucucuuucuuuuucuuguucuuucucccauaaagaaagcuuuauuuacuacaaacauccuaaggauguauuauacauggugcacauguuaaagauaacuaaacuacuaccaugugugaaaacugagguuaaagcuuuuaugcagggcuggagggauggcucagugguugagagcacugacugacucugcucugcugaagaucuugaguucaaaucccagcaacuacaugauagcucacaaccaucuguaaugagaucugcugcccucuucuggggugccugaagacagcuacaguauacuugcauauaauaaauaaauaaaccuuuaaaaaaaacuuuuauccauuuugcuauugauucuaaaaauuucauguauauuaaauuacacucacuucaguaguguacaugaaaucaacuugucuucuccuuaauuagguauuuuguuacaguaauagaaaguugaugaacacagaaagcuucucuuugucauuugguuuggauuauagaccagcuucugaauauggcucaagacuaguagaacagagaaacccugucuugaaaaaccaaaaaaagaagaagaagaagaagaagaagaagaagaagaagaagaagaagaagaagaagaagaagaagaagaagaagaagaagacgacgacuaguagaaucaguugacaguaguuaaauaaagugauaugaguuaaaaaacaaaacaaaauaagacagaacaaaaaagcuauuuaggcccugcuaucccagcacucagacuaagagggaacuggaaaaucuaaucuagcaguuaagaaauacauagguugcuggcuucaacuucuuagaagucaguguggcagacagccuccaagauagcauccuagggcccccuuuacaucauuaaguaguguucucccauaauagauaaggagcaaauucaaauguuccuugugcccaucucagcaccagaaaugagucagucugggggagccagggaaagcagggaaaagaauauggccacggggagcuagcaagucgaacucuucccgagcaaaauauaagcaccaagaaaaccaagucagucuauuuuuguuauggauauuuuucuagacagggucuuacucuguagccuagacuagccuggacaucacauagcacaggcuggcuuggaauucauuguaaaguucugccuauuggauuugauccaccaaacacuaaacuguaucuagugccacaggcaaaggaagacuguauacggagaguuuaagccuuaccaugcccuuuucagaucagaggaaggucuguaaauagguauuccucauaguccaucccuucaugccuucaaucaaugaagagacacuuauauggaauacccacuguacacuacauauaaagugccauaccaauccugcacuagccaauuuuggaccuuaaaucuuucuauuuugugcuuuuuaaagucuggguuauuugugucaguacuguacuugcagguaaugcagauccccuguuuuaagaaaugaguuccagucacaaaucuacaaauaaagaauuauuauaauaauagcauauucaugaaaagcaaauuacuuaucuuggcguuuaacauccuuguaacuauuccuguacuuuuaaugucaacagaaaaaaaguaaugucuaagucuggcugauacaguaaauuaauguuaauaacaguuuugacacuaauagcaaguuuuuaaaagauaaaccuccagucucuaagcuggguuucauuucuuaaaaaucaccuccgcucacugucaccagacuccuuaggaaccauuccagcuacuauuucgccuuugccgggagccugagacgacagggaggauaacauuccuaggaaaugauauccuuucccugccuucgcucaccccagguggagagacuauccacccacugcguuccaauccaagggcuucuggcagggucacauuucuaaagcaugcuaagcaaaugagcugcuacauggcuccauuaaaaaccacuugccacuccuucagaggcagaaaacugugaaaaugcaaaguagugaggucuacgcugacuggcucaaagggcaaguucagaauuuagaugcugaagaccagagaacagagugcucacuuugacugucuuuguguucuuucggagugcuguguauagacaagaacguuaauaaaugggccauggauuaaacgaucugagcugaaaaugaacaaaacaagugaaaaggagcccaguguaugguuucugcuuucuuaccaguccucacuggaaguucuuuaauggugcaauuagcccuucccuuucaaacucagccuucagauagaacaugguuggcuuauaacauugucuacaacacuaggcuuuaagcaucuucuccaacucucuucuuuuucuauacuaauuggguguuuuacuuuuagauaauccuauaaugaaugagcucaaaugagcaauggcagaagugacaacccaucaauaaaauaaguagaaguggauuuccuuagagacuucucauaucauaauagaaaaucuuggcuauuuaagauuaaggaaaucaaauggaaucauuuaucuuuguuuuaaaaagaaaguuggcuuggggcuagaaauccccagcaaccugucucaucucugcacacuuagaugugggguugcagcuguguacaagauggcuggcuuguucugcaggugcugccauccaaacucuggcccucaugauuaugcaguaagcgcuuuucucugauaagacaggaggguugcuggggcuuucuagagucuaucuuagccaagaaaacaggagugccauguucagggagaaacucugguuaaaaggaauagcuguguaggaaggugacaaagaagggcacaugaaaccuucuucuggccucugcacacagacauccauguuccacauguauacacacauaugaaaacauacauagcauuucuucuaaaaggaaagucauuuuaaagauaucuaugucacagaacccucaucaacucuuccaaaagcacugguuauuuaauuaauggaaggcauguacaauagaacuaccauggcggcuuccagaauuuucuuuucuuuuucuacaguuaucaaucacaguugucugaagaauuuuguugaggagaaaauaugcuuuuccuuucuuggcucauggucucagucccuugagauuuugggaccuauaccaacaacuacaugccaaagaaaaaucaagguuaaauuggcacaguuacaagggcaaaauucugcugcuucucuuucucuccagugguagacuuccucguaacacacgaggguagagcagcuccauucuuucccauuguccugaugggcagcacugugccccaaguacaauacccacuccuuacuuacugagagcaagugugauuacccucgggaaaccuucaagagcaaauccauugacauacagaaugagaacaaagggaggguugcuggucccuuauccaagauuccagccauucccuccuggaccucccugccaacaugaauucugcucuggcugccuguggucuauaaagcauggaaggcuaacugaaagggaacacuacccacucagcuguaggaaaguugccauccauucugaaccgggacauuugcugaaguacauguuuuaaagucauccacacacccguucgcaaccccccaccccacacauacacucacacuuuuguuaagucuaaaggcaucauuuccccaagcuagaguugagucauuacguuggucugucacucuaucuggggugaguacacguauguucauuucucucuaggaaaauaaauaaugcaacaccucccuaaacccuuguccuuguccagccuuaauaugagggaaggugccuaguuuuacugcaacuugauaugucacauuugauugauauccugggaggccuguggaugguagagaagggaguaagggagugggagaagaagauggggagaaacugaaguugugauauaauacaugagagaagaauaaauuaacaauuaaaagaaaaagaaccccuggacuugacuuccaacacaagcuucauguuccauugacuuacuuacuuuaccauuaacccuaagcuuugugucgcccccaacuugaagacuagguugaacuaugagaccaacuucugcaauaccagacauucaaagguaaaugagcggcuucuaaguucuggaaacagaaacagagaagaccccacuuuguguaccauuugguaccguacuaaaucaguauuugagggcugauucaguaacugaauaaggacauggacuuggagugacuugagaugauguccaagcagaggucacuauauaagggacauguuugagucuaugaaaggaauuuaagcugaaaauaccugccauugcaguaccaauugaaauaaguacauacccaugcaccaucuggcccaaacaguuccaggaaguugccaauaaacucucuugauuuuucuucccacuuuugaauuaggucaugacucuuuucuucuacucuguuaacaaacuccuuugaucuuucuuccacauucuugaccuuuucuuucaucuuguccaccugguucuggaaacgguacuucuucuccuaguuaaaauugacaagagaaagaaauugauucaggaggacaucagagagguucgucuguauugguuauauuuuauaucaacuuggauuuucucguaaugugaagaauagaugucauuauuucucgagggcuagacugauaggaaggcaugugucuugcacaucaaucuccuuggauauauaaauggaaguacaaauguugaacuauguucaaucuguucaacaucuacgaguugaaauuguaugagaauagaauacaaaacaaugaaagcuaccauuuacugagcaaauaccccuacucuucuggaacuuagaucaaaagauguguuguacacagaacgacuacucagagccugaaaaguuuguuuuacugagguaguauuaaaaccaaugcaguuuacauuaaguuguacacuaacugggcuuaggaccaaugucucaugcuaaaaaugccauugccauaguuucuaucaggguaauuaaagugucuccuuggacauaaagaaaguuuuauuuugaugcaucucuggguucuaugauuagggaucuuauagaaugguguugucuaucuauguuccagaaagccauauuauauugggcaagucacuaaucacuucuaagccucacuauucucaucaauaaaauggggauaauaaucaucacuaccucacgggguuguuaugacaaucagguaaggucauguaucugaauguauggcucaaagccuaucauuugcuccccauauguuaauuauguuguuauaaagcaccauaggaauuuaucugcauuaccugauaaacacauuaucuaaacaaugaaaacacacuaagggucuucccuuuugaaaucgcaauagucucuaaaggagucauagggcauauauuuuucuuuacuauguagacucaagcucauuuuguacuuuagaauuuuguaaaauaccucaaauauuauaaaacuaggucaagauucuaucauuuagauauuccaaaagcauguugccgccccagugugagguuggagaugagcugugugugcugcuacugagcuauauaagacccagaugugcuauaggaggugcucugacuucuaucauuugcagugugcucugacaugagcuguuuaauguucuaaaauucugucuucucaccuauaaguuagauaguguuaucacacccacccuagcaggcuuaucacaaguauuaaaugagaugaugcggucaaaacacuuagauggguagcucguuggcucuagauaaguguuagcuguugucuuuacaucaagcucuuugauauuuuguucaacacuggaaauggcuauuuuguuuaguacucagugacagcacauaacaguagagugagcacugggcugggagucacgagauuuagagggguacugccaccuccaccucuccccccacccucccuuggccuugggcuccguuuuccuuaucucaaaagucaagggacauggauuggaugacugguccucaucaggucuuugccacuucugagguucugugauucauuuacacgcccauccaacacauucaauuuccucucugagcugcagccaggcuuguuguuggagaaaggcaguaagcacacccccacuguccucacgguucccugagcuaaguggcuuaucuaaagaccauuuaaagagacugagcaauaacuuuuggaaauggcuugcuaugcuuggaugguugacugaauucaauuuaaaagaacagacaguuuaauuuauugaaauaaccagggcuuuauucucucuaagauaccaaaucaucacguuggcugaauucuuugcagcaacguguucgggugccacucgaacccggcauuuuccauuuuguugccuggcuuguacaaagcuagaggggccugcaucccaacacucccugcuuuaucaggacaaugaauaaucacugacuuacaauuaaugagccccuccuauuuugaagguaccaaugaucaguugugaaagaugcuagauaauuagagcugcacauaauuauaaaugccuacuuuugcagacaaaucccccuuugaaaauacaguaucucuuugggggcuggaauucuguaugcauagagaguauuuguuuggaucaaaaucaugggcuccuuggaagccuggcaaccccaguuguccagacucacuaacaucacccccaaccauccugcuacucucuuugccuuguaacagcuuguuuugcuuguuuuaaagauuguuuuaacagugcucuauuauuaaacuaacagcagcucugugggaacaauaagguagaaauacaaaaggaagccaaaggcuucaggcuuuauuuaagcagcuguaauuucucuggacaauaaaaaacggcuguuaagguuucuaaugagcaucuguaaggccuuaauaaaaugaaaauuguaaaacguuaaaacaagaaagccuuuucucugggcuuagcaucucauugcuuccgccugccuucccuuccuuugagaagaagacaacacuugccuuuccccaaggggcagauguuccaggagcccuuugggguuugggggcaggggagagaaguaaggaagcuccauuauacaauguggcgcuaccuaugcucccuggcugacucacguuaccucuucggacacuguuuucucauuuguaaauccagagcucauuucuggugcacaggugcuggugcgugccuguaaagccagcacuugggaaacugaagcaggcaggucacacuuuugaggccauccugggcaauacagugaggcccucucucacaaacuaaaguauaccacuguuuuuuuuuaauauggauuaaauaaaacaacaaugaaaagcacuaagcgcauugcacaguguacaguaaacacaagucaugauaaauauagaccucauauaggugugauaugguggccccccagaguacaugggggaggcacacuuacguuuauaaagcugacguucagcuccuuggcuguguacccucucuggagauuacgccgggcauauacaucauagucacggacaauucuggugaugaugucugauguugagaugccuucuguucuuuguguuggaacaaacaugccuguccaaguaagaauaaaaagauuaagauaaaauuacaguuuauauaguuccuuuuuuuucuggacagcacuggagcuucagguuaggucagggagacucuucagccacaguacacuuccuuucgcauaacacugugugcucaucaucccggguuuggcccaggagacaccauccacucaccuggcuccuuacaacacucaacucuuccuuccaauccugaguacucauuuccuaaccgcaucacccacagaguucuuccucacccucauuaguccaccuucaaggcuguaccucugugaaaucuuuucugauguuaacaugagaacccacagcauucuggacauaaagggaucgccaguuaacaaucaaaaaaagaaaagucugauuacugucucugcacagaaauaaauagacauuguuuauguggggacuuuaaaauuuuuuguuucuuuaaaaaaaaaauagaaauggacauuuugaaugccgggaugccucgguuguuuuuccaucaccaggguccagaucaguccacauggaaggugcugagugaaugcgaaggaaaugcacaaguggaugaauaauaacugagucaaugaaugagucagaucacggcuccucaucccuccggaagucucugucccaguauccccacaggaaaaggagaagaauggcgccuuuguugucucuaucuaaggguaugugugcgaugugcuaaaugauucgaccuccucuaagaacagucuacucugcauggggguuucaccacuuucaucuggaauaugugggaaagaguaaaaauaagcaaacagaaggaugccaacuuccaguggcccuguuagauguccuuaaagucuucaaagacauauuggaguuuaccagcagcacaggcuagaaaggagucacagauaccaaaacaguaagaacuauauucaugcucaaaauucugcugucaacaaaaauuacguaucgggcaguugaggucuuuguagcccauaucauugcaaccauguugagauguccuguaucaacagcaacaauaaagccaaagggcacugcauucuccacuuacaagaaaccauucaaaccucugaaggcaagugacuugaccuuaguuucccucagcuaagaaguuagcuagacaagguaagcugggcucauuugggccacuuuucuaccccgaguuguccauauccaaucaauguauaauaacaaaccugcuccucaaaugcuucacuaauucaaccucuuuucuccauuuuuaggcacaccugauccaucuuauucaaagauuacaccaagagcugcccagggagggugaaagaagguagcagacuccuggaccuggaauuaggaauuucaagcaguuaugagcugauuggcauggaugcuagaaaccaaauccaggucuuuugcaagagugguaugcaaucuucagcauacacagcaagaccuacagagucagccuucuaaaugcaagucccaugccugcucauuccucuucauuggcuuucuacuguguuuagaguaaaggcuuuuacuugacucugccauggcuugcagaauccccguucugugcuuccuucuacucuuaggcucaucucacagccucucuucuuaacucucagccaaggcuccuguacuguacaagagcuagaauuaguuugcuuauagucuaugaaggugggccuguacuuagcaaaaugggcaucuucacuguucuuaaaaugauuggcucuccuccucucugucugucauagucucugucuacuuaacucuuggucagguuuaguaccaaggaaauuaagucucaacuuccaaaacaggucuuucuauuugucagcccuacugcacucuucuuucaaauauugcaaggucuuugguggaacacuuccauuaucaaccauccuucuugccuauaaucuauaugagggacagggccacacccuucucaucucagcaccaggugacaggcaggcacuaucagaaaauuugcugaaugaacgacaaggugaauacugaugcugagcacccuuccaaagccaagucucucugaauuuuugguuugcugcuccaaagugucccuucagagaccuuuaaaaauaugucccaugcacauucacaaugucagcagcaggguggugcugcugaacuuagagacagaacaucugaguccaguccaugcuacagagguagggcugcccacuaggucugaagcuucuuugaucaucuucuagaagggugaaagcaaacacagaaauugcaaacacacaugaaugcaaagagaauuccaacuggaccaagcaugggaucagggcuuugguaggugguggguuccuggaugagcccaacuuagcagaucugggacagcauacccaccuuaauuggaacaguuaaagacuuucuuuucuguugaaaaauccaucccaucuuucuuugggacuaaugaaaguucuuuaguuacuaauagauuuuagcaagucacuuagacacaggggacaugagcuuguccugucuaaagucagagacuuggaccuccguagcugaguaauggaaagcagauuuggggcugggggggagggauuugcuuuggcugcuuaagagguaagucucugaaagaagccaagcccucugcugacauaaugaggcacccagcuuccuccaaauccuaauuauugcucugcuaaaaauauucaguaaugagcaugaucagagaaccuuuuuuaucaugcuuuucagaauugcagcguuugguuauggagcuauuuuaagaagcagcaaagcgcauguuaauaaagcaacuuucaacaguaguaggcacuaucagaaugauaauaaguaacaugggccuuacagucuauugcaucucagcuccaucuuuccauccagcuuugcuagaggauuuugacacucaguucuggcaaacagagcacacgguugcacagcuuaauuuaugcucaugauaucacuugcuuuauuuaaggugaguuuuugaccuuccaaauaaaccauagaauauaaaagcugcaagcgggcacucaggucuuuucugagacucuuccccagagaggccacucuauggccuucccuguauauaucccaaccggaucuuuacagugacuccuccuucuagugaggcaucaguggagcagguucauggaccauaaggaaggaucucugugcaaaagaugucacauacuuuagucuuaggccugcacuuccagagaaaaaaaagugccaccugaccuuucauuuuagaaagugaauugugguaaagggucacacugguaaguuguugcccauguuccauugcauggcuccaaaggcagcacuaauuggacucagugaauugauuauauuuuuaaaaagaagaagagggcaugaagguagaaggugagaguauugggggggggguuguugaaaggccauagaaauaauuuggguuggccaugauucaguuauauuguauacauguaugaaauucucaaggaauaaauuuuuuaaaacccucuauuuucggaagagguacagauaugcacaaaauaauaauauaggaaaauaacucuugcccuuccgcucgacucgagacucgagccccgggcuaccuugccagcagagucuugcccaacacccgcaagggcccacacgggacuccccacgggucccuaagaccucuggugaguggaacacagcgccugccccaauccaaucgcgcggaacuugagacugcgguacauagggaagcaggcuacccgggcuugaucuggggcacaaaccccuuccacuccacucgagccccaggcuaccuugccagcugagucgccugacacccgcaagggcccacacaggauuccacacgugauccuaagaccucuagugaguggaacacaacuucugccaggagucugguucgaacaccagauaucuggguaccugccuugcaagaagagagcuugccugcagagaauacucugcccacugaaacuaaggagagugcuacccuccaggucugcucauagaggcuaacagagucaccugaagaacaagcucuuaacagugacaacuaaaacagcuagcuucagagauuaccagauggcgaaaggcaaacguaagaauccuacuaacagaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagaauuacaggagagcacugcuaaagaguuacaggcccuuaaagaaaaucaggaaaacacagccaaacagguagaaaucauuaaagaaaaacaggaaaacacauccaaacaggugauggaaaugaacaaaaccauacuagaacuaaaaggggaaguagacacaauaaagaaaacccaaagcgaggcaacgcuggagauagaaacccuaggaaagagaucuggaaccauagaugcgagcaucagcaacagaauacaagaaauggaagagagaaucucaggugcagaagauuccauagagaacaucgacacaacagucaaagaaaauacaaaaugcaaaaggauccuaacucaaaacauccagguaauccaggacacaaugagaagaccaaaccuacggauaauaggaauugaugagaaugaagauuuucaacuuaaagggccagcuaauaucuucaacaaaauaauagaagaaaacuucccaaacauaaaaaaagagaugcccaugaucauacaagaagccuacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaccaaauucacacaauaucuuuccacgaauccagcccuucaaaggauaauaacagaaaagaagcaauacaaggacggaaaucacgcccuagaacaaccaagaaaguaaucauucaacaaaccaaaaagaagacagccacaagaacagaaugccaacucuaacaacaaaaauaaaagggagcaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagauugaaaggcuggaaaacaauuuuccaagcaaauggacugaagaaacaagcuggaguagccauuuuaauaucggauaaaaucgacuuccaacccaaaguuaucaaaaaagacaaggagggacacuucauacucaucaaagguaaaauccuccaagaggaacucucaauucugaauaucuacgcaccaaaugcaagggcagccacauucauuagagacacuuuaguaaagcucaaagcauacauugcaccucacacaauaauagugggagacuucaacacaccacuuucuucaaaggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucacaaaacaggccucaauagauacaaaaauauugaaauugucccauguauccuaucagaccaccauggccuaagacugaucuucaauaacaacauauaacaauauauaauauauaauaauggaaagccaacauucacguggaaacugaauaacacucuucucaaugauaccuuggucaaggaaggaauaaagaaagaaauuaaagacuuuuuagaguuuaaugaaaaugaagccacaacguacccaaaccuaugggacacaaugaaagcauuucuaagagggaaacucauagcucugagugccuccaagaagaaacgggagacaacacauacuagcagcuugacaacacaucuaaaagcccuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggaugaaauggacaaauuucuggacagauaccagguaccaaaguugaaucaggaucaaguugaccaucuaaacagucccauaucaccuaaagaaauagaagcaguuauuaauagucucccaaccaaaaaaagcccaggaccagauggguuuagugcagaguucuaucagaccuucaaagaagaucuaauuccaauucugcacaaacuauuucacaaaauagaaguagaagguacucuacccaacucauuuuaugaagccacuauuacucugauaccuaaaccacagaaagauccaacaaagauagagaacuucagaccaauuucucuuaugaauaucgaugcaaaaauccucaauaaaauucucgcuaaccgaauccaagaacacauuaaagcaaucauccauccugaccaaguagguuuuauucaagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacaugauaaaagcaaucuacagcaaaccaauagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugacaguauauauaagugacccuaaaaauucuaccagagaacuccuaaaccugaaaaacagcuucggugaaguagcuggauauaaaauaaacucaaacaagucaauggccuuuauguacacaaaggauaaagaggcuaagaaagaaauuagggaaacaacacccuuuucaauagucacaaauaauauaaaauaucuuggcgugacucuaacuaaggaagugaaagaucuguaugauaaaaacuucaaaucucugaagaaagaaauuaaggaagaucucagaagauagaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuucuggcggaaucaccaugccagaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcacuugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacagguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacauaauauguauucacugauaaguggauauuagccccaaaccuaggauacccaagauauaagauauaauuugcuaaacacaugaaacucaagaagaaugaagacugaaguguggucacuaugccccuccuuagauuugggaacaaaacacccauggaaggaguuacagagacaaaguuuggagcugagaugaaaggauggaccaucuagagacugccauauccagggauccaccccauaaucagcauccaaacgcugacaccauugcauacacuagcaagauuuuauggaaaggacccagauguagcugucucuugugagacuaugccggggccuagcaaacacagaaguggaugcucacagucagcuaauggauggaucauagggcucccaauggaggagcuagagaaaguagccaaggagcuaaagggaucugcaacccuauagguggaacaacauuaugaacuaaccaguaccccggagcucuugacucuagcugcauauauaucaaaagauggccuaguuggccaucacuggaaagagaggcccauuggacuugcaaacuuuauaugccccaguacaggggaacaccagggccaaaaagggggagugggugggcaggggaguggggguggguggauaugggggacuuuugguauagcauuggaaauguaaaugaguuaaauaccuaauaaaaaauggaaaaaaagaaaaggaaaauaacucuuagaagagacccacaggggcuggagagauggcucagcaguuaagaccacugacuguucuuccggagguccugaauucaauucccaaaaaccauaugguggcucacaacuaucuuuaaugggaucugaugcccucuucuggugugucugaagacagcgacaguguauucauauaaauaaaauaaauaaaucaagagagagagagagagagagagagagagagagagagagcacuacaacucccuugcccuugaauuuggguuggccuccucaguuacuugcuugucauauaaaugguggggugugacuuccaaggcuaggccacaggaauccuuauggcagcuguuaaauuuccuugcucuuuagacaguugcucucagucuucaugcugugagaagcccaggcaacauggagacaauguacuaguguccauggacaaauaccccugagcucccagcuaacagcuaacuaaagcuaaguauauaauaacagagccccgagccuucagagcuccuaucagcaucuagauauaaucauuugaaagugucaagcaaaacucucagccaaugguagcaugcuugccuaugggaagcucuagguucaaacaaaacaaacaaacaaaaaaacaggcaugguggauuauaccuuguaucccaacucuugggaagcaaggacaggccaucucugugaguuccaggcuagccaaauauacauagugacuucuaggacagucagagcuacagagcaagagucugguauaaaaacaaaacaaaacaaaacaaaacaaaacaaaagauaaaagaagcacucagucaagcccucuguuaagauccugccccauaaaaaucaugaacaaaaccauucuuuuaaaauaaccaccuugggagucauauuguuauuacuccuuuacucgaaacuaacccaauaaggaaacuucuaccagauauauacccaagguagcuaagaaauucuuuuuuguuuguuuguucugguuuuuguuuuguuuuguuuuguuuuucaagacaggguuucucugcuuaguccuggcuguccuggaacucacucuguagaccaggcuggccuugaacucagaaaucugccugccucugccucccaagugcugggaucaaaggcgugcgccaacacugcccaacagcuaaggaauucuuaagcagaaauucaguuaaugcuggggucucuuagcugaacguuaaccccaaagugaccucucugcugcuguuuucagggaaggaagaguuggcuuauggcucagaccuuaagaagguauucaucccuugugcuguaacucaugcacuaaccgugguuuuucuccuccucaacaguguuucucagcuucucugcagcuuuccaagcugcaaauauguuagauuucuucuccuugaauuccuuacaagaaagguuaggacugaaaagugucaggccccugguucuuacccaguucuccuucguucuaagggggcucucuugcagaggaugauacaggcccagccacuuggcugauacuggauauuccaauaguccaucuacacaugcugcagaccuagggcagcuggcuuuuaugcuuggcugugugcuguggacagaagaaugucucaccugcuuccuugauaugcuuauaaacgucaucagaaccagcagaggaguauggaauaucaucgugagccacaaagucaaucuauugaagaaagggacaaaaggacauuagcacuggcauggagggagggguugcagaucugaaagggacugaugaguccuccccucuccaccccagugccuuuuaaaauagagcaguuguagaaugcuggccucugagcauaacggccauuaaccaucugcaucagaacagcugugacuacuuucaagagcccuuccaggucagccucacaggagaaggcccugucgucuagguuuugacauuaacucaucugaacuuccucuccaagucauccugcugucaggugggcuguccuccugggacggucaauuuuuauugucaacuugaugcgguuuagacucaucaugagaacacauaucuggggcaugucugggguggggaggagauccagugauucuuuagguuaauugagugggaagacccacccugaauauggguggcaccacgccauaggcuuggcuccuggaccaaaaggagaaaguaagcugagcacaggcuuuuguugaucucagcuucuugauucuagaugcuaugugaucagcugucucuuucuucugcuuccacacacucauuaucaggaugaacuauaucccuggaauauacaaaauaaacccuucccuucuuccucaagcugcuuugaugagguguuuugucacaacaacgagacaaauaacuaaugugccucuugaacaauuucccucuaaucuucacuccugcuaagccucgccccugucuccuacuacaccagguaaacaacugagcuuuuauuccaucucaagagcuggcuuagaugaguaguuuaauuuaccagaguaucauuccuaccuaccccuuacaaguuacaaaacucauucacuggauuccucuaccucaauacuaaugacaauaagggcuagauaauuuggggggggcaguguguauagguguccugugcauuggaagacacugaccagcaucucauaccuccucccacuuagaugucaguggcagccccuagcuaggacaaccaaaauguuuccagacauuguccuuugggguggaaauucaagggagaauugcuggauuaaaugauauguagcagugcuuaaaaauagaaaguaguacauaguaaguacucaguacauauuuuauugcuguuguuauuaauucuagccuccacauucaaacuuaguuccccaucuucaaugcauaauaauaacccaggguagccaugacacugaacucauuuuauauaauaguaaaguccuuagcacagugcugggcauaugguaaauaauaaauggcauucaucguugucauuauuaguauccucuaaacugccugucauguguugaauauacaauauaugcuaaguaaaaaaagugugauuacugguaguaaaucauauuguaguuuuuccucuuuucuuuucauucucaccaggaaauugucuccucugcuauuacccaugcacauuuaucaguguucucuauucucuucuguauugcgaauuuaaaaauagaaaagaaaauucuuagaacagcuuaaucuuauuuuuuuuguacugcuuauaaaaggaaagaauaguuccuaguguggggcugguagggagauacaaagaacauaauuugaugcagaucaaaagaaugucucauguuuucaacuaauaaaaaucuuaugucaguaggaauuucagagucacaaaaucagagauagaaaguucuuucuuuaaagccucaccccugaccuuccagauaagauguguguucauuuguuucaugccuaaggauacccguaagucugugagcacugacaauggugcuggugacaguaaugacaaugacaaccuuggagcucuuacuggccagccaguucuccaagguuuuaacuuggauucuuucauuagcuccuuaaaauggucuuacaauggucccacaagggggacagcagugucauccaauuuuauagaugaaguauaaaguucagcgugguuaagaaccuucuugcugauggcucucuaguuagaaaagagaggcagcaugugguccugacuagacaucucuaauaucuguacuccaggcaaggagaagacagcaguccuuacuuuugggcaaaagagacuguuccaucaagugaugccacacguuaccccuaaaacuuccccuuuuagaaacuggaagggucuuuaggaucccugcaaucucagcuacagaaacagaguuucuaaucuuacacagggugaauguguaagaaagagaaguaccuuguguuuuuccagaaacucuggaguaagaguccauggcgcgucucugaugacuucauccacguaucgacagugucugagagcuucauaucucucugccucguucaucacaguaaaaccuuugaauuugugaguaaggucaucacugcaaacugaaaacgggcaaagauauuaaauacugcugccucccacucugugguagacucggcuucuucagcaagagggaaggagcacugacuguuccagugggugugcggcaucacugaacuuggaguuuuacaguaacaagggaugaggagaggaaagccaaccuaaacacacuaggaauucagaguuucauuuuacuguuaacuauagcugcauuuuuuugaggcuuuuaucaaaauuauucugcacacuaucuaaugucacuuucuuauuuuuuucauccuucuagcucacccuuuggugucuguuucuauucagaaaugaaaugaccagaugaaaccagaugaagagacaaaggaagaagaggaggggagccaagaggccugcauugaacaaggcuggacuaaucaauaucaauuccaauucuuucacauaauuauuguacuuaguaaccuuauuagaacacauacacacacacauacagagacagacagacagacaggcaggcaggcagagacauagagacagagggaaacagagccagagaaaggagggggugaguauugauucccuagagagggaauaguaauuuccuuuaccccuggccuuagaaagaaaugagguuuuuauuucuugaagauuuacuaaaaaguauuuuuaaaugaacuaagcaaaaauccuacuuacucaccuauguuuugguuggcuaaggcagguuuacuaauguucccuaugugccaggaagaaaggucacuauaaguacuguguuuauuuacccaggaccugcugagcagcuugcugaaauggucagagcugcccucacugccucuugcaauaagaauuauuucccuuugaagcauuaagugcacguagucaauucucugaucuggaaccaaaucauguucuauacccuggaccaaaacuggccacagaguaaguguagccaacugccauggucagcaucuccagaaaacaucccuucccuucauggcuucuucacaugucuaauauccaagucgucaucaaaaucgcuggcucugccuucaaaggagaaagaaggucauuuauggaaagauuccuuuguccuugguauucuugaucgaaggauguaaauugucagacuggaggaauaaguuuuagugaucuaauggugaccacuuaaugauaaagcuuggucuacuuuaaaauugcuaaaacagaccaaccacucacacacaaacaaaaaaaguuaaaucacuaaggugauagauauguuauauguauauaauuacugauuuccuuauauggaucaaaacaucacauuguaccuaacaaauacacacaauuauugugucaaugauagucauaugucauuuaaaaacauggucaaguucucagaaguucauugcuaguugauuuugcaacugcaaauacugaagcauguauuuauucaaacuuagaugauacaggucaucuaaggucaauagcuagauguugccuuggugcaaccacaagacacaguaaauacaagaugggcagggcagcugcccauguaagauugaauaauguuuuacaguaagcuauuuaaauaaguagguauacucuaaauuuacaauagaaaauauaguauaaucaggguuuggugacauauacuuauaaucccagcauuagagagacugagguagaaggaucaugaauuugaggccagccuaggauauauaacaaaaccuuaucucaaacacacaaaaaaguauaacauaguauaacuacuuaagccaguaagauaucauuaucauuaucgaguauugcauacugccuaucauuguacagacuguaacuuuuuuuugaggugaagacaaacugcauaguccaggcugaccuuuaacuugagauccuguugccucaaccuuuuaaaugcugggauuauaggugugcacaaccaaggcugguguggcuguuucauuuuucuggugaacaguccugacccacuguuguuuauuauuuuaaauaaaauaaaauuuuaucuauaaguauucuuugacaacacacgugcacaugaauuuaaggaaucucuagacacauacacacccaccgacacaaacauaccuauauaguuccuguuuuguuuuuuguuuuguuuuguuuuguuuuguuuuguuuuguuuuguuuugguuugguuugguuugguuugguuugguuugguuugguuugguuuugguuuuccgagacaggguuucucuguauagcccugacuguccuggaacucacucuauagaccaggcuggucucgaaaucagaaaucugccugccucugccucccaagugcugagauuaaaggccugugccaccacugcauuccuguauauuuauaucuucuauaaauuuuccugaaauacucucuauuguugcaauuuaaaugaucaaaaguucaacugcuuggcugcaucauccaaagaacuuguuaaauacaaaaaugucugagucagacaccuuuagacucagcacucugcaggcugaggcaggaggaucuauuugaguuccaggccagccuagaauacauagugaauucuaguacagcuagggccauauagugagacccugucucaaaagaagaaacuaugugugaucacuucuuuauuacacaguaauucccaaugauccuuuggcuccuguuuccauuucucucucuuuuuaagaucacacaggagucacuggcagcuuauccacagcacuugguuucagucacuuacaguaggccugcauuagagccauggugcaauguagacaacaugugugguugagcaugcagcagaggaaguaagaagaagcagguagcagagguguuaccuacaucacuacauugcuuugccagcauuugggauuuuauaguccuuuuaaucaaaugggaaaacaauuuauauauuuaucauuuuuuuuuuuaguuuaaauaaagaacucacccuuacuaugcuucguuucaccuggaaugaaaaccguuuuauaaugguugugucucuuguagcacauugccagagcugcgugugucauggaguggccaggauaaccuaggggcaacaccuuuuuaagugguaaaauaaaucuaaugaauauuuuaaaaacagaaaagaaaauccaugugugugggggaggguugcauacucugcuccuugggguuuugacucagugggucucuggugggguccauacagcucugucuuugacaaacuuuauggaugauucugaugcuuauaacauuugcaaguccucugaggcauaauaugaacaacuugaguaaagagaccaaccugcuugucucuaaaucauccaucauggucaaaggcaggagagggggugggagggcagguaguaaggccauaaugacuagguaucaauucacugauggugucagcuuuugacuccauauauaggaaccguuuaugggccacacuauacuauuuaaaaacagaucuaagacuuuaaaaaugugcuucuaggacuuuaagauacuacauuaagaaucauauugaguagaaauggauuucagaucugucuguuuuauauuucagacggcacaaaacuaggucccguccacagccuuccccuuuuggaaucuguaccugagcuguuucauaugacuuggacaugacugagaugauagccuccugauaaacugcaaagaaaacaaacauccuguuuacagcaacacacggcucuuuucauacuccaggagugaccucaagaagcagcugaacaugcugagccauauugucuaaacauuaauuaugccccaagcagcauuguuguucuugagucuuggcaaaugcacucugacaacuagauggagaacucuacgcaguggcauuacaugggugaauucacuggacucugagagcacaugcugcagcuaaccuauccuggacuuacuuccuuaccuauccuggcaacugacuguguuccaggagaagcacccugcuggagaaaaaaaaacagcacaggacuugaauuuuggacccccaaacuuggaaucuuuuuuguguguuuugguuuuuaguguuugguuuuuaaagacaggcucucuuuguguugccuuggcuguccugaaacucucucuguagaugggcuagccucaaacucacagagaucugccugccucugccucccaaaugcugggauuaagggccuauaacaccaguuggaaaagacuuggauucuaaucccaguucuacucuacuuuuacugggaaagcuguucagaugugacugucuacucuuuaaaacaggguaaaauuuuugagaauucaauuugaugauccacacaaacagagaguaaggcucuaaaauauuagccacuuaguaauaauagugaagaggucagcucaggaacuuuagaaaauuccaccagacuccuccccuccuggaagagaaaggucauagguaccccuccccucuagaaggggaggggcuaauuacauuccucagaccacagggaagaggagccgaccacuacugaucaccaacaacuggccaccugcagguaagggagacacauuccccaaccauuggccaccuaccucauucccuauagaccaaucaguuuaaaagucacauuguucugccaaucacauugugccuaaugauugcugccuugagaacuguauaaagacccacuggacaggcugcgcguggucauucucucuccccauaugcagggugaccccaacauguuggaacaauaaauuccucuugcuuuuugcaucaauuccuggcuuugcaucguuguucacucagggaguccccaguaaacuaaggcucaccagagucuuaaaauaguaauauuggaccauugguggaaauauuccuuuagguuuugugcugucuuuuccuugccccaacucuugcuuguccagggcucuugcuacagacugcuuguagaagugcuacuguucacuaugcugguugacaguuugcuuuccuggcuagagcuccuugggggauuuguauaagggagaugauaacaaaagauaagauuccaucaagcagugggcaaaaguccaaaccguuucuggaaaccacaagcagcagggcuaguggcagaaccuuaagagagaugagggaugacacaucucuaguaauugguguucacaucugggugcagaccucaagagccucagcugagaaaggugcaacaaauucacucucugcugguaauuauguagagcuagaugaagagggcaguggagaugugagcugggcugaagacuaggaaagcccucuccuguuuuuacggacguuucagacacuugacugcagaacaacuauacaacaaaggcugagacugaauuucccaucugccgcaaaaagcagaaucuuagaagaauauguuuuuuaaagagcuguuuucauuguuguuuauauuuccauguuacaaggggaaucgaaucuaaagcguccuuauaauagccaaguggucuaccacugacauacacccuuagcuguagaggcauacuuaauuuuaauuaauacaaauacaaguuugugaaguaauauuuauauguacuguauuaggagucaucaucauagcauuaauaguacugcauuuauuguuuuauucuguuuccuuccuuuuugguggagguagguguuuggugagacuuaagccuuaaaaaaugaucaggcuuaaaaaaauucccuuuguuguaaaauuuuaauuuauagagcuauaccacuuaacauuaaaauggauuuuuaaaaguauuuuguaaguggauaguuucaguucauuaaaaugcugccaacaugguaagacuguacaggauaaaaauuuaaaucauuacuggcugcaugcuuuaaaaaaucacacaugcaaguacuguaaucaugaugcaaauauguuucuaaaauucaaaagucaaccauagcacuucuaguuucugguccuuuaaugaauuauuucuggagagcaguaaaauggcuuaguaggcaauagcucuuguagacaggcuuuacaaccuaaguuggauuccugagaccuauaugguagaaggaaagaaucauagcacauacaugcauauaugcacaugugugcaugcacacacacacacacacacacacacagacacacaacuauauaugaauaauuucuguugaacacuaaagacuuccaccaaguacuuguccauguaugugaaucaaaaacagugguuuuaugaauaaaaccaccccagggaauuccuaccauaaaccuaccaguagauguaauuaauaugacacauccuuucaacucaccacaagcauuuuuauucguucacacauaagccccagagccagccacucaaccaacaaaacaaaauggcuuuuccuuaauugugcccuaacucuccucaggcuagagcuguccgcuauuaggcugguuugugauacucugaaaagauaaucuaagacaaaggucucuuuuuacugagaacacauagucccaaaggcacgaagggguggcucaggcgggacuugaaaacagggagcuuuaaaggaaccaguguccagaaccuccgcuucuaacaguauaauuuccuaaaauuaauaugccagagaaagucuuuuccauaugaaauagcccucguuacaauuuucaaaagagauaccauccauaccuuacuguggugcauugcaaggguggggggguaacacuuucagggcaaacuuuaaaggacauucagagcaccccgaaccuauagagcaguaccucucacccuuccuaaugcugugacccuuuaauacaguuccucauguuguggugaccccccaaccauaaaguuauuuucagugcuacuguauaacugucauuuucugcuguuaugaaucauaauauaaauaucugauaugcaggauaucugauaugugagcacugugaaagguuaucccacugcuguccucgccaagggcuugugacccacagguugagaaccgcugucuagugucuccuugucuuucccuccuauauacagacuucuguuacaagugaaaauuggcauuaggaaccaaacagagcagaauggagaaugaugcaaauuuuggccuaacaauuuuucuucugcuucucucgucuauuaucagagaacacauggaucuugaggggcaagguccaggaauucaaaguaaacggagcacuggcaagaaauauugaaugugaaaaauagcuuuuucauguaguuaaggguaagcacuuuuccagcuauucucaacacucauauugaauccuaaaaauggcuuuucucuuguaguuaagaguaagcacuuuuuccagcuauucacuucaaaaucacuuuaauaagccaaagcucuauaggcugguacggcugcaucucaaaaauguaucuggaauauuuuccagaauuauaaaaauuuuaagauacacuggaauaaagguguggguaaaacauuuacaucauuuuugcaugcauuacacuauauuuuacaugcauuauuuuaaaggaaguuaaaaaaacuauuuuauaaauucccauaacaaaauauuucauuuacaaauaugccuuauccaauuuugauuuuuaaaauguuuauuuucuauauccuccugauaaaaaauaaacuuaccuacaaaugauuuuuaauaauaugcuucuuuccucuuuaaauacauaggaaacuuuuaaucaugguacuuaauaaagauaguugaguuauuucugacuuuuauacuugaauuuauggaguuauuccugaaauccaaauauuauaaucugauacacacaauaaguauuucauuuuguuuuauuuuauuaugagacaggguuucucugugcaguccuggcuguccuggaacucacuuuguagaccaggcuggccuuuaacucagaaauccgccugccucugccucccaagugcugagauuaaaagcauaugccacaugucuagcucaaaauaauaugccuuucaaaaacacacuucucaugugaaacccugucucaaaggguggagauggcccagcaguuaaaagcaaacacugcucuugaagaggaccugcguuuagcugccagcacccucaucaggugacuuacaaccuuacgcacaucaucuguaacuucauuucuagggagaugcaacaccuuuggcugcuaguaccuacauugacaugcacauacccucccuauauauauauacacaugauuaaaaacaagaaaauaaaucuuuuuuaaaaucuguauuuuucuucuuauaaauauccuauaauuuaaucugugaauuauauuacuuugcaucaaauuaaauaugcuggcucauugucuuguuuauaacauuuguuggaucuuuauuauuuuaaucgugaauaauucuacuuuuagauacauauauuuuaggaccauuucuugguauuuuuauaaagcuuccuggaauguauuaauauaguugaauuaaaagccauuaugcugaucuccagguuuuuaguaaaucugauaauaagaccccauuuugccuauuaaagaaaauauacucugcaaauccaauagguuacaauccuagccuccacacuuugguuuuuuuuuuuuuuaaugcuuuaaaaguaaaugccaaagacauuuuuuccagaaauuguuggauuagugaugguguaacgugauuacagauacgucuauuuccccucucuuuuuguauaucugcuugaauaaguugcuuucaaguaaaguagcaagggugauaauuaagagccauuugauaagucuugauaaaaccuuuuguuauaacuucccagaaagggaaagaacaaaugauucuaagagcuuaguaacaaaucccuuugcaggucagaccaucuccaauccauucuuugcagacgaucuuaucaggcugcuacuugacaaacaaaagacaacaauaauacacuguguuccugagcuaaggaauucagggaaaugcgugauauuacuuuaacuccuuccauucccaucuauacacuugugugaacaaguauuucaguacuuacuaaagcaaggaaaacaaauuauugcuauaccuugccucaaucuggcaauaaguuauguucacccauagauacauucauaaauaagaauauccuauucaucuuauuaaaggagcaauugcugaucaaauuuauuuuuauauuuaacaaucacuuaucaaaauguguaacaugguacguguguuuggauuuccacaccgauuucuucuuuagaacugugacagaggcaacuaaaaaguuugcagcacugaaacauuacacuaggaaaauuauaggcaagagcaacuuuaggagaaaaauggaaauuuauaaaguauuagaaaaaaugaagaguuuguuuuguauucuacaaauauauaauggcucauuuuaaaguuuuuacaugcuacuagaggcauguaagugacugaaaaauaauguuuaauuaaguuaauuguuuuggaauagacagaguuugcugaaugacucaaacuggccugaaacuugcuaccuacauagcccaggguagccucaaacccaugauucuccuacuuuaaccucccaaauucuuggauuauaguuauauaccagcauaucuggguacaauuauguuuuaaaaauucauguugugauucuggcuccugguguggcaugucaccacaccauuguacaaaggaagaaauaacugaaaaaaaucaauaugcuuucauauauuuaucagagaaaugaaggcaaaggggaaacugcuauuaaagagaggaagagaauugaagaaggagagagagagacagaaagaaggauaagagagagaaaggaagagggagggagggagagaggaagggaaaaagagaaagauagagaauaugaacauauagaauauauaucacaacuuauugaaccagaaauccauagacagaaaccuuugaaggugccaguggcagcaagauguaaaaugacaucuugcugaggcucauguggacccaugagagaguucagaauucuggguuacaugguuaauuaugacccacccacacuaaaccuccuccaggcucagaucaccuaaauaacugaaacccacaugcugcugaggccuuucgagggcccugaggguccugaagauuccagguggcaguacucagucuagagacaggacagagaagggagcaagaaauaguuucuccuuugggucccuuuaucugacuugcugaguagccauugguuuucuugccauucucaaagaacuccauucaauagucacaugguuaguacccuuaguaaaaucuauagguuucccucugaaauuuucaggaaggaguuuuuaacauuugcauaauauaacaugauacuagacacuagaauguccugguuguacauauuuuuccccucuuagagaucucaaggauuauuauagugccuaguucaaugcagugccauggaagcuacagaaguggcauacaggucuccucagucaaguacuagcuugucaccaaauuuagaauagguaagccuucuagagaaggaaaacaucuguuuauaccaaaccauauuucucuuuccauacucuuaggaaguacaucagcuccuucauugugaaccaagaugcccuggauauauaaauccccauuucuuuaucacacuguacuuaguuauacaaccaauuagguccaucuuauuagcauggcacugucuuaagugcugcaggucacacauaaaugacauagacaaugaccuuaugcuccaucaaucauccuaaaccccuuuaauucuccaacauuugaaaucagaguaauauugccuuuucuuugauccucuggaaaauuuuagaagugcaaauuugaucaugucacaaauagcaggagaaaagcauuaauggaaaauguaagguggcuacccuugguggugucauuaaucugucucucucucucucucucucucucucucucucucucucucucuuugauacagugguacacaauuucaugauguaauuucuccuaugguuuuaaaugucacuuuaaauuucagguauugaacaagugaggugguaugggcugaacuggaaacauuaacaaugucagauuuuauugauggacaucugaaagggguacuuuucaggaagcauauuauaaagcaguuucuggacaaagaaaugcacuucuuaccuccuaccaacaaguagcuguugggaaacaguguuuuugcuugcauaagugcccuugcgugaccugaguggaagaggucaaauauuccaucugcauacacucuaacaggccuaucaacuguggaagaaagagauacaguuaacacaacuacacaauaaguaauccccauuaccuuccauuagaacugcacaauaaguuuaccuacagaagacacaauagcuauacauuaucaguuuaacaucaguacauaaaauugauuuuuaaaaacuagauucuuugaaagcuaucaaaauccaacaacgucaccaaaaaaaaaaaaaccacaaaaaaaaaaaaauacaguguuacccaacaaggaagacacacagagcacuccguacucucuucaucccacuuagaaucuaacugaaccagugaagucuaccuggcacuggggaaacuaagguucccuuuucgaguucuucauuuuguucauuaaugauuuuagacauggacuugaaaagagaccugaggacaauuuuaaucauuuaagugaaaaguaagguggggaggugggagugggugggugggugagcacccucauagaagcagggguugggaugagacagggggcuuggggggggacugggaaaggggauaacauuuaaaauguaaauaaagaaaauauucaauaaaaagaaaaauaagugaaaguacaguuuaaguaaaaauccucagcugaauaaagagacccccaaagcauccagccauguagcagauggucuuuuuuuaggucccugccccucccauuugugucugagggcuuugagugacacagacucuguuucuuagaugauggcaggguaagaauaggcaagcuaucuuuuuucauguuaaguuuuuaagaugggaucucacuauauugaccagacuggccuugaacucacagagauaugauaaaggaauaugccaccacauguagucauaugguaauuuggacauaguguuuaaaguuacucuuuauagcaugcuuaaugggaccauaagagaaaggccuuaguccuguucucaaagacagugaugcuuugaugucuauucagugcucagacuguuguucauuuuucuuuccaauuccaaaguucauugguggcugaaguaagcugugauggggauauuuucauaccauaaacagggaaaugcuacaaaauaaggcucauuucaccuuagaaagcacaauguuccccagcauaucuuuguacaaggccacccugggguguaagauagagacggcaugugacaggcccaaacaagaaggcagucaguguaucaauuuuguauauagaguuggugcuuuggauuagaagcaaucaauuggucaguuaguccuuucuaguccugcaggaugcuauugcugauccagcccagacagcaauuuccuuugaaucagaaggacaugcugaaugguuggcuuucaucaauguaguauauaaaguggccacaacauggagggagaggguuauuguucuugauauuuuuauacugauagccaagaaaaagaagaggaggaggagaaagaggaagaagaggaggaaggagagggaaggagagggaggggagaagagggagggagagagaaaggggacaggcaugcaugugggaucaucaaagucaucagaggaugacauggagaaauuuguuuacuccuguuggauuuuagggcucacacucaguccaccaugcuaguacagcaaucucacuagccuggugauuuuuuaaauaaacauaagaaucauauugacuuuuaaaaauacauguauauauuauauucaugcucuaaaaugaaguauuaagggaaugggauauggccucaugguagagugucugccuagcauguaacaagggccugaguucagacuucagcgccucacaccacaaaauagggaacugaacucaaaagagaucauugcaaacuuccauuaacugauuuaggauuuagauuuaaaauugugauuaguuauugaugcaacccgaccucauuaauuuagaacauaaagaaauaucacauuaauagauucagauguacaaucuugcuaauaaauuaaauuucuccaauagaaaaaaucuagagauuuuaugucagacugagaacugcaacuauuuucaauuauauacuauuuugaacagacagaauugcuuucacaggaugauacuguauucuaaauaaggcgcaguaaacagaaaaugcucugaaauaacaaacugucuaaugagggaucuuggauuucaaugcucuuauucaauugcaauucaauugaggaaaauuuguuuuaagauauaaaucccacaagaaagcagauggcaguuuuguggaaguuuuuguuaacgauucagaggugaucaggauaaaugaauucaggaagcagagaggaagaaaguaaagaaagacgccauaauuacugggggaaaggccauuuaguaaauuucaagacuaucuguagaguugauuuugcagucagaucacuuuuuaaaauuguacugugucagcaacuuccagacuggaaaacuccuacagggccccaagcaaaaagaggaaccugguuucuuggucucuucaagggauggagggaaugagaaaggagggaaggggcggggagggaagaacagguggggagggagagagacaauggagagagagagagagagagagagagagagagagagagagagagagagagagagagagagguugagauuaaaccggagcaaacgauuacagugaaagcauuguuuaucugcuguacccacacaccuucccucauggcagggccugagcaugcuugacuuaguccugaagcuagccgaggacagcccucacagggaaggucacuguacuggauaaaggagggguaugaggcaauagggagcugaagcccuagcccuaccuaguuaugauaccgcuucuccagucuucugggguuuuucaaagauuaaaugagauagggcacauucuggcacugagagccggcucagccuuccgacuccacaggugcucccagagcagcggcauuacccgggagguuggcaagaguuacagcacagugggccccagcccgugcaggacagaaucacagacuccaguggggagucccagacaucuguauguccgagaguccuccuggugacucugaugcaggcuccaguguaagaagcccugccacuugacagcugaagugcagccuugcaagcucucuaagucuucauuuccuuaugugugaaauacugaacguccugaccauguugaguuaggagagcaaaaugauaggauacacauaaagaccuuaggacuuuguauacauugaguaacugccuauuacuagcaguugacccacugucccuuacccuguggauuccuuuaagcuuggguugucugcauauugcaguggcuguccgagcucagucugcuuucccaucagaaaugccuuaaaucuccacucacucaaccagucuuauuuuucacuccaucccaaccgauugacugauccacguuuacccccagacagcucucucuagcucugugcuuucuggcaaguguucuuguucuaucccuacagaauaacuguucucuguggacacaauccaaaacuucucucaaaagaacuagcuauguucuguacccucccuuaugucuugccugaccacuccaggccacacgaaugugccauucucugaacugucacuuaucaucaguguuguacacugugccuauguacaacaugugaauguggcuuuuacuuugugucuaacaggcuugccccuuuaauuaucaugaaagcccuugggaaacagaaaugguacuuuauacuuuuauaucucuuccccgcuggucuucugauauaggcuaaaggaauggcuggaggaauacacuucaagaacaaaacccagucaucuuaggggcucacuuaaaacauacaaaugacauuucagaaaaguuacagcuauagucacuuaguucaucaacaccuugaaaguggaauuuuugcagaaccugucugucacaaaagccauguggaacaagacauugucccuguuuugcaagugggaagaugaagccacaucuucuuccugaauugccaaagucuguggaaguaguagaugacagaucuugggcuuaagcaucuccugcauuuugaccuuggcaacuuugauuugcauacauuauugcugucuugauccuuuuguuacaggagcgccuuacucugcagccuaccuuaucuuggaacucacuacugcaagccacacuguuccugaauucacagcuggccuugugcuucggccuccucagggcugagauugcaaaugcaaauccucauacucaacugcuucucacuaggaauguccacugggcuacgaucacagaauucugcuccgaaaggaagcacugcucacacaaagcugugcgaugacuucagauguccagacgaagcucauuugagaaaugagaacagccucaccugguguuccuaagcgggccugggcaacggucaguuuuucaugaggugcuuggcacuggcagcuggauucaucagcaaauggggcuggugcagucagggucuaaaagggggaaagagaagggaaauacauucugauaaagauuucuuuagcacaauccuccucccucgaaguuuccuguuugguaggcagguaugacuaagaaggaaauagcaggucaugauggcucacaccuguagucccagugcuuaacugaagagcaggauaaccauaguuaguuccaggccagccugagcuggagugagguccucaguguuccacaauggcucaggcuucagaggcugaaacccauggggcuagugggaaagaguagaauauaucugcugggcuugccagagcaauauuauacuccuagaaauaaagcuuugucacagucccuucccccuccucuuuaacugaugcgucgagaauauuaagagcuagucagccauggugacuuacacauguaaucccaacacucaggagacugagacaggaagauggagaguucaaggccagccugagcuauagagugagacccugucuuaaaaacuaagaacaaauaaaauuuuaaaaagaaaaaauaauagaucuguacggugccuaccauaugccagguguuagaugagauucucugggacugccaucucuuucuggccucccaacaaagcuauguacauauuucuauccuucccauaggguaccaucauacuauaccuauuucacagaaaaggcaaccgaggcucaggaagauuaaaaaauuugcuaagucaugcccuuggaaaaucauaauguccagcuuugagcaucucccaaccaacaagggcagucuucagauauuuagacucacccacacccgggacacucggcugaaaggaaccucauauucagaaguguggcacgacaucuccuguacuucacauacacacacacacacacucacacacacacacacacaccagccuggcaaauaacagaugcugaugucucuucaaugcaaaggccaaagcugauaucugcaccggagagagccuaaaagcacagcaauucuggcgggcugcagauaacugcuccugugguagcucccccagcuaccaauggcuagaggccccgccccaggcagcuugggcugaggcucuggggaacgcugugagaaagauguagucacuuggaagccugcccaggaaguggcccugcauuuuuuagucagccucuuaaaaugaaaaccucacucucuccagacagaggaagacaaagcgggcgguguuuguuguaaacagggcaauccagaguuguccauuugcagucuuuaagcuaugucauuaccgcagucaccucauuuuugggguuuguuuuuguuuuaagcuaagguucacuagucacugcaaacauuacucacagugcuacaugaauuguuuauuagagauggagacaggugguauuucuuagcuugggaagauguggcugaggaaggaucuagacaugugaacaagggaugugauuuacaucugccaucaauuuacucauauuucuucaguuacuuauucacucaaaucuccaucaggcgcuguaugaaaaucuagggcuagauguagggauaaagcuagcccauuccuuggcuuuuuaauuguuuuuaaaagucaggaccuuguuacauaucccaagcugaccuugaccucagaaucccccuaccucauccucccaagcgcuaggcuaauagccacucacuaucaugccuggaaguuaguccuugcucucgacgagaccguguucucuaagacaccauguuuucuacacugacaaaaaucccuggccccauccuggggccccuuucaguaccuucuacucugaggcaggaauccuacugcaguuucauuuggagaucuccuaauuaguugccugagacuuccauaacucccacccugucuucagagcucuggcaacaaaccaagacucuggcgaaaaagaauuggggaacgcgacuccacuuuuugguuuugguuuguuuucuuuuuucucggauacauuaaggugauuuggggugcucuaguagggcagagaaauguguguaauguggcaaagaagugucauauguauuuguaagacucccguucaaaucuccuuuguagcacuugcugaguguauacacacacacacacacacacacacacacacacacacauuauagaguagaaucugucuggcuaagcucauguuuucaaaucaggauacaaccagaccuggcuagagcuguaucagauggacucuugguuccaacagugguggcaacgaaagucauggguggcccaauaucaucccuuuaacaggaacuagcuauauaugugguguauacauguuccuaaaagcaaguucuauaauguaucuggauucaguuucaucuguaaacagaguaaauauuuuacaagauuguucugagaaacaaagauuauaugugugcuauacuuaguagccaauacauuguaccuacagcugcuauccuuacucauuagauuacacaucgcacuaccuauuauuguaccaugauagagaauguaguucuccauacaaacaagaaaaaugacucaggaaugcauuuuaucaacacaacccaaauuaguaaaguuguugaaaaugagaaugucuuguguguuguguugcuugugugugcaugucugugugugaauaaaccucauguuugugguuacccacaggagccagaagagggcagccaauccccugcaacuggaguuacaggcagucaugagcuaccugacacagguacugcggaccaaaccuaggucuccuagaagagcagcaagugcucuuaacuacugagccaucucuccagacccaaaugaaaauaucuuauacuaaugauuucuugucuguuucuguuuuguugcuguuguuguuguuguuguugugagaauuuuuaaagauacaguuuuacgauuaugcuaguccagguuagcuauaacuuguuauagaguccaggcuaaccuggaacucugcuucagucuucacauauuugaauuuaacccagcuguuucauuuacauguguauaugaacaguuaaucuuuaucauauagucucaaauaaaugacgauuuagaaauauuuuuauguacuaaccucaaagcuuacuagacaaaguguuguuguuucauaaggaagauguauuaagagggugggaaagcuggcauuuaaaacagaggaaaauuguacugaaagaugaagauaguuuaugugugcugugcauuuugcuguugauuuucauggccuggaaguaaggaaaugggaagacugaagagaaggaaaacagacagaaccccucagugcauaugugugcuucugugugcagcaugaacacagaugagcaucuguaacugcaguuggcaugggaaaaguuuauuuuugaaagaacagggauaaugcaaaaauaaacaaguugaagccugcuuuccagaacauuuccuuucaaagugaugcugaauagaccuuggguugagcauuugauacuauauuggaacaauaggauggcucaguggauaacagugcuuuccaugcaagcccagcgacccaaguucaguuccuagaaccuauguaaaggcagaaggagcgaucagacuccacaaaguuguuuuauggccucuaucccuacaaauuauuauuuuuuuauuacauuauuauuuuaauuuaaaaguaauuaaacucuauauucaacaagauuuggugagggccuggaaaauaccaacuaguucccgugacuugaaguaauauuguuucagucugaacaaaucagacuauaauuaaaaaaaaaaaacucccuuucaacacaaaauaaaccauuuaaugucuaaagaaucuaugcuuauucaguucuauuuucucuacauacaagcaauagguucaccucagaacaauugggaauaaaauaccuggagucaccuaggagaagagaggaucggccaaucuggccuuugaccuaucuagaugucuacgagggucccuaucuauucuuuaaccuuuaccaaagcccaaauguuuacugggauacucugauauauucuggagauaggccuuuuguuaagacaugaaauuggggcccaauaacacaguguaauaacuaagucuuugauugucuacccagugaugcauauaaagugucaaauauauuugcucauuuaguuuguacaagaacucuguaggauagguucaacgucuagcaaacuauauaggaccugucugcaauagugauaucaguugaugacaagaagccacagauagcagugauagauccuuuagacucaguugucuuuguuggcucccucugaacugagcaaacauucaaauuucuagacaggaugaggagaccacagaaagaagauacugaaaugccugauaauccagaaggggaaacucaaacaauuaacugaagaaguagcaguacauggcagauauuuucacccugacuuagugaagcauauagccauugucaagccucaagccucagcucagacucuaaggcauccagcucaccuuuucuaguguuucuagcacaagcuacacaguuaacugaugcuagaugucugggagguaggcaaauaaaagaacaaauaagaaaggcagggaagagaggugacucuggggcagcagucuaccaaagugaagagugaccuuaucagaacaugaaaagauaauaauuaaaaaggcaagcacaauuucccaucauuucauauuuguaaccaaagucccauucuuuucaauguacaauucauagaaaucaagugacuagaauagugggugucaucagaaccauagaccacaccucccuggagaaccauaguccacauucaaaguugggacuaugagacacaagagaucguucaucagaagacugaugacuuucaagggauaagaagccauggccagugccccagacuucacauguacacaggccuuggaagaccacagauuugguucuaggccacaguaaagaguccugccuaauuuaggauuucaaaacacccaaccauugcuugcaaaugggcuucccauuugucauguguuccaguacuguaaacuguaccacagagucauacaaaagcuauacucccaaaaggcuuugcaaaggaaaggacauuguguauuggccauuguuuuccagaaucucuuuuacugagacuugucaaauauuuaccuaaaacaaaaacuguuacauagcugggaguguacucgagagaccaaagcagaaggcucaggaguacccaagccagauuaggccacauaggaauucaagggcagcuucaguuccaaaugcaagacuucugcaagugugugugcaagcaggugcauaugcacgcacagcuacaugcccauaccugaacacacacacauacacacaugcaugcacaugcacacaaagauagcuaucagauacaauauaaaauguauguuauaauuacuacuggagugcaaaaaaaaugacacauaaaaccugcacuuaugcacuauacaucgcugacugacaacaaaaauaugagaauuaaaaaaaaagacaacauaaaaaauucuauuucucaucucugauaauuuuaaauccagauuuaauuuaugaucauaaaaguuuagucugauugcaagauagaaaaaaaaaaaaacaguugaccauaggucugaaauacacaagucacuagagucuggaauuaggucauugauuauguagaaucccaaaucacauaguugauaugaaaguucugccagcagaaauccauggaguggaggauaacaaggcccagaauguggcucaacaccaagaaguacccuuuucucauuuuguuaacuauaguguguguacacaugaagaagugaugacagacaucaccacauaucugacuggggcagauauauguguaucaagaaggaaucauuccuaagauauuucccugaaugcaagauggaaauccccaaacaguauacuugcauguuaauacuguaggauaucauuuaugauuuuaaaagagggggaagggugagguagaaauagaucagaauuaugcugagaugauagcuauuguucacauguggcuauuuaaaugaacaugauacuuaaaacgcaauaauauuuaaaacagaaucucagucaugcuagcuacacuagaaguauuuaauaaacaaauauggucaacagguccauuggacaguacagacagagaacauuccuguuaucacagaaagggcuacuuagcuuagaagaagaaagagcaggcacuuaaucaccuccuuggaaagaagauauaugaguucuuuugcuuuguucuuauaaugagaacauauucacaccauuuacauaauguaaaaauaaauuuaaagaaauauuuuccucuucugugauuucagaguugcagaaaauuuaaucaaggaucagguguccuuaauauagaggguaggucuuacagaaaauaaaagcauucagcuauuaucuauaaacuagcugauauaauuccuaugcauagggaaguuuuagaacucauuugugcuuuugaaaaauuuaaaacacugucauaauaucuacucauuaucccuuuguucaacauuuuauaccaugugaguaguacuuaguguguguucggugcuguuguagauucugaggucacaucagaggaaauaacagacagaaacaaaaacaaaagcaaaaaaaaaaaaaaaacaaaacaaaaacagcugggcagugcuggcacaugccuuuaaucccagcauuugggaggcagaggcaggcggauuucugaguucaaggccagccuggucuacagagugaguuccaggacagccagggcuacacagagaaacccugucucaaaaaacaaacaaagaaaaacaaccaaccaaccauccaaacaacaaaaacggucuuguccuccuaacacugaacaacaaugacaaacagcaagaauguaaaauauaugcaguguguuaaguggugauugccaggaggaugcuggguguccuucagcacucugccuuuuuucuuuuagacagggucugucacugaaacugcagcuaagcuaacagucagcccuaguuaguaauuaucccaccccucuccacuguggcacuguguuauauguguauauguggcacuggguuauauguguguauguggcuacaucuuuuuuuuuuuuaaacauggaugcugaaaucaaaacucaaguucucgugcuuguauugcaagcacucuuccccaaugagucaucugucuagucacugguuuuuauucuuuuuuugagacaaggucuuauguagcccaggcuggccuugaacucacuauuuuucuggagguggcuugagcucuugauucccuuuuguuagccuuugcuaugcugggauuacaggcaugcaccaccacaccuggcuuugugcuuuaggggauacauugagaacaaacugguaagagaucuuagguggaaauaacacuguacuagagguaaugagacaucagacuuuacauagauuuuguguaaauaaaauuuggaauaccuuguauacaaaguauaaaaagaauaaggagcuaggauaauuccaaaguaauugggcagaaaaauggaagcaccuggguuaucauucucuggaugggaaagguucgaaaagugaaagucugugguaggaaggauggaaagguuuugguucuguucucacucccuuacuuggauauuacuguuagaucucuacuuagggaugucaggccuauauguacaaggcagaaauuugggagagagcacuaaaagcugcaauauacggcucuagaagacaacucaauauaagugauacuuaaagcaauuggaaugaauucauauuauaacauuuaaaagcaugaaggcagggagaauaaggguccaaguuggcaaauaaggagacacuaaauuuguagacagucuuucuccaccauuaggaaaacuccaggaagcaaggacuuggucugucaucuuuguugcuauaacuucacuccccagugcaguccuagacacagaguagguccuuaacaaauacuaguuaaauaguaacuggagaaagugauugcugauaaaaacagaaauaggcauuaaacucaggaagaaaguacacauauuaacagugugcucuaaaugucucuuaucaucauaguauauauuuuaggaaacuaggggaaguuaagagaaaacaaaccucaaauaauuuaauccuguuuuccagagucaacuguugguaauacauuaugguuuaguuucagccuuuccaauaugccauguguacuggccgguuuuaugugucaacuugacaccagcuggaguuaucacagagaaaggagcuucaguugaggaaaugccuccaugagauccaacuguaaggcauuuucucaauuagugaucaagggggaaaggccccuugugggugggaccaucucugggcugguagucuugguucuauaagagagcaggcugagcaagccaggggaagcaagccaguaaagaacaucccuccauggccucugcaucagcuccugcucccugcccugcuugaguuccaguccugacuuccuuggugaugagcagcaauguggaaauguaagcugaauaaauccuuuccucccaaacugcuucuuggucaugauguuugugcaggaauagcaacccugccuaagaccccauguguacauacuaaaagcuuuagaucuuuucugcauaagcacuuucuucacccaacacaucacaacaaucuuaucauuuaauuaguuuucaaucucgcuaauuuaagacaauuaaauauuacacugaauaggaaaaccauacauagaguccaagagauagcucuauguuuaaaauugcauacugcucuuguagaggaccaaguucaguuccuagcacccacaucaggcaauuugcaacagccuauauauagcuccagcugcagggaauuggauacccucuucuggauucuguaggcaccugugcacacacaugcacacacccacacacagacaugcacauaugcacauaauuaaaaauaaaacaaaucuugaaaaaagaaaagucuuaaauuguucuguaauguuguguuaauuuaaaauauauuuucuuaauaaaggaacauucuaaagauaauucugaaugugugauuguuuucuuugaauagauaccuaggagcuaaauuacuuagaucagggguguaaacauuuuaaagauaagcauuugaagaauguuuuagcauguauugguaaauuaccuucuacaaaggcugcaucauucacacucacauuacaauguaugaaaaacgccuaucuuguugccaucucgcuggcaugaaguaucaucuuugucaauuuuauagaccaaaaacuggcaucaugcuguuucaauuugcauuauuuugauuacagcaaagauugaacauuuuucaaauguuuauuagccauuuguauuuucuucugaaaauaaccuguccuuugcccacuuuuucuauuguugggaauaaauagguugaaacuguuuaaaagcaaaacaauauagcacaguuaaaaaguuaccugaaauauuuuuguaaaugcauuugcaacuuuauuuagauuugccuuguaggaacuccauuaaggaaaaaaaaaacccaaacaaccauuucaaugcagucaucugggcgugagagggcuguuauaguuaugaacaggcagugacuauacguuccuacacaagagcugcacaaaaucaagccagauaaaguccaaacacgaacuggaucagggagggagccacaaaguaccaccauugcuuaagaagauauuggcaguuaacagcugcugggagaugggacggucgguuuucuucggggauucagcaccugagaggcuacccgugcuccaauaaaugguucuccacccauguccauaaggcagcucuaaguggauucagugggcuuaaaaauacaacagcacauaauguagagagggaagcaugcugaaggggaaaggggaggcauuagagaagaggggauggguaauaagguggguuugauacuuuacuuuucucucucucucucucuuccuuccuuccuuccuuuuuuucuuuuucuuuuuuuuuuuuuuuuuuuuuuuuuuuuuugucugagacagaguuucucuguguaacccuggcuguccuggaacucacucuguagaccaggcuggccucaaacucagaaaucccccugccucugccucccaagugcugggauuaaaggugugugccaucacugcccagccgauaguuuacuuuucaaaaacaaaauuuaggccagucauuugugguaguguaugacuuuagucccagcacuugagagguagaggcagguguauaacuaugaguuuaagucacccugggcuacauagagaguuucuaggacagccaaggauacagaguaagaccucaucucaaacacaaagcaauaacacaaguuaaaaaaaaacaaacaaacaaacaaaaaaaaacagccaggcagugauggcacacuuuuacucccagcacucuggaggcagaggcaggugaaucucugaguucuagaccaaccuggcuacagagcaaguugaaggacagucagggcuacacagaaacucugucucaaaaaacaaacagcaacaaaaaacaaaaacaacaucaacuacacaaaaaaaaaagagugucuaagcaccugcauguaaaucagccuaguaauuacugguccuuuggagaucagaggagagaaacuguauuaugcccugguaugugggcuuucuuaaaacaaggaccagccauaagcugcaagucccuccaauguugcuuuggaacacacaacagugacuuucaaauagcaugacgaaucuuagaaguaaaccugaaaucauguuuuacugauuauaaaauaucuguuuccuccccaccaauuguaacgggcucaagauuagaacacgucuccccgguacaucuugucuuauaaccggugcuggcuguuucacacaugaccgcucagaaaugcaagugcagcuuacaguuaacagaucuuagguccaugccauuaacaggcacugguacuaagaaucuuuaccuggagguaagaaaugcuguacucuaaguuauguuuucguaggcaguugagcuuuaauacgaugaacauuggucaucuuaucccacuuccuucccccaaaaccuuaaagcggcuuaaaaacaguaaaaauuggcaguuuaaaacuugcuuuauuuguaggaagaaggaaguauaagugaguuucuuaauagacccuggguaagggcugggggugaaguuuagcgacaggauugccuacguggcauguucgagccugcgggcucuaucucuagacaccagaagauaagaucaagagugaaguaagcacauggaaugcaggaguacgucuuguaccaucagcacuuuugagagaugggcuacaaaaauggcuuuaacucuaugcaguccuagcaacaaggaggaggaggaggaagaggaggaggaggaggaagaggaggaggaggaggaagaagaggaggaggaggaggaggaggaggagaacuauugaggaaaaggccagcaaguucuggaagaaauccccugcacagugcuaccuaaaaagauuuguugcaggaugcagucacaauuccuacaacuucaacaacagcuccuggaagaagacagcuuuguuuugaagguugcacugucugugcaaggcagagccccacaacaacaauaacaacaacaacaauagcaacaacaacaagggagaagagcauuucuauaagguaccaaacagagucuacaaaugcagcacccaaaggcaagauuuggaauguguagacuacuguguccucauaugcaaagcggaagacagugaggacagugagucuuguacuauuuacaguugccuuucaugucaguaaucaagaaaggcaucauugcuaagaucuaauucuaacauguggauuuauacuagcaccccaucucugucaugguaaaguauacaaugaccuguggggagcagggugugcaaauuggguggccugacuuacagcucaccuaggguuugaucaaugccuuuuggaauguauuaucuaauuuuauccaaacagauacucauaagaucaguuaguggcuuaaaacauuuccugcaacgaacggcuggagagcugguucaguggucaagagcccauacugcucuugcagaggaccuggguuugucucccagcaucacacucaggcagcuaacaauuguuuauaucuccagcuccaggaggaucccaugccucugcccucugaagguacuggcacucaugugcacauaccccugcauacacagaacuaaaaguaauaacaaugaguuuuucaaaaaauauuucuugcaauaaaauagggaggcagcacugguaaacaacaagaaaacggcagggcuggggguuggcaauggagcucaauugagagagugcuugucuagcauauacgaagccaugagcuugauacccagcagcacacagaacugggcuccaugccucuaaccucagggcuggggcgguacaggcaggaggagcacaaguucaaggucguccuuggcuguauaguaacuuggagaucagucucagauacgcuaaacucugucuuuaaaaaagugaaaugaaacaaacaaagagcaauaaaccacaaaagaggaagagaaggcaaaggaaaaggaagggcagcagagcugaugcuucuauugccugcaugaguucuguaucagccacaugaucaggcauaaccaaugacgacuuaaucugaucucacaagucgacagcugaaaugaaaauuauuauacagcagacuauuagaaaugccaagauguuccaguuugagcguauaucauaccucaagauaucagcuaauggaaguacuauaaagcuauuguaauuaucaugguauucuaaaaugaagcauucagaacaugaagacagaugacucuuuuaaguuucauguuuugagucauaggauacucaacccagcacuuuaaaaaaauauugucacauguagugauaaauauuuagaaguauuuuuucaguuuccuguagucuaaaagagaaaaaaaauccuguucuuccugcuacaguaaaacaaguaacuguaacaugaaggagaaaaaaaaaugaugucagaguaaaacacauucuuuugucagaaaauauguuuagaagacauauagaaaacauugcugagggucggaagaaacaagcauuagaacaaauuauguagugugggagguuugcuaugcagucagguugaguacagcuauuucuaacauggcucagcuugaaguaugugcaagauuguauuuuaauaaaaguguguuuaugagcaauggacaaauaugcuccaaagaaaguauucucugcaaaauauaugacuucuuaaacuaaaacuaguuuauuauuuuauggggagauggaggaaaugucaauggggugauggugucuuggacuccuggucucccagcuauaugagaaauaucauucugucuuuauuuauuuauuuauuuauuuauuuauuuauuuauuuuauguaaguacacuguagcugucuucagacacucuagaagacggcaucagauuucguuauggaugguugugagccaccaugugguugcugggauuugaacucaggaccuuuagaagagcagucgcucuuaaccgcugagccaucucaccagcccucauucugucuucuuuaugggacccuccucuauuagcccucaaaauguugcucccaggaucccauccugguagacuguagagugaagaagaacaauuuaaucagaauucauggagagacagguggauauggggaggaguggguagccuuaacgaccacucuuuugguucuccuguaaacccuggguauacacugcauccagagcaagucacugaccugugcuaucauccaucccuugccccucccacuaugcugacuucuaauaucauuggugagcucugccuaucucauuuuguguuuuguggaaaggaaacuaugucauauguauuacaucauaucuggauugugagauuagcuacauuguuauaguugauugucuagucuucauuguuguugccauauagauagacuacaacuuauuugcccaguccucuucuacugagcauuuagguaaaacauacuagggggcuggguggcucugaccauauguacaaguuucuucagagaguaauuacuaugucaaaagucuuuccuuugagaccugaguguagaucagugguaaaccacauacuuaacaugaaaaacccugaguucauuucccagcauugcaaaaaaaaauaauuguacuuacuuugaauuucuaauauuucuacaaaaaaccuagauaucagauuuguuucccaguccugaaauuuaaaagugugacacgggagggaggucuaaauacaguauucugcaaagcgcuuucucgcacauaucgauucugaauccucuaggggcuugagcagguaacucauggcucacugguuugagacguguauauaguuuagaagucagauggaucuaauuugaaaucucugcuuagucaguuaguaucuaauuuggggggaauuuuuuucauaauuuucuuuuagcgugaagaauuguaauucuuaugucaugagccuguggccuguuugcacguguuuaacacauauagaacauucaacacagugcccacuacagugugacuaugaauggcuguaccauuucucuaucaccuacugagaaaaaugaguaagaccuccagccuggaaccaguauagaacaauuaccuuauaacuaaacaauuuggagcuacaauacaguuuauuauuaugugacugugccugcagucacuauuaggcguacuagagaugaagccuagagaccuguguguccuaggaaugggcuuucaacaucauucauuuggcaauaagcucuacacaucauucaugauguuucuauuaaccuauuauugcuguuguuauuuuucuuuaaugcccauuuaaauaacccucagcguccuuuuacacugaugucagguucagcaugcaagaauuauggagaggaaaacaaaaaccccaagucaaagacuugggcuggagggaggagauuauaugaaaaugaauccugcucaauaggcuagcccuguguggcccugcacauuauuacacaggcuuacacuaccagggcuugcugcuuuauuuucuaaucacuguguuuucaaguccgccuucaagaucauugagugcgcuaaacugucuuuccccaagcagggucagcuucuccagccucccuuauaacccaguucaugcugggauaaagaggaagguaggaauguuaaaacaauaauacuauggucugaggccagcaacggguaaucagacccuagcaagggagaggcuguuaccugggagauuauuggaagaaaauaggccuggcuugcaaugacugacuucauuccuaccuuccuucuguucuccuucucauccugcccccugugagcagauggaauaauucuuuuucuauguuuauuuccccgagaagcuuugcucaggcacaagagcuucaagacuauuguuuuucccaguugcuggguuuucaccccaagcacugaacuuagauggacagccucuguuaagaaaacucuaauucaaugugauacugccaugccucaaagaaagccaauguuucaaacuucaguauuaugaaacagguaaauuaggagacuauuguucacaugaagagaagauucaacauagcuuucuuuaaacaaugaauagaauguaacaaauacaauuuggaauacauucaaucuuuugaggaggcaucugagacaaaaagcagaaaucagaagugguuuguacaacauuaauguaaaauuucaaaguacuuugugaacauuucuuacacauauuuagccagugugucuuaccauaaaaaaaucauucaggggcuggugagauggcucagcgguuaagagcaccaacugcucuuccaaaaguccugaguucaaauccaagaaaccacauggugucucacaaccauccauaacaaaaaucugaugcccucuucaagagugucugaagacagcuacaguguacacacauauaauaaauaaauaaauaaauaaauaaaucuuuaaaaaaaucauucaacccaucuugucuccaaguggaugaaacagaaacaaggaguggcagagcccugacuuuugauuggaacagcagguuggacagacauacagcaauggaucacauuccaugguaaaaccaucaccugugucacuccuuuggggugguagauuuggaauauagaagaauugugauuugcucaaauucauacaauaauuucacgaaacaaaacaaaauaaaacaaaacuguguaaccuagcaggcuucggugaauggagacuaacuuucagcuucaccagcccccagccuuugcacuuggggccaggccaguccccucuggcuauccuagguuccucuuguuggcagcuguagugcuucagagaccaugaaugaccugguuugcuugcucucaucauucuaucuuaucaagaaccagcauacucucucaccaccccauuucugucucucucucucucucuguaucugucucuuucucugucucuguuucucugucucugucucugucucucucugucucucugucucucucucucucucucucucucucuguguguguguguacauguguggagaucaaaaagccucuuuucacuccacagaaauggaaucauaagcuugagauauugugcccaaguuucaaaucaaacccagaucuucaugcucugugggauuuuacgaaacgaacuaucucacuagccauuucuaacucuuccuacucccagucuaacaaccucugaaaaacauucugugacaggaucuaauaucccaggauaccacaaagugauacuucugcaucugccagaaucaagccacuacgauuuuccucucccuuuacagacagcagcagaaugcuaucagauaagaaggacccucaacuugcacuauucuuucacauaacuuaauugaacccaaacucacacagcuuuaccacaacauaaccacugacuaucuccuaaauccaaucugaaauucuuccuucugucuuuucaccucauuugcucucucugcugacuuuggauguucucucugggaauuuacccuccccuugguacccugaucucucagucauuugagaaauacauuucucuccccuuuccauaauccuuccucuguuggcucuuucuguaucuuccuugggauucuguccuggaaagaucuggggauaaaaauagauuaauuuagccaaauuucauguacagacaggcaagaauuaggaauauucuaauagauugaucugcagcucuucuguuccuuuucccccaagaacauaauaauauacauuguuuagugcacauuguuucugugcuggcugguuuuaugucagcuugacacaaaccaguauugucuuaagagagugaaccuuaauugagaaaaugccuccagaagacaaggcccaugcggucaagucugugggauauuuucuugauugaugauugauguagagaggcugaguucauuuucuuaauuaguagucagugggggaggguucaucccauuauagguugugauauuccugggcuggugguucuggguucuauaagaaagcaagcugagcaaguggggggagcaagccaguaagcagcaccccuccauggccucugcaucaguuccagucuccaggucuccaucuuggcuucccauuccagacuuugacuggggauaauguaagcuaaauaagccccucucuccucaaguaguguguggucaucaucacagcgaugguaacugugauuaagauagaguccuagaguuagcuuugucacaggauuguuuaaggugacuggugauugguuuuguuaagguuuuguuuguuuuacauggguuuuuuguugcuguuguuugaaaaagaaagucuuguuauauagcccaaccuauccucacacuugucaacuuucccaucuauuguaacuaggguuucuauugcuguuauaaaacaccaugagcaaaauacgacuuagggaggagaggguuuauuucagcuuacacuuccacaccacacucuuuuaucacugaaggaagucagagcaggaacuuuuaaaccagggcagaagccgaugcagaggccauugaggacuacugcuuauugucuugccuacccugcuuuuuuuuccccaagaacccagauaccagccuagggguaucaccaugcauagugagccaagccuucacacacccgucaucaauuaagaaaaugcacuacagacuugcuuauaggcauaucuauuuuuuuuugagacaggucucucuccaugcuguccuauaacuuccuaauguagaccaggcuggccuugaguucacagacauccaccuuccucugcaucccaagugcugggauuuaaaggugcgugcuaccaagcccagagcaaggcaaaaaacuuuuggaggcauuucucaacuaagaguuccucugcccaaacgacucuagcuuguuucaaguugguguaaaucuagacaagacaccaucuuagccuccaacugcugcuauuacagcagugagucacccaccauuaauacuaucccgaggcaucuuuccuaguaauuguuucaauccacuuccuucugaggugacccacauucauugucaucaauuugaaagccaccucuuccguguuguuccuacaauuucugcuuucaguuccaaagucucuccugagcuucacaaacaacacugaguagauaauaguaaauggaaaucccauggugucuuccacacuccucacuccugauguucgauugcagugaccacacucacaugcuggagccaggaaagcuagccuuccuugacccugcuccaacuucagacuagaugaccaaaucuugauacauucgccucucuaauaucucacaauuucuccuucucccauucaugccauaaaugaaaacucauuaacucucuagauuacugcauuauccuacuaacugaaacagaauagcuuaacaacuaaaauacaagaguauaaaauaggagguggugguguucaacuugcuaugauacauuuauguaugggugcauugaacacugaagauuucucucuuuuggcaguauugugaggguugaaccuagguccucaugcaugauagguaaauguucuaccacugagcuauauaaucccagcccuacauaaacuguaaacaaagaaaaaguacagccgggccugguggcacacgccuuuaaucccagcacuugggaggcagaggcaggcagauuucugaguucgaggccagccuggucuacagagugaguuccaggacagccaggacuacacagagaaacccugucuugaaacuacccccccccaaaaaaaagaaaaguacuuacuguagauccucaaagcucaacaugaauugaacuagguauaaaggugucugaguuuacucuaaagcuguauauggccacugagcacuugaaacuuuauucugaauugagauacaugacagguuauuucucugaugcuggugaaauaagccaauucaagccagauuagauuauauuaaacgcagguuuauugggaagcugcuuuugggcuggcaaguucaauggccucaaggaucaaggccugggaagucacaauacggaaagggguuaggggagggagaaagacagaaaggucacaggugcagggagagaagaaaggagaggagaggagaggagaggagaggagaggagaggagaggagaggagaggagaggagaggagaggagaggagaacaaaaugucuggguuauauagagaagagccucugggggaaggguagcccagcccuugggcuggaaaguucaggguugugggcagaguaugccagguagagacugagggauacugggagaaccuggaggccagguuuacuuugguauguaagauauacaccuuagucccuuguuucaguaucugaaaccaaacaauauauuuacuggauuuuagacuuguaugaaaggaaaacaguagaaaaagacccgguggguaaaagcuugauugccugaguucauauccucagaaaccauauaauacuagauauaauggccacauaucuguacuuacaugugucaucuuauauacugucacacacaaacauguacacacauacacauauguacauacauauaaaauaauaaauaauacuuuuauacggauggcauguugacauaauauccaugauacauggcacuaaauaagauacaucaugggggcuggagagauggcucagcaguuaagagcacugacuguucuuccagaggucaugaguucaaaucccaggaaccacauggugguucacaaccaucuguaaugggauucaauucccucuaauggugugucugaaggcagcuacaguacucauauacauaaaauaaauaaaucuuuuaaaaaaugauacaucuauacauuuuucacuuuaaaccucugucuguuagauaguuuuaaauugcacauauggcuugaauucuauuuccauuggauagcacuguucuaauggcuggagugugccacuuacaauaaacaggucuuuaagcgauagugucuggguuugguucuacagaugggauggauccccaugugggacagucucuggauggccuuuccuucagucucugcuccacuguuagucccuguauuuuauuuagauaggaacaauucuggguuaaaauuuuugagauaggugagugaccccaucucucaacaggggcugugccuaaccucuggauauggucucuacaaguucuaucuccccuaugcuggguauuucaucuaaaaucauccgaguuggcuccugggaaccucuugcuucccugacaucuggggcuuucuaguggcuacccccaguuccccauccccaauugcuacacaccucuguucaacuuccugacccucuguacuucucuccccaaucuucuuccacaccugccccugcccccuuuuauccucccccuccucuauccucuuagauccuucucucccucuaccucccauaauuauuuugcucccccuuuuaagaaggacugaagcauccacacuuuggucuuccuucuugagcuucauauggggcaaauauccucuuaucagugagugcauaccauguguguucuuuugugacuggguuaccucacucaggaugauauuuucuaguuccauccauuugccugagaauuccagagccuuaccgauauagaugaggaugcucacagccaaccauuggacugagcaaggggaccccaguggaggaguuaggggaaggacugaaggagcugaugggguuagcagcuccauaggaagaacaacaauaugaacuagccaguaacaccccccacccccgagcucccaaggacuaaaccacuaaccaaagaguacacauggagggacccauggcuccagcugcacauguagcagaggaugcccuugacgguccgucaucaaugggaagggaagcccuugguucuguggaggcuugaugccccagcauagaagaaugcuagggugguaaggugggagucagugggugagugggggagcuccuucauagaggcagggggaggagggaugggauagggggcuuucagaguagaaaccaggaaggaggacaacauuugaaauguaaacaaagaaaauagacaauuaaaaaaauuagguuuugaagagacccuaaaaaauagacugguccaugugugugccugugugcguguguguuuaugccuguaucuguauguauguguggagguauacguguguaguugcagggccagagauuacauggguuguccucaguugcucuccacauuauauuuugagagagucuuuuuuuuuuucgguuuuuucgagacaggguuucucuguguaguccuggcuguccuggaacucacuccguagaccaggcuggccuugaacucagaaaucugccugccucugccucccaagugcuaggauuaaaggcaugugccaccaugcccugcuaagagucucuuacugaaccugaaaaucaccaguucagcuaaauuggccggccagcaaaauccucuugucuccaucguccccgcauugagauuacagguguguggcaccaugcucagcuuuuacaugagugcuaggaaucaaacucaggucuucauguuagcaagacaagcucuuuacuaagugagucauugcccuagcuccagacugauccuuuucuugucccaaaauacagcuaaagcuuaaaaaauguaaucuuacccucaaauggugggacuugucuuaaccuggggauaagguuaauaggacccucccugcugagaacuucuuccucucaauggauaaaauauggcuuuuuaagaaggcccaaauuauuaaggucacaauuacaagaaaguucucuuaagggauuucagcauccuggcaaauauccacacauuagacuauuaaguggaaaugaucuuuaaaggugggggcuauggaguuacuucuuuuauuucucuccacaucaccugguauauugcugcauuuagaaguugucacccuuuagcuggcugugaaucugcuugguaaaggaaugaguugucucucaguuacuuccuaaaauccuauaucauuggaugcuuuaaauccucugcauugccugaaugcuggccuauguaccuuuuugguuucuauaugcccaaacaccaaaacaaagcaaaguacugaccuucuauuugauauaagcuuuuuuuccaauaaggaauuuagcauuagacaaaugggugcuuaggagaauagugagauaaauaaauucauugauuccaugggcaauauaccuauuaucaaucuguaagaaauggguauugcauuuggacaugaaccaauagaaaaaugucuaacaauaaccuugggcagaauuccaguuggccauagaaaauacccaaggaagcuuauuuguaccaauacagcacauuaaaagcaucuugcuuuuaaaauguaugcuacugaguggcuaaauagauggugauacuacuaaaggaaguacagugauagcuggaaacucagucgucuuuuugaguaccagugggugaguaucuacauaccaaaugacauaaugcaccuucucugcaagacagcagucucuuggcgauguuccacuuuaaaguaaaaccccaaaugaacuccugcuaacguagcacauugaaccagcccuucuuuauuuccaaggccuccuauauugacugaugccacauccaucuucauggacguauacuuuuguaggcuagaauuacagcuuccuuaugacaauagaauguaccccaagaacuugaccaaggugauucacuaaauccucacucaggcagacagcuuuuugaacaacuaguccuuguuaguaaggguuuuuagagaccccauuggucccagaggauuagucuaggcauagucacgggguuggggcaauuugugaacaguccaugccugcaaaaaguguuccuuccccaagagguagguuuccaaggagagugguuacuucaucucacccaagaccccucagcuuuucuuuuucaaaucuaagcuucugaaucaccuugcaucauauuuaagcaggagacauuaaguaacagaaaaccagucaagaguacauaucauaauaaugaaaaguucucagaaacauauccaauuggauaccuugguaauaugggcaagaagauuauacucccaaaacauagacuuccauaaaagugaaaugauuuuccgcgauuauuuuuauaauuucuucagcaguacuaauuuuuuucuauuuaguccuuuccuuuuguauuuuucugcaaugcaacuaaagcagcuggaaagacuacauguuuucccuuuagaaaauuuucaccugaaguauauauugaauauaauucaacagcauuaucaauuugcaccuaaaauauggauugcuauaaagccuuguuuauucauaggaaaaauauggauugcuauaaagccuuguuuauucauaggaaaaauauggauugcuauaaagccuuguuuauucaaaggaaaucccagucucccuuucaaugacugggagaaaagaucugacaucagagguggauucugaguaucguauugaaguuucauuccgaaacugacuucucucaaaucuuucacaaacaaaacaaaacaaaaaacaaaguuacuuaugcaacuuaauauucauacccuguugccuguggauggcuguuacaugaguggcccacauaugacuagcuugggugaauagggaaacacagacuuuauaacauuugaaugauggaauucuuaggaaugcuucaugaucaacagaaaaaagaaaccaaaaacaaaacaaaacaaaacaaaaacaaaccagaaaaugguaaguucccauuuuccugucccacucccucucuucaucaaaaaacaucauuaaguaauuacugugugccuuaguuacugaagcaaaaccccaggcaaagaccaguuagcuaugagaaaucaaucaaaauguagggcauaaccaacuccauagugaaaguuugcuccuaacaaaaaagaugcuucacaaaaucuaguuuaagcagguacuuaaauagccaauuucagcagcccacagaaaccuuuuaucaaaguauaucaaagcaauuauuucaacaauuccauuuuggaacacaccucucuuaccucuguggugcuuguguagccccagccccgcaaaaagauaggaagagacugcaucucacuugaagaacaaauucuacaggcacgagaucauacuuuucagguauaccccucugaguuuagugccuaccuguggcccuucaaagcgaucuuuagggaguuaguuucucugaaggaauucugucaaucccuuauuucugcacauguguggaaggagaaggugaggcacugcuggguuuggcucuggucaguuacuaccugagagaagcucaaagcaaaagaaugaacugaacuuagucccuuccgggauuaccugugcacaccccucucaggccaacuaggcaaggaguggaacagcuaaauggugagagggaaagaaaauauauuaaacuggggcuggauacugccuuucucucugcugccuaaacucuuuauccaaagggguauguuuucaaguuuguauauugcacuuauuuaaaauguauauucugggagauuuugugauucacuuuuagcggucaguuuuuuccacuauuaaaccaugaguuguuuaguggcccagaggaauuuuuaaauaaccaacuuaucagaaaaauuuauaugacagaagugcacagaggccacaugacuuaugucacacagucacuggcuaaugggcuaagaaguaguuaauauugaaauacccuaaaaacaugccucaaaacauagaaacugcucuaauauaacuccccgcugguuaucugauuucagaaaguugauccaagccugccuucaaacccuuauuaagaaauaacaguucaauaguggauuagcauugaaaucuguaaguccagauuaugugggggcucauauaaaauucuacaccaaaaaaaaccccaaaacaaaaacaacaacaaaccucuuuaaaaaaaaaaaaagucucccuacugucaaacugcacagccaaucaaaacacuuuacguuuuaacuuggaagaaauccuugaagaaaggauaacucuagucugugucuuggauuuggggguucaaagagcaguauccccagguuguauaggauuucaagcuucaagaaaccuacaauuuauuugacuuuuuuauuuuuuuuuuaauuccuugaggccagguuugcugaagugguugagaagaaacuuccccauuuaccuaaagaauagaacaagugugaaagaagcugcucaauagagacacaguuacugagagagaagaaagcucuagcccuguuucuguacuuucauucuuaaaggcaugcauccccauucuaaauaaacguagcaucuccagguugccauugccugacuagaaaucuucaguaucguccuaaaaagguucacgcuuccuuuucaacgcacguucuuucuacaugcaaccucaagguauauaucagaggaaugaggguguuuuguuuucauauaguuuucguuugccauuagguaugaaagaaagagagagaaagaaagaacgaaagaaagaaagaaaucguuccugagcuagaauuuagaacuucaccggggaagcaguccaagguuugugaagaagaaaaccauuuuaaaacugugacaaugcaccuaaaagggaggggggggggaggucauucuuucuucucccaaagcacaaaaaagcacaacauauccccagcagcccguuuccuacccagccaauacaauaaugcuuuguaagcugagaacaguguccgguauaggagcuaaguauaaacagcugagaaggauuaggcugcagcuccauucucauuuacaugaaaauccuguaagcauuuuuuuuuuccucgcuggcugcgggcacagaaggaacucuuuugugccauagccacgcauacauuuccauccuuugucuuuacuuaccagucgaggcugugggcaugugugcucuauuuccuccaugguuucugagggaggcucauuggaaagggauuuugggauaccuguuucugacucagcaucagugguaaguacuggcauggccagugaaugcucccuccagcucuacacccucugggagucuccucccaggcaaagaauguuuucuuugucacguauuuuucucuucccuacccaucccccuucuucuucccuucuuuuuugucuucccuggggggaaguaaagagguuacccccacccccacccccaacgcacacaccacccuuuucuuucucggagaagcccagaggcagggccucaguuuaucacuauaacaaccagacagcacgggagcgucuggugcggauacaguauccucauuugcauggagcacgcugguugguuacugucaucauaguaccacuccaccugggagcggccggggcccauuggcuggccugccuuacccaccgggccugaacuugcugcuuuuguuuuuugcauuuaauucacuugugaaggucucugucagugccugguaaggacucccugcacuucuuagauaagauaaagcuguuuccugaggugccccagacgcgucgcaaaagagcauaaaggaccauucccuggcaugagcauuuaaugcaguuguagucagaacauuugcuaaauaggaaucguucugaaggcagagccacuuuaaagccccaaaccacuaggucaauugcccacuggcuucugagggcuuguccggcaacucacugugggcauccgaguguucaucuucuggacugcauaagacaggaacacugacagaugccuaaggccuguuguaacucugucuaucccuggggcugcuccaggaggaaguuuaaaggagguagguugucuuugacagccugccucccaggucuaacugcccucucuuccucagccagccuuuccccauuagucuuacugucaucuguuccacaguacacuuaucuaacaucccuauauccuauaguauagggccuagacuccuauccaagugcucauggaaaucugagggaaaaaaaaccacagugaugugccuuaguguuuacauuauccuaaaacaucaguguaagaggagucugaagacacacauuccaaggaaagaacuugcaaaaguguuuguucuagugaaaugccaugucuaauauuaguaagaaauaaaaucacuaguauuuguuaagcacaggugcagugccaaguacuuuacuuagaucuuccuuaaucuucauaagaacccaaagcagauccuauuauuauccccacguucuaaguaaggaaauugcaacuuagaguaauugcguagggucucaaaguucauaagcaauggagcuggcauuugaagaagagggaggaggagcagggagggauacagcaaguguagcacaaaaggaacuaaggaagaauccauucaagccgaauaaauccuuaugcuuccaaagcuuucauuuuguguuucuaacuacgguuucuauccaaguguggccacagaccagcaguggacaacaacagaaucaccagccagcaaugucuuaggagugaaaacuauaggucccaugacagauccaaaaaucaaauuuugcagguuugagguggggcuugcauuugcauuuuuagugagcuucuugguaauucuaaugcugcagguauggggaccauaacuugagaaacagugguucacaggauggaauaaaaauaccagucuuagccgggcgugguggcacacgccuuugaucccagcacucgggaggcagaggcaggcggauuucugaguucaaggccagccuggucuacagagugaguuccaggacagccagggcuacacagagaaacccugucuugaaaaaacaacaaacaaacaaacaacaacaaacacuaaaacaaacagacaaacaaaaccccaccaaaguugucgauuuaagucaggaugacguagcucacuugacacuaucaccuaugcuuaagagaacucuagggacuagagaaauggcucagugguuaagagcacacaccgcucauguuagauaccucacaaccaccuauaagugcagcuccagggagcuccaaagucucuggccuccaaaagcaccuauaaucacacacauauaccuacacacacccacccccacggacacaugaauauacacauaauuaaaaagcucuuugaauaaaaaagaacuccagugaugcaaaucucccagcuacuacccugucaucuugagaaggguccucuccuuccuauucugccugcccuucuagaaacacaaaacacucaggccacagguuuugcucuacugagaugaucagcauggaagaaacaagcccugcacuacauuuuaaaaaaauuuuuuaaaaaucauuuuauuguaaugaauacacaaagacaucauacaacuagauuaaaauagccacuccaaaaaauaaguuuggucaguccccaaaucuacauggcaaugaacuuuuacuaucugguuagaaugguccuucugaaguccuagagcuucacuugggcuuuuacauuuucauuguuauuuaaagggcccuuuucaccugcaguggacugugagagugccauugucagucuugauauuuuucaucuggauccacccucugucccucccacauccccccacaccccauccccucacacccccaccaagaagugguucucagagaguugugccccaaggaucggcccaacaauccuggcaacucuucagacauucucacuccucccugaccuacuaaaugagaauggagccuaggaaucugggauuuuaagagccacuccugguuuaguagguauugucacacgcgauaaaguuuguguguggaccaugagcuagagucacauauuuacacuggaaagcaccuaacucccagggcauacugggucagugagcugaugguaugguucuuaaaugguccucuaauucccucucuggaauaagacgcucaccauaagguaagagguuugcuugcuaauugaguuccugaagcccccuccccccagagccuggaccacagccuugcacccccagcuuucugcauuucuguuucaaaaugggcagauaccuuucccuccccuguacuucacugucccagcaaagcaaaggcugcuucuccauaaaauguggaucuucuuugagucccccaugucagacauugagaacacaacucauccuguguucucuccagcuuuggcuucuaguugcccugagagucagcuaaccagggccuuggcuacuaauccuauuccauccuagucuuggcuuuuuccaucccuuuucucuucagcugagauggcaggugugugccaccaugagccacuaugguacccuugucauaggggaaaaaaccauuacuuucuucuaaaaggcaugugaggcugggcuaguuagcacauguacaacuagaaaggcauguggagcucggugcaaagaaauccgaaagcugaagcaaggaacaaggcuauguguaauuaucacaggcagaggaaaugcacuggggugguuguucagaaacugucccccugaggcacaucuagauauuauaaccuauuucucuccuguugaauuucaucugagucacauccccaguuuucccucuguggcucaaaguuaaggucuaaaucuugacagucugaagagaagcagccauguuaagucacgaaacccaugcacaaauccuuuucaucuauuucagaaaagucuugcuaauaaagagaauucccgaugggaagcgugguacccuuuuuguaguacuuuuccccguuagaugguaucaguguagcacaaaaucgaauauugugaaauuucaaaugaauaaacaguuaggugcuuaggugacuuaaccaauguugcauaguaaaugauaagaguccaauuuuuuuuaaaucagaauugaacacuucuuuccacuaagcuauacugcuuugcuguucaauauaacuagauuuacuuuguuuaaaaacaaugaucaggugguucaggcucuuccuucauuguauccuuuacuccuuuucuacugacgucaugaaacaugaggcgcucuuugaccuguacaguucauuucaaaucuguauaacuauggaucuggacaucacagguucucacauuuacuucugacacaaaacucaaacauuuugcuuaagaaugagguugauacaaggccaggauucauaaagguaucugggggaaaaacuggaaaacaaaacagagcuucaaacuuauuuuuugaaaagaaaaaucaaaagauccagaagauagaauuaaagugauuuguuucauucuuaaauguauuuucuacuuuuuaaaaaaucuucuguaguaaccaagaguuaagccuucacucacuuguuuaaccaaaauguauugauucugagcccuguuuuguggcacuaaagugcaacugcauaaacccaacacaucaaaccuacaguauaaugaaaauguggcugacaaacucuggccuaguaucuuauauguaaaauaagcaggcuggccagcaggcucaguaggcaaaggcacugcugagccuaagaaccugagguugauccauggguucaugguguaaggaaagaagcaacucacaaguuauccuuugacauccacacuuaugcuaugggcaaggcagugacagacagacagacagacacacaccacauaaauaaguguaauuuggaaaauguaucuaagaaaacccaaauauuugacacucuaaguucuuaguagcaaagggaacagacagcagagcauuaauggcuguaccuguguuugagagagucuugaaaagaaacacauucuuucucaaaauacaacaaacauaucuaaauacugaugauuaaacucaguagaaauaugauggguuuuguuuuacuauauaaaccagauauaacagggauuuggggcagaaauuagaguuaccauuagcuguaaaaaaaaaaaaaucauucuuacugacauuagcagcugcguagucaguaaagaauuauuguugcuaucacuugguguuauuuauaaacacuuuuauauucuaagugcuuuacaaucacuuauugucuaauuaauaucuaaucaucuguuuacaaguaauaaucacacauguagugcaguuuaaucaaaacuccaagugccgcagacaucacacucaggaugcuguguaaauuuuggucccucccucaugggauuugagucuaacaugugacugaaacacaaaauacuauagacaaaaauggauaaaaauuccucacuuggauuugaacacucuuuaaaaguaaaacuguugcauauuaaaugaauugagugaaugucagccaauaaguaaaacucuagguaguuuuccacucuuuaacaagcuuaauuucaugugucuaugaaauuuuuguuugcuuaaccuacaacauuggaugguaguuucccuaaacauaaaaagccagacagcaacuuauugcaacugcuggucauagucacagucacaguuucagugauuuuaauaaaaaucaaauguaccaaaagggaaggaucuuugagguauucauuuaacuagguucacgucaaacaccugcccgucuucauucuucaccuuaaaugggguuacugcuguauccuguccguauccaucacaugcuauucuguaugcaaucacagaaccaugaaaggauugaaguacacauaugauaugcguagugaucugguuuuuuuccauucaaugaguuuucuuauaaguacaauuguuacgguggaguacuggcuuuuuuuucaaggcuuuugacauauauauuuuuauaccauuaccaaauuaucuuccaaaauguuugauuacaucuaguuucuuauauccacuuaaacaccuguuuuccuugguuaguaucugccauaauuaguucuuucuuuaaaaauaaaaagacaggucucacuguguaguucagguaugaacucacuagccugcagauaucaugacucuacuuccugaaguuugggguuacaggcgugccccaccauacucaugguuuugguccuuuuugcuguuucaacaaaacuuaguuucccaauccugcagcauauacugcaggguccugaggguuuucccaggggccauccaagugugacacagaugaaucggacaagcaaucaagcaaucaagaccagaugccaguauagaugcauucguucccaaguagauuguuauuaugauccuugaauuuuauacuaacagaauuuuuaaaugaucuuguuuccagugugacuuucucauaaaaucuacacucaaaaucuuuuaaugcccacacagagaguugguugaauuuuuuuguuaguuuccuaugaaugccauaacaauuugucacaaaauuaauggguugacaacuauacaaaucuauuaucuuaaaguucuggaccaaaguuagaaaccuaaagugagucucccuugaauaaaaaucaauauggccacaugacuguacuucuagaagcucaaagggacaaucugcuuccuucugguucuggacuuguagauguugcccaucuuccguggccugcuuucuuccaugggugaaacagcaaucauaucacucaagccucugcaucaauaaucuccucuuugcccuugguccugagaaggcucagugccccacuguaggggaaugccaggacagggaagggggagugggugaguuugugagcaggaggaggggggauacgauagagggguuuuggaggggaaaucaggaaaggggauaacauuugaaauguaaauuuaaaaaucuaauaaaaaauaaauaaucuccucuucuaaaucucuggcguccuuuguucacucagacucuggugaugucccugggucaucugaauaauccagagacacucuuuccaccuuaagacgguaaaucacaucuguagggucccuuuuaccauguaggguaauauagucccagcuucugaggaguaggacagacaccuuugcucuguuagucuuccugccacauauuccuuaagaggagccuggccugauauuucauguugagauauucagaagaauagauugcuuguaguuucaauacuuaguaauuaugagacccugcugucagguacaggcacgaugcccaguuggccgauaacaagcaguacuuggagacucuaaaugauucucccaggauuucggaacuugugcaaaacuggauuucaaauccagggcuguggcacuucaaagccuugguucacugcacacugcuucaguaucucagcguaugcaauguucugaucaguuuacucuccuuggauagcucucuuugagagcauuucauuuaauuugaauuuaauaguacaaauuagccagauaaagcuuuuauuaagccccauauaucuccuaguuuauucaguuagaagaugucagcauugagcaucaucaggaaacauacacuggaaaggauacccuggcuggggaugcagugcagacuccaugguucagcacuugcucaguauggacuagccucugagcuuuauccacagccagaaaaggaaaauggccuucacaucucccaccaaucuuuuuuuuuuaauuguuuaaaagauuuauuuauuggccaggcagugguggugcacgccuuuaaucccagcacuugggaggcagagucaggcagauuucugaguucgaggccagccuagccuauagagugaguuccaggauagccagggcugcacagagaaacccugucuugaaaaacgauuugguuuaaaaaaucauuucauuugguuguugggaauugaauuuuuaugacuucugcucguucugguaagcccguucccuuugguaaacugcacucauuuaggcccaaagauuuauuuauuauuauacauaaguacacuguagcuaucuucagaugcaccagaagagggcguccgaucucauuauggaugguuguaagccaccaugugguugcugggauuugaacucagcagcuuuggaagagcuaucuugcuagccccccaccaaucuuuuagauugguuguauugccaucaucacaacgugaguugcucugcagugugaucuaaaauuaauucauugcuugugagacuaggccggggccuagcaaacacauaaguggaugcucacagucagcuauuggauggaucacagggcccccaauggaggagcuagagaaaguauccaaggagcuaaagagaucuguaacccuauagguggaacaacauuaugaacuaaccaguaccccagagcucuugacucuagcugcauauguaucaaaagauggccuagucggccaucacuggaaagagaggcccauuagacacgcaaacuuuauaugccccaguacaggggaacgccagggccaaaaagugggaauggauguguaggggaguggggggaaggguauggggaacuuuugggauagcauuggaaauguaauugaggaaaauacguaauaaaaaauauuuuuuaaaaaaagaauucauuggggccucuucuuugugaguagcauguaaaucuccaaaagauaacucacucuguagaccaggcugaccuugaacucagaaaucugcuugacucugccucccaagugcugggauuaaaggcaugcaccaccacugccuggccuauccucugagccuuaaagccaacuauuaaauauuucucccccuaagaauccaugagaaaauaacuauuauuguauguguucccaaaagcuugcuaucuaaaaacucucaauaggcaauuauuuuaaauacccaguccguugaagucuuaugagaggcuauguaaaaugccuuacuaauccugaguagaguaacucuaugcaagccaauggucuucugcagaagcccauccuuacuauaaacaauuuuuuucuuaagcaaauuagugaacaugggauaagcauagcaucaacgaaaagagauucuuuauuccugcaaaauaacuugaauaaguucucucucauuaaaccauaggagcucaaaaaggaaggaaaucuaccauuuguuccacacgcuuuaagaaugagucuuuugcaauauugcauacgccagcaagauuuugcugaaaggacccugauauagcugucuccugugaggcuaugccagugccuggcaaauacagaaagguuguagcuuugagucaugaugacauggagguuagaauauuauuuaaaauaaugcucacagucagcuauuggauggaacacagggcccccaauggaggagcuagagaaaguacccaagagcugaagcggucugcaaccuauagguggaacaacaauaugaacuaaccaguacccccagagcucaugccucuagcuguauauguagcagacgauggccuagucagccaucauuggguagagagggcccuuggucuaccaaacuuuauaugccccaguacaggggaaagccagggccaagaagugggaguguguggguagggaagcagggcggggguaguguauaggggacuuuugggaaagcauuggaaauauaaaugaagaaaauaucuaacaaaaaauauauaaaaaagaaugagucuuuugaaauuuucaucaugucaacacauuaaggugacucaugaaaaucagagauucuaauucaguaggccaaucaauuagaauuuuguccaaguucacagggguucaucaacacuguaauagaguaauuaugagaauauaguaaauacaagaccuaccaggugaaacugugccaauaacaauucucaugaauauaucaaucuuuuuuuuaguaauagaaauuguuaaaagaacuuaggauccaaauugaagaguccccugccaaccaagauggagaguucaaacaucacuaagaaugaggguuauaauagauugaagccaaccaaauaaguuuaaguccauaaguccauaguacuaaccaagaaaaaaaagaagaacacagaauagcuaggguugucugucaccacauuugcuaguuauggaucugcaggccugugagcccaucacuuagggagacagaaggauuaggaguucaaaguuauccucaacuacauuguguguuugcagcuaccuugggauagauauaucagacccugucuggaaugaaacaaaacaaccaaaaccuuuacuugucuguauuggagggugcuaacuauuuugaaaauugggagcuagaaaaaggaucaaguauuaaucuuauguuuucugguacaaaccuuuuccuuccaaacuguuagcuugagucaucaauuagucucuucuuaaaauggcuacugaagaaggcaaugcaucugcucugccucuucccccuaucugcuuccugaccccuaaugaaugauuaaaucuaggcacugagcaugcgcgacagagaggcauucacagcuacucugugcuucugagucauccauaaaguagucuuccgaggaaauagaaccugacucugaccacaccucuugaucucauagcaauuuacaggaaacacagaggagauaaacaaauauguuaaccccacagggacgcaaucagcaaaguccagguuguagaaaauuccacagcagaagcuuugcuucuuagggccaaagaauuguaagaaaucuauugacuacauacagccuauaagauagcagucaguguagaguacagucuuaguauuucagauucaaaacacugaaaaaugauaacauuuauguggcaacuagaauuggacugauuuuggggugguaugaagauauuguuaauuuuuuagauauagcaauggcauuauauuuuuauguuuucaaaacuuuauuuuagaaauauauauuguguuugccccuguauaauguuuggauaugaaaaguggauuacauucuagaucagugguuuacaguugggugaaguuuugccccuagaaaguuuuagugauaucuauagacauuuuugucaacuuggaggauagugcuacagguaucuaguggguaaagcuauggaugcuacuggacacccuagaauguccuacgccaugaagaccuuggauuacccagaggcucgagguaccggagaaggccuuguaaucuuucuagcuaucucccucugggcuccuuaucucucuuuaaaccaucugcugucacaagaugcuuucuaaucaccuccucccuucuuuuggguacuaggccuucuguuuugucucaguuuggagcugcaaaacuuucaaucuucaauggguuucucugugaugggagucaagucauuugguccauuuuguuucagcauuaucuuuuuuuccaaugggguacagggcuacggaaguuagggacacaggccauuguuucuuuugaugacuauguaagugauaaacaauuugaaucuaaaagugacucauuguacuguuaccagucaaauugggcaagaccuuuucugaucugcacaugcaugacaaugaccccacccaugagguuacgaauaucuggaaugagcaggaugggcuaugaguugaucaccuugaagcaaguugaggaacacaaacauuauaaauggguauauacagcuuuaucuaaaugcauauacauuugauacuuuucuugaacaaaaauauuuuaaaaaaagauaaauaauugggcaggagaaauggugaagcaguuauaagcacugucugcucuuccagaggacccuguuugauucccagcacccacauggcaauguaaaauugcuuguaacaucaguuccaggagauccaauguacccuucuguccuuugcaagcaccaggcuugauauauaguaguuucugauauugaguaguguucugauuuugccuuugagucucaaauaccaaacuccaagcucacauugauuuuuaauuaauagacugugaaggcagggcuucucuucauuaacuacuagaaacgauguuccuucuucugauagcucuguagacuuuuuuuuuuucugccaauugaaagaauugggaugaacauauucaucaccacaaggguuguauuucuuuuguuuacauaacccaucucagccagguacagugguacauacuuauaauccuagcacucaagaggcugaaucaagaggcuugcuauuuuuuuaaggccagccugggguauagaacaagaaauugucuuugaaaaaaauauaauuuuuuauuauuuuauauaauuuccauuuagaugcuggcugccuaucagauagcuauuaaauagaaacuauuauguauuauuuacccuccauaucuguuauaaagccaggaaacauggaguugagauuuauaauaauaugugcucagaaagaaagagguuaaauauguauuuaguuaacucacuaacaguguagcuuugaacaugaaccgugucuuuaaauaugugucucuguaucugcuaaguaccuaucacaaaguauauauagguccuagguaugcauuaacucagacaagucucaaccugaagaucuuccugccucagccucccaaaaacugaguuuuaguuuuuuuuuuaagcauucugugaaacuaagcaaugauguuggcuauuucuuucaggagucccaagagcucucugaagguuuccagcuaguagauaagcuauuguagaucacuagguacuuuugcuuuaacugagcuaaaaaaaaaaagaugucgcaauuuuuuuuaaaugcaagccccuuguuuucucaugucuuuuuuuuucuugauuuuaauaaaucuguauuuuuaaagauuuauuuauuauuauaucuaaguacacuguagcugucuucagaugcaccagaagagggcgucagaucucauuacggaugguugugagccaccaugugguugcugggauuugaacucaggaccuuuggaagagcaguuggugcucuuaaccacugagcuaucucuccagcccaagagaguuauuuuaaacuaaauugguaagauauaguuuuaugacccugaaaauugccauugaauggcuugauaaggccaagaccacaguaaaagccagggaacaaaauucgaaagucuuaucuagugauucuguacucagaauauuuuggaaguaucuuaagcugucauuccaguuagaauuaaagaaaaccagaaacuguagacaauguaggugugcuugccuaaugaaaauaagacaaggcagaacacugagcacugcccuaaucaauaaaugauuaauguauauacuuaugguuuuccaaaugaggcuccauuauaaccauuuuaauuuucaaugaacugaaauauuauauguccuuauacaggguaagacaucuacuguaaugccuagugauugcaacucucuccaacuuuguacaguggaaaaaacacuacaaaauguagguggacaucaugaaugauuugugugauaauuuuaagaaaauccuucaagcuugguaugauggugcaugcacccuagaauuugggauguugagauuggaggacugacaguuugaggccagccugagccaccuaagaagaaacugucaaaaccaaaccaaaccaaaccaaaaaauaccuucaguugccacucuagaccaagcgcgcgcgcacaaaucuuauuaucuuauuccuuucuuuuuuuuuuuguuuuuguuuuuguuuuuuguuuuuuguuuuuuguuuuuucgagacaggguuucucuguauagccuuggcuguccuggaccucacuuuguagaccaggcuggccucgaacucagaaaucugccugccucccgagugcugggaucaaaggcgugcaccaccacgcccggcuuauuauuuuauuccuaucucucggaggcuggucuagcuuccacccucugggaaaggugagcaggaguuguaaaagcauaagucuucccucuguaguagccauaaacuuucagucauuauucuccuaugguaaguuguagacucacacaggauuugaggagagccuuguaaacaacaaucccagugucuuuguuauuggugcuaauguuaaugucaaucaaguuaguaguuacagucuaguugaaguuggucuacuugacauuaaaccauuucucaaaggcuggguuguaacaaauucuuuuucaugaaugaucuagagauggcucuagauggagaaacuucagagucuuugugggcaagaaaaaaaaaacaggauaaacagcaauuuagagguauuuuguuuauucaacaaaaguugcagcugggcagugaugacacaugccuuuaauuccagggcucagaaagcagagucagaugaaucucugugaguucaaggcuagccuggucuacagaaugacaugaguuccaugacagccagggcuguuaaauagagaaacccugucuugaaaacaaaacaaaaauaacuaacuaaauaauaauuuuaaaaauugcuuugguggcccaugcacucgggaggcagaagcaggcugauuucugaguuggaggccagccuggucuacagagugaguuccagaacagccagggcuacacagagaaacccugucucgaaaaaccaaaaagaaaaaagaaaaaaagaaaagaaaaugguaaguauuacuaggagccaugauuccagaugaaagucuccacuuucaagaauauguagaacaaacacuugacacuuagagauugauuuggaguuuggagauacauagcucagugguagagagaaugguucaaggccccaaguucaaucucuauaauccuucuccaaaaaaacuaagauugauuuuuuuccaguaaauaugguuuuuaaaaaaacucuaauaggguagaggggauaggggggcuuuggagaagaaacugggaagggagauaacauuugaaauguaaauaaauaaaauaaccaguaaaagagaaaaaaaaaaaaacucuaaucauacuguuuuuuauuucaacagaaauuauuuaaauucuuccauauuuuucuuuucauuuauuugugcguguguuguauguguguuguguguguguguauguauguauguauguauguauguauguauguauguuauacagaggccagagaaagauauuagguaucuucuucuauugcucucuaccuuauuuuuucccucacugaaccugaaguucacuauuuugccaggcuaauugguuaguaagcuccugggauuagagauuaggucccauugcuuucguagcaauuuuuuuuuuauuccacugagguauuuuucuagccucuuaugcuuuuuuauucaugacuuaaauaaauguuacuaaaaaaaaacagauuugaaauugauauaguuuucuuugucccagaccaugcuuggcaauuuuuggaguuccuuccuuccuuguaugugucuaugcauguagaacacgugagucugucuuuuugugugugugcacacaugugagagagaauuugucauuuguagaaaaacaaagaaaaucauuucugcuguaguuuugagacaagcucuugcgguugcugcacagucuggucuuaaacuccugucuguccuccaacucauggcaauacuccugccuuaaccucucaaguauggggauaauaggcaugcuacaucaugcuuggcucaaagagaacuuuaagcuguucugauacccaaggcaagauugaacuaaaaaaaaaauguaguuucacacuuauaaggccuuguuauuaaaaugaaacaaaauuaauuuuaugccaauuugcuguuuucuuuaucuuuugauguuuuagagcuagcucuaugcccuucagaauagaaaaacaaaaugaaagaaauaauaagucucuuauccccccaaccccccauaguucucaauguuaggaaacacugaaaaccccuauuuggucguaaggcuagaacuccugcuccaagucuuuuugccugaucacugggucauuucagugaacagggagucuuuacagaauuugaacccacuaaggcuugccuuggggaaucacagugggugagguauagugaaaaguuacuauacucuauagagagucaacuucugcuccaccugucaauagucagaggaagaagaaguaacauccaggcacucuauggcagugauccucuuucugcuaauugagauaaaaggcugugugaccuuuagaacagucuaccauaguguccaaaggacacaaggcuggcuguguuguguuagcagaugggugugcaaauacauacugcuucuguaauguacagggauuacagaaagaugggaggaaagaaggccuaaugauauguuagaauaaaaaguuaauaccuaaggcuagagagauggcucggugguuaagaacacugacuguucuuccagagggcccgaguucaauucccaacaaccacaugguggcucacaaccauuuguaauuggauggacacccucuucugaugugucugaggacagugaugguguacucacauaaaauuuaaaaaaaucucuaagagaaaaaaguuauuaacuccuuuacuuuuauacacguucauuuguuuuuugagacaaggucucacuauguaucccuggcuggacuuagaauuccuuauguagaccagccuagccuugaacucacagugcugggauuuagguguguaccacuacaacugaauuuuuccuuagguggcuuuuaaaauuuuuucauucaucuaaaaguucuaaaucuggcagauucuaaaaaguucaauggcagccaggcgugguggcgcacaucuuuaaucccagcacuugggaggcagaggcaggagaauuucugaguucgaggcuagccuggucuacagagugaguuccaggacagccugggcuauacagagaaacccugucucgaaaauaacaacaacaacaaaaaaguucaauggcuuucagauaaaacauaaauauuugguacacauuaaauugcuucuacuaauuucccuugucucauuguauggacugugagcuauacaguuucuuuagggaaaaagaagaaacaacagauaauauucuuugaguuuacugagagguggagguggaggaguuaguuucauaggagaguaggggugcauggggggacaugcucacaguacauuauuuacaugaauauguccuuauggaaucuaguauaaugaauauaugccaagaaauauaugcccucuguuugauucccuagcauagaaaaugugugucacgcacacacgcacacacacacacacacacacacacacacacacacacacacaaauagcuaagaacuaagugcugcuuucugaacaaaacaucuugaaguucuuuauucucugcuaucuaguucuuucuucuaaaggagucagccaauuuacuuuucauaucacauccucccucucgcuccccaaaugcccagaaguuaguucuuucucauaacauaggaaggccuuauccugcuacaaagacugguaccaaaaaagaagcaaacacgggguaguuuucuauuugauucauagauucuguuuggaaaaaugagaggucaccugagaaagugggaucuugaaagugucccucaauugacaggcuguuaucuaaccccuguguugugaaaugcuaugugcuagagccauaggaacacccuucuaggguuuugugggauacaaaggaugaaguaaggguuuuggaagugguucuugaacuggucaaaauaucagugcaggggcuggcgagauggcucagugguuaagagcgccgacugcucuucugaaggucccgaguucaaaucccagcaaccaaauuguggcucacaaccauccguaaugaaaucugaugcccucuucuggaguaucugaagacagcugcagugaacuuacauauaauaaauaaauaaaucuuuaaaaaauaucagugcagaaguauuuuuugcuaccaacuuacucuauguuccaagugaagagaacaaaaucaguagcauaaaaugaucuacauagaauuuagaaacagcuagaggguggcuaggaauaaguaggcuaaccacauuauucucuacaagggcaccuuaggggaucccuauuuuaaugaauaaauaaaaaugauguguaauuaucauaucaauugcuugcaacuaagugagugcuucuggaguuauuugauggugcuuaaaaaucuuuggucucugaagugcauuuaacagucuccuugacucuuaucuauauuauuaauuugcagaucaaaguuaacuuggcacuaugcaaaugaggagacuucaaaugaaugagauuuuaauguaaauuuuaaaauccauauuacuuguaacagaacugaaaccuauuuucagaacauggcucaacauaccuaaaagaaauauaguguuuaaagccuuacuauucaauagaacauucuaugauuguggcauguucuauaauugcauuguucaaauaaagguagucucaugagcuauauguaagcuacugagcacuugagguauggauggugcagcugagaaauugaauuuuaguuuauauuuaauuguaauuauuuuaaauuuaaauagcuagaauuggagagauggcuuagggguuaagagccagcaccuauuacucuugcagaaggccucuguucgguucccagcaccuauaugguggcucacaaccaucuuccaggggaacugaugccuguucuggccuaugugggguucugcaugcauauauguacaugcguaccuacauacauacauucaaguauauacauaugcacauaaaauucaauaaauuuuaaauaauuuuguguagcuaguagcugacuuccuuguuugauaggauaguuuuuuguuugguugguuuuuguuuuuuuucugagacagguuuucucuguguaacccggcuguccuggaacucacuuuguagacuagacuggcuuugaacucagagauuugccugucccugcuuccuagugcugagguugaggagugcgccacuuccaccuggccuuuuaaaaacuggauccuaggauccaguucuuccuuuacuaucuuggacaauuuacacaacuucuaggagcuucaguuuucacacuuaaaagugaggauuauaaauauaccucugaaguggguaagauccucuguggugagacauacauguaguaccagcucuugggaggcagguaucaggcaggggauuguggguuugaggccaccuagguuacauagugaaauucagcccaacuugagcuauuaguaagacuuaucccugcugggcaguggcagcacacaccuuuaaucccagaacuugggaggcagaggcaggcggauuucugaguucgaggccagccugguguacagagugagguccaggacagccagagcuacacagagaaacccugucucaaaaauaaauaaauaaauaaauaaauaaauaaauaaauaaauaaauaaaauaaacaaauaaaaaaauuuuaaaaaggaucauaaucuuaugacauuuccacuagaaaaaaagcuagcacuuuagaugauagugaagauuuuguuaaacuauuuucccacuauccccagguuuucuagguauucuuuuuuuugccuugaacuaccuauauuuccucauauggauuugacucuuuaaaaaaauuuuaauuuuuaaaauuaauuaaugaauuauaucccgaaugccgcccccuccugaggaguuccuccucugcccuucucugagauagcagccgugccauaucccccacucugggggcaucacgucucuauaggauuagguggugcauccucucccacugaggucagacaagacagcucucugcuacauaugugcaugcgcuggagcggggagcucagagcugcucuuugguuggugauuccgucgcugggagccccagguucagguaaucuguauuuuuggcuugaauuuugggcuuggacccagagcuuuacuuaccuauguuaaguauacacuccacacucagcuacaagcccaggucccaacuugauuuuuuuaaugauuuuuuuuuuuuuuuuuugcuguuaacucagggugaccuugaaucuguaauccuccugccucagucgccuaaaugccgggauuaacagcaugagugagccaccuccauuacaaucucacugagcauuucuagaaaacaaguuuguuccuguugucuaaaauccacccaaggaccuuacaaaacauucugaggaaagagaaccauuaaacacauugcuucuccuuuuuaaaauuuaccucaggauggaaaggcuauuacuuucauuuucagugugacugugacacacucucgcacagaggaauuuacuuuuccaccaauuuugauaucuaaaggagcagaaaggaagaggaaagcauuggcauuaccuugcgugagaauucguccuuguccaugcugcauuucugguguaccacaagguuuggccccaacuuucuuucgucucuaaggucuucucccuuacaaguucuuuugagucacagggagaaguuuaguggcucuagauguaugggagagacaauugguuuaaaaaguucaaggcagcuugauaugcccagugcugacagauaagauccaaaggacuaggagugucugguuuauuggauaagcagagauucaagcuguccaguccuuugcuuuauuugauuuucuacaaguguccucuuguccccucugggcuguuguucauugacaguugcugugcucuguccgcucugauggcuguugugugaggacaggcagguuguggugaaagcugaaguug

SEQ ID NO: 9612 - RNA, 5202 nt, Mus musculus
aagaacaaagggcaaagaagggagggaaggauauaaggaaagaggcgagaagucuuuguuguggcuuauucuuaguauuuacgaauaugcauucaaauaguuuguagguccggggccuacuguagaagaacaugagauacuguucugaaaguguaugugcagguagaucaugaggcaaaggcuuauuuggaaugcuuguaggauugaaacuucaaucaguagcuggaacauccuaguugccagccagcagcaaacuuaucaccugcagaauucccauucaaugaccaaggaccacauccccggaacugugcaugggacagggcauuuccccgaggccagccuucaccuugaguugugcuggugugaaguagaugacugaacgcagguguccuuagcuaagcaagacugggaaugaagguagcagacaggagucaugggaaggaagaugaaguccagccuucaauuucaauaauauguuaccauaugcuagaaacuauacucacugcuggacaugugacagugaccaaagcagagugaaaucccugccucaggagcuucccuuccaguggggacaagauagagugauuuugugcuucacuuaggaaacaagaacuguggggguaaaugagaggcuuaaaugucuucaggauuucccaaguuucucguuuuaagauaucagucugaauugugaaagucugucuucugugcuuggcucuucacugggcucuauggggucucugcugaggcccuuguucuacagcuucaguagguaacgggccugcgcccaugccagccauugucccccuggccaacagggagcaaguggucugcugagagaggaguucacagucaaaugucauggaauaaugaggguugccauuugauucuuuguaacagaaacucagcacagguucggauacaucuuuuuaggguuucagaaacaaucauuuaagggccagugagguggcugagcugguaacagugcuugccaaagacuggcaaccgaguucaaucucccaugucccacaugguagaaggaaagagcuaaaugcgggacauggucagcuaacuucugcacauaugcuguguguaacacuugcacacacacuaaguaaauguaauguuuuaauccaaaguuuagacguaucgagauaaugaguaaaaguugccgcuugucaggagacccuauuuaacacuugagcuccucagagaaagcuucccucugaagucuaccaguugauaucagcuguggucacuuaacaaaaugaaggcagugccccagccacagaagucuggagaaauggguccuguguuuccaucuuucucugaaguaggaguguggauucccccuaaucuccaugauacaguuugaaguagccagaaccugggcuguuacuucgugugugccacccgcagcuuccuggcagaagauucacuuucccucaaagggaauguuagaguggacucacccuucuccauacccgccucucugacuucuuggagcagaucugaggaggagcuuuaacugguaggagaaggggugggcauguauuuaauagcauccauagguagauccaacuucucgcccuuuauuuuauuuauuuuuucgcccuuuauuuuaaacagccagcuuuuacaugaacagaaucaccuuggaacaucaguacugaaaguuugauagucugauaccuguauuaaagaaaagcaccccucgucucacacuauccuuugguauuuuaauucacucaugauauccuauacgugcauuuugcuguacaaaacaauuuuacccaaguugcagagcugaccucaguucuccaccugcuugcucccuaaguguaggugacuacaggcacaguaccaaccaauucccaguggugacaaccuuugauggaggucuguccucaagucccuuggaagugaaaagaaauaaaacuugagcugugcaaucucugauccaguuaggccuguuggguuuuagcugaaacuuucuaaaagggcuagagaguugacauugugaggcugagggcaagcagaccaggauggggucaguggagaaaggagcaugaacuucaccugaaaaauaccucucuucuauaaaucucucaguggcauuuggauuaaucaagcauaauuaaacauaguuagguuuuuugucagauuguaguucaaaauaauauucaucuauggagaggguaauauauucuguagaaauuuuauuaagcauuuuagcuaagcaaacaguaaggagaacaaaaucagccucaggaagguuaauuacuaaaaacgauggaguauaguagauuauguaaaucauuuuccuuuugaauaccauggcuugagcuuuaauuuacauagagagguaucuuggauuuguuuuuuacauucugauuuucaaaaguaccaaauuauacuugcauucuuuaaaaguuguaaucacuccaggcuucuauuaaaccugcucuaacuucuuccuauuagaguuugcaaaacugaacugcaguuuccuuccaacgaauucucgcaggauuccaccucguuuguggaagugaugagagcuacuguuuuuauuucucuaccaaaugguggcuuuaagugcaguaucuggggagcaaguguaugaaagcauucagcccaggcgagccuuugcggacaguguucacugaaaagagaagagaaaagagagaugaaauugauuugaaaugcuauuucuccuugaguggagacugcucucuccccuugccuggcucaugggacagguucugaucagaucuggaacugguacguucagauuuggcacuugcccaaguuucacagugagacuuucgaaagcauugucaucucaguaguggaagcuucccgacgaaaccugaacuugcccuuuucauaagaagugaugcccagauuuccucgggguaggacagagacagaggucuaaagcccucugagauuuucagagaaacucccuucaguuggguucuguucggccauuuguuuagugccuuuucagugaagauccuauguuccugcagaacugccuccuuuugagauggugaacuuucaccuacaagaacaucccaguuaaguaauccugacuuccuuuaaacguggccuauuaauguaaacgcucucucuggcuaacuuuugcaaacgucaaagauccauauguguaguaacugagcaaugcuggccagcccugcaguuugcucaguaaagaggugcagaaguguggcagguggggcuggucuaauugcucucccgcucagccugacaucaccaauugauugaaauuggcccagugccaauagaauucauagugacaacagaauugcuucauguuucaaaugaucuuacccuccaguucuucuugagaaagaaaaagugcaaccuuagcacucagugggaacaucucuuaggcauugacgcaugcuagucacaaggagauugugacaguuaaccgugacgacaaggcaguggcagucaccacuuagcuaugcugaaugucagguccaggaagagucuaugaagucagucagggcaagauugaaaugugauauuguuuacauuguggaauccauuucacauaauggcuugcuuucucuuugucauuugaaucauuuuuagaagcuuuaaucuuuaucuuaauuaaaagcauauuuuuuuaagaauaacuucuaccuuuauguuaaauguugagcuuaauaucccacauguaauuaggaguuuugaacacauugacaacugaagccuguaacuuacagggagaugaaaagacuugagacuaccugccgcucuaaagggaccaggcuggaccuugcagucucacuuggcaaguccuuucaggaagcagaauuuucccaauuguuuauccagcaugaaaagggaaauagaagggccaaccaugccuguucccuuucuugcuggguguuauauaacuuccuggggaaacaucaccaagucaauugcuuucuuuucacaucaaaaaggaccucuuacgcaggguggugguggcugcagcgcacaccuuuaaucccagcacuugggagacagaggcaggcugaucucugaguccaaggccagccagggcuauacacagaaauccagucucaaaacaacaucaauaacaaaaaaguuccucuuagagcugagauauuauuuagaccaauagacauuugugagacuaauaaguguaucuugacucagauggcagcaaaguuuacuuauagugcuuuauagcacuaagugauuucagauguuccgggaacuuugcuggggauuuagcucaaugguugagcacuucccuggcauauguggaggccuggcuuccaccccuagcacugaaaacaggaaacaaauugcugugaauugucaucuccacaguuccuucuguccauuguuccagcugcuucucucuuaacgccguacucagaaucggagcucaaguugugauugcaucaguccuggacaauaacacuauuagaaaaaagggaaggcuaacccuaaucucugcugaguucguacuuuaacgugcuuugaaguuauaauugcugcuuaagguuuauaagcagagcauuugcucuuccaaguucccacccaagugcuugaaguggaacuguuucccauauuucgagccugaccuuagaaggccugggaagcacucgggcuguucgagaggugugagugaaaaaggucagugcuuugccaaguucucuuuguaacuccuugacuaauuaggguugucuacaugaaauaauugcugcuuugauaagagacaaauauuaacuuacacaugaaaugaauguucguugcagaguuuguacccauagguacaagucugagcugauucacucugugccucuguugacuuaaauuacagugaugaauguacacacacacacacacacacacacacauuuucacaguucccgagcaaccuugugguuuguaaaaugaagcucagccccauacguuaugcugucaugaaugaaggaugauuagauugggucauuugucacuccacguucuacggagagaaguauguugugacuguuggaaaacacaaccgagacgugcguggcuuggaccgugcuccuugaguugcuaagcaaucuguuguuugucauaaccaaaccaauccugccgcacacaggcacuucuguacccugguaaccagaacaauaaaauggcaguugaucuucccag

SEQ ID NO: 9613 - RNA, 67598 nt, Mus musculus
uaagugagaaauuccaagacaacguuuagagugcuuuaaucaauggaacagaaguaagcaaaugaacuuuaaaauaaaauugauacagauggacagguucuaacauccaaguaccacaccucacaaugagaacccagucagcugaagggggcacaaagguccaaaucagagagugaagggugauguauaugggacaggaagaacccugguacugaauuuucaagaugagcuccacugaugcauccgacugcccaagcccuagcuggagguuuguaucagaaaugagcucagaaugcuggaagacuucagacacuaaacuccauaacaagauacagaauauaggguacaagagcgcuaggagguucugugcucuuuugugacgggugcuaaugaugccacagcaagacacaaugaaaaauugcucaagcuuuaguggaagauacaaugggaaagacuaugggaagggcuccauggacauagugagccauuauaaagaaagcaacuaagcauugggauaacaauagugccgucaugguuaagaguugguagaaauacgcgucucugguugacuugcagaagguauucuuucuucagagacuucagagacagcacucagcuuucuagaaaguucuauuacucuugaucuugucccuauaaagaaaaggauccagagagcucaugaguauagucuccuuuauuuuaaccaaaacuuauucagaacauuuacaguaauaaguccaaaaccuuugccuugacucagaauuguuuucuauaguuacuccagaaaaaguagcauucuauuauuuauguaaacuuuacaaaaguuuuguucucucaaguaaaauuuuuauuagaagccaggugugauggcauaugccuuuaauuccgcacucagaagacagagacagcuggaucuuuguugaguuagaggccagccuggaauaacagugaguucugggacagccaggguuauguagagaaaaacuguuucaaaagaccaaagaaaaauguauuaaaaauauaaaguggcuacuaaugcauaugggccuucuucuuugcccgagaaagucucaauuugaaacaguggugagggcuguaaauguugaauagccccagcaacuuagcuguaugcuucaaaagagcaaacuaugugguaugagaaucauauuucaaaaagaaccugcugcuuuaaaaacuugcuagagacuccaucucuccauagaaaccccgacagucccauucguguaccuuuccugagcauguauucgcuuguucugguuauagagcuuaacaauuuuaaacuaccaagcucacuacuuuagguuuuuguuuuguuuuguuuuguuuuguuuuuuuguaaaauuuguuugaaaacaugcuggaaaguaggacugauuuuuaauuagcacccaauacauuaagcuauuuacuaugggucucacuauguaacucuacuuguccugggauuggcuaaguagaccaggguagccuaaaagucagagagaucuaucuaucugccucugccucccacugauguccaacaagauacuuggcuuacauacagacugaaaaugggacuggaguaaacugaucugauauggcuuucaagcuaaucugcuugucacuggcugagaaugguaacacugacaacacuccccucucccucucucuguaugugugcaugugugccuguaugcauguguguccaagagaaagugauacaaucaagccuuguguagguguucagagcacaacucuuccuugggaaaaaagaagcagccacuguggacaguggggauaaugguccugauccuaucaucugacugauggugaaugacuuaaucccuuuacauuuccugcuuugagaugaguugcauggagcucuaccauggcuuucuucugcaggaagguaaagcagcaguguggauaacccuuuuaucucuuuuaucuguuugacucuuuacaccacucauuagaaaacaccagcauuuacuauaauguuauaaaauugcaaagguauauaaaguauauuugcccauaaauauuacuguucugucauuuuaaagauuuuaagaaucaagguuuguauguuaagaaguauauaaaaaacauuauauauaaagaaaaacuauauaagaaaaacauuagagagaaauaaucaauguuaaaauagaaugacacuaucaauaugaacuuagguauauggguauauacaaugcacccauguaugucuguauucagaaccucuauccagaaaaggggcuuagaagaggcaaaaugugcaccccuauccgccaagauuagucucuaauacccguuaaaaagaacucuaaaauggcugauuccgggguaggagcacagaggguggaagaucaucuuaggauaauuuugucuugcuuguuuuucgagacaggguuucucuguguagcccuggcuguccuggaacucacugucuagaccaggcuggcuuugaacucagaaauccaccugccucugccucccaagugcugggaucaaaggugugugccaccacgcccggcugaucuuaggauaaaugcuggacaauaaaguaggacaacuuucaaaaaauuaacacacuguggucaauggaacacagaaaaucaaguucaaaaauaacuccaucuaaaagugugccaucuuaagcaacaaaaaguacagugacugccauaaucaauaucaugaauggauuucacagugggcaaagaugacaaggggacauauuuacaugugguuuuuguuuugucuuuuaaaaacaccuccagugaaggucagaaaacaucuaugguagagaaaagagaacaaucuggcuagaaaugagucuuccaggguaucaaaaguagagauguaaacguauaucaaguuauagacuuaagauucauagacauuccuacuauauguuauauacuucaauaaaaaagugcucagugaguauaauguguaaaauaauaaaauacauuuaaaucuacaaugcuuaaaaacacaaugcaagaaacuuguguccuauccuuuaaggcagagguuuucaaccugaggaucacggcccccaggggauugaaugacccuuucacaggggucaccuaggaccaucagaaaacacagauauuuauguuucauaacaguagcaaaauaguuaugaaguauaaacaaaaauaacuuuacaggcggaggucaccaagcgugagggucagagcauuaggaagcuugagaacgucugcaacagggaccagacaucaccuaaauuaugggcuauccauaccaucacuaauaauuucugguucaagcagaaaucaugacucuaaacauguaauucugcaacaguacugauggaguguuccagcaaaauagcauuaaaaagcuccacugagagccuuuuuaacaacuucugauuucuaccaaauaugguaagaaggaauaaacuaaaugguauuucagaaaugaacuaacauaaaacaguggaagcuauucuguaagcagcaacuuuucauuuuuaauauuuuacugugauaaacgauacauuauagagagccuaccaucagcuacuucuaagugaaaaguuuggugacuugggcauauucauaccauugcacgagcaucaccauuaccuauaccaagaccuuucucaucaccacaaacagaaagucuguauucauuaacaauucccugcucugccucccaugaagccauggcauccauccgucuauguucagacucugaaauggucacuuuagguaucuuauaaaagugcaauguaaucauuugcuauccaaguauggccuguuccacaucaaauaagacuucaagauccaucuacauugaagcaugcaucagaaucuccuuuuuaaagacuaaauaauauuuugcugugugaauuaacuacauuuugauuaaauuuaguuucauuuuccaguuuuaacccacaaaaauucucaccauauuucuaagacugacaauaaacugaaaacuuaauuguuuuaaaacauucacaauagaauaaacccuuauuuacugucaaucccucugaagugcaaggauuccuaggaccgagggaauuccacuuacacgauuauucuagcuacccaauucuuguucuccuuuucaacauaaaaguccuucuccgagcauucuuuuuucuaaggaucacuuugcuuucccaaugaugaagccacagagaaugcaugguguaaaauacuguucaauugucugccugguacuuucuggagacaaaucagauauuuuauaauggaaaucgaagugguuucuuacuguuuagccuuguauuuugaugcaucccuugguucacugcugggauugcuccagucaucagcuucaggaguggucuuguaauggcgccaugcagacuuauugaaaacuggcagccucucaaaggauucacuugaaagggccuauuacaaaaaaaauacauacaccaaagaucuaggauacuauuuuucucacaugaaacucacagauuuuaccccuuuaaaaaccaguaaccauaucuuuacuuuugaaauauuaacauuuauuuuauagauuuacuuagacuaaccaggaaaaauauccugaacccuuuguaaaugagugaaaucauuuacucacucacucacucagaaucaauacugaaacaauaugacaggaacacaauauauuguaauucacuuacuacugcuuugagauacucaauaguguugacaguguguguuaagaucaaucauuuuuguucaagaggcaauuguugcccaaaaagagcccaagaagaaauagucuuauucacacuagacuuauaaacauuugccaucaagugccauuaaacaucacaucauuuaugggcuggggauguagcucagugguaguagagagcaugcguaguaccaugcagcaggcucuggccuucaucuccagcaccacagcaagcaaacacagcccaucacugagauauacaucuaaaugacuaguaaagcugugauuucauuuccaguaaucaacuaugccucagguaaaaagaaugagccacuuccacaugacucaauguggaaaguucugcaggguauauuccaaacuuaggaaacaaaacugaccugcugaaaugucuuucgaauuagauuuuaaaucuauuuuauaaguguagaauaaacucuauuacagauuuuucuauguugcuaugcuuuugagacagggucucacuauguaucccuggcuggccuggaacuuucuauacagagcaggcuagccugcuucugucuuccacguguugagcacccuuaagggugugugcugccacacucggcuccucuauuagauuucugcuugucugguuugccuuugugauacugggaauggaaccuaaagccuuguacauguuaggcacaaucuguaugacggagcuacaucccaagccccuauaaauauagaaucaacuuuaggaggauccguaagaaacaaaaccccaguaccucgugaagagaaggauagcuuagugccauaagugaaacauugcauuuuccccuuugaagcuuuuaaauaucacuaugcucucuuaacuauugaaauaguaaguauaccaagauucuagaauucagaaauagaagucuaacacuaccaacaaaugagaaaaacugaguuuauacagaccuuaguuacuagauagacauuuuaaauggcuauuaguaugauuuuaaaaaaugaauguacaauguaauauguuccauuaaggaacuuuuaucuauaauguguuuuugcugauuccucuccccuccagcucuucucuuccaucccaacaucuguccccugcauccccuccuuucaacucuaguaguuucugcuuuuaugugcuauucucuucucuuccuccauccuccaaagccuuucuuuuaucuuguggaacucuuuauaguuuugugaccugucuggaugcucauugccacauauguacauauauacacaaauuaaaagccaaggucugauucuccccccaccuucaacagaccugaggauccuggagucugcagauuagcuucccuucccccacccaucucuguugaguccucggagacacccaagcugcccugaacagucuauuacaucgaguggaccuccauucucccaccaccucucuguauaccuucaccauaccugcaaauccugaaccacgcagaccugcugaucuggaacuacacagcccaaggcuauccaucagaggccugccauaccaggacugcugaggaucaccccccuccuaauaccuacuacaagaacaucuagggaccaaaaccauccagauggcuaaagguccuagaaagaaaauaaucaacaagagucagggcaauuugauaccucuggagcacagcuauuguacuacagcaagcccuggauauccuaaugcaauggaaacucaagaaaauggccuuaaauccaaucuuauaaagaugauagaggccuuuaaaaagaaaaugaauaaaccccuucaagaaauacaggaaaauacaauaaaaagguacagguuuuuaaagaggaaacaagucccuuaaagacauaaagaaaaauaaaauuaaacagguaaaggaaauaaauaaaacuguguaagaccugaaaguagaaauagaagcaauaaaaaaaagcacaacagagggaauucuggagauggaaaaccuagggaagaggacaggaacuacagacacaagcacugccaacagaagauggaagcgagaaucucagauguagaagauacaauagaaaaaauugauacauaagucaaagaaaauguuaaagauaaaaaauuccugacacaaaacacccuggaaaucugggcuaccaugaaaagaccuaaccucgagacuaugccggggucuagcaaacacagaaguggaugaucacagucagcuauuagaugggucacacagcccccaauggaggagcuagagaaaguauccaaggagcuaaagagaucugcaacccuauagguggaacaacauuaugaacuaaccaguaccccggagcucuuaacucuagcugcauauguaucaaaagauggccuagucggccaucacuggaaagagaggcccauuggacaugcaaacuuuauaugccccaguacaggggaacgccagggccaaaaagggggaguggguggguaggggacuuuuguagugugugugggggcaugugggggacuuuugggauaccauuaaaaauguaaaugaaauaaauacccaauuaaaaaaaaagaccuaaccuaagaauauuagaaauagaagaagguuaaaagucccagcuccaaggcccagaaaauauucucaacaaaaucauagaagaaaauguuuccaaccuaaagaaagagauauaucuaaacauacaagaagcuuacagaacaccaauuagacuggaccagaaaagaaaauccucccugcacauaauaaucaaaacagauuauuauauuuucuauagaacaaagaaagaauauuaaaagcugcaaggggaaaaggccagguaacauacgaagguagaacuaucagaauuauaccugauuuuuccaacagagacucuaaaagcuagaaaggccuggucaguuaucuugaaaccucuuuaaaacacacacacacacacaaacacaggucccaaccuaagacuacuguacccagcaaaauacuuaaucaccauagauuauggagaaaaaaauauuucaagacaaauccaaauucaaacaauauuuauccacaaauccagccucacagaaaauacaagaaggaaaacuccaacacaaggagguuaacuauaugcaagaaaacacaggaaauaaguaauuacauaccagcaaaaacaagggaagcauacaugucacacacacacacacacacacacacacacacacacacacacacacacuacaaacaccacaccaacaucaaaauaacaggaaauaacaaccuguggucauuaauaucucucaacaucaauggagucaauuccccaauaaaaaagcacaggcuaucagaauggaugaaaaaacaguauccaucuuucugcugcauacaagaaauauaaugauagacauuaccucugaguaaagggaugggaaaaaguuuuccaagcaaacaagcuggaguagccauucuaauaucuaacaaaauauuuucaaccaaaauuaaucaaaagagacagggaaggacauuucacaaaggaaaaauucaccaagaugacaacuuaauccugucccaaacacaagggcacccacauuuauaaaagaaauguugcuagagcuuaaaucacacauugagccccacacauuaauaguggcggacuucaacacccuacucucaccaacugacaggucaucuggacaaaaacuaaaccgagaaauaaugaaacuaacagacauuaugaaucaaagggaccuaacagacaucuauagaauauuucaucccccccaaaaagaauacaccuucuucucagcaucuccugcauccuucuccaaaacugaccauacagucagucacaaagcaagucucaacagauccaagaaaauugaaauaaugccuuguaucuuaucagaccaccauaaauuaaagcuaaagcuagacuucaaaaccucuagaaacaccagaaaaccuacacacucaugaaaauggaacaacuuucuacucaauaaagaaauuagacuuucuagaauuuaaugaaaaugaagguacaacauaccccaauuuaugggacacaaugaaagcagugcuaagaggaaaguucaaagcauuaagugccuccauauacaaauuagaaaguucucaugccagaaauuuaaaagcauaccugaaagcucuagaaaaaaaaaaaaagaggcaagcacaccaaagaggaguagaagacaggaaauaaucaaaaucagugcuaaaaucaauugguuagaaacaaagaaaacaauacaaagaaucaaugaaaccaagagcugguucuuagagacaaucaacaagauagauaaacccuuagccaaacuaaacaaaaggcagagagauaguauccaaauaaacaaaaucagaaaugaaaagggagacauaacaacagacuuugaggaaacucaaagaaccccacuaggucuuacuucaaaagccucuacuccacaaaauuugaaaauggacaauuuucuagacagguaccauuuaacuaaguuaagucaaaaucagguaagcauuuuaaacagccauaggcccccuaaagaaaugaaagcauuaaaagucucccaccaaaaaaaaaaacaaaaaacaaaaaaaccaaaaaaccaaaaaaacaaaaaaaacccagggcuagaugguuuuaguguccaauucuaccagacuuucaaagaagagccaauauuccucaaacuauucuacaaaauagaaacagaaggaacacugccaagcucauucuaugaggccacagucacccuaauaccuaaaccacacaaagauuaagacugaaagagaacuuuagaucaaauuucccuuacgaacacagauacacaagcuuguuuuuuuuuuuuuuuccaggaaagaaaaguuuauuuugaauauuccuaaauacuuugaauauuccuaaauacuucuguauuuggggacuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucauaacucuaaccaaacaagugaaagaucuguaugacaagaacaaguaagaaagaaauugaagaagauaccagaagauggaaagaucucccaugcucauggauagguagaauuaauguagcaaaaauagcaaucuuaccaaaagcaaucuacagauucaaugcaaucccuaucaaaauuccaacacuacaucuuauaggucuugaaagagcaauucucaacuugauauggaaaaaacaaaaaaacccaggauagccaaaacauuccugaauaauaaaagaacuuugggaggaaucaccaucccugauuucaagcuguacuacaaagcaauaaugauaaaaacugcaugguauugguacagaaacagacacuuugaccaauggaaucgaagacccagaaauaagucuacauacuuggacacaugauuuuugauaaagaagccaaaaccauacaauggaaaaaagaaaacaucuucaacaaauggugcuggucuaacagcaugucuacacauagaagaaugcaacuugauccacagucaucacccugaacaaaacucaaguccaaguggaucaaggacuucaacauaaaauggauacacuaaaucucauagagaaagugaggaauagccuugaacucagugguuugggagaaaauuucaaaaacagaauaccaacggcucaggcucuaagaucaacaauugauaaauagaacccuaugaaacuguauaaaguuucuguaagguaaaggacacugucaauaggacaaaacagcagucuacagauuggugaaggaucuucaccaacccuacaucugacagagggcuaauauccaaaguauauaaugaacguaagaaguuagacuccaauaaagaaagaauucucaacagaggaaucugaaaugacugagaagcacuuaaagaaaugcccagaguccuuaguuaucaggaaaaugcaaaucaaaacaaccuugagauuucauuuuacagcagucagaauggcuaagauaaaaagcucaagagauagcacgugcuggugaggacgaggaugcagagcaaggggaacauugcuuuauugcugguggaaguacaaacuuguacaaccacuuuggaaaucaauuuggugguuucucagaagauuaggaauaguucuaccucaagacccagcuauaccacuccugggcauauacccaaaagaugccccacuauaccacagggacacuuguucaacuauguucauaguaguuuuauucauaauagccagaaacuggaaacaacccagaugucccucaacugaagaauggauacagaaaaugagguacaccuacaaaaugggauacuauucagcuacuaaaaacaaaggcaucaugaauuuuucaggcaaauggauggaacuugagaggaaccugagugagguaacccagacccaaaagcaccagcaugguauauacucacuuauauguggauauuagccauaaaauacaggauacccauagucacacuccacagacccaaagaacuuuaaaaaagaaggaaggccuaugugaggaagcuugaauucacuuaggaggaggaaugaaauagucauaagaggcagauggaggaagggaacugcaugggagagaggcuggggagggaucaggaucagguguggggagggacaggagagauggccugauggccaugagaaugaauggaaaucugcaacugaugguuggggguuaggggacauacagaguaagugccagagauuuuggauaagggaagcucccccaaaucaaugaggguaaccuuaccugagauuccuagcagugggguauggaaccuaaagaggccaccuccuguagccaggcaggaaccucagugagggauugagauaccacucacccacaaaacuuuugagugggauguaaaguacaauuuuaaaaaagcuaagaucuucaugagagcaagcauuugguauuugucugagucugguuuaccucacuuauuucaagaucuauagauaauuuuauauaagcauauuauuauugcugacuucuuaccacuugagaaauuaaagcaaaagacgagaaggcuucagauuauugguaucugccuacuuuuaaacuauuuacuauguauccauuguucugcuuacauguaugccuucauaccaggagaggguauuggaucccauuacagaugguugugagccaccauguaguugcugggaauugaacucaggaccuguggaagagcagccaaugcucuuaaccuccgagccaucucuccagcaacuagguuuuucaauggacauauaauuuugaaaaacuacaucuaugguuguaaaaauuuaaguucauauuuccaugcuacaugauuuguuaugucuggucauaaaaucagggugagacauaccauggcuucauaauucugaugucuagguaagagauugauacaguauucuucuugacuaguuaugggcacuuccagauuuauaaagucaagaggccuuuauacuaacagaaacaaaacacaguaccuucaaauaaaugacugcaucgguacccacuccuuccauggaauacaguuuuagaucucccugaaaauaucuggcauacagacgagaaauuggcaagccauaaccaaauccagccuauuaagaaaagaaaaugaauaaaaugagaccaguacaaagcuucauaggggaccacuuacagaagauuaaaaugaaucccugauuuggauuuaaaucaaaugaauuaguaacucaaucucuuuaaugcugcaucuauaaucuauaaccgaaauucccuaguuaaaaaaaaaaagccaauaacaacaacaacaaaaagcaaaaaacacuugucaaguuuggguuaaaaaugucauuuuuuauuuuuauuuuuuagcauuuuaaaguaaaauuuuagcuauguaugagcauaaaaucaggguaucuuuuuuugagacaggguuucauguaacuaggcugaccuugaacuaacucguuaugaucuaagauugaccuugagcuccugaucuucuugccuuuaccuccuaaguacugggauuauaagcauagaaccaccaugccugguuuacgcaguagugggguuuagagucaagagcuuaaugcauaccaggcaaggauuccaccaacugaacaauacccugagcuccaaguguuacuuuucaaguguacguauuacaucugucgauaaguagcucucgucccuuacaaagagaccauuauggaagcuuacacuggccauaaugcagagagcaacuggccauugggugccuggccucaguugacaaaccuguaacucaauuccuauacuuaaggaucagggagcaucuuggaaagguggguagauggacugcugagagaucagggugucugcugcaagacagugucuuccuuccauccauccauccuuccuuccuuccuuccuuccuuccuuccuuccuuccuuccuuccuuccuuccuuccuuucuaggauacaagaugggaaguagagggagagggaauaggaaggagaucugugaggagcaauggcgagugaaaauuaucaaaauaggggcuggugagauggcucaguggguaagagcacccgacugcucuuccaaagguccagaguucaagucccagcaaccacacgguggcucacaaacaucuguaacgagaucugacuccuucuucuggagugucugaagacagcuacaguguacuuacauauaauaaauaaauauaucuuuuuuaaaaaaagaaaaugaucgaaauacagaguaaguauguuguaucaaguuuucaaagacuaaaaauaguauacuaaaaagcaaacauccaucaagaggaauuugaucugaugacaacacaaaaccacauucacuuucaaguuucauuaucagauuucccucgugacuaaaguaagaauuaauagcaaaagaauugaaauuuuuuugugggacagggucucucuguguagucuuggcuggccucaaacucacagagauuugccugccucugccucccgagugcugggauuaaaggcgugcgccaggcaagaguugagauuuaccaauaagauuaaagcacugaaaauacuucuuagguccuuccuaaggaucuagaaaagcuacaguauggugauacagugaauggguauuuuuagaaaaaauugaauuuucaaacugucagccaauauacauuuuuaaacaaaaggucacagacaagaauaaagaugaugauauaauagaaaugccauaucuaugcaguaucuaccauacagucaaacuuaguaggaugguucaauuugcugacaaaucugaggucaauaucugggguccacauaaaggcagaagugaugaucgaccccacagaguugucuucugaccuucuaaagcaugagcugacaggcauaauagauacucccaaaaaaugaaauucagaucuauggagaugagguugugccaugcgauaagucguuuccuacuguguaaaacagugacuuucaggcuguaccucaucauggaaaaguaucauuugucucuacugcacagauguauaggcuggguggauggauggcuccucaccuuacagugcacacagacaucauguguccaguaucauaaauaggacauaggcuaguaacauuucuaauguaaaaagguaccaccuauaaacuuaucuagguaaacugggaacauauaacuacaugaguauaguaagaucauuucaagugcuggggguguagcuugguggguagagugccagcugaccacacuaaaggucaucaauucgauuccccaacaucuccuaaacugaggaggcacacagcucuguucuucaagcaggaagaucaagaguucagggucacuguagcuucggccagcuaucagcccaccuggaugacaucagacgaugucucgaaaccaccaccacagacuagaucuugugcuggugagacgguggaguggaucaaaguacuugcuggcaacccugacaaucugaauucaguccuuggaccaacaaacagguaaagggacagaauucaacuucauaaaaaugcaugcacacagacuaacucauuccuucucucauacaaauaguuacaauuguuuaaaucugucauaucagcuagaaagguggcuuagcaguuaagggcacuuguugcucuugcagaagacccaggcuccguucccagcacccaugugguuacaaccauguguaacuccuguucuagaggauccaauguccccuucugaucucugcugguacuaggcauacaauggugcacaaacauacauacauacauacauacauacauacaugcaaaauacuuacacacauaaaaguuuaaaauuuguucaacuaaaaauauaugaaggaaggcccagauucauaaaacccuaagcgauuugcaaaggaaacuguuucuagaacugcacagcuguguaccuacuuaaaaguugaggauaguauauuaagugggagcgauguggauggaagcauuucuuccaaagcagcuauaauaguauaccagaaagcucacagacugcucuaccauucauuugcuuugacccuuucucccucaugggaagguggauaaauaccagucuccuggaguccucuguuucacaaagaaaaccauggcauaaagagcuacccucaggaugcucuuuuaaaaagacgugcaauagacaauccauauucuuuuuaaacaacugaggaagaugcaaaauuuguaccagaccccggucaggguaauacuauuucaaauugaucuuuuaugaauuuucuugaauccuguauaaaugacuuccucagucuuccacaugcugaguuaacaaacucugccucaaauaacaauguaaaguguuugauuuuauucauacaaauaaaauauaaucuuaugugcuuaucagucagguaggacuuuaaaaugaaacuuaauuuauacccugagccauuuugcagacugauagauacauugcuguguuuaauaacaaaggguucaauuguuguuugucaauuagaaacacucagcaggggaagaaaguguggcccucccaggaagaaaugcugccaugguaaccagaggcuaugcucacugccugaauuaaggcucaagguuauuucuagagugcuacagagagaccucugaaaauacauacaucacuacauauuuugugcuuacauuauucaaugugaaaauuccaaugacuuuauaauuaaauauuuuaauuauaugaacaaauuggacaguggugacccaaaagcugugggugacuugggccuccaagggagggcagcacuaaaaucucuccuacuaagcggaagccauacguucccacgggcccuuugcucagccauggguaauguccagcucucugagggcagugcagaguguaaguggcucuccagcagcagucuuaccacagagaaaagcuuuuucccacuguauuugggagggaaacacucagcuuggaguguuucuuggauaaauuagaaaagcacucucaguccaaagaccucacagacuaaauagcuaaggcagaaaggugccucugcucccaaacccgcuggaaacauccucaguuuuaggcaaggcuaguacaaccaccugaggagaugggcagcucccuacgccuauauuaaagaccauuucuucugcagcaguuugccaugcuuaccaagggcgccgcucuuguaggcuccaggcugggacgaggagcaguugaguacauguaguuaaaaagacggucuauuuuucgaagugggacuccaccaccuaggucacuuaucugcagugcacaacauguuaaaaauaaaaggggaaucaauuugugcuuaagaaggagguaacaagagcucauuaaauaaaguacacgcuaggaaggcucuaaaaugagcaagggcuuugaacucccacugaaaagugguuccucuggggccaguguaaacaaaggggacagaguagugcagcaaaauuugacaggcuugggaccgagguccugcuaaugaacauacaaugaaguaacuuaagccaaaaauccagcacaauauagucauguuucuauaaaugagagggacacacucugagaaauguaccauuagguagugucauugugcaaauaccauagaaggugcuuauacagaacaagaugacuacaaugucacuagacaauagcaucuuaugggaccaccacuauauauguggucaguucauugcugaggaagcacuaaaacauggcuuuacuuacaaauaacaaacacacucaagaacugccaggucccuugccuucccucucauaguauuaaauacauacuauucaaucaacugauaaagucaaaaugcaaacaaaagauuaccuuaauggacaagucuucuuuacccagaguaacgagaguuuuaacagcuggguagccuucuuuuuuaucuucauguaguucaacuguugcccucauugaguucuaaaacaauaaguucuuucugaaaaaccaugcugcugacuugcaaaguacaauuauauuaaagguacugauuauucuuggugcuggagguagaaccuagagccacacacaugcuaagcauguacucuaccacugagcuacacccucagccccgaaaaccacgauuucaaaaacgaaacaagcacaagauuacuuuuauaugauaauuacuuugcauagcuacuauuaauaagauuuauguggauuuuuuuuucuccacugagcuuggcuauccacggauuccugucaaggacauauuuucccugagcuucucuuuugcauugaauuguagccccauuccacauguuaaacaguuuuguuuccuuugcgggggguggggugggggugaggagacuuagggauuuuuuuuuuuuuugugggaaugagaguuguugggacagggucucacuaagaagacugggcuggccuugaauucauugggauacaucuguuuuuaucugcccacuggugggguuaaaggcaugugccaucaugccugguggcuuuaggguuuuaaaaguauucaucucaacccagaaagaauguuuuuauuaaauguaauguggcuacagaagcugguuugugcauuuuaaaugcuauuuaucacuugcauuuauaaggcaccuauccucuaauaugcaggcagaaaaacugaagggauucauacuucucauaaaaauuaaucucuggaaugaaaaaaggauaauauccaucaaaaaggaguucugcaaaguuccaacugacaaagagaacgcucacaacugcaugcccauccuaguguuagagcaggagcauucguguucuugggaagaaaccagcacaacugcuucuuuagguauucaauuuaguguuuuauacauuaaagugaugaaauguuagcucaaauacccuguacucauaacacugcuacuguaaauauaacuggcaacuggauaacaaaagcaacagcuuaggccauagagagucugaaaaagauuugguuuucuuuccuuuuacauccagacuccacauuuucccuccccugccucuaucaggucuucugaaaugauucaaauuauaaaacggcuacaggaucucccaggacgggaagcacuaaugcaugagcacagcuaacgcuccggaaucauagccacacagcagcagguuuuuauuuuggucuggcaaucaccaauaaaacucuguuaggcuugaaaaucuaaaaagcaucucuaaccuccuaacugaaagaaaaacaguacagauuugaugugaagucaccaaaguauaauuaaguuuugaaaucaauauguacuaauauucacaaaacuauaguguacacagcaauuuuucaucucacaguguacagauuauaaagcccacaggauaucagaaauagacuucuuaaaaugguuaugcaaaaucuuuuucuuaugcuaaucuaaugaauccauuaugcccagaaucaaagccauuuaaaaugaagacuucuucccauguuuuaaaauuccacuuaccuugaacagcucaaauagcaugugaaacagaugugacggcacauaaacuaccugaauggguuuguuuggcgcuuuggcugaaaacagagacaaaaccaucaaugaauaaggaccuaaaguaggagaaaguaaaaaaugaugcuucuauucuauuuuccaagcacaucaaacaaauauccauaaacgacaaauaauacagauucccacacugaaugccauaacugagcaaagcuuccggaucacgcaaaaccgcagugacuaacuccaccuccuuugcugcagcucaaugacccugagaaaccagccaaccucuuucaaacuuugucgagcaaaacuggacgaggaucaccugugccaugguauucugagcaucacacgaggacauacaaagaucacuuggaacuuuucaaaucagaaguacagaucugcuaucaacagagcagagccaaaugaaagggguaguaaguuuggacuuaaaagcaccaugguuugaauucaacuauucacugaaacauucauguuaaaggcucaacuagcugccagaugauaagcuucagggaaauguagcaagcaagaaggcucugauaggaugagaaaugguagaaaauaucaggcagggccugguuggagucaguucuuagagcauguccuugaagaagcuaucucgucccuggcauguucuuuguucuuuccuggcuacugugagggaagcagcuucaucugccacauucuccugcugccaugauaguuugccuugccucaaguccaaagcaauggaaccaagagacauggauugacaccuuucaaauugugagccuaaaccaacccuuauuacagagacaaaaaguaauuaaaauguacuauauuauuauaaacagagcaugguauagacuagacuacgagguucacgaacuuuucuacuacaaugaaauccuugagcaucuauaguauucuccuugaaccagggaucuucuaaggaaccuaaugcaaagcacuaagggcaguaugugggagagagaugcucagcaugaaaaguccuccuccuuccucaugacaugcaagcagguaagacacuaaaacaaacuuucucaauuagaacagauagcuuagaacucaguauuuccucuaauaaagucauuaauaauaccaauuagagguaagaaucauugguucuaaguaauuuauuaugagccucucuagucaccauguaauuguauccuuauguaauauguacugaucuuagaguaggugcuaucaguuacagaugaguaaacaagccuuggaaagcuggugugaccgugguaacaaaagggaugcugaaauuggacacacagugcuguugguuuacaucucaugugucauccaaggccauauguuaaagacuuggcugcuagucugugguacaaauaggaggugcuagaaccauuccgagguaaagccuagugugacgaagacaucaaaggcaugucuccaaaaucaaugucgguugacucuaguacuuccucccuuucuugcuuccuggcauccaugaaguaaacaacuuuagcccaucauauacucccugccauaaugcugcagccugccaugggcccuacaggcauguacaacaguuuggcaccuacaaaauugagaaccauagaaccauacaauuugacuugauacacacacacacacacacacacacacacaagggggggggagaggagggagggacccuaacuguuuuaaguauuuaaguaguuuaugguuuuguacugagcuacacacauggugcucuagauugugggucagacucacauuuguaacaauagagccaaacuaucauggauggaaaccucuaaaaccauguauuaaaauaaaucucuccucuuuguugcuguuuuucgagacaagguuucucuguauagcccuggcuguccuagaacucacuuuguagaccaggcuggccucgaacucagaaauccgccugccucugucucccgaaugcugggaucaaaggcgugcgccaccacacccggcuuuucuuuuuucuuuuuuaaaucuguccucuuuuaggguguuaucucagcuauuuuaucaugcuaacugacuguaccuaauacaacugcccuaagaacauuuuuaccagguagggggaucagaccuagaacuucauguaccuuaaaaaaguacucuaccaaggaguuacgcuuuaaggucccaaggccuuugauaaauuauuuguaauauuuauugauguguuuaaaugguugaaaaucuucuaaaaacagaaagccaaaguccuuuuaccuccccucucugcccucuucauuucugcugucgucuuuuaaaggcuaguuacauucuguucuauaaacuugaccauuuuauuuguucccuagaggcucuguuaagaaaguuaaaaaucaguaauguugguauuauucuauguaguaccaaucacuauagaacagccacaaaaguaguauuuccuucccugggagucaauccauguguugcuuggaggaaauacuuucagccuuacaguggaauggauucugucuauauucuuccaauugcucaucaucaccccuucuagaauguaucacaaacaguuuggagguuuguauuggaaacauccucgaaaacucauguauuuggacacuuggugacacuauuuaggaaggcuaugggauauuuaagaggugacacuuugcuggaggaaguauuuuauuuccugcuugcuuucauccuucuuucuccuaucucuuuccuaugugguaaugagaaugugacuagccagcuuccuucucuuacugccaugacaugccuuccccaccacgaaggacacuacucuucuggaacuauaagacaaagugaacucuuuccuucuuaaauugcuuuuggucaugguaucuuaugaugacacaaagguaaucacugcacaguguaugucuuucuuaugugcuaugcauuuuuccuacugggucgaaucacucuccucuuggguagccuuacuguaucaccaaaucuucuagcuucuuuugcacgguaugcauacuauucuuuaggaaucuuuaaauuagauucaguugcuuuuuaaaacaugcuacauggccaucucugggcuuguagacuguugcauauauuucuuacaucuauauuauacagcccauugaccuaguuauauaaccucccuuacagaagugcgcaugggaagacaauccugauaacccugucucaguugaggguuuggauagacacagaaauggaguugaaugugacaguguuccuuucccuuuggauauugccuagagggagaaggcugacuuggaguguuuuaaaaucaagacuccaccggcuuuagaauaagccuuuaguaaggaagaugacaaccagagagaccuucaaaugcuaaaaugaagguuucacuucagaguaauguuauucacuaucgcaucggguaaguuguucucggauaacacacuuaugugacuguugguagcggagccuagacaguguaaagcuacucccugccaucucugcaggcuucccuuagaccagcuuucagcaaacuaaugccaaucuuuuggcuucuuuccuguucuaguuguuuguaccacucagcucugcucccacggucccucucucguggaucacuggagaaauggcugccaugucugcagcagcuuacuccuuuuugcucaguccuggccugguguaucacucagcauaccucuaucuggcuguauucuuccacacguuggcacuaauggguugccauggacucacugucuauguccuucucaagucagaccuuaaaacuuaauuucuaaaaugauggcacuuggaggugggcccuuuggaguucauuaguucaugaguguggaaccuuaugaaugggauuagcacucuuauaaaagacaccccaaccccagagagcuccuuggcccuuuccuacaauguaaaggcacaccaagaagucaucuguaagucagaaaauaggcccucagcagacaccaaaucuguuagcaccaugaucuuguacuucucagcuuccagacucaugggaaacaaaugucuguuauuuaauccacccagucucugaugguucuguuuuaccagccugaagggacuaauacagugguccacuuauaagaguccuuggcucccuuugcucguuuuaugggauucuuuuauugugguuguaauggggccugagaagcaagcugagggcuuaguuuaucuuguggcaaacagcaucauuaguuauauaaacagccucagaauucaauucaaccuuuucaguccaaauuucaaggaaaugaaaaacauuuuacaguuuguuuucuucucuuaaguuuaaacaacauucucuaggagucaucgaaaggcuugcucaauuauguguacuuuucuuugggaauauuacaguugacauuucuuuucuuccuuuuagaaccauguaaaauguguuuggcuaugauuccucccuucuccugggccuaguggcuauaguggaugauuaauagaggcuuguuggcuuucuaaaauaagaugagcagaauaugaauauucccuaauaguacauuucuaaaagucaaugaaaaaaaaaauggucuggguuuuuuuaugcuugagacucacgaaauaauaaaaucuauuuugcacagucauugccugaaacaccauuaguugaagcagcacuuaauaaaugucaacagaauucuauacagacauaaggaauuuuacuuucagauagcuuuccuguaagaacgaaaaauagaaacuggaggcuaagcagaaaaaaaaccucacauauaaaaggaaagguggcaacacaagauuaacccccaauugggugagaggaaaaggcuacuaaugagcacaggguacacugcacaguccuuuucaaaagggacucauuacauccccuguugacuaaguggauacgagccauuuugaaacaacauaaagauggcaaggcagccagcccuauuuuaggacuucuuggacagacagcuuggauauuagcauuuaaguccccuuuguacuuaacauuaaaauacuuuuucuugcuauggcuacacugcccugacccagccugaucucaucuaaauugcuuugucuuuuaccauugaauucuucaacuucuagcucuggagcuaccagguaauacuguucacaaagcaucuuggcuguuucauaugcaucuguuaagaaagaaaaauuuaauuguugcauuaaugacagauauaaacauguggguauauacauagaaauaaagaauuucucuaaagggacuucaaaugaaucaaauaccaucuuuuaaaacaaucucuugauuucaauacuuacuaugacuaaaauauuucucuuuucuauguuuuaacaacuacauccauaucauaaucauagacuaguaacaauaaaguuagguuuaugcuaaguacacaacuguuuaacuucuaaguaccgcuaaaagauauucuucaugcaaauuuauaaacccaggacuguacuuuuaagcaccacagaaucugaguaaauuguagcaagacaauucuuucuauaauuuaaaauauugacaacuguuaggccuggagagauagcucagcaguuuugagcacuuugugcucuuguggaggaccuagguucaauuuccagcauccaaugguggcucauagccacccauaacucaaguuccaggagaccugaugcccucuauggcuucuauaggcaccaggcguguacaugguauacauauauacauggaggcaaaauauucauauacauaaaauauaaguuaaaaagugccaaaaguuaugaucuucccuuuacuagcaaaugaaaccccaauaauaaauuuaguaaucagguuuucaugagguacagaauuuacauuauuugaaccacucauugucuuuaaaaugucuguuaaguuguuuaagaauaacagcuuagagcugauauaaaguuuaaggugcaagagugugauaaaaauguucauugugauaagggguguacaaccucagacaguacuaaauaugacugaauugcaugcuuacuauaaaugggugaccuguaaaagaauaucacugcagaagucccacacuauuggcagcuauuccucucugcucuaccgugcccugcccuuggugaccacccuucuacuucaucugaugaucauucuggacagaucaaaugaagugaauccuguaauauguggcguuucaugacuuguuucuuucccucagcauaguauuugcgauggcuauuucuguccauuugacauaucuagggucacccagaaaaggagucucaaugagggacacuggucuauacacauaccuggggggauuauuuugauuauauuaacugaggugggaauaucugccuaauuugaguuucaccauucccuaggaagggaauucuaaaguaaguggagaaagcaaggcaaacacgagcaugcaugcauuacuucauuauucuuuugcauugguugcagaugucaugugacuaauucuaucaaccuccuuccacuacauuucccugccaugauggaauguaaccuggaauugagagccaaauaaaccccuucuccccuaaguugcucuuguuggggcacuuuauuguagcaauaggaaaagaaacuaagacaguguuuucaagggucaucuauguuguaacaugaaccaguagucauuccagagauuuaaaguuccuaguacauacuuuugcuucucauguacuuaggaauacgaaagcacugaacuauaagguaacuccauguaagcacuugagagcugcccaacuguuuaccagaacaagacuuuucaguuucaccuuugcaauuucaaauuacuuuaucauauuucaugggcacaucugcaauguucucagcaccauaucagcuucauggagauggucaacacugcgcauagagaauguauucacuuaagauucaacaggugacagaaggaaagauagaaagggagagaaauaagcuccagagaauuucaauguuaaaauuugacaguaaacaccguaaaauaauacaaagguaagaacaggguauguucagacucuuaaguucacuuaucaugcauugcuaccaaaucagaauuucauauucuaaucauauaauauuaucuguccacacauuuaaaaaaaucacaucuaguuaaacuagagacaccagacacagagacaucagacuaauucugacaagauacaacaaauauagaaaacaaaaagcaaauagcaguaagaacagaaaauaacucuuaaaaaauuagaagugugaaaacagacauuaaagugggguugaauuuucacacugaaaaaagaauuuuaaacuacacuaaauuugcaaauuuucucuaggacauaauaaaccucauuaauuguauauaaaauacuuguuuugagagggagaaagagagagagagagagagagagagagagagagagagagagagagacacggacgggccaggucuuuuugcuuuggcuagucuaccaaacaaugcuacaucuccaccuagugacgugauagcacaaaagcugaccaugaacuuuuaagaccccaaauacugaaauuuauaaugcuucauuaucuauauacaaagucuauauaccacaacucuuccaaauauauaauaauguuuaaauauugaacuucuuuuacuauaaaauagagacagaaacuaaacuuaauaaauauucuaauuauccauggcauuagcuuugccauuacuaugagcauaguaacguugaaaacaugcuaggcaaauacaguguguggaggacagccaacuucaaacuuaguauggcucuaaagaccauauaugaaagaaauacuuuuaguuucauuauacuauguaguggaucaaugcuuaauuaagaauuaucucauuuuuccugaaaaucucaagacauugcaauguagacucacauacauuggcccaccaacagauguuggaaguauuacuaauaaaaauuuauuacuaugcacaaauucuaagaggauacuaaaaugcuuuggauaaaauacauauauaauaagcaucugacuaagggauugggucuauagcucuggaguagaguucuugcuuagcauauaaaaagcccugguucaaccccaaacacuauaaaagcaaaaaauaaagcauuugcuaaauggaacaauccucugcccaaugauaaaguuuuuacuauucacucaauuaugcuaccaaguaggccugauguggugacauaugccuuuaaucucggaacucaggguuagaaggcagaagcagguggagcgcccuaaguuuggggccagccuggucuacauagugaguuccagacuaaccauguaauuauggagaggaucuaaaguaacuuaacguaaacuacaaucacuucaaaauucccaacaaccauacuacagcuacuggucuggacgcuuccuuuacaccuagaauuuugauaagcuuaccuuauaguaaguucucuaauaaaaaacuuucuauuuuauuuuauuuuuuuuuaaagauuuauuuauugauuauauguaaguacacuguagcugucuuaggacacuccagaagagggagucagaucucguuacggaugguugugagccaccaugugguugcugggauuugaacuccggaccuucggaagagcagucgggugcucuuacccacugagccaucucaccagcccaaaacuuucuauuuuaaaacuagaaauuuuuuugaaaagcuauugccaaacuaguuuuaccuguacuauauuucaguuagauuuauggcuaaucuugaaaagaaaacauggaaaauuguuauucuuauugccaguaaacauaagugauagucauugcauuaagaacaguugcaaugguaauggaguguuuucaggagauccauccaugcauccauggcguaguuuucagaaauaucgcauagggaaaguuaacagauuacaggguuauuugauuagacuucucuaguccagaucuaccaaauuagucucccagauuuuaugugaacucacucguucacaggcauauggagcuagaauuggagugcugacauuuuuucauucuuuuccgaaaagagugauccaaaagaauagauuauuuauuuacaggcauaaagaaauagaguuuugaaauaaacaugucaaagacaauaacuuuaagucugacagaauaaagaaaaaucuuagaaacucaaguuuaaaauuccuaucagaacaaaguacucacaaauagccauaaaagauuacaaagucauaaaauaacauuuuuauuuauaucuuauguguggugugugugugcgggugcaaacacacaugccucaguacaaaggaaagucuggggacaaucucaagggucaguccuugccuucuaccuuguuugagacagaugcuuuacacagguucugggaacaugaacuuagggccuucauacuugcauggcaagcacuuuuauaaacugugcaaucucuccagcucugauguuuuauuuauuauuuuauuuuaugugaauggcuauuuugcauguaugucuaguguacugugggcaugcugugaugcaguacccacagaggccagaagagggcaucagauccccugaaacuugcuuuacaaaugguugcuagcaugugggugcuaggaguuguacccagcagggccucuggaagagcacucagugcuuuaaacugcugagcuaucucuccagccucccagacucaagauucuuuucuuuuuuuuuuuuaaaacaaaaacaauaccacaccauuauuuucauguguaauaauauaagguaagcaaaacaacauaagcaggcauuuucaaacuuccuugccaaagcaaagucaccuaaaacggccaacuucuuaacugaugcuccuuuagaauuccuggcaccccacauagcagcucgucacuaucuguaacuccaguuccaggagaucgaauaaccucuuccggccucugugggcaccaggcacucaugugaugcacagaaauguauaauauacccacacacagaaaagaacaauaauuuacgaauguaaaaugaauuuuguucuguaugcucccaugugagcugagagugguggaacacagcuggaauaccggcucuuagaaagugaaguaaaggggaucaggaauugaagauuauccuaggcuauaccaaguuugaggcgauccugggcuacaugagauccuuucuugaaaaaccugaacaaaaaccaaaguaaacacaauuuggcucuccuacugcauaugcaccuccucccugagccacaccucaacuggaacccacuuuguaaguauccuaagaugaggcugaugcguuacauauaccucaccggcugcacuguuuggagccuggccaccuauggugaauguucacaauagaccacacugaccccugugcucccuuagaaagaaauuuccagaaccaauaugguacuuuuuagaaauucuuuaaguuacaaagaaauauaaagcaauauauguuauuagcuuuccuacccaaaauccauuccaaagcaguagauucuccaaugucauaaaccaagcugcagaagugcaggcaaaacaucuaacauaaugaauccccaggcaacccagacuauuaaaacuuguagucacggguaaaaccaagaugaacugaggcaagaaaaccuacuuuuuggaaacucaagauagguuauuuggaaugaccauaagucaaaagggcacugagaaguaucauaauguaagaaggcauagagugcuuggcauugucuuaaguggguucagucaaguuaaccagagcauuaaaaaaaaaaaaaaggcaagcagagaggucauaacuugacaacuccagauaccuaagaaaauagccugguauuuuguuucccaauuccaguaucuauagcacugacuguaaaguguuucauguccugaccuacucaguuauuuuaauaaaccuauuucuggagcuagaaugagucuguuacuugcaaucuaaggaggucacauugagagcauaggauauuauuucuaauccaaaauaauaccauacacucaggaggucauuuguaugcuaucauacuaagcaauaauaacauauaaaagugacauagaaaacuuagcaagacugcaaaaguuaacuuuuguaccauaggaaagcuauaaguuuguaucuuuaaaauacucucauuacaggauuguccauuugauugucuuguuucuaacauagaaaggaggaagaagggacaguacagaaugucccucccaaaggacaacaggaguugccuccaaacaguaauucuagcauucacuacugacuguauuuuauagauguauaaagguagaaaucaauguucugacuaugccugccuugaggaggcaugcauucagagaggucuauguauucaguuacuauuaugcugggugaacccuaguucuacacauuuauacaacuuucuaguaaaaaaaaaauaguguuccuacccuucuacauaaaaauugucuguagucugucucaaagggccuaaauaugagaucaguuuuaguuaagacuugugaaggcuguaaaacacacguguacacacacaaggacuugaaugcacaggcacacacacacacacacacacacacacacacacacagggucauuugggauggacauauaaguacacuuaaaccaugcaagcucuucacagcuaaggaagcaaaaaaaaaaaaaaaagcauuuugguggcacaggccucuaacagcagcuacucuggaggcuccuacacaaggacaagcuugaggccugcuugggcuauagagcugagggcagagcaagucuggcaacuuaacaaggucuguuccaaaaucaaaaacaagaagaggguuggaauauaguucacuuguggaguguuuucaugugaggaccuggguucagucucuaguauuauaaaacaaaguucucuagauguagauacuuggaaagcacuugaugugaagggagguugcuauaaagguuucuguggaugugacuuugcagcaguguacccuuuaggaucugaaaccacccuccaaugccauuuaacuuuaggaaagagacuauugaaagaugaaaacuguugaaagauuuacagaggagcagagacuguguuagucuuccggccucaccucauaaguauggugguagaguguguguauguauguguguguguauguauguguguaugugugcaugucuguguauguaugugugcaugucugugugcauguguguguguauguauguguguaugugugcaugucugugugcauauguguguguguguauguauguguguaugugugcaugucuguguauguauguguguauguguguaugucugugugcaugugugugugaguguauguguguaugugugcaugucugugugcauaugugugugugugcugggggaaguggaaugagagaggaacauggggagucccagucacaacauagacuuuccccaagaaucugggcuuuaguuaguuaugccucuucccaaaucacacaagugaauauaguaaacuuauuggcaacauacuaggcagaaaguuaaagggagggguagacggccucaaugggcaggaacccaaggcuagauagcucagagacccaaaacugauugguaaaacaaaacaaaacaaaacaaaacaaaacacaaucaaugaaguuauuccuaaugguauuccacuauacucauagaccgaugccuagaaaggcuucaucaagcaacugaugggagcagaugcagacacccacagccaaacacuagguggagcucggaggauccuguggcagaguggugagaacaaacuguaaaggccagagaagucaaggacaccaugagaacgagucccaccgaaucaccuaagcugggcucauagaggcucagagccugcaugggucugacuuaaguccucugccuauauguuauggcugugcagcuuggcauuuuaugggacuccuaacagugggagucgaugcugucucugacuccuuguggguugcuuuauccagcuuuaaugaggguuugugccuggucuuccuguaccuugauacgccauguuccguugauaucucugggaggccugcucuuuucuaaagggaaauggaggaggacaggguccgggggagaggggagguguggggaucacugggaggagugggcggggagaaaaccgaggucaggauguaagaaaagaauucuauuugaaaagaccaaagaugaagcugagugggcugugccuggugguguagguagaucuauaaucucagccacuaagaaagucaaggcagaaggaucacaacaaguucuguaguccauguagagugaguucaaggccagucugguagacaugguuaaacccuauucugaaauaaaaaguaaacagaaggcugggaauaauggucaaugguaaagugcuugcccaccauguugaagggccacgggucaauccccagcacagcaaaaauaagcugugaguauuggaaggaugaagaaaaaggagagacgggaacuguaaauaaaauaaacaaagaaaacugauauuuuacauuuuugaauccuaaacguccccuaaaggacauuaaauggccucucacuugugguacuguuggacagaaccuaggagggccggggacaagagggaggagguuaggucacugaucuugaaggagauauuggggcucuggccccuuucucuuuuguuucccagcuuccaugaaacaaguagcuuugcucuggcauacacacucacugccaugauauuacacacugucacaggcccacagggauggggccaagcaacaguauacugaaacuuuugaaacugaauccacauaaaucguuucucccauaaguagauugauuuccucaggcuuugcuucccagcaauagaaagauggcugacagagcaagaugaggagacucaggcauaaauuuucgggcuuuucauuuccuuucacacacguguuacacuauccugaauaaucuuccaguaaguuuuugguauaaaaguugucacuaagaaugaugcagacguuuacagcauagguuagagaucaccuaacaauaucaguaguuaauacacacuaaauaacagaauaauguugacaguaacggucauaaacuaaguucuuucagcuuuaagagucgagccacaggagaaguucgccuugaaugacacagaucuuugaugcauuguagcaauguuuaaucucucuguacgguauaaauuguuaaguuucauaaaacuccuaauacuuaucaaauuccacugguccuccgauauauccucccuaaaaauuagccaaagacuuuauauuguaaagaaauaaugagauaacagaacaaaguaauuuucaaaacuuuaucacgagaauuucaagcacguaccagugucaagcacaguauaacgaaccgcacauacucaccaaagccucaacgauucuuuacacaggccgugucuuuugcuauuccccaacuucugauuuugaagcagacccuuauuucauaccauguacagacauuuaaaaauaucccuugaagcucuaucucuaaagcuaugaguaaaaaguagccaccacaucaauaucacaccuaagaaacuagacuuugggacuaauucauuccagugugugguauuuuuuauuugaaauuauuuuuauuuuuaaaaauguaacuauucuuaucccaugugcauugcugguuugucugcauguaugcacggauguuggauccccuggaacuggaguuacagguugugagcugccaugugggcacugggaauugaaccuggguccuuuggaagauagaaugcuccuaaccacugugccaucucuccagcccccuacaacuucuuaaauaccuuuuaaacuuuacuucauguauaugaguguuuugccugcauggauguuuaugcacauacaacacauguggucagaagagguggucagaaaagggcacugaaacuggacaguuaugaacugcuaugugggagccaggaagagaauguggguccucugcaagaacagugaauacucuuaacagcugagcugucucuccagcccauuuuugguuuguuuggcuucuuuuguuguggugcuguuuuuguuuauuagugugguuugguuugguuauuccagacagcguuucuuuguguaaccuuggcuguccuggaacuugcucuguagaacagguuggccucaaauucacagagauccauuugccucugccuccuugagugaugggauugaaggugugugcugccaugaccagacauccacauuuuuuaauaauaaaauuuaacaacuuuaaaugucuaaaauuuaucaagccacagauuauuuacagaucuucuauuucuacagacacucaggguucuauaaaaguuaucaagcaagaaaagacauauucccuggccuuacaccaaguauagcucaacagaaaaggcacauacauaucagcuagacccaguugccuuaaaagugaaaugaugugaggaaaugucuucucgccaaagagagucacgugcagaccuggaaaauauacugcacaggcuguccuuagccguggucgcuuaagaacaaccaaggucccugaugaaaaccagggacaaaguaugaucacgcaaagcuugccagcuaaguguuuaaagcuagaugagaagcagagccggaaaugccaucuggggaaggagacagguucggaacaugaaucugcacaaagucaaaacugagaagugcuggaaccuggugggucacaggcagucaagcuuucuugacauagcauucagcauuuauuuuaaucagauaaugagauccaccuauucaaacgccaagucccccguggaccagggaucuaucuaugaguaccugaccuccucuacucugggaauacugacuaguauccacgcagcuaagcccacuggcuggauagcuucuaacacuagggcuauguaagagaaagaaauguagcuuuggcaacuguaaaugcagacucauuuaauaacguauaauucuuauuaaaaaugauggcaagucaaaucuagacguuccugaaauguuuacucuuuaagaaagcaauacaaguacaacccuaaccaacaaaguagaaacugguguuugagcauuagaaauuauucguuuuucccugaacuagaaagauuucauauuuggauuaauugguuuaggccuaacauggucugugaugaaccacagacuacacagcaacaugaccccacagcugagcugccucaaauaaaccccaaugcuauuucugccacggucagugccgcuggccuggcauccuuaccuuuaaccacaucagcuacauuacagguggggucgauacucccuauauguuucggaugugcaggguuagugucaccaccaaacagaagugcuaaaugaacacaaaagagaaggaaagggauugaaacacagucagcugauauggucaagcacagaaauaaaguccuaacugucaaaacgaucuuuuuagaaucauuucgggauccacaaugacuuugagcaaugcaauacucuaugagggagcacauacaucaggcaaaagggggagggguguacuuuaagucccaucaggcacagguaguagauccuauagcagcagugcaugucaggggcccaggccuuucuuccucuucugaugauaacuagaccaagacacuuaaugauugacaggcuaucucccugagggcucaacacuugcagccauuuacugcagucacuaaguauuuccgacaugcagcaugggccauuggugaagaacccucacagguagcacugcaaucgccuccaccaugcaggaucuuuugcaguucuauguacacaaaccguauuuguucaaauaucuuuagaaagcuauuccacuuuacucuacacaauaguugcagauuuuuauucccaaauaaaagccuaaagaagcugaaaagaaaaaaagcaacgcaagcuaaauuuuuauagguauacuuuaucaaaccuaucaaucaaaccuggggacuaacuuagacuccacaacaggagaauaaauaucuaaacaaaauaggaaugacuugagauuauaaaaacgacaaauauagguguaugccaguacauaaaguucuaacuuauuaaaaauagaaaaaaaaacagaggugcaugaguuuaaucaacaacaaaacauaugcauaucuaugugaacacaaauaugcuuagauaaggaaauugccacuaugucaguaaauuagcuggcuuguauuuagguuccuuuuuuuuuuucuauaaauuaucauacauguuucuaaaaaauauaaauaaauacauacauuguuuuaaaagacaggguuuauggcuaucuugaaacucacucuguagaccaggcuggccucaaaccuagaaauucccugucucuugcuucucgaguacucagauuaaggcaugugcugucacugcccggcuauaaguacauauuaacaguuccauaacauuugcuuaucuaaguaaaucaaaugaauuaaaaaugcuugccgggcagugguggcuuaugccuuugaucccagcacuugggaggcagaggcaggcagauuucugaguuugaggcuagccuggucuacaaagugaauuccaggacagccagggcuauacagagaaauccugucucgaaaaaccaaaauaaauaaauaaauaaauaaauaaaguuuugcucccucucugauucagcaaggacaacuccaaauauguacaugcuuuuccuuagaauuaaaaaaaaaaucaaccaaggugacaguacuggaaaucagugaagaaguucauuguguugaaagaacugaauauacuaaacucucagugcagcaucauggacuaauuaaaaaucagauuuuaccuaucacugugcaaucaaggaaauugcuuauauaucuaacaugcucauucaauauucccauauuggugcuuuuaaaaccauugagaaauuaauguggcugccauucaagccagucccuugacuccacagaaagguaacagcagagccuuugaaaggcaggcaguggcccugccuauaauauaagcaucacaaagccuuccaaggacaacuuuuaugcaagaauaucgauuaauggauuuuauuuauuuauuuuuuuuauuagauauuuacuuuauuuacauuuuaaauguuauccccuuuccugguuuccccucugaaaaccccuaucccucccccugcucgccaacccagccaaacagauuuuuauaauaggaaggauucccuuaacaaaaaaaacugaacuagaaaugaaauuucuauagccaaagucuaagucaguaaacuuaaagugaagcaaaaggaaaacuuuucagaaaaaucaauaugguuaccuguucaaaacuagaccgaaaacaacccaacuuacugugcugguuaauaagcaugcggaaagaaaugcgguugguauaaaaccgauccaggaaauauugaauguuacugcuaaugaacggaucaaacccgaacuuuuccuuguacucaaucacgccuugggccauuguaggaacaacaucauugugucuguuucugauauuuaucagaacguugagaaagcugugugggaaggaaauacaaugugguaaguuuacauuucacgggcugaaagccaucccccaccucuaucuaguuaccugcugguauucuuuauaaguagaaacauuccucucacuagauaguaaaaggaaguaagcauaaacgcuaaaaccuagugaaacuuacaacuggcauucuuucggagacacacaaaguaaaagggucuagugaaguuaaaaaacaguucaaauccuuuuuuaggaaugugcugacacuuggagguucuauauuuuuuuuuuauuuuuuacuaaaagaauguaaaucaguaaggaaauaaggaaauaauugaacugauggggccagagggcuaacaauuuaaaccauauauaccaauuucaagccuuaagccccaagagaaugagaaauguaagaauaauagugaggagcuggcuugggggggugguaaagugacgaggaucuguagccacauauaagccagguaugguagcacaucucuguaagcccagagccaggggagcagacacagguggauccccggggaguacuggcuagccagucuagucaaaacaucaaggucccugguuagugagcgagucugucugaaaaaaucaggugagagugauccagaaaacaucugacaucaaccucugauaggcacaugaaaaugcacacacauacacacacguacacaucaguacacacacauacacacacauguauauaucagugcacauacacacaugcacacaucagugcacacaggcauacacauguacacaucagugcacacacacauauacacaucagugcacauacacacacaugcacauguacacaucagugcacacacauacauauacauguacacaucaguacacacacauacacauguacacaucagugcacacacauacacacacauguacacaucagugcacacacauacacacacguauauaucagugcacauacacacauacacauguacacaucagugcacacacacauauauacacaucagugcacacacguacauacacauguacacaucagugcacacacauacauacacauguacacaucagugcucacacauacauacauacauacacauguacacaucagugcacacacauacauauacauguacacaucaguacacacacauacacauguacacaucagugcacacacauacacacacauguacacaucagugcacacacauacacacacguauauaucagugcacauacacacauacacauguacacaucagugcacacacacauauauacacaucagugcacacacguacauacacauguacacaucagugcacacacauacauacacauguacacaucagugcucacacauacauacauacauacacauguacacaucagugcacacacauacacuacacauguacacaucagugcacacacauacauauacauguacacaucagugcacauacauacauacacauguacacaucagugcacacacauacacauguacacaucagugcacacacacauauacacaucagugcacacacauauauacacauguacacaucagugcacacacauacauacacauguacacauaagccauauaaacauacacaaaauuaauuucuuuuuaaaaagacaaaaauguuaagagugaaaucacagaaauaauaaaagaaaaucagcugaauuaagucuauaccuuugggauaaaggcggcuguucucggcuuauuaccaagggcagaaacacacaaugcaaagaaacaaagaacauaacuggggaauugaugaguaagugaagaaauaaaagcccauacacuuagugaagaugaacaucccacuggaaacuagggaaaggaucuuagugggaaaaucuaugaaaaacucaagcacagugccaaucaauuuaccagcacaaaagcaaaggaaaacauuauuuauuagaauggcaaauaauaaccagugaagguugcgugugggcgcuaaauggaacauuuucuaagggcaauuuaaccaaauauaucugaaguccaaagaagauaauuccacuucuaggaucaacgcuagggaaacaaguggacaagguaaauagcuguuuuuaaaaacugcuuuccacacacgcaaacgcauacaucauacccagagaaugcaagugugggaagagaaagagaaaacaaaagcuguuuuuagagcacucugugcuaguaaggugacuugcugcguaaaugcagugcuguguaagcuugcugaccugacuguggaucccuggaaacggaaggcaaagagcagcacccaacacugucaucagaucuccacauccacagcaugacacgguacucucagacacaaacaccuaugcaauggaucauagacucacacacaggagaagguacugaaaacuacaaaccaggauaaaagccaacauuagugggucaaauagcaugaccuaucuguagaauuaauaauauaaguaagugccaagugguguauaaguaagugccaagugguggcggcacaggccuuugaucccagcacucaggaggcagaggcaggcggaucugaguuugaagucagccuggucuacagagugaguuccaggacagccagggcuacacaggaacccugugucaaaaaaacaaaaacaaacaacccaacaagacaauuugcaugugugugugugugcauguaugugugugagagaguacugacagcuacaugcuacacaauaacauuucagugacagacuguacacaauagugucccuaaaagauuaugucaccugguaagguuguaguccucuuauguuucuaugaggauacucuacaguguucacauaaacaauuuuuccucauaaagcauuucucuaagguaucugucauugagugauccaugacuguauuauaaaauuacuggccacuauuaaguggccaagaacuguauuguaaacacaaaaauugcugagcagugguguucaccuuuaaaucccagcacuugggaggcagaggcagaggcaaguggaucucugugaguuggaggccagccuggucuacagagugaauuauaggacaaugagggcuauauagagaauccuugucucaaaaaacuucacacucauacaauaugaaugcuuaggggaaaauaacggcagaagaaaauguuagcugaggcuguccucuaguaaugagauuuuggaauaaguuucuuuuacuuaucucgucuuauuuuuuccucaaugaaaauuuucuguaacaaauauguacguacaaugaaagcaaagaugaauaaacucugaaacuagaagcucacaauuagccaggcuuggaggcacacaccuuuaaucacagcccucaggaagcauaggcaggcuaauccacagugaagcccuucuucaaaacaaaacaaaaaaagcccaaguuugcaauuaugcacaagaaauuuuuacaauggguaaauuuucauguaccucuuuccaauguauuuaucaauuaaguaucuguaaaaugaaacaauucauuauagugcagaaacaucuucaccugaaggaaagaggcuuauuuaaauggaugaauucucagaacaccucccuacucuccugggcuuuucuaucuccaucaugaggaccaaugugauugacauaaaugacucuccagcuaguggccccacguauggcagaauuuauguucucacugaacagagaaggcuguuaccaggauacacacucaucucgcaccccucccuuuacuaacagcacgaggcaacucaaaucucaacuuuccaaccgcugcauaaagccagcaaguuaucgaaauucacugaguaagagcuacugccaugaagaccuagcacacacucgauucagcacuguccauucacuuaaauugguccugaugaaaauaauguuagaguuuggacucuacaaaaaccauagcaauuaauuaauaauuguguacuucuccaaaucuuuaucuucaaguguacaccuagaggcuagcuccauuuugagaauuucaaauguccucaacuaaugacguaagaaaacaaagcuccuagauucaauccauuuaaugucaacacguuaaauaacaguugauguggaaccuuacggguuuguuggaaagugaauuaugcuauauuguguuuugcuggggcaaacaugugaagguguguccugaagcggacacaggugugaaagacuaaagccgacucacgaaggcauguuuagcugaagcagacacaggagaaaggauguucugcuaaaccaaacacgugaaaggaauuuuugcuaaugacacaaaugcaucgguucaccauauacugaguaguugagcugcauuugucaagacuccacagagagaaaugagccaaaacaaaaaacaaaaacaaagacaaaaacaaaaucaaaaacaaagacaaagacaaaaacaaaagcaaaaaacccuucugguggugugcugcaguuucuugcagcuuccugcuuccuuggacucaggcugauugucagcugagacgggugcacguguugaggcacaacccuuagaagacacgugauguuuggagguuauaaaaagaacucaauggacagugacagagggaggcugagcuugcugugcagcacuugugcaccaccaguucgcuucccugagagaggcacagcugagaacuucuccugguguuccuguuggucccuccugcugacuggagccgaggcugaggccuggcugucucugcuaggucaugucacugcuguugcugacccaacucauggacuucauggacuaccgguguauccaugaaguguuuucgaguguaugagcuuccaccgccugcugaccuguaaacugaacugcugauuuccagacaacacugaugagaguugcuccaaagaaccuuucuaagcaggcuuacuucccccauauccuuucuuucccacuaccucugguggguggugggcuauaagggagguuaaaguguuuaaggaccaucauuaaaaauagaguuugaaaaaauaagaguuacagacagcaguggcuagcuaguaucaaggaaacaacuauauguguggcucuaacccaaugcuuguacuuuucacauucaccagauccauucaauaagauacaacugacccugagcucccuucuccugccugaaagcagcauuucuggcuguaugguacacugcagaggaccagcauacuauggaaaaggaacaaugacucacgggucuagcucugucacaaccuugagcacauccuuccacaccucugaccuccagauuuccuggguuaaaacucuccaagguugguugugugguguaguguuucccuacuucuauucacggagcucauccaagccaaguguuugucucaugauuaugaggauuaagccuaugauaaaagaaaguccucagcacaacuggaugccgugaguauucacuguguagauccccaacaggaagaaaucaggcuaaaggagauacuuaauuucucuuggggggaaaaagcucuacucacagaugagguuaugguuuacuggagaacaaaaauagaaaacagaaauacuuucugguaacaugagaauuccauagucuuugugcacagugacagcaauagaauccaacaguuguguguguguguauguauauauauauauauauauauauuuaaaaaaaaaacacuuuuacgcuucuccaaaacaaaaucacuacaauuuucuaagcucaaaaaguauuuuacuuuagaaaguauuuuaaguugauggauuagggagauacuugcuguauauauggaggcuauugcauucuuaaaacuaccacuagauggaacauucccaacaaugcuuauaguaagcugcugucuauuuuaccuugaccacauauauuaagaacugggucaugaagcauuaauugaaguuucauuguucuuugugaauuaugcuaaauucuuaaguuaaaaaaaacaacaacuauguuauuacccacaagaaaauuaaaaccuuugucuaaauuccaguuauuuauguucucaaaaguguguguaguguaugugggaguauucguguuaaaacuugagcacacaaauguacacacacaugaggauuccagguuaguaucaguugucuuccucagucacucucuaccucauuuaucaaaacagggucucucauuugaaccuagagcucgcuuacucaggacauuuagcuaggcagcuucucuggggauccccagggugacuuccaaccacuaggauuacaggcaggcugucaugccugcccaguacccacuugacaacugcacauccaaacucaggucugcacacuuguucaguaagcacuuuaacuacugagccaucucguagcccugaauuauaacucucuagucuuaacaugaguuccauuucacugaaauguucucuugccgagguauuuuuacuuucauguaauuggcaucauacuuacuuauccaaaacucgugggucuucugggcucuuguuuucauauucuaaaaguucaaggaagcucugcauguaccuagaaaacacaagucagcacgugagcuaccugccugcucccucccuccucacucagccuuuaccccacuccuaucugcagcuucagggcuucaggccgaggugacuccuccagagcauguaggaagagcccuucucucucaucaauacuuacucucuagucccacaguccauagcuaagacuaagaaccaaaugcaucccugaaacaggcacugacucaggaacaggucuagggcuucaauucaaacggaaagaaauacauagaagacuugcuggagguuucuaagcauacugccuucucugcuuugguacaguguaugaaaucugcaacuucuacaaccagucuuccgccuggaaggaagcucaccugaaaacaaagccaacacugccaaaaagcauagcucugauagcuuugugugucucugauucaaacuaauaggaagaacucauccaaugacugacccuucugguuguacaagccagguucagcauccuaacucauacuccaagucuacaauuugauuacucuaaaagcacauaaauuuuucuugaaacaaggucucacuagauagccuuggcuggccuagaagucaauaugaggaccaggauuaccuuacacucauagaaaucuaucagcuacuaacuccuaaauucggggauuaaaggcauacacaccacauuuggcaaaaagaucacaaaauuuuaagaagcacucugguuugauccugaagcauacaccaagaauacaagaaggcuauuucuuacaguaaaauuaacuucaucaguauguacuagagaaaugcacaucaggaaaagauucuaaauugaucacgauaguuuucaauaaaggccaauacaagaaaaaacuguguauauuauaaaauccuuaagucuuaauaagaugugccacacaugagcaaguuaggugggccuccagccuuuucccaaagcaguaauccuuuaaagagaaaaguuauaaaugcagaagaauccaagaucauacuaagauuuguagcaugaaaagaaaacgggaagacuacagggugacuaagagaacaguggagucccuguuucacaugcaagucacuuguaaaagcaaaugacaggaucacauaaauaaauacaugauccuaauauggauucuuaaaucaagacaauuuuuuuugguuuguuuuugagacaggguuucucuguguagcucuggcuguccuggagcucacucuguagaccaggcuggccuugaacucagaaauuugccugccuuugccucccaagugcugggauuaaaggugugcgccaccaugccugacaauuuuuuuaaaggaucauuauuaagacaauuaguaaaauaauaacaagcacuaccuauuaggaaacauuuacuagaucaaugacaaacuucuaaaugugaauauuuauaucaugguuuucuaagaguuauccccagagaugcguguuaaaguuauuugggggcaaaggaacaaacauaaugucaacaucaauucaaauguuucaggaaaagcaaugaauuuuuguaugaugucaaccaguaaaaggaacaaucugaacuauauccucaaauacuacugauauuuauuuggaaagagcauuuucaaagaaaaaggacaugcuacaggaagccacacauguguucaugcuacaggaagccacacauguguucaaaagagcaccuccuuguagauucccugacuacacuucuaaaaucccuccugugucaacacacuuccuuuucgacuccccuuaccagcuuguccuuucuuuucuaaugguuccuuguuaaacagggauguuguuuuauucaucuugcugcuucuuuaauaccuaaggcaugguuaguaauauaugauuaaagaaggaaaagaaaaggcccaaggcaaggggacuucuaaagaaaaaugaucauaccagauaguugaaaucaagaacugucgauucuaaugauuaauaccaaggguagaauguucuggagguugaagacuugcugaccggauggucuuacagaugucauaagguugcaagagccuccguaugaacguguagaccuagaaucucaugcuagucacuaauaguaacaaccaugcaaaagaaauuguccuuaguaacucccuagcucuaccaauuccauuuugauccugacaauguuuacauuucuuucaugcauauguguaugucauauuauauacauauauacaugcacacauauauucauauuaucucuccccauucaaugugggagaggagauaaacaugaauuaugaaagagcaaauauagucaaauguuaucagugaagcuagaugaagguauaugacaauucuuucuacuagucuuguaauucuuaaguaggaaauuauuuuuuucaaaauagaauguauaugaacaaaaagaaauggcaugcacagucugaaguagacacggacaaugcagaggauacaaaggaagguuuaacacuguaaucugagucuauacuucacuuugccaguguuauaugcauaacacaaaaauaaauuuaguauucacuccugcuuccugguacaguuccuaagccuuaaaguuccagaaugacaggaguaucucuuguuacucagaagaagcaccuaucgcucacauuugaguuauucuaauaaggucacuuagaguggggcucuagacagugucaacaugaucuugaucaaaacaaugagcaaguaacuagagagcucaaacuuuuagucuacucccaaccucuguggaggcaugaggacugaaaaugaagcucuauaaaaacuccugaaugaagagaugcugaaggcuuuguacugaaccccuggaggugccaacagagcacacacagggaggguauggaugcugcaaaguuacaccaacaccuugucugauauauuucuuccauuuugcuguuucuuuuccuauccaccugcaaauauaaacaaagugccuuccugaauucugugauccacuuuagccaauuaucaaaccucagaagagggccauggaaacucaauguacagccagucaauugcaucagucagucaaaggcauggauagauccaggaccugcaguugacacauaauguauggugucagucucuggagacugagcucugaaauuguggggccucugcugacuucagauacuuaguaucaggacugaacaguugcugaacacucagcuggugucuggagaaucagaguuggcucauguuggaaaacaguucggaggcaguaauuuacuuugaaguuccugaaguaacugcugcauaagcaauggaaacugguuaauugcugcaaccuaauggaucaaaggacaugacuuugccuaccgaggaccuucaucauagugucccugacagugcuuauacuaucuacagcucaaguuuccuccucccagguauguacagccugagacuguuugccuacagagucucccuaccuagaacagcuaaacuuaccaccuuauucagcuauauaccauaaaucugugucuuuaauucugauggugcaaguccaucaaaaugcauggcucacucgacuccagcuuuucuuuuuuuuucuuuuucuuucuuuuuccuuuuccuuuuuguuuuguuuuguuuucaagccaggguuucucuguguagcccuggcuguccuggaacucacuuuguagaccaggcuggccuugaacucagaaauccgccugccccugccucccaagugcugggauuaaaggcaugugccaccaccgcccggcaacuccagcuuuucuauaugugagcuaucacuucuucauucccugucaucugaauuaggucaaccccuaauccaugcaagguuauugcauaaaacagugcuuuucacaaaaacguauucuucaggaauggccauugaauucuucauucuuuaucagaagccaagccaccacaaacccucugaauucgagcuaguuuucuuaagcuggugauuucuuaagaugguccucuacacuagucaacuccacccacccaucaaggaacaguacaaggccauggcuagcguuuucugccccuuuuuuguucucaacacuguuccugauuagcaacagugugccuccugguccuuacaguccuccagguuucuccacaugcuuccgccaugcuuuuuauagcagaguagaccaaacaugcaaaucucugucuaaaaacaugccaccuuuucuuccagccucccacucagugaccucacggcgggugggggaucaucgcagacuccacuuccucugacagagaaugcaggcuuuacagucagagcucugacugauuuaacuuugcuuuaagaucuugcauagagcaggcacagcacagcagggacaugauugguuuuuccacaugagguuccccuauaaaggacuuagucuaaaaaguauuuccuucaugaaagaucuuuaaaacaaaaauaaaagaggcaaggcugagacuuacuaaagguugaaaacaucucucuauccaaaggagggcaaaugggcuaggcacguagcucaauuaggagugcuugcuuugccucuguugucaaagcccugcuucaguccccaguaacuggacaugguggcacacagugugcccucagcacucaggaggcaagaggaucagaugugcaaaggauaccuaggcuacaaauggaacucauggccagucugggaugcaagagacacugccucaauuucuuucuuuaucaaaguagguccacugauacuggucacuguaaugucauuccuucauuuuauucucuauuuuuuuucaguaagcaaucaugucucuaacaagaaaaaaugaaagguucaggaagugucuuaugguucaaaauaguuacauuaaaauuuuuaaacgaauaguugaaagcuuaagugcacggaaagccuagcucuccugaaagccucauucccagacagacaguuuguacacuucugugcaaaaugcuuccagugcagaacuguucgcagcacuuacuuaccagcucugaacuaaucccacggaagggcgguucaacaaguuauccggcaagagauuaaccucucucaugguguuagccagucgcacaggaaguuccuugcgcagaaacauauaggaaguuuuuucacaugcauuaucccuuccuauuaagagaugaaaaaauuccauaaaauuaacaucuagagacauaaaaugcucucauguucacagaauuagaaaaagaaaaaggaaauuaaguaauauaaugaugucuaguuaaauuuucauucuccaaaauaacaaguuuaagaaaacagcuuaauuagaagcgaaaaagaacauuuauuccaagaggcaacuuugaaagcaguuuuuuucuuaacacaaauagguaccuaguguugcuggccacaacauaaaagugaccugggauauaauuugaguuugcuuucaaauaaacacuguauggaaacugccaaguacagaacaauaugauauugaaaucuacuauuguucauagugguuuucggggaggcagcaugauccguuccuucuguaaaugcgccuauugcaugccaaccacuuguuacgaguuuucuuccaauguaaagaaacgcauggcucugccauccuggaagcagaaacucugugauuccaaacgagcagcucuaagucacacaacuaauacgucucaaaaagcuuacaauguacucccagugaaugacccacugugacaaguccaagaaggaaaaagcuacccuauagguggucagugagcuaaggcaggcauagaaaucaggcagcacgugagcauguggaacagcagaaaucgagaccugaacaauggcucugagcucggggucaguggggaugggguggggcuuuauuaagagcuccuagcugaaguuagaagaaguaaguucugguguaaugcuguacaauauggcuaacaauuauauaccgcauuuuccccaaaacuagaagaaaauugaaaguuugacacagagaaaggaccaaauuuuuaaugagguaacuauguuuaaccugauguuaacauuauaaaacuauuaucauguacugaacauuuuauaccacuccauuaugauuaauauaaacaagaguagguuaucaccuaucagauuuucccaaaaguaaaagacaagacguggucgaggaaaucuucuggagauggguguccauucacaugaauagcaggaugacagaaaaggcaugcggauaccuuuucccaacuucacuguggccagaacacuuucccaaaccuguuacaaacuuauggcuggggagaggugugaaauaaaguauaugagcuuuggggugagaaacacccucuggaccggagucagccauccugugcgugugaaacauugguuaaggcuuacuacgccucuuaacuuuagcuacccuaaucuugaaggcggggggucaaucuuuguaaaggcaacauguaacccacacauaaccgugguccuccacucugugauccucgugggucuauccugucucccuggcacuggcuaggccucccugaugcuccacucccuggaagcuguucuggaaugagucaagaccagacacaagggagggaagcuuucuaaacacuuugccuuccaaacucucuuaagcuuucccuguauaaaaaaggcagcaacugaaagguuuacacacaugguauuucuaaugcuuccauccacuuucugacuucucccuuuccuuucuacaaaauaaagcuugggaaaaaaaagagucauucuugaaagucaucuguggcucuuuucuuccucaccaaccuggaccccauuuccauauuuaaacaaauuagaaugaaagauugcucucaaaucauuguuuucuucauucaccaugaguauacugaaggucuuugguaggaaaaucccuaacgauugauucuuucacucacccuuagcccucugacauuaguucccagguaagaggggaagggguauaauacuccagaaacagcagccaacagcuacuucaccaagcugauuuugguaguuuugcuucaaaaauauauugcuccuauugaugcauauaauuuuaauuucauaugcacaaagauacuaguauugccauaguuaauuauauugguuaauauauauuacauauauauuauaauuauaauuauauuggacuauuaagaauuuuaaguuuuggugccccacuuauucuuugguagaaucuaauuugagcugauuuaaauaauacuuuaaucuauuuuaaguuaaaauauaaaucuggguuuuuacaggacagaagaaauacucuagauucugguaaaaauacacugguuuaagcacacacagacacacaaaaugucacugugggcuacugaagaccagcuuucaaucaagcuuccucugaaaccucucucugaacagcucaaccuugcgcucuagguugacuugcuuagaacauuguaacaagaaucugcaugccaucuuagcaaaaguccuuugccuuuagcaaaagucugguuucccuugguacugaucaaauuccucacucccuauucuaaguaucuaaacauuccagacaguuuucagcagggcucuaguugcucuaguaagagccuccccaagcacugaucccugcuacuaauuuccuggccaggggcccuuugcccaggcacacacacauaacacuguuccugagcuauaaaucuccauuuguccauggugcaucgagagcugagcccaaucucucucuccuacuauaaaaucgcccugcaguggucacucaugaacagaguucccuaccaucugucuuaguuacuuuugcauugcuaugauaaaaauggcaugaccaaagcaacuucuaaaugaaagcauuuaauuuggggcuuaugguuugugaugguuuguauauccuccacccagguaguggcacuauuagaagguguggcccuguuggaguaggugugucccugugggugugagcuuuaagacccucauucugccuuggguuuguggaucaagaugugagucucaguuucuguuccagugccaugugugccugcugcuguacuuacuucuauggggcuggcuuacagguucagagguucaguccaauaucauuaaggcagcacauggcaguaucuaggcaggcauggugcaggaggagcuaagaguucuacaucuucaucugagggcugcuagcagaauacugacuuccaggcagcuaagaugagggagccacugggaacagcaugggcuuuuaaaacuccaaaguaugccccuagugacauacuaccuccagcagggccauucuaguuccauucaaaccauaccaucuuuaacaaagauuauuaauaauuccuucacaaggggaagaaagcucuggaauggggaagaaauaaaacaucccuguauugauagcuggaauuaugacuaucuguagaacuaaaaacuuuaaaacccugaggagcuuuggggggaggguaguaaaaguuuacaugcuaaaauuuccuagucucuagcugguuaggagcaacagauuagaagaacaggguaggaugaaguaaaggcuauaauaagcaagagcuaaccaccagguccaugucucuccucuaaaacccaugggacuagaugguccagaauugaaagguuuuccaccuuuuaaaaauuaaagaaucuaugcuauucugauguuauauggaaugcuauacagauauaauauaguuacagugaaauauaugaacauuuacauuaaauagauuaaagucuauucuuuaaaucagcucaaauuagauucuaccaaagaauaaguggggcacuaaaacuuaaaauucuauuuucagaacuuuugaacuucacgauuccaauaaaaguguauggcccuacagaacggcaauaauguacuugggucugaaucuuaagcgcucacagacuucuucagucuucucuaucucauauacuucaaccauccauaaaauaugagcaccuucuucauagagguuuagugaaggcugguguuuaacacugaacauugacacauucuuuaaucuuagaaguagaguucauuaaagagcaaacaaaaaugauuggugauaaccaagcagaacaguucaaagccauggggagcgacaucaaacugucugcuacaugccccgucgguccucagagcacgacucuauucuagacuggugugauuccccagcucaucugacgacucuacaucacuuuaaaaaccaugaagguguguucacuguuccuaggacccacuauuuuaaaauaaaaguccuagauggcacugcaggcaacucugcacuaucaccugucgguaggaucuaagagaaccggugucagaaacuauuggacucucguggaacuggauugucagauuguuaaaacccguggagagaaauuugucuuauaucccccccccccagaacaccuaucacagcaccuugccuauuauagcugcucaaugacuuuuuggaagaugcgaucaugcuuucaaagguuuacauuuuuaaugcagaauagcuaaaaauucccagguuuuuccuccuacauucuaauuuagcuccaagaacaaauucuuuguacuuagcuaccuuaauuauacaucagcuuaaacaggagcauaagucuuuuuaguuaguuaauuagccgaucuaaaaauaaaugucugauuuuuacaacuuuucuguggcuuucuucauauacauuaaagauauuuuauccuagauguugaauacuuaucaagggguuauauuagccacuuuuauaauaaauguaucagaaccuccuugguuuuuaauagcuguccucucaaaggagucacuuccacaagucuuuuccagcuauucuuuccaguucuuugauuccauuccucccucccccacacacuuggcuucucuacauucccugcuucuuauuuucuauuuaugaacaacaguauuauuucuacauuucucuauaugcuuccuauuauuuggaugugccaguuaaaguuuuccuaauacccauuuagaagaugacagagaggaaaccaugaggaucuuggagaagaauugacucagcaaacccuagucccagggguugcuuuucuccugguuucauaagccucugagucucuuguuucugcuucauuucaaugcuggggauuuaaaguuagagguccacguccucucccacucagugucuuuguguuuuuauacucugucuuucacuggaaaguuugagacaacuauucaugugcagaaagcccuacaguuucccuggucuaggauggcuccuuauagcuuucuguuuaccaagguaucggaagaauaggcauaaaaauuaaaauuuggggaguccucuuguggaggaaucaagaaguauuuguccagccaccugagagcaaggguucccagacaagacuuuuccauaguagcuggugucuuuaacccuguuuucaaauaauuuacaggugagagagaaaaaaauauucuguuaaugaaauggccugauaaugagcauuuuauaauugaagaagaauguugaggauaucuuccaugaucuaucucacuggauucuuaaaggcuaucuccaucuccaccuuucuaccacuuggugugggucgguuacagaguagcagggggagggacaagugagugaaaaaggagaacaaagggaaaguccuagugaggccugaaacccuagugugaaugacccugcucagccaugagagguugcguuuucccaggacugucuaguaaaaguuggaguugaugauguauuuuuuuccauuaaccacguuaaaguggauaaauuuuaccaggauauagguuuaggguagcucuuugacauguucuuuucucuaguaauauuuauaagacuuuaaucucagaauaugauaacacacacuugcaauccaagcacaggaggcaggggccucccuggugagcaaaacaaaauggauugcaccagagagacaacagcccgaagcugucuuauggccucugaacucauggacacacaugcaugcacaaguacagagcuaucagaugaccuaguaacccucuucugaauaauacaguggcaauaaggccacacagugcgucggaugcaucagagaguaugaagaaauauggaagccccaggagcugugaucagcuagacucuagagcuucucagccuuccuaaagcuuuagcacacacaguuccucaggcuguggugaccccugcccguaagauuacuuccauugcuacuuccuaacuguaguucuuagcuccugaagaacaguauacucaccgguuaacucaaaaguccgagcaccuagacaccgcucugagagacugaauauuaaguggcuuaggugggggaacacuaucagcucauaggcacucccaagaaccaugaaccauacgcuagcaucuaaucacguacaacuaagugaggaaacgugagucaaagaaucccucaggcucaaauggcagacauggagcauuugaaagcauuuuagcuaccuacacauuuuagucuuuauuuucagguuugaagucuuuuuuuuauuucagccucauagaaaacugaccacggauaccuucaaucuguaugccucuuuuuuucuccccuuucgcuauuaggagaccccaaauggaagaugaaagcugaacaaauucauuaaggaaaugagcuguacuugacaaugugguaaugucugacaagggaggaccaugcacuuguugaacuuucccccauuucgaucaugcagcaccucuguucuaagcuauaaagaaugguaggagccgggcagugguggcgcaugccuuugaucccagcacuugggaggcagaggcaggcggauuucugaguucgaggccagccuggucuacagagugaguuccaggauagcuacacagagaaacccugucucaaaaagccaaaaccaaacaaacaaacaaacaaacaaaaugguaggaugggcaggugagcagaaaccuagcugcugccuacugcaaguguaauucuccccugcucagaauuucagucuccucacuuguaaaguggguacagcugcugagaaccaaaugguaccacauguuacacugaguuuggguaagugcucucuaaauacucguggcaucaacagcuucucuuccaacugcaauauaaagccugauuuccuacuggaauaguuucagauuaaaacagaaagacuugaguauacugcacagagacaucuacaauguacaagacauuacaauguguaacgagcacuagccaaagaugaguagugcccagaaggacaauugcuacagaguaggggauucagugugaagccuucuccagaagggguuacuccaaaaagugucucuccuucagcacauuaugugacaaguacacgauuaguaacagaacaaugaccacuucacuuucuauuuaacuggcugaaucaggaaacaaauuaacccguauaaaaccaaagucauggaucaagaaauaccugcuaccaaacuuaaggaaauauuucauguuacuagagcuuauccaagaaagaguucauauacagugugguggcacaguccuguaauuccuacacuuacaaggaguuuauacauacucaugucuaucaaaauauaaguuauugcagaaagauagguauaccacauaaggcccuauuguuuucuaauaccacaugggacaguauuaaacuucaugguguggagaaacauggaagaguugaucacuuauacugagacuacuauauacuggucuccaaagauauuacaggggcaaagcaaauguuauggcggagucccagaucaacucuaagaaugaaauucaacuguugcugccagaaugauguuuagggaaauaaagcaccauuguguuagaacccaaaguguucaguuagagagaauauaucaauauugacuugugaaauauaaucacuuacuacaauuguaugguauucauuauggcagaagauacaaucuuagcgagaagaugaaccaaugaucaggagcaggguucuuaaagagauaugauggcacacaucuauaaucccagcacuggggaggcaaagccaggcagaucucucugaguuugaggccaggcuaguuuacaaaguuccaugauagccauggguguuguacagagaaaccuugucgccggugaaaaaaacaaacaaacaagcaaacaaacaaacaaaggggauaugaagggaaccuaacaugagccaugaccaaguucuguucggccaguuaaagaacuauaaagggaaauuagcccucccugcccuaaaagcguauagauacuuuaaugcuaguuucaaugccaucuuccacgacaaagauggaacgccuucaacuaucagguggcccagccacagucccacugacauauuuuugagacuauguuagucaacauguucuucacugacuaccaacacagaaacauacacggaauguaugcaaaugauucaaacuccagauuccagguacuacguguucaaagacacugcaugcagaacaaaacuccaggcaauauaccuaaucaggcaaaaaaaccuuguagugccuauguuaggcauuacaauuaaucccaaaaccucauuuuggcaacccuguagagaaacaaguacugucaguuuuguaaacugaaccuauaaaaucuuucaaagccauucauauggagauccuauucagaaauaagacacuauaaguaaauaccagauucucuggaaaagucuaagccacccaauaaaucacauuccacauaagcagugcugaguguuagcaagagacagacaacuuuauacuuacugcaacuucagaaaaauagugcucacucuuuaaagaggggacauaacugccuuagaucagggguuggugaacuuguuuuagaugaccagacaauaagcacuuuuggcuuugugaaccauacauacaguuucuggcaacaaggcaacucugcuguuggggaggaacccaaagcuacagacuguauguaacaaaugagcauguguacgauccaguaaagcauuauuuguggguaucaaaacucagaguacacacaaagaaccauuucuaguauaaacaauggacuuuuggugcugaugaugguuucuuaguugcaacaaugguuacuggcagcuccucaaggucucacaugguacaggauguugaaggcaguuuaggcugcauuugggaugcucaagggaagucuguacuuucugcacuugcagaauuuugcugugcaucgaaagauacucuuaaacauguacucauuuuaaaaaugaggaaaagcauaggcucugaucagagauagauaaagguauucaaaaaaggagagaucuacccaacucuaagacagaacuaccacugaaguacaacaauuuaauuguauauacaauauaaaaaaugaaagugguaauauuuuguaauugcauccagcaacaaagcuaagguuuccuaauucuugccaacaguuuaaucaauuuccaaaagcuuaccaggaggaaagcagccagccaugaacaaggucagcaagugacaccauguccucuucaaagagcuuauucacugcuagugugcauucaaaggaggccaaccaccaugauaaacaguauggaagugccucaaaaaguaaaaauagaauuagcauauaaccuagcuaguccacuccuggguauagccaaagaaccucaaguccacagaaauagcuacacacacaaguuuauugcugcacuguuauaaacagccaaacaagaagggaaagggacacaaagaauuaauggauaaauguaugcauaugcaaaugaauuuuaaucauccauaaagaaaaaauagaucaugauauucauggacagaacuggaaaugacacuaagcaaaaacaaaacaaaaccccacauuuacuuuguaggcagaugcuagggauauguguguguuacacauguguuagucaugaaacuagaaaggugacuaugaggaggaaggccauguuaguggaggacagagaaaaaaaauggguaacaggacagauguggcaugaaagcagaugggaagaggaggagggcuagcaggaggagggcagugggaagaggaaaccaacacaacagaauauauuuaugaaaauauauaugaaaaugcuacagugaaauuuaacuuguaugauaauaauaaaaaaaacuaauaaagcucaugaaagacacucaagugcucuaaaaggaacaaagccagaacuucaacucuagaugccucaagguuucccagagcccaauaaaugaguuccauggaaacccagcccuaucagaucauaaaggccuaacagcuaguucucuuuacugagcaaagaugcaaaaagcuaaguaugagauucagaccuuaaacuaaauugcucuccccccuuuuaacuguaaauagccggcuucugucucuagacaggcugcucuaauucuugacaaucccucccaaugcuggaccuuuucuacucauagaauagaccuguugugcacauguaaaguggcagaauaaacaugcucaggaagaagggugagacugguuccccuuuccuaacacaaucuuuaaauaacaccuuucaacuucuccacgagugaaaucacagcucuauccauuggaaaccaagugucaaagaacgaacgagaugacuuaaaaaccugagacuuugcagagagcaagcacuuggcacugaagucaaugucucaguggcuaauggagucuuaaaauauuugcaaaagcaaaacugaaggcagcugggcccuuaaaaccucaagacuagcaagaacaaggggacuggcugcugcugucuaacagcuaacaccuggaagauucacagagccagcauguugaggguagaaaucaaagcauggaauuccgugaaaagacagaggagguguguacaacagucugcuuuccggcaauuuuauuugggagacgcuguauuuuucugcaaguuuaaacgucuguaacugacuaaagugagcaaucugugaugaccucuauggcauuuguggaguucccacucucgcugugcagagaaaacugagcugaggagccaggcggcuacaaaggagcaagcauccacacucuggaaagaggacaggaugaaauaaagagaaaaaggaacgaaaagaucuuaauuacaagugaagcuuguaaaugagaaacaaauagaaagggacaaaaauggcuagcgagaagaucagaaacaggcagugaggccaaaagaaaacgcaaauacugaugaaaaugaaaacgguguucccacaaacucacucaacuugcacaagaauguaucuuuaauuacuguguaauaguccaaguuggccuuuucuuaaucaaaagcuaaaagaaaaaucauaagguaaaaucacuaagagaauuauuaacucaaagaaacaauacuuaggagacagaacugaaggguugcccaaaugguauaagagccaccauaauguuaacaaaaaucaauaagcuucuuuuguacauaaaauguaauauuaguguuuccacuaagaaauuacuauuugaagccacauugaauaugccaauggaauaugaauuauauauauaauuuauaacuucuuagucacauuagcaaaaauagauaagauuuuuaauuuuguuuauccugacauauguaaaauaucauuucaauauacaaucaauaugaaagauggagaguauagcucagucauagagcacuggcuuacuauauacaaagcucuagauucaauccucagcaccucaaaaaugugaaaagacauuaugcugguuuuagaugaauuccuuguuaucugcuauguaucuuacauguaccacacaucacaguuuagaagcugaauuucuaucaugaagaaauggccuauaacuaaguccauaaaguuuaugguuguuaagguaaauucuuuccaaauuauucuaaaugaacugaggaauacagagauaggucggugagugaaguacuugccucucaaacaugagaacccgaguuacauucccagaacagauauaaacaugucagcaagccagcugggcaguggugacucacaccuuccagaccagcacucagaaggcaaaggcauguggaucucugaguucaaggacagcccacucaacaaagcacauuccaggacagccagagcuaaucacagagaaauccugucucaaaaaacaagcaccaaaacucaggcaugcuggcuuagacuuauaauucuccugcugguggagcagacacaagucagaucccuguggcucucugaucuacuugaugagccccacaguaagugagagacuaucuaagaaaacaaaauaagacaguucuaaggaaggacagccaagguuaucuuuuggccuccacaccauauacacacauacauccgaauaccuacauguaacacaauuuuaaaaugaaccaaaucaaaucuguuccgaauucaaauuaaaucaauucaguuucucagccaugcuagccacauuucuacuccucaaaaggcccaugagcuagcaaggcagugaccacaaucagacaaaggaaggucuggucuaaagaaauaaaguggggcugcaugacuuggaagaucagaguaauuguuguucuugcagaggaacccauuuuccauuuucagcccccacacaguggcucacaaccuaccuuaacucuagucccaggaaaucuggcccccucaucugacuucugaaggcaccaagugcacacacaaugcgcaugcaugccacgcaggcgaaacacuuauacauauaaaauaaaaauauagaaaggaagucaaaauuauaacaaaugaaauaaaaauucaagccuaaguacuaaccaaaauaaaugugguaaaauaaagcaauaaauuaugugacaagguuaaaaauuaaagcauuaacaacaaaagggaacaauuauacaugcuuaccauuauguaugacagaucaauugauuuauaccaguaaguauauucaggcuaaaccuaccauauaaaagaaaacaauuauuacaaagcaaaaccagcuuuacauuugaagaaauauuuaaaucaaaguaauucagaaaaacugaaaauaagaaagccaaugagaagauagaauacagaucucagcaucaaauaaggcugaauccagaccaaaaagcauuaaacuaguaaugguaaaggcgacaacucaccaugaggacaugacagcuaauauguaucaagggucacaugacaaaaacuggagacauaugggaaaacagaauuauauugaaauacuuuaauaucucucauguuugauccacacccaauuaaguguuuuuauaccuuagcaagguauaaacaaucacauacaucaauuuuugucuuugaagauaaaggacauuuuuguggccgggcagugguggcgcacaccuuuagucacagcacucaggaggcagaggcagauggauuucugaguuugaggcuagccuggucuacagaaugaguuccaggacagccagggcuacacagagaaacccugucucaaaaaaacaaaacaaaaacaaaugaacauuuugugcucaugcaacaaaacuaaagauacuuaauagacauaauaaaccugcaauggaaguuucagcacucucaagcuaaccuuaauucauaagagaauaaacaucuuccaggauauagaagagauggggguaagggucaaaugaucagaggcacagcuaauagccuuaaaacugaaaggggugggagauauggcucagcaguuaagugcacucauuacacuuccagaggaccuggguucaauucucagcaccuacaugguagcucacaacagucuguaacugggagagcugacuuccucuucuggccucuacauacaccaggcaagcaaguggucaacagaaauacacguagaaaaaccgccuauauacauaaaauaaaauuaaaauuaaaauagaaaaaaaacaugaaguaaaagggaguggcaaaaaagaaaucgguauccaacuuaaaaaaaaaagaaaaaacaaaauuaaucuaaggauaucagagagacucagaaaggucaagguaaacaugaaccacacauaaaagccaucauacuaagaaauaaauauaagcaaauaaaccaccuacuaacugaaucaagaagacaguggugccucaugccuguaaguccagaacuccaaaaaguugagagaaagggaucaacaagaguuugaagucaauuugggcuacacagugaguuccagaagaacgaaccccuaucuaaaauaaagguggagagagggauggagaaaaaagacaaaaaaaagacuguuaagacaauacuauuaaagcugcaugcagugguauauaccucuacuuguagcauucagaagacuagaugaagacugggaguuagaggcucacuuaggcuacauagcaagacuguuucaaaaaaaauacauaaauacaacuggauauguuguaugucuuuaauccuagcacugaggaggcagaggcaggcagaacucugaguuggaggccagccuaguguacagaggguuuuccagacccuguuuuaguaaauaaguaaggcccuacaaugcuccaauccaauggucagacaaggucauaaaacuaaaccuaaagccaugaaucuaggaagggucggggugugugugugugugguguguguguguguguguguguguguugauagggaugggaaauggguaagagaggagugcaggagaaaguagugagaauggauuauauacguaagaaaccugccaaaagacaagcaaauuuuuuuaaagcacaaaauaaaaagugagcaccuaaauggaacaagagaugggagagaggggaaucuauucaaacuugccaaaaaaaaaaucaaugaaaaugaguauuuuguagaaaaaaauauauccaaauggacuccaaaugacucagaaaaucuacacagaccaauaccauagaauauagaaacuuguggaagguuucauaggaguguuagaccaaaucuuuaaagagcaguuaaugcaaaagaauaaaucaguauuaauggagaaaaaaauuaucuuucugaaacaagccuaacuuuugaaaaaaagaaagccaaauaaaaccuaacagccugcauaugcaaacaucuacaaauaacgcaagggucucaguauaacgacccaagaguuuaucaaacuaucucuucuacugcuauacaauuuuccaaaauaaaaagccaagauaaaguuuacuugaggaaaaaaaaaccuuucuauguaaacaugacuucacccauuaaaaugggauaaccagauaaccauguagcaagaguacagaaaagcaggcacucuaucucagaaacuccccauaggugggugaauagauuccucugauggaaaggaauuuguuaacaauuaucaaaauuacaaaugcguaucuuccuugauguaaaaggucaccaucagccaggcggugguagcgcaugccuuuaaucccagcacuugggaggcagaggcaggcggauuucugaguuggaggccagccuguucuacaaagugaguuccaggacagccagggcuauacagagaaacccuguuuggaaaaacaaaaaacaaacaaacaaacaaacaagaaacaaaaaaagggucaccgucaggaauuccuaucuauacccagacauaugugaaauuacaauguacacaauacuucacugcaguacugugcaaagucuucaaauaucccacuagcugucacuugugagguaucuaauuacacuacacccauaugaacccucagccgucagaaaaagggaaaggaaguuuacaaguacauacacaguaaguucuuucauauuaagcuuaaaaagcaagauagaaauaaaacuauauggugcaacuuaugcaaaaagaguagccaacagaaguaggacauagacauuuucugcauagguccuuuuacaucuuuugaauuuggaaucauguaacuguaaucuugagccaaaagagaaaauauaaauuuuuauguuguugcuguuuuuuuuuuuuaaucuugcccuugggaauggugcuacaauacuaucuuuguaaauugauauuccauuuagaauacuugguauucuugcagaccucauuuccaguaaagaugauucaagaaauuauucuuuuuaaagggcuuaaacaaguauuccauacagaacaaagggaggcagcagacuaaccagaaguacaccuacuuaauggcuucuagcccugaugaugcuuuggaaggacucggggugcccgcgacuccaugccccaagccccaagcccugaccucaacgcuuuaaaagaguaaacauuuguuucuagauacucaccacauaagauuacccaccauaacaauauccuuacagcaguuucccuauucaaauaacauccuugccuauaaacaugggagauacugccauagaaauaaaguaacugaaauuucagguuuacuauucaaacuuucacaaacuuugcaggugggagugagccauuucguuuguucuuucaauuaagagugaaucugucuguuuacccuaacaaaagguuccuguguucacaaucaucucuaacccuaaguuaggaaaacaugccuauugauagcaauagcaacguuuucauucuaagcugugaagucaggaccugucucaucucugggacccacaugccaggaggagagaaccaacucccccaaguuccccucugauccuacagauacaccaugauacguguggccacacaaacaaguucgugcauagauaaaauguuuaagaauaaauacauaaauucuacacauagccagagggaguagaguccaacuacugaaaagcuuuugaaaaugaaacuuaagaugcaaaggccaacuucacccucaccuuagauuuucaucaucuaucuuugguaacuuagcuucuaaaacuuaauuuggcaucagcuucaaccucuaaccuguaccucuuuccauccccuguguugcucccccaaauauagacaacaccauauuuugcauaucugguccucccagaagguuguaccuauuuugcauuuuuauauccaacugauaccaucccaugacauuuaaaucauaugaauucaacagaucuaggcuuugagagccuaagucaucuugaguuuccuuggggggaugcugaguuccauauuuguuuuauuucagguguuucauaaccgcauucggccugcuggaguuagaaugacauucucugggggaaacauaauugaucaguucauggaagguggcagaaccuauucccaucuaaguaggccucagacuuuauuggggguccucuccauucccaucccaauccauguaaaaugaaguacuagcccagcugccaaaaggguguaaggaaaggugcucacacuuaggcuggaguuguccuagaaccccugcuuuguagccaggagcccacaggucagcucuuacccaagacucugacugcuuugaagucagaaucauaaugauggcguucagguccugccacucaaggcuacccaacaccuuucagcagaaaauuuugaacaaaacgccacuacgugauuuacucaaccucaagguguuucuaaacacaucuuacacaaccauuaaaaacgccuaaaaauaaaaacguuuacgaguucucuuucugaaguuuucaggagagugcgguuugagucaaguagauuugaagcucguaaugaauagcuggagaguucugaguggaaugaggguccuuggacgaagcugggcgugagggugucaggcccugccccuccacuucccgaaacccgaaaccuaugccccaggagggcccucaggcaugcauccccaucaccccucccggagcuucucacggaauuugcccagaagcuuaaguaagagccccaacuacgggcaggacaaggauggcgucucccucacucccguggggccuuggagguggcuccaaggagucagacuuaccgaaguccaggaacuguuugauagacaguggcgacggggagaagcgggaguagcgcucgaucugcuuggggaccggcugcuugagcagccgguagaagagccgcauccucacuagagcagugugcagauccgccgagccguccgggaccggagccgaggcggucaccgccgccuagccgcgaggaggaggcggcgccggcggggcuuuaccucuaccuggggcucggccuuggcgccagcagcugcucgccugccgcgacaccuacacaaguaccgggcagcaguugggcggccguggccggcugcccgcggcuucccaagccccgccugaaaaaggcgggaucugccgccgcacg

SEQ ID NO: 9614 - RNA, 67598 nt, Mus musculus
cgugcggcggcagaucccgccuuuuucaggcggggcuugggaagccgcgggcagccggccacggccgcccaacugcugcccgguacuuguguaggugucgcggcaggcgagcagcugcuggcgccaaggccgagccccagguagagguaaagccccgccggcgccgccuccuccucgcggcuaggcggcggugaccgccucggcuccggucccggacggcucggcggaucugcacacugcucuagugaggaugcggcucuucuaccggcugcucaagcagccgguccccaagcagaucgagcgcuacucccgcuucuccccgucgccacugucuaucaaacaguuccuggacuucgguaagucugacuccuuggagccaccuccaaggccccacgggagugagggagacgccauccuuguccugcccguaguuggggcucuuacuuaagcuucugggcaaauuccgugagaagcuccgggaggggugauggggaugcaugccugagggcccuccuggggcauagguuucggguuucgggaaguggaggggcagggccugacacccucacgcccagcuucguccaaggacccucauuccacucagaacucuccagcuauucauuacgagcuucaaaucuacuugacucaaaccgcacucuccugaaaacuucagaaagagaacucguaaacguuuuuauuuuuaggcguuuuuaaugguuguguaagauguguuuagaaacaccuugagguugaguaaaucacguaguggcguuuuguucaaaauuuucugcugaaagguguuggguagccuugaguggcaggaccugaacgccaucauuaugauucugacuucaaagcagucagagucuuggguaagagcugaccugugggcuccuggcuacaaagcagggguucuaggacaacuccagccuaagugugagcaccuuuccuuacacccuuuuggcagcugggcuaguacuucauuuuacauggauugggaugggaauggagaggacccccaauaaagucugaggccuacuuagaugggaauagguucugccaccuuccaugaacugaucaauuauguuucccccagagaaugucauucuaacuccagcaggccgaaugcgguuaugaaacaccugaaauaaaacaaauauggaacucagcauccccccaaggaaacucaagaugacuuaggcucucaaagccuagaucuguugaauucauaugauuuaaaugucaugggaugguaucaguuggauauaaaaaugcaaaauagguacaaccuucugggaggaccagauaugcaaaauaugguguugucuauauuugggggagcaacacaggggauggaaagagguacagguuagagguugaagcugaugccaaauuaaguuuuagaagcuaaguuaccaaagauagaugaugaaaaucuaaggugagggugaaguuggccuuugcaucuuaaguuucauuuucaaaagcuuuucaguaguuggacucuacucccucuggcuauguguagaauuuauguauuuauucuuaaacauuuuaucuaugcacgaacuuguuuguguggccacacguaucaugguguaucuguaggaucagaggggaacuugggggaguugguucucuccuccuggcaugugggucccagagaugagacagguccugacuucacagcuuagaaugaaaacguugcuauugcuaucaauaggcauguuuuccuaacuuaggguuagagaugauugugaacacaggaaccuuuuguuaggguaaacagacagauucacucuuaauugaaagaacaaacgaaauggcucacucccaccugcaaaguuugugaaaguuugaauaguaaaccugaaauuucaguuacuuuauuucuauggcaguaucucccauguuuauaggcaaggauguuauuugaauagggaaacugcuguaaggauauuguuaugguggguaaucuuauguggugaguaucuagaaacaaauguuuacucuuuuaaagcguugaggucagggcuuggggcuuggggcauggagucgcgggcaccccgaguccuuccaaagcaucaucagggcuagaagccauuaaguagguguacuucugguuagucugcugccucccuuuguucuguauggaauacuuguuuaagcccuuuaaaaagaauaauuucuugaaucaucuuuacuggaaaugaggucugcaagaauaccaaguauucuaaauggaauaucaauuuacaaagauaguauuguagcaccauucccaagggcaagauuaaaaaaaaaaaacagcaacaacauaaaaauuuauauuuucucuuuuggcucaagauuacaguuacaugauuccaaauucaaaagauguaaaaggaccuaugcagaaaaugucuauguccuacuucuguuggcuacucuuuuugcauaaguugcaccauauaguuuuauuucuaucuugcuuuuuaagcuuaauaugaaagaacuuacuguguauguacuuguaaacuuccuuucccuuuuucugacggcugaggguucauauggguguaguguaauuagauaccucacaagugacagcuagugggauauuugaagacuuugcacaguacugcagugaaguauuguguacauuguaauuucacauaugucuggguauagauaggaauuccugacggugacccuuuuuuuguuucuuguuuguuuguuuguuuguuuuuuguuuuuccaaacaggguuucucuguauagcccuggcuguccuggaacucacuuuguagaacaggcuggccuccaacucagaaauccgccugccucugccucccaagugcugggauuaaaggcaugcgcuaccaccgccuggcugauggugaccuuuuacaucaaggaagauacgcauuuguaauuuugauaauuguuaacaaauuccuuuccaucagaggaaucuauucacccaccuauggggaguuucugagauagagugccugcuuuucuguacucuugcuacaugguuaucugguuaucccauuuuaaugggugaagucauguuuacauagaaagguuuuuuuuuccucaaguaaacuuuaucuuggcuuuuuauuuuggaaaauuguauagcaguagaagagauaguuugauaaacucuugggucguuauacugagacccuugcguuauuuguagauguuugcauaugcaggcuguuagguuuuauuuggcuuucuuuuuuucaaaaguuaggcuuguuucagaaagauaauuuuuuucuccauuaauacugauuuauucuuuugcauuaacugcucuuuaaagauuuggucuaacacuccuaugaaaccuuccacaaguuucuauauucuaugguauuggucuguguagauuuucugagucauuuggaguccauuuggauauauuuuuuucuacaaaauacucauuuucauugauuuuuuuuuuggcaaguuugaauagauuccccucucucccaucucuuguuccauuuaggugcucacuuuuuauuuugugcuuuaaaaaaauuugcuugucuuuuggcagguuucuuacguauauaauccauucucacuacuuucuccugcacuccucucuuacccauuucccaucccuaucaacacacacacacacacacacacacaccacacacacacacaccccgacccuuccuagauucauggcuuuagguuuaguuuuaugaccuugucugaccauuggauuggagcauuguagggccuuacuuauuuacuaaaacagggucuggaaaacccucuguacacuaggcuggccuccaacucagaguucugccugccucugccuccucagugcuaggauuaaagacauacaacauauccaguuguauuuauguauuuuuuuugaaacagucuugcuauguagccuaagugagccucuaacucccagucuucaucuagucuucugaaugcuacaaguagagguauauaccacugcaugcagcuuuaauaguauugucuuaacagucuuuuuuuugucuuuuuucuccaucccucucuccaccuuuauuuuagauagggguucguucuucuggaacucacuguguagcccaaauugacuucaaacucuuguugaucccuuucucucaacuuuuuggaguucuggacuuacaggcaugaggcaccacugucuucuugauucaguuaguaggugguuuauuugcuuauauuuauuucuuaguaugauggcuuuuaugugugguucauguuuaccuugaccuuucugagucucucugauauccuuagauuaauuuuguuuuuucuuuuuuuuuuaaguuggauaccgauuucuuuuuugccacucccuuuuacuucauguuuuuuuucuauuuuaauuuuaauuuuauuuuauguauauaggcgguuuuucuacguguauuucuguugaccacuugcuugccugguguauguagaggccagaagaggaagucagcucucccaguuacagacuguugugagcuaccauguaggugcugagaauugaacccagguccucuggaaguguaaugagugcacuuaacugcugagccauaucucccaccccuuucaguuuuaaggcuauuagcugugccucugaucauuugacccuuacccccaucucuucuauauccuggaagauguuuauucucuuaugaauuaagguuagcuugagagugcugaaacuuccauugcagguuuauuaugucuauuaaguaucuuuaguuuuguugcaugagcacaaaauguucauuuguuuuuguuuuguuuuuuugagacaggguuucucuguguagcccuggcuguccuggaacucauucuguagaccaggcuagccucaaacucagaaauccaucugccucugccuccugagugcugugacuaaaggugugcgccaccacugcccggccacaaaaauguccuuuaucuucaaagacaaaaauugauguaugugauuguuuauaccuugcuaagguauaaaaacacuuaauuggguguggaucaaacaugagagauauuaaaguauuucaauauaauucuguuuucccauaugucuccaguuuuugucaugugacccuugauacauauuagcugucauguccucauggugaguugucgccuuuaccauuacuaguuuaaugcuuuuuggucuggauucagccuuauuugaugcugagaucuguauucuaucuucucauuggcuuucuuauuuucaguuuuucugaauuacuuugauuuaaauauuucuucaaauguaaagcugguuuugcuuuguaauaauuguuuucuuuuauaugguagguuuagccugaauauacuuacugguauaaaucaauugaucugucauacauaaugguaagcauguauaauuguucccuuuuguuguuaaugcuuuaauuuuuaaccuugucacauaauuuauugcuuuauuuuaccacauuuauuuugguuaguacuuaggcuugaauuuuuauuucauuuguuauaauuuugacuuccuuucuauauuuuuauuuuauauguauaaguguuucgccugcguggcaugcaugcgcauugugugugcacuuggugccuucagaagucagaugagggggccagauuuccugggacuagaguuaagguagguugugagccacugugugggggcugaaaauggaaaauggguuccucugcaagaacaacaauuacucugaucuuccaagucaugcagccccacuuuauuucuuuagaccagaccuuccuuugucugauuguggucacugccuugcuagcucaugggccuuuugaggaguagaaauguggcuagcauggcugagaaacugaauugauuuaauuugaauucggaacagauuugauuugguucauuuuaaaauuguguuacauguagguauucggauguauguguguauaugguguggaggccaaaagauaaccuuggcuguccuuccuuagaacugucuuauuuuguuuucuuagauagucucucacuuacuguggggcucaucaaguagaucagagagccacagggaucugacuugugucugcuccaccagcaggagaauuauaagucuaagccagcaugccugaguuuuggugcuuguuuuuugagacaggauuucucugugauuagcucuggcuguccuggaaugugcuuuguugagugggcuguccuugaacucagagauccacaugccuuugccuucugagugcuggucuggaaggugugagucaccacugcccagcuggcuugcugacauguuuauaucuguucugggaauguaacucggguucucauguuugagaggcaaguacuucacucaccgaccuaucucuguauuccucaguucauuuagaauaauuuggaaagaauuuaccuuaacaaccauaaacuuuauggacuuaguuauaggccauuucuucaugauagaaauucagcuucuaaacugugaugugugguacauguaagauacauagcagauaacaaggaauucaucuaaaaccagcauaaugucuuuucacauuuuugaggugcugaggauugaaucuagagcuuuguauauaguaagccagugcucuaugacugagcuauacucuccaucuuucauauugauuguauauugaaaugauauuuuacauaugucaggauaaacaaaauuaaaaaucuuaucuauuuuugcuaaugugacuaagaaguuauaaauuauauauauaauucauauuccauuggcauauucaauguggcuucaaauaguaauuucuuaguggaaacacuaauauuacauuuuauguacaaaagaagcuuauugauuuuuguuaacauuaugguggcucuuauaccauuugggcaacccuucaguucugucuccuaaguauuguuucuuugaguuaauaauucucuuagugauuuuaccuuaugauuuuucuuuuagcuuuugauuaagaaaaggccaacuuggacuauuacacaguaauuaaagauacauucuugugcaaguugagugaguuugugggaacaccguuuucauuuucaucaguauuugcguuuucuuuuggccucacugccuguuucugaucuucucgcuagccauuuuugucccuuucuauuuguuucucauuuacaagcuucacuuguaauuaagaucuuuucguuccuuuuucucuuuauuucauccuguccucuuuccagaguguggaugcuugcuccuuuguagccgccuggcuccucagcucaguuuucucugcacagcgagagugggaacuccacaaaugccauagaggucaucacagauugcucacuuuagucaguuacagacguuuaaacuugcagaaaaauacagcgucucccaaauaaaauugccggaaagcagacuguuguacacaccuccucugucuuuucacggaauuccaugcuuugauuucuacccucaacaugcuggcucugugaaucuuccagguguuagcuguuagacagcagcagccaguccccuuguucuugcuagucuugagguuuuaagggcccagcugccuucaguuuugcuuuugcaaauauuuuaagacuccauuagccacugagacauugacuucagugccaagugcuugcucucugcaaagucucagguuuuuaagucaucucguucguucuuugacacuugguuuccaauggauagagcugugauuucacucguggagaaguugaaagguguuauuuaaagauuguguuaggaaaggggaaccagucucacccuucuuccugagcauguuuauucugccacuuuacaugugcacaacaggucuauucuaugaguagaaaagguccagcauugggagggauugucaagaauuagagcagccugucuagagacagaagccggcuauuuacaguuaaaaggggggagagcaauuuaguuuaaggucugaaucucauacuuagcuuuuugcaucuuugcucaguaaagagaacuagcuguuaggccuuuaugaucugauagggcuggguuuccauggaacucauuuauugggcucugggaaaccuugaggcaucuagaguugaaguucuggcuuuguuccuuuuagagcacuugagugucuuucaugagcuuuauuaguuuuuuuuauuauuaucauacaaguuaaauuucacuguagcauuuucauauauauuuucauaaauauauucuguuguguugguuuccucuucccacugcccuccuccugcuagcccuccuccucuucccaucugcuuucaugccacaucuguccuguuacccauuuuuuuucucuguccuccacuaacauggccuuccuccucauagucaccuuucuaguuucaugacuaacacauguguaacacacacauaucccuagcaucugccuacaaaguaaaugugggguuuuguuuuguuuuugcuuagugucauuuccaguucuguccaugaauaucaugaucuauuuuuucuuuauggaugauuaaaauucauuugcauaugcauacauuuauccauuaauucuuugugucccuuucccuucuuguuuggcuguuuauaacagugcagcaauaaacuuguguguguagcuauuucuguggacuugagguucuuuggcuauacccaggaguggacuagcuagguuauaugcuaauucuauuuuuacuuuuugaggcacuuccauacuguuuaucauggugguuggccuccuuugaaugcacacuagcagugaauaagcucuuugaagaggacauggugucacuugcugaccuuguucauggcuggcugcuuuccuccugguaagcuuuuggaaauugauuaaacuguuggcaagaauuaggaaaccuuagcuuuguugcuggaugcaauuacaaaauauuaccacuuucauuuuuuauauuguauauacaauuaaauuguuguacuucagugguaguucugucuuagaguuggguagaucucuccuuuuuugaauaccuuuaucuaucucugaucagagccuaugcuuuuccucauuuuuaaaaugaguacauguuuaagaguaucuuucgaugcacagcaaaauucugcaagugcagaaaguacagacuucccuugagcaucccaaaugcagccuaaacugccuucaacauccuguaccaugugagaccuugaggagcugccaguaaccauuguugcaacuaagaaaccaucaucagcaccaaaaguccauuguuuauacuagaaaugguucuuuguguguacucugaguuuugauacccacaaauaaugcuuuacuggaucguacacaugcucauuuguuacauacagucuguagcuuuggguuccuccccaacagcagaguugccuuguugccagaaacuguauguaugguucacaaagccaaaagugcuuauugucuggucaucuaaaacaaguucaccaaccccugaucuaaggcaguuauguccccucuuuaaagagugagcacuauuuuucugaaguugcaguaaguauaaaguugucugucucuugcuaacacucagcacugcuuauguggaaugugauuuauuggguggcuuagacuuuuccagagaaucugguauuuacuuauagugucuuauuucugaauaggaucuccauaugaauggcuuugaaagauuuuauagguucaguuuacaaaacugacaguacuuguuucucuacaggguugccaaaaugagguuuugggauuaauuguaaugccuaacauaggcacuacaagguuuuuuugccugauuagguauauugccuggaguuuuguucugcaugcagugucuuugaacacguaguaccuggaaucuggaguuugaaucauuugcauacauuccguguauguuucuguguugguagucagugaagaacauguugacuaacauagucucaaaaauaugucagugggacuguggcugggccaccugauaguugaaggcguuccaucuuugucguggaagauggcauugaaacuagcauuaaaguaucuauacgcuuuuagggcagggagggcuaauuucccuuuauaguucuuuaacuggccgaacagaacuuggucauggcucauguuagguucccuucauauccccuuuguuuguuuguuugcuuguuuguuuguuuuuuucaccggcgacaagguuucucuguacaacacccauggcuaucauggaacuuuguaaacuagccuggccucaaacucagagagaucugccuggcuuugccuccccagugcugggauuauagaugugugccaucauaucucuuuaagaacccugcuccugaucauugguucaucuucucgcuaagauuguaucuucugccauaaugaauaccauacaauuguaguaagugauuauauuucacaagucaauauugauauauucucucuaacugaacacuuuggguucuaacacaauggugcuuuauuucccuaaacaucauucuggcagcaacaguugaauuucauucuuagaguugaucugggacuccgccauaacauuugcuuugccccuguaauaucuuuggagaccaguauauaguagucucaguauaagugaucaacucuuccauguuucuccacaccaugaaguuuaauacugucccaugugguauuagaaaacaauagggccuuaugugguauaccuaucuuucugcaauaacuuauauuuugauagacaugaguauguauaaacuccuuguaaguguaggaauuacaggacugugccaccacacuguauaugaacucuuucuuggauaagcucuaguaacaugaaauauuuccuuaaguuugguagcagguauuucuugauccaugacuuugguuuuauacggguuaauuuguuuccugauucagccaguuaaauagaaagugaaguggucauuguucuguuacuaaucguguacuugucacauaaugugcugaaggagagacacuuuuuggaguaaccccuucuggagaaggcuucacacugaauccccuacucuguagcaauuguccuucugggcacuacucaucuuuggcuagugcucguuacacauuguaaugucuuguacauuguagaugucucugugcaguauacucaagucuuucuguuuuaaucugaaacuauuccaguaggaaaucaggcuuuauauugcaguuggaagagaagcuguugaugccacgaguauuuagagagcacuuacccaaacucaguguaacaugugguaccauuugguucucagcagcuguacccacuuuacaagugaggagacugaaauucugagcaggggagaauuacacuugcaguaggcagcagcuagguuucugcucaccugcccauccuaccauuuuguuuguuuguuuguuuguuugguuuuggcuuuuugagacaggguuucucuguguagcuauccuggaacucacucuguagaccaggcuggccucgaacucagaaauccgccugccucugccucccaagugcugggaucaaaggcaugcgccaccacugcccggcuccuaccauucuuuauagcuuagaacagaggugcugcaugaucgaaaugggggaaaguucaacaagugcaugguccucccuugucagacauuaccacauugucaaguacagcucauuuccuuaaugaauuuguucagcuuucaucuuccauuuggggucuccuaauagcgaaaggggagaaaaaaagaggcauacagauugaagguauccguggucaguuuucuaugaggcugaaauaaaaaaaagacuucaaaccugaaaauaaagacuaaaauguguagguagcuaaaaugcuuucaaaugcuccaugucugccauuugagccugagggauucuuugacucacguuuccucacuuaguuguacgugauuagaugcuagcguaugguucaugguucuugggagugccuaugagcugauaguguucccccaccuaagccacuuaauauucagucucucagagcggugucuaggugcucggacuuuugaguuaaccggugaguauacuguucuucaggagcuaagaacuacaguuaggaaguagcaauggaaguaaucuuacgggcaggggucaccacagccugaggaacugugugugcuaaagcuuuaggaaggcugagaagcucuagagucuagcugaucacagcuccuggggcuuccauauuucuucauacucucugaugcauccgacgcacuguguggccuuauugccacuguauuauucagaagaggguuacuaggucaucugauagcucuguacuugugcaugcauguguguccaugaguucagaggccauaagacagcuucgggcuguugucucucuggugcaauccauuuuguuuugcucaccagggaggccccugccuccugugcuuggauugcaaguguguguuaucauauucugagauuaaagucuuauaaauauuacuagagaaaagaacaugucaaagagcuacccuaaaccuauauccugguaaaauuuauccacuuuaacgugguuaauggaaaaaaauacaucaucaacuccaacuuuuacuagacaguccugggaaaacgcaaccucucauggcugagcagggucauucacacuaggguuucaggccucacuaggacuuucccuuuguucuccuuuuucacucacuugucccucccccugcuacucuguaaccgacccacaccaagugguagaaagguggagauggagauagccuuuaagaauccagugagauagaucauggaagauauccucaacauucuucuucaauuauaaaaugcucauuaucaggccauuucauuaacagaauauuuuuuucucucucaccuguaaauuauuugaaaacaggguuaaagacaccagcuacuauggaaaagucuugucugggaacccuugcucucagguggcuggacaaauacuucuugauuccuccacaagaggacuccccaaauuuuaauuuuuaugccuauucuuccgauaccuugguaaacagaaagcuauaaggagccauccuagaccagggaaacuguagggcuuucugcacaugaauaguugucucaaacuuuccagugaaagacagaguauaaaaacacaaagacacugagugggagaggacguggaccucuaacuuuaaauccccagcauugaaaugaagcagaaacaagagacucagaggcuuaugaaaccaggagaaaagcaaccccugggacuaggguuugcugagucaauucuucuccaagauccucaugguuuccucucugucaucuucuaaauggguauuaggaaaacuuuaacuggcacauccaaauaauaggaagcauauagagaaauguagaaauaauacuguuguucauaaauagaaaauaagaagcagggaauguagagaagccaagugugugggggagggaggaauggaaucaaagaacuggaaagaauagcuggaaaagacuuguggaagugacuccuuugagaggacagcuauuaaaaaccaaggagguucugauacauuuauuauaaaaguggcuaauauaaccccuugauaaguauucaacaucuaggauaaaauaucuuuaauguauaugaagaaagccacagaaaaguuguaaaaaucagacauuuauuuuuagaucggcuaauuaacuaacuaaaaagacuuaugcuccuguuuaagcugauguauaauuaagguagcuaaguacaaagaauuuguucuuggagcuaaauuagaauguaggaggaaaaaccugggaauuuuuagcuauucugcauuaaaaauguaaaccuuugaaagcaugaucgcaucuuccaaaaagucauugagcagcuauaauaggcaaggugcugugauagguguucugggggggggggauauaagacaaauuucucuccacggguuuuaacaaucugacaauccaguuccacgagaguccaauaguuucugacaccgguucucuuagauccuaccgacaggugauagugcagaguugccugcagugccaucuaggacuuuuauuuuaaaauaguggguccuaggaacagugaacacaccuucaugguuuuuaaagugauguagagucgucagaugagcuggggaaucacaccagucuagaauagagucgugcucugaggaccgacggggcauguagcagacaguuugaugucgcuccccauggcuuugaacuguucugcuugguuaucaccaaucauuuuuguuugcucuuuaaugaacucuacuucuaagauuaaagaaugugucaauguucaguguuaaacaccagccuucacuaaaccucuaugaagaaggugcucauauuuuauggaugguugaaguauaugagauagagaagacugaagaagucugugagcgcuuaagauucagacccaaguacauuauugccguucuguagggccauacacuuuuauuggaaucgugaaguucaaaaguucugaaaauagaauuuuaaguuuuagugccccacuuauucuuugguagaaucuaauuugagcugauuuaaagaauagacuuuaaucuauuuaauguaaauguucauauauuucacuguaacuauauuauaucuguauagcauuccauauaacaucagaauagcauagauucuuuaauuuuuaaaagguggaaaaccuuucaauucuggaccaucuagucccauggguuuuagaggagagacauggaccuggugguuagcucuugcuuauuauagccuuuacuucauccuacccuguucuucuaaucuguugcuccuaaccagcuagagacuaggaaauuuuagcauguaaacuuuuacuacccuccccccaaagcuccucaggguuuuaaaguuuuuaguucuacagauagucauaauuccagcuaucaauacagggauguuuuauuucuuccccauuccagagcuuucuuccccuugugaaggaauuauuaauaaucuuuguuaaagaugguaugguuugaauggaacuagaauggcccugcuggagguaguaugucacuaggggcauacuuuggaguuuuaaaagcccaugcuguucccaguggcucccucaucuuagcugccuggaagucaguauucugcuagcagcccucagaugaagauguagaacucuuagcuccuccugcaccaugccugccuagauacugccaugugcugccuuaaugauauuggacugaaccucugaaccuguaagccagccccauagaaguaaguacagcagcaggcacacauggcacuggaacagaaacugagacucacaucuugauccacaaacccaaggcagaaugagggucuuaaagcucacacccacagggacacaccuacuccaacagggccacaccuucuaauagugccacuaccuggguggaggauauacaaaccaucacaaaccauaagccccaaauuaaaugcuuucauuuagaaguugcuuuggucaugccauuuuuaucauagcaaugcaaaaguaacuaagacagaugguagggaacucuguucaugagugaccacugcagggcgauuuuauaguaggagagagagauugggcucagcucucgaugcaccauggacaaauggagauuuauagcucaggaacaguguuaugugugugugccugggcaaagggccccuggccaggaaauuaguagcagggaucagugcuuggggaggcucuuacuagagcaacuagagcccugcugaaaacugucuggaauguuuagauacuuagaauagggagugaggaauuugaucaguaccaagggaaaccagacuuuugcuaaaggcaaaggacuuuugcuaagauggcaugcagauucuuguuacaauguucuaagcaagucaaccuagagcgcaagguugagcuguucagagagagguuucagaggaagcuugauugaaagcuggucuucaguagcccacagugacauuuugugugucugugugugcuuaaaccaguguauuuuuaccagaaucuagaguauuucuucuguccuguaaaaacccagauuuauauuuuaacuuaaaauagauuaaaguauuauuuaaaucagcucaaauuagauucuaccaaagaauaaguggggcaccaaaacuuaaaauucuuaauaguccaauauaauuauaauuauaauauauauguaauauauauuaaccaauauaauuaacuauggcaauacuaguaucuuugugcauaugaaauuaaaauuauaugcaucaauaggagcaauauauuuuugaagcaaaacuaccaaaaucagcuuggugaaguagcuguuggcugcuguuucuggaguauuauaccccuuccccucuuaccugggaacuaaugucagagggcuaagggugagugaaagaaucaaucguuagggauuuuccuaccaaagaccuucaguauacucauggugaaugaagaaaacaaugauuugagagcaaucuuucauucuaauuuguuuaaauauggaaaugggguccagguuggugaggaagaaaagagccacagaugacuuucaagaaugacucuuuuuuuucccaagcuuuauuuuguagaaaggaaagggagaagucagaaaguggauggaagcauuagaaauaccauguguguaaaccuuucaguugcugccuuuuuuauacagggaaagcuuaagagaguuuggaaggcaaaguguuuagaaagcuucccucccuugugucuggucuugacucauuccagaacagcuuccagggaguggagcaucagggaggccuagccagugccagggagacaggauagacccacgaggaucacagaguggaggaccacgguuauguguggguuacauguugccuuuacaaagauugaccccccgccuucaagauuaggguagcuaaaguuaagaggcguaguaagccuuaaccaauguuucacacgcacaggauggcugacuccgguccagaggguguuucucaccccaaagcucauauacuuuauuucacaccucuccccagccauaaguuuguaacagguuugggaaaguguucuggccacagugaaguugggaaaagguauccgcaugccuuuucugucauccugcuauucaugugaauggacacccaucuccagaagauuuccucgaccacgucuugucuuuuacuuuugggaaaaucugauaggugauaaccuacucuuguuuauauuaaucauaauggagugguauaaaauguucaguacaugauaauaguuuuauaauguuaacaucagguuaaacauaguuaccucauuaaaaauuugguccuuucucugugucaaacuuucaauuuucuucuaguuuuggggaaaaugcgguauauaauuguuagccauauuguacagcauuacaccagaacuuacuucuucuaacuucagcuaggagcucuuaauaaagccccaccccauccccacugaccccgagcucagagccauuguucaggucucgauuucugcuguuccacaugcucacgugcugccugauuucuaugccugccuuagcucacugaccaccuauaggguagcuuuuuccuucuuggacuugucacagugggucauucacugggaguacauuguaagcuuuuugagacguauuaguugugugacuuagagcugcucguuuggaaucacagaguuucugcuuccaggauggcagagccaugcguuucuuuacauuggaagaaaacucguaacaagugguuggcaugcaauaggcgcauuuacagaaggaacggaucaugcugccuccccgaaaaccacuaugaacaauaguagauuucaauaucauauuguucuguacuuggcaguuuccauacaguguuuauuugaaagcaaacucaaauuauaucccaggucacuuuuauguuguggccagcaacacuagguaccuauuuguguuaagaaaaaaacugcuuucaaaguugccucuuggaauaaauguucuuuuucgcuucuaauuaagcuguuuucuuaaacuuguuauuuuggagaaugaaaauuuaacuagacaucauuauauuacuuaauuuccuuuuucuuuuucuaauucugugaacaugagagcauuuuaugucucuagauguuaauuuuauggaauuuuuucaucucuuaauaggaagggauaaugcaugugaaaaaacuuccuauauguuucugcgcaaggaacuuccugugcgacuggcuaacaccaugagagagguuaaucucuugccggauaacuuguugaaccgcccuuccgugggauuaguucagagcugguaaguaagugcugcgaacaguucugcacuggaagcauuuugcacagaaguguacaaacugucugucugggaaugaggcuuucaggagagcuaggcuuuccgugcacuuaagcuuucaacuauucguuuaaaaauuuuaauguaacuauuuugaaccauaagacacuuccugaaccuuucauuuuuucuuguuagagacaugauugcuuacugaaaaaaaauagagaauaaaaugaaggaaugacauuacagugaccaguaucaguggaccuacuuugauaaagaaagaaauugaggcagugucucuugcaucccagacuggccaugaguuccauuuguagccuagguauccuuugcacaucugauccucuugccuccugagugcugagggcacacugugugccaccauguccaguuacuggggacugaagcagggcuuugacaacagaggcaaagcaagcacuccuaauugagcuacgugccuagcccauuugcccuccuuuggauagagagauguuuucaaccuuuaguaagucucagccuugccucuuuuauuuuuguuuuaaagaucuuucaugaaggaaauacuuuuuagacuaaguccuuuauaggggaaccucauguggaaaaaccaaucaugucccugcugugcugugccugcucuaugcaagaucuuaaagcaaaguuaaaucagucagagcucugacuguaaagccugcauucucugucagaggaaguggagucugcgaugaucccccacccgccgugaggucacugagugggaggcuggaagaaaagguggcauguuuuuagacagagauuugcauguuuggucuacucugcuauaaaaagcauggcggaagcauguggagaaaccuggaggacuguaaggaccaggaggcacacuguugcuaaucaggaacaguguugagaacaaaaaaggggcagaaaacgcuagccauggccuuguacuguuccuugauggguggguggaguugacuaguguagaggaccaucuuaagaaaucaccagcuuaagaaaacuagcucgaauucagaggguuugugguggcuuggcuucugauaaagaaugaagaauucaauggccauuccugaagaauacguuuuugugaaaagcacuguuuuaugcaauaaccuugcauggauuagggguugaccuaauucagaugacagggaaugaagaagugauagcucacauauagaaaagcuggaguugccgggcggugguggcacaugccuuuaaucccagcacuugggaggcaggggcaggcggauuucugaguucaaggccagccuggucuacaaagugaguuccaggacagccagggcuacacagagaaacccuggcuugaaaacaaaacaaaacaaaaaggaaaaggaaaaagaaagaaaaagaaaaaaaaagaaaagcuggagucgagugagccaugcauuuugauggacuugcaccaucagaauuaaagacacagauuuaugguauauagcugaauaaggugguaaguuuagcuguucuagguagggagacucuguaggcaaacagucucaggcuguacauaccugggaggaggaaacuugagcuguagauaguauaagcacugucagggacacuaugaugaagguccucgguaggcaaagucauguccuuugauccauuagguugcagcaauuaaccaguuuccauugcuuaugcagcaguuacuucaggaacuucaaaguaaauuacugccuccgaacuguuuuccaacaugagccaacucugauucuccagacaccagcugaguguucagcaacuguucaguccugauacuaaguaucugaagucagcagaggccccacaauuucagagcucagucuccagagacugacaccauacauuaugugucaacugcagguccuggaucuauccaugccuuugacugacugaugcaauugacuggcuguacauugaguuuccauggcccucuucugagguuugauaauuggcuaaaguggaucacagaauucaggaaggcacuuuguuuauauuugcagguggauaggaaaagaaacagcaaaauggaagaaauauaucagacaagguguugguguaacuuugcagcauccauacccucccugugugugcucuguuggcaccuccagggguucaguacaaagccuucagcaucucuucauucaggaguuuuuauagagcuucauuuucaguccucaugccuccacagagguugggaguagacuaaaaguuugagcucucuaguuacuugcucauuguuuugaucaagaucauguugacacugucuagagccccacucuaagugaccuuauuagaauaacucaaaugugagcgauaggugcuucuucugaguaacaagagauacuccugucauucuggaacuuuaaggcuuaggaacuguaccaggaagcaggagugaauacuaaauuuauuuuuguguuaugcauauaacacuggcaaagugaaguauagacucagauuacaguguuaaaccuuccuuuguauccucugcauuguccgugucuacuucagacugugcaugccauuucuuuuuguucauauacauucuauuuugaaaaaaauaauuuccuacuuaagaauuacaagacuaguagaaagaauugucauauaccuucaucuagcuucacugauaacauuugacuauauuugcucuuucauaauucauguuuaucuccucucccacauugaauggggagagauaauaugaauauaugugugcauguauauauguauauaauaugacauacacauaugcaugaaagaaauguaaacauugucaggaucaaaauggaauugguagagcuagggaguuacuaaggacaauuucuuuugcaugguuguuacuauuagugacuagcaugagauucuaggucuacacguucauacggaggcucuugcaaccuuaugacaucuguaagaccauccggucagcaagucuucaaccuccagaacauucuacccuugguauuaaucauuagaaucgacaguucuugauuucaacuaucugguaugaucauuuuucuuuagaaguccccuugccuugggccuuuucuuuuccuucuuuaaucauauauuacuaaccaugccuuagguauuaaagaagcagcaagaugaauaaaacaacaucccuguuuaacaaggaaccauuagaaaagaaaggacaagcugguaaggggagucgaaaaggaaguguguugacacaggagggauuuuagaaguguagucagggaaucuacaaggaggugcucuuuugaacacauguguggcuuccuguagcaugaacacauguguggcuuccuguagcauguccuuuuucuuugaaaaugcucuuuccaaauaaauaucaguaguauuugaggauauaguucagauuguuccuuuuacugguugacaucauacaaaaauucauugcuuuuccugaaacauuugaauugauguugacauuauguuuguuccuuugcccccaaauaacuuuaacacgcaucucuggggauaacucuuagaaaaccaugauauaaauauucacauuuagaaguuugucauugaucuaguaaauguuuccuaauagguagugcuuguuauuauuuuacuaauugucuuaauaaugauccuuuaaaaaaauugucaggcaugguggcgcacaccuuuaaucccagcacuugggaggcaaaggcaggcaaauuucugaguucaaggccagccuggucuacagagugagcuccaggacagccagagcuacacagagaaacccugucucaaaaacaaaccaaaaaaaauugucuugauuuaagaauccauauuaggaucauguauuuauuuaugugauccugucauuugcuuuuacaagugacuugcaugugaaacagggacuccacuguucucuuagucacccuguagucuucccguuuucuuuucaugcuacaaaucuuaguaugaucuuggauucuucugcauuuauaacuuuucucuuuaaaggauuacugcuuugggaaaaggcuggaggcccaccuaacuugcucauguguggcacaucuuauuaagacuuaaggauuuuauaauauacacaguuuuuucuuguauuggccuuuauugaaaacuaucgugaucaauuuagaaucuuuuccugaugugcauuucucuaguacauacugaugaaguuaauuuuacuguaagaaauagccuucuuguauucuugguguaugcuucaggaucaaaccagagugcuucuuaaaauuuugugaucuuuuugccaaaugugguguguaugccuuuaauccccgaauuuaggaguuaguagcugauagauuucuaugaguguaagguaauccugguccucauauugacuucuaggccagccaaggcuaucuagugagaccuuguuucaagaaaaauuuaugugcuuuuagaguaaucaaauuguagacuuggaguaugaguuaggaugcugaaccuggcuuguacaaccagaagggucagucauuggaugaguucuuccuauuaguuugaaucagagacacacaaagcuaucagagcuaugcuuuuuggcaguguuggcuuuguuuucaggugagcuuccuuccaggcggaagacugguuguagaaguugcagauuucauacacuguaccaaagcagagaaggcaguaugcuuagaaaccuccagcaagucuucuauguauuucuuuccguuugaauugaagcccuagaccuguuccugagucagugccuguuucagggaugcauuugguucuuagucuuagcuauggacugugggacuagagaguaaguauugaugagagagaagggcucuuccuacaugcucuggaggagucaccucggccugaagcccugaagcugcagauaggagugggguaaaggcugagugaggagggagggagcaggcagguagcucacgugcugacuuguguuuucuagguacaugcagagcuuccuugaacuuuuagaauaugaaaacaagagcccagaagacccacgaguuuuggauaaguaaguaugaugccaauuacaugaaaguaaaaauaccucggcaagagaacauuucagugaaauggaacucauguuaagacuagagaguuauaauucagggcuacgagauggcucaguaguuaaagugcuuacugaacaagugugcagaccugaguuuggaugugcaguugucaaguggguacugggcaggcaugacagccugccuguaauccuagugguuggaagucacccuggggauccccagagaagcugccuagcuaaauguccugaguaagcgagcucuagguucaaaugagagacccuguuuugauaaaugagguagagagugacugaggaagacaacugauacuaaccuggaauccucauguguguguacauuugugugcucaaguuuuaacacgaauacucccacauacacuacacacacuuuugagaacauaaauaacuggaauuuagacaaagguuuuaauuuucuuguggguaauaacauaguuguuguuuuuuuuaacuuaagaauuuagcauaauucacaaagaacaaugaaacuucaauuaaugcuucaugacccaguucuuaauauauguggucaagguaaaauagacagcagcuuacuauaagcauuguugggaauguuccaucuagugguaguuuuaagaaugcaauagccuccauauauacagcaaguaucucccuaauccaucaacuuaaaauacuuucuaaaguaaaauacuuuuugagcuuagaaaauuguagugauuuuguuuuggagaagcguaaaaguguuuuuuuuuuaaauauauauauauauauauauauacauacacacacacacaacuguuggauucuauugcugucacugugcacaaagacuauggaauucucauguuaccagaaaguauuucuguuuucuauuuuuguucuccaguaaaccauaaccucaucugugaguagagcuuuuuccccccaagagaaauuaaguaucuccuuuagccugauuucuuccuguuggggaucuacacagugaauacucacggcauccaguugugcugaggacuuucuuuuaucauaggcuuaauccucauaaucaugagacaaacacuuggcuuggaugagcuccgugaauagaaguagggaaacacuacaccacacaaccaaccuuggagaguuuuaacccaggaaaucuggaggucagagguguggaaggaugugcucaagguugugacagagcuagacccgugagucauuguuccuuuuccauaguaugcugguccucugcaguguaccauacagccagaaaugcugcuuucaggcaggagaagggagcucagggucaguuguaucuuauugaauggaucuggugaaugugaaaaguacaagcauuggguuagagccacacauauaguuguuuccuugauacuagcuagccacugcugucuguaacucuuauuuuuucaaacucuauuuuuaaugaugguccuuaaacacuuuaaccucccuuauagcccaccacccaccagagguagugggaaagaaaggauaugggggaaguaagccugcuuagaaagguucuuuggagcaacucucaucaguguugucuggaaaucagcaguucaguuuacaggucagcaggcgguggaagcucauacacucgaaaacacuucauggauacaccgguaguccaugaaguccaugaguugggucagcaacagcagugacaugaccuagcagagacagccaggccucagccucggcuccagucagcaggagggaccaacaggaacaccaggagaaguucucagcugugccucucucagggaagcgaacugguggugcacaagugcugcacagcaagcucagccucccucugucacuguccauugaguucuuuuuauaaccuccaaacaucacgugucuucuaaggguugugccucaacacgugcacccgucucagcugacaaucagccugaguccaaggaagcaggaagcugcaagaaacugcagcacaccaccagaaggguuuuuugcuuuuguuuuugucuuugucuuuguuuuugauuuuguuuuugucuuuguuuuuguuuuuuguuuuggcucauuucucucuguggagucuugacaaaugcagcucaacuacucaguauauggugaaccgaugcauuugugucauuagcaaaaauuccuuucacguguuugguuuagcagaacauccuuucuccugugucugcuucagcuaaacaugccuucgugagucggcuuuagucuuucacaccuguguccgcuucaggacacaccuucacauguuugccccagcaaaacacaauauagcauaauucacuuuccaacaaacccguaagguuccacaucaacuguuauuuaacguguugacauuaaauggauugaaucuaggagcuuuguuuucuuacgucauuaguugaggacauuugaaauucucaaaauggagcuagccucuagguguacacuugaagauaaagauuuggagaaguacacaauuauuaauuaauugcuaugguuuuuguagaguccaaacucuaacauuauuuucaucaggaccaauuuaagugaauggacagugcugaaucgagugugugcuaggucuucauggcaguagcucuuacucagugaauuucgauaacuugcuggcuuuaugcagcgguuggaaaguugagauuugaguugccucgugcuguuaguaaagggaggggugcgagaugaguguguauccugguaacagccuucucuguucagugagaacauaaauucugccauacguggggccacuagcuggagagucauuuaugucaaucacauugguccucaugauggagauagaaaagcccaggagaguagggagguguucugagaauucauccauuuaaauaagccucuuuccuucaggugaagauguuucugcacuauaaugaauuguuucauuuuacagauacuuaauugauaaauacauuggaaagagguacaugaaaauuuacccauuguaaaaauuucuugugcauaauugcaaacuugggcuuuuuuuguuuuguuuugaagaagggcuucacuguggauuagccugccuaugcuuccugagggcugugauuaaaggugugugccuccaagccuggcuaauugugagcuucuaguuucagaguuuauucaucuuugcuuucauuguacguacauauuuguuacagaaaauuuucauugaggaaaaaauaagacgagauaaguaaaagaaacuuauuccaaaaucucauuacuagaggacagccucagcuaacauuuucuucugccguuauuuuccccuaagcauucauauuguaugagugugaaguuuuuugagacaaggauucucuauauagcccucauuguccuauaauucacucuguagaccaggcuggccuccaacucacagagauccacuugccucugccucugccucccaagugcugggauuuaaaggugaacaccacugcucagcaauuuuuguguuuacaauacaguucuuggccacuuaauaguggccaguaauuuuauaauacagucauggaucacucaaugacagauaccuuagagaaaugcuuuaugaggaaaaauuguuuaugugaacacuguagaguauccucauagaaacauaagaggacuacaaccuuaccaggugacauaaucuuuuagggacacuauuguguacagucugucacugaaauguuauuguguagcauguagcugucaguacucucucacacacauacaugcacacacacacacaugcaaauugucuuguuggguuguuuguuuuuguuuuuuugacacaggguuccuguguagcccuggcuguccuggaacucacucuguagaccaggcugacuucaaacucagauccgccugccucugccuccugagugcugggaucaaaggccugugccgccaccacuuggcacuuacuuauacaccacuuggcacuuacuuauauuauuaauucuacagauaggucaugcuauuugacccacuaauguuggcuuuuauccugguuuguaguuuucaguaccuucuccugugugugagucuaugauccauugcauagguguuugugucugagaguaccgugucaugcuguggauguggagaucugaugacaguguugggugcugcucuuugccuuccguuuccagggauccacagucaggucagcaagcuuacacagcacugcauuuacgcagcaagucaccuuacuagcacagagugcucuaaaaacagcuuuuguuuucucuuucucuucccacacuugcauucucuggguaugauguaugcguuugcguguguggaaagcaguuuuuaaaaacagcuauuuaccuuguccacuuguuucccuagcguugauccuagaaguggaauuaucuucuuuggacuucagauauauuugguuaaauugcccuuagaaaauguuccauuuagcgcccacacgcaaccuucacugguuauuauuugccauucuaauaaauaauguuuuccuuugcuuuugugcugguaaauugauuggcacugugcuugaguuuuucauagauuuucccacuaagauccuuucccuaguuuccagugggauguucaucuucacuaaguguaugggcuuuuauuucuucacuuacucaucaauuccccaguuauguucuuuguuucuuugcauuguguguuucugcccuugguaauaagccgagaacagccgccuuuaucccaaagguauagacuuaauucagcugauuuucuuuuauuauuucugugauuucacucuuaacauuuuugucuuuuuaaaaagaaauuaauuuuguguauguuuauauggcuuauguguacauguguauguaugugugugcacugauguguacauguguauauaugugugugcacugauguguauaugugugugugcacugauguguacauguguaugugugugcacugauguguacauguguauguauguaugugcacugauguguacauguauauguaugugugugcacugauguguacauguguaguguaugugugugcacugauguguacauguguauguauguauguaugugugagcacugauguguacauguguauguaugugugugcacugauguguacauguguauguacgugugugcacugauguguauauaugugugugugcacugauguguacauguguauguguguaugugcacugauauauacguguguguaugugugugcacugauguguacauguguguguaugugugugcacugauguguacauguguauguguguguacugauguguacauguauauguaugugugugcacugauguguacauguguauguauguauguaugugugagcacugauguguacauguguauguaugugugugcacugauguguacauguguauguacgugugugcacugauguguauauaugugugugugcacugauguguacauguguauguguguaugugcacugauauauacguguguguaugugugugcacugauguguacauguguguguaugugugugcacugauguguacauguguauguguguguacugauguguacauguauauguaugugugugcacugauguguacaugugcauguguguguaugugcacugauguguauaugugugugugcacugauguguacauguguaugccugugugcacugaugugugcauguguguaugugcacugauauauacauguguguguauguguguguacugauguguacguguguguaugugugugcauuuucaugugccuaucagagguugaugucagauguuuucuggaucacucucaccugauuuuuucagacagacucgcucacuaaccagggaccuugauguuuugacuagacuggcuagccaguacuccccggggauccaccugugucugcuccccuggcucugggcuuacagagaugugcuaccauaccuggcuuauauguggcuacagauccucgucacuuuaccacccccccaagccagcuccucacuauuauucuuacauuucucauucucuuggggcuuaaggcuugaaauugguauauaugguuuaaauuguuagcccucuggccccaucaguucaauuauuuccuuauuuccuuacugauuuacauucuuuuaguaaaaaauaaaaaaaaaauauagaaccuccaagugucagcacauuccuaaaaaaggauuugaacuguuuuuuaacuucacuagacccuuuuacuuugugugucuccgaaagaaugccaguuguaaguuucacuagguuuuagcguuuaugcuuacuuccuuuuacuaucuagugagaggaauguuucuacuuauaaagaauaccagcagguaacuagauagaggugggggauggcuuucagcccgugaaauguaaacuuaccacauuguauuuccuucccacacagcuuucucaacguucugauaaauaucagaaacagacacaaugauguuguuccuacaauggcccaaggcgugauugaguacaaggaaaaguucggguuugauccguucauuagcaguaacauucaauauuuccuggaucgguuuuauaccaaccgcauuucuuuccgcaugcuuauuaaccagcacaguaaguuggguuguuuucggucuaguuuugaacagguaaccauauugauuuuucugaaaaguuuuccuuuugcuucacuuuaaguuuacugacuuagacuuuggcuauagaaauuucauuucuaguucaguuuuuuuuguuaagggaauccuuccuauuauaaaaaucuguuuggcuggguuggcgagcagggggagggauagggguuuucagaggggaaaccaggaaaggggauaacauuuaaaauguaaauaaaguaaauaucuaauaaaaaaaauaaauaaauaaaauccauuaaucgauauucuugcauaaaaguuguccuuggaaggcuuugugaugcuuauauuauaggcagggccacugccugccuuucaaaggcucugcuguuaccuuucuguggagucaagggacuggcuugaauggcagccacauuaauuucucaaugguuuuaaaagcaccaauaugggaauauugaaugagcauguuagauauauaagcaauuuccuugauugcacagugauagguaaaaucugauuuuuaauuaguccaugaugcugcacugagaguuuaguauauucaguucuuucaacacaaugaacuucuucacugauuuccaguacugucaccuugguugauuuuuuuuuuaauucuaaggaaaagcauguacauauuuggaguuguccuugcugaaucagagagggagcaaaacuuuauuuauuuauuuauuuauuuauuuugguuuuucgagacaggauuucucuguauagcccuggcuguccuggaauucacuuuguagaccaggcuagccucaaacucagaaaucugccugccucugccucccaagugcugggaucaaaggcauaagccaccacugcccggcaagcauuuuuaauucauuugauuuacuuagauaagcaaauguuauggaacuguuaauauguacuuauagccgggcagugacagcacaugccuuaaucugaguacucgagaagcaagagacagggaauuucuagguuugaggccagccuggucuacagagugaguuucaagauagccauaaacccugucuuuuaaaacaauguauguauuuauuuauauuuuuuagaaacauguaugauaauuuauagaaaaaaaaaaaggaaccuaaauacaagccagcuaauuuacugacauaguggcaauuuccuuaucuaagcauauuuguguucacauagauaugcauauguuuuguuguugauuaaacucaugcaccucuguuuuuuuuucuauuuuuaauaaguuagaacuuuauguacuggcauacaccuauauuugucguuuuuauaaucucaagucauuccuauuuuguuuagauauuuauucuccuguuguggagucuaaguuaguccccagguuugauugauagguuugauaaaguauaccuauaaaaauuuagcuugcguugcuuuuuuucuuuucagcuucuuuaggcuuuuauuugggaauaaaaaucugcaacuauuguguagaguaaaguggaauagcuuucuaaagauauuugaacaaauacgguuuguguacauagaacugcaaaagauccugcaugguggaggcgauugcagugcuaccugugaggguucuucaccaauggcccaugcugcaugucggaaauacuuagugacugcaguaaauggcugcaaguguugagcccucagggagauagccugucaaucauuaagugucuuggucuaguuaucaucagaagaggaagaaaggccugggccccugacaugcacugcugcuauaggaucuacuaccugugccugaugggacuuaaaguacaccccucccccuuuugccugauguaugugcucccucauagaguauugcauugcucaaagucauuguggaucccgaaaugauucuaaaaagaucguuuugacaguuaggacuuuauuucugugcuugaccauaucagcugacuguguuucaaucccuuuccuucucuuuuguguucauuuagcacuucuguuugguggugacacuaacccugcacauccgaaacauauagggaguaucgaccccaccuguaauguagcugaugugguuaaagguaaggaugccaggccagcggcacugaccguggcagaaauagcauugggguuuauuugaggcagcucagcuguggggucauguugcuguguagucugugguucaucacagaccauguuaggccuaaaccaauuaauccaaauaugaaaucuuucuaguucagggaaaaacgaauaauuucuaaugcucaaacaccaguuucuacuuuguugguuaggguuguacuuguauugcuuucuuaaagaguaaacauuucaggaacgucuagauuugacuugccaucauuuuuaauaagaauuauacguuauuaaaugagucugcauuuacaguugccaaagcuacauuucuuucucuuacauagcccuaguguuagaagcuauccagccagugggcuuagcugcguggauacuagucaguauucccagaguagaggaggucagguacucauagauagaucccugguccacgggggacuuggcguuugaauagguggaucucauuaucugauuaaaauaaaugcugaaugcuaugucaagaaagcuugacugccugugacccaccagguuccagcacuucucaguuuugacuuugugcagauucauguuccgaaccugucuccuuccccagauggcauuuccggcucugcuucucaucuagcuuuaaacacuuagcuggcaagcuuugcgugaucauacuuugucccugguuuucaucagggaccuugguuguucuuaagcgaccacggcuaaggacagccugugcaguauauuuuccaggucugcacgugacucucuuuggcgagaagacauuuccucacaucauuucacuuuuaaggcaacugggucuagcugauauguaugugccuuuucuguugagcuauacuugguguaaggccagggaauaugucuuuucuugcuugauaacuuuuauagaacccugagugucuguagaaauagaagaucuguaaauaaucuguggcuugauaaauuuuagacauuuaaaguuguuaaauuuuauuauuaaaaaauguggaugucuggucauggcagcacacaccuucaaucccaucacucaaggaggcagaggcaaauggaucucugugaauuugaggccaaccuguucuacagagcaaguuccaggacagccaagguuacacaaagaaacgcugucuggaauaaccaaaccaaaccacacuaauaaacaaaaacagcaccacaacaaaagaagccaaacaaaccaaaaaugggcuggagagacagcucagcuguuaagaguauucacuguucuugcagaggacccacauucucuuccuggcucccacauagcaguucauaacuguccaguuucagugcccuuuucugaccaccucuucugaccacauguguuguaugugcauaaacauccaugcaggcaaaacacucauauacaugaaguaaaguuuaaaagguauuuaagaaguuguagggggcuggagagauggcacagugguuaggagcauucuaucuuccaaaggacccagguucaauucccagugcccacauggcagcucacaaccuguaacuccaguuccaggggauccaacauccgugcauacaugcagacaaaccagcaaugcacaugggauaagaauaguuacauuuuuaaaaauaaaaauaauuucaaauaaaaaauaccacacacuggaaugaauuagucccaaagucuaguuucuuaggugugauauugaugugguggcuacuuuuuacucauagcuuuagagauagagcuucaagggauauuuuuaaaugucuguacaugguaugaaauaagggucugcuucaaaaucagaaguuggggaauagcaaaagacacggccuguguaaagaaucguugaggcuuuggugaguaugugcgguucguuauacugugcuugacacugguacgugcuugaaauucucgugauaaaguuuugaaaauuacuuuguucuguuaucucauuauuucuuuacaauauaaagucuuuggcuaauuuuuagggaggauauaucggaggaccaguggaauuugauaaguauuaggaguuuuaugaaacuuaacaauuuauaccguacagagagauuaaacauugcuacaaugcaucaaagaucugugucauucaaggcgaacuucuccuguggcucgacucuuaaagcugaaagaacuuaguuuaugaccguuacugucaacauuauucuguuauuuaguguguauuaacuacugauauuguuaggugaucucuaaccuaugcuguaaacgucugcaucauucuuagugacaacuuuuauaccaaaaacuuacuggaagauuauucaggauaguguaacacgugugugaaaggaaaugaaaagcccgaaaauuuaugccugagucuccucaucuugcucugucagccaucuuucuauugcugggaagcaaagccugaggaaaucaaucuacuuaugggagaaacgauuuauguggauucaguuucaaaaguuucaguauacuguugcuuggccccaucccugugggccugugacaguguguaauaucauggcagugaguguguaugccagagcaaagcuacuuguuucauggaagcugggaaacaaaagagaaaggggccagagccccaauaucuccuucaagaucagugaccuaaccuccucccucuuguccccggcccuccuagguucuguccaacaguaccacaagugagaggccauuuaauguccuuuaggggacguuuaggauucaaaaauguaaaauaucaguuuucuuuguuuauuuuauuuacaguucccgucucuccuuuuucuucauccuuccaauacucacagcuuauuuuugcugugcuggggauugacccguggcccuucaacauggugggcaagcacuuuaccauugaccauuauucccagccuucuguuuacuuuuuauuucagaauaggguuuaaccaugucuaccagacuggccuugaacucacucuacauggacuacagaacuuguugugauccuucugccuugacuuucuuaguggcugagauuauagaucuaccuacaccaccaggcacagcccacucagcuucaucuuuggucuuuucaaauagaauucuuuucuuacauccugaccucgguuuucuccccgcccacuccucccagugauccccacaccuccccucucccccggacccuguccuccuccauuucccuuuagaaaagagcaggccucccagagauaucaacggaacauggcguaucaagguacaggaagaccaggcacaaacccucauuaaagcuggauaaagcaacccacaaggagucagagacagcaucgacucccacuguuaggagucccauaaaaugccaagcugcacagccauaacauauaggcagaggacuuaagucagacccaugcaggcucugagccucuaugagcccagcuuaggugauucggugggacucguucucaugguguccuugacuucucuggccuuuacaguuuguucucaccacucugccacaggauccuccgagcuccaccuaguguuuggcugugggugucugcaucugcucccaucaguugcuugaugaagccuuucuaggcaucggucuaugaguauaguggaauaccauuaggaauaacuucauugauuguguuuuguuuuguuuuguuuuguuuuguuuuaccaaucaguuuugggucucugagcuaucuagccuuggguuccugcccauugaggccgucuaccccucccuuuaacuuucugccuaguauguugccaauaaguuuacuauauucacuugugugauuugggaagaggcauaacuaacuaaagcccagauucuuggggaaagucuauguugugacugggacuccccauguuccucucucauuccacuucccccagcacacacacacauaugcacacagacaugcacacauacacacauacacucacacacacaugcacacagacauacacacauacacacauacauacacagacaugcacacauacacacauacauacacacacacacauaugcacacagacaugcacacauacacacauacauacacacacacaugcacacagacaugcacacauacauacacagacaugcacacauacacacauacauacacacacacauacauacacacacucuaccaccauacuuaugaggugaggccggaagacuaacacagucucugcuccucuguaaaucuuucaacaguuuucaucuuucaauagucucuuuccuaaaguuaaauggcauuggagggugguuucagauccuaaaggguacacugcugcaaagucacauccacagaaaccuuuauagcaaccucccuucacaucaagugcuuuccaaguaucuacaucuagagaacuuuguuuuauaauacuagagacugaacccagguccucacaugaaaacacuccacaagugaacuauauuccaacccucuucuuguuuuugauuuuggaacagaccuuguuaaguugccagacuugcucugcccucagcucuauagcccaagcaggccucaagcuuguccuuguguaggagccuccagaguagcugcuguuagaggccugugccaccaaaaugcuuuuuuuuuuuuuuuugcuuccuuagcugugaagagcuugcaugguuuaaguguacuuauauguccaucccaaaugacccugugugugugugugugugugugugugugugugugugccugugcauucaaguccuuguguguguacacguguguuuuacagccuucacaagucuuaacuaaaacugaucucauauuuaggcccuuugagacagacuacagacaauuuuuauguagaaggguaggaacacuauuuuuuuuuuacuagaaaguuguauaaauguguagaacuaggguucacccagcauaauaguaacugaauacauagaccucucugaaugcaugccuccucaaggcaggcauagucagaacauugauuucuaccuuuauacaucuauaaaauacagucaguagugaaugcuagaauuacuguuuggaggcaacuccuguuguccuuugggagggacauucuguacugucccuucuuccuccuuucuauguuagaaacaagacaaucaaauggacaauccuguaaugagaguauuuuaaagauacaaacuuauagcuuuccuaugguacaaaaguuaacuuuugcagucuugcuaaguuuucuaugucacuuuuauauguuauuauugcuuaguaugauagcauacaaaugaccuccugaguguaugguauuauuuuggauuagaaauaauauccuaugcucucaaugugaccuccuuagauugcaaguaacagacucauucuagcuccagaaauagguuuauuaaaauaacugaguaggucaggacaugaaacacuuuacagucagugcuauagauacuggaauugggaaacaaaauaccaggcuauuuucuuagguaucuggaguugucaaguuaugaccucucugcuugccuuuuuuuuuuuuuuaaugcucugguuaacuugacugaacccacuuaagacaaugccaagcacucuaugccuucuuacauuaugauacuucucagugcccuuuugacuuauggucauuccaaauaaccuaucuugaguuuccaaaaaguagguuuucuugccucaguucaucuugguuuuacccgugacuacaaguuuuaauagucuggguugccuggggauucauuauguuagauguuuugccugcacuucugcagcuugguuuaugacauuggagaaucuacugcuuuggaauggauuuuggguaggaaagcuaauaacauauauugcuuuauauuucuuuguaacuuaaagaauuucuaaaaaguaccauauugguucuggaaauuucuuucuaagggagcacaggggucaguguggucuauugugaacauucaccauagguggccaggcuccaaacagugcagccggugagguauauguaacgcaucagccucaucuuaggauacuuacaaaguggguuccaguugagguguggcucagggaggaggugcauaugcaguaggagagccaaauuguguuuacuuugguuuuuguucagguuuuucaagaaaggaucucauguagcccaggaucgccucaaacuugguauagccuaggauaaucuucaauuccugauccccuuuacuucacuuucuaagagccgguauuccagcuguguuccaccacucucagcucacaugggagcauacagaacaaaauucauuuuacauucguaaauuauuguucuuuucuguguguggguauauuauacauuucugugcaucacaugagugccuggugcccacagaggccggaagagguuauucgaucuccuggaacuggaguuacagauagugacgagcugcuauguggggugccaggaauucuaaaggagcaucaguuaagaaguuggccguuuuaggugacuuugcuuuggcaaggaaguuugaaaaugccugcuuauguuguuuugcuuaccuuauauuauuacacaugaaaauaauggugugguauuguuuuuguuuuaaaaaaaaaaaagaaaagaaucuugagucugggaggcuggagagauagcucagcaguuuaaagcacugagugcucuuccagaggcccugcuggguacaacuccuagcacccacaugcuagcaaccauuuguaaagcaaguuucaggggaucugaugcccucuucuggccucuguggguacugcaucacagcaugcccacaguacacuagacauacaugcaaaauagccauucacauaaaauaaaauaauaaauaaaacaucagagcuggagagauugcacaguuuauaaaagugcuugccaugcaaguaugaaggcccuaaguucauguucccagaaccuguguaaagcaucugucucaaacaagguagaaggcaaggacugacccuugagauuguccccagacuuuccuuuguacugaggcauguguguuugcacccgcacacacacaccacacauaagauauaaauaaaaauguuauuuuaugacuuuguaaucuuuuauggcuauuugugaguacuuuguucugauaggaauuuuaaacuugaguuucuaagauuuuucuuuauucugucagacuuaaaguuauugucuuugacauguuuauuucaaaacucuauuucuuuaugccuguaaauaaauaaucuauucuuuuggaucacucuuuucggaaaagaaugaaaaaaugucagcacuccaauucuagcuccauaugccugugaacgagugaguucacauaaaaucugggagacuaauuugguagaucuggacuagagaagucuaaucaaauaacccuguaaucuguuaacuuucccuaugcgauauuucugaaaacuacgccauggaugcauggauggaucuccugaaaacacuccauuaccauugcaacuguucuuaaugcaaugacuaucacuuauguuuacuggcaauaagaauaacaauuuuccauguuuucuuuucaagauuagccauaaaucuaacugaaauauaguacagguaaaacuaguuuggcaauagcuuuucaaaaaaauuucuaguuuuaaaauagaaaguuuugggcuggugagauggcucaguggguaagagcacccgacugcucuuccgaagguccggaguucaaaucccagcaaccacaugguggcucacaaccauccguaacgagaucugacucccucuucuggaguguccuaagacagcuacaguguacuuacauauaaucaauaaauaaaucuuuaaaaaaaaauaaaauaaaauagaaaguuuuuuauuagagaacuuacuauaagguaagcuuaucaaaauucuagguguaaaggaagcguccagaccaguagcuguaguaugguuguugggaauuuugaagugauuguaguuuacguuaaguuacuuuagauccucuccauaauuacaugguuagucuggaacucacuauguagaccaggcuggccccaaacuuagggcgcuccaccugcuucugccuucuaacccugaguuccgagauuaaaggcauaugucaccacaucaggccuacuugguagcauaauugagugaauaguaaaaacuuuaucauugggcagaggauuguuccauuuagcaaaugcuuuauuuuuugcuuuuauaguguuugggguugaaccagggcuuuuuauaugcuaagcaagaacucuacuccagagcuauagacccaaucccuuagucagaugcuuauuauauauguauuuuauccaaagcauuuuaguauccucuuagaauuugugcauaguaauaaauuuuuauuaguaauacuuccaacaucuguuggugggccaauguaugugagucuacauugcaaugucuugagauuuucaggaaaaaugagauaauucuuaauuaagcauugauccacuacauaguauaaugaaacuaaaaguauuucuuucauauauggucuuuagagccauacuaaguuugaaguuggcuguccuccacacacuguauuugccuagcauguuuucaacguuacuaugcucauaguaauggcaaagcuaaugccauggauaauuagaauauuuauuaaguuuaguuucugucucuauuuuauaguaaaagaaguucaauauuuaaacauuauuauauauuuggaagaguugugguauauagacuuuguauauagauaaugaagcauuauaaauuucaguauuuggggucuuaaaaguucauggucagcuuuugugcuaucacgucacuagguggagauguagcauuguuugguagacuagccaaagcaaaaagaccuggcccguccgugucucucucucucucucucucucucucucucucucucucucucucuuucucccucucaaaacaaguauuuuauauacaauuaaugagguuuauuauguccuagagaaaauuugcaaauuuaguguaguuuaaaauucuuuuuucagugugaaaauucaaccccacuuuaaugucuguuuucacacuucuaauuuuuuaagaguuauuuucuguucuuacugcuauuugcuuuuuguuuucuauauuuguuguaucuugucagaauuagucugaugucucugugucuggugucucuaguuuaacuagaugugauuuuuuuaaauguguggacagauaauauuauaugauuagaauaugaaauucugauuugguagcaaugcaugauaagugaacuuaagagucugaacauacccuguucuuaccuuuguauuauuuuacgguguuuacugucaaauuuuaacauugaaauucucuggagcuuauuucucucccuuucuaucuuuccuucugucaccuguugaaucuuaagugaauacauucucuaugcgcaguguugaccaucuccaugaagcugauauggugcugagaacauugcagaugugcccaugaaauaugauaaaguaauuugaaauugcaaaggugaaacugaaaagucuuguucugguaaacaguugggcagcucucaagugcuuacauggaguuaccuuauaguucagugcuuucguauuccuaaguacaugagaagcaaaaguauguacuaggaacuuuaaaucucuggaaugacuacugguucauguuacaacauagaugacccuugaaaacacugucuuaguuucuuuuccuauugcuacaauaaagugccccaacaagagcaacuuaggggagaagggguuuauuuggcucucaauuccagguuacauuccaucauggcagggaaauguaguggaaggagguugauagaauuagucacaugacaucugcaaccaaugcaaaagaauaaugaaguaaugcaugcaugcucguguuugccuugcuuucuccacuuacuuuagaauucccuuccuagggaauggugaaacucaaauuaggcagauauucccaccucaguuaauauaaucaaaauaauccccccagguauguguauagaccagugucccucauugagacuccuuuucugggugacccuagauaugucaaauggacagaaauagccaucgcaaauacuaugcugagggaaagaaacaagucaugaaacgccacauauuacaggauucacuucauuugaucuguccagaaugaucaucagaugaaguagaaggguggucaccaagggcagggcacgguagagcagagaggaauagcugccaauagugugggacuucugcagugauauucuuuuacaggucacccauuuauaguaagcaugcaauucagucauauuuaguacugucugagguuguacaccccuuaucacaaugaacauuuuuaucacacucuugcaccuuaaacuuuauaucagcucuaagcuguuauucuuaaacaacuuaacagacauuuuaaagacaaugagugguucaaauaauguaaauucuguaccucaugaaaaccugauuacuaaauuuauuauugggguuucauuugcuaguaaagggaagaucauaacuuuuggcacuuuuuaacuuauauuuuauguauaugaauauuuugccuccauguauauauguauaccauguacacgccuggugccuauagaagccauagagggcaucaggucuccuggaacuugaguuauggguggcuaugagccaccauuggaugcuggaaauugaaccuagguccuccacaagagcacaaagugcucaaaacugcugagcuaucucuccaggccuaacaguugucaauauuuuaaauuauagaaagaauugucuugcuacaauuuacucagauucuguggugcuuaaaaguacaguccuggguuuauaaauuugcaugaagaauaucuuuuagcgguacuuagaaguuaaacaguuguguacuuagcauaaaccuaacuuuauuguuacuagucuaugauuaugauauggauguaguuguuaaaacauagaaaagagaaauauuuuagucauaguaaguauugaaaucaagagauuguuuuaaaagaugguauuugauucauuugaagucccuuuagagaaauucuuuauuucuauguauauacccacauguuuauaucugucauuaaugcaacaauuaaauuuuucuuucuuaacagaugcauaugaaacagccaagaugcuuugugaacaguauuaccugguagcuccagagcuagaaguugaagaauucaaugguaaaagacaaagcaauuuagaugagaucaggcugggucagggcaguguagccauagcaagaaaaaguauuuuaauguuaaguacaaaggggacuuaaaugcuaauauccaagcugucuguccaagaaguccuaaaauagggcuggcugccuugccaucuuuauguuguuucaaaauggcucguauccacuuagucaacaggggauguaaugagucccuuuugaaaaggacugugcaguguacccugugcucauuaguagccuuuuccucucacccaauuggggguuaaucuuguguugccaccuuuccuuuuauaugugagguuuuuuuucugcuuagccuccaguuucuauuuuucguucuuacaggaaagcuaucugaaaguaaaauuccuuaugucuguauagaauucuguugacauuuauuaagugcugcuucaacuaaugguguuucaggcaaugacugugcaaaauagauuuuauuauuucgugagucucaagcauaaaaaaacccagaccauuuuuuuuuucauugacuuuuagaaauguacuauuagggaauauucauauucugcucaucuuauuuuagaaagccaacaagccucuauuaaucauccacuauagccacuaggcccaggagaagggaggaaucauagccaaacacauuuuacaugguucuaaaaggaagaaaagaaaugucaacuguaauauucccaaagaaaaguacacauaauugagcaagccuuucgaugacuccuagagaauguuguuuaaacuuaagagaagaaaacaaacuguaaaauguuuuucauuuccuugaaauuuggacugaaaagguugaauugaauucugaggcuguuuauauaacuaaugaugcuguuugccacaagauaaacuaagcccucagcuugcuucucaggccccauuacaaccacaauaaaagaaucccauaaaacgagcaaagggagccaaggacucuuauaaguggaccacuguauuagucccuucaggcugguaaaacagaaccaucagagacuggguggauuaaauaacagacauuuguuucccaugagucuggaagcugagaaguacaagaucauggugcuaacagauuuggugucugcugagggccuauuuucugacuuacagaugacuucuuggugugccuuuacauuguaggaaagggccaaggagcucucugggguuggggugucuuuuauaagagugcuaaucccauucauaagguuccacacucaugaacuaaugaacuccaaagggcccaccuccaagugccaucauuuuagaaauuaaguuuuaaggucugacuugagaaggacauagacagugaguccauggcaacccauuagugccaacguguggaagaauacagccagauagagguaugcugagugauacaccaggccaggacugagcaaaaaggaguaagcugcugcagacauggcagccauuucuccagugauccacgagagagggaccgugggagcagagcugagugguacaaacaacuagaacaggaaagaagccaaaagauuggcauuaguuugcugaaagcuggucuaagggaagccugcagagauggcagggaguagcuuuacacugucuaggcuccgcuaccaacagucacauaaguguguuauccgagaacaacuuacccgaugcgauagugaauaacauuacucugaagugaaaccuucauuuuagcauuugaaggucucucugguugucaucuuccuuacuaaaggcuuauucuaaagccgguggagucuugauuuuaaaacacuccaagucagccuucucccucuaggcaauauccaaagggaaaggaacacugucacauucaacuccauuucugugucuauccaaacccucaacugagacaggguuaucaggauugucuucccaugcgcacuucuguaagggagguuauauaacuaggucaaugggcuguauaauauagauguaagaaauauaugcaacagucuacaagcccagagauggccauguagcauguuuuaaaaagcaacugaaucuaauuuaaagauuccuaaagaauaguaugcauaccgugcaaaagaagcuagaagauuuggugauacaguaaggcuacccaagaggagagugauucgacccaguaggaaaaaugcauagcacauaagaaagacauacacugugcagugauuaccuuugugucaucauaagauaccaugaccaaaagcaauuuaagaaggaaagaguucacuuugucuuauaguuccagaagaguaguguccuucgugguggggaaggcaugucauggcaguaagagaaggaagcuggcuagucacauucucauuaccacauaggaaagagauaggagaaagaaggaugaaagcaagcaggaaauaaaauacuuccuccagcaaagugucaccucuuaaauaucccauagccuuccuaaauagugucaccaaguguccaaauacaugaguuuucgaggauguuuccaauacaaaccuccaaacuguuugugauacauucuagaaggggugaugaugagcaauuggaagaauauagacagaauccauuccacuguaaggcugaaaguauuuccuccaagcaacacauggauugacucccagggaaggaaauacuacuuuuguggcuguucuauagugauugguacuacauagaauaauaccaacauuacugauuuuuaacuuucuuaacagagccucuagggaacaaauaaaauggucaaguuuauagaacagaauguaacuagccuuuaaaagacgacagcagaaaugaagagggcagagaggggagguaaaaggacuuuggcuuucuguuuuuagaagauuuucaaccauuuaaacacaucaauaaauauuacaaauaauuuaucaaaggccuugggaccuuaaagcguaacuccuugguagaguacuuuuuuaagguacaugaaguucuaggucugaucccccuaccugguaaaaauguucuuagggcaguuguauuagguacagucaguuagcaugauaaaauagcugagauaacacccuaaaagaggacagauuuaaaaaagaaaaaagaaaagccgggugugguggcgcacgccuuugaucccagcauucgggagacagaggcaggcggauuucugaguucgaggccagccuggucuacaaagugaguucuaggacagccagggcuauacagagaaaccuugucucgaaaaacagcaacaaagaggagagauuuauuuuaauacaugguuuuagagguuuccauccaugauaguuuggcucuauuguuacaaaugugagucugacccacaaucuagagcaccauguguguagcucaguacaaaaccauaaacuacuuaaauacuuaaaacaguuagggucccucccuccucucccccccccuuguguguguguguguguguguguguguguaucaagucaaauuguaugguucuaugguucucaauuuuguaggugccaaacuguuguacaugccuguagggcccauggcaggcugcagcauuauggcagggaguauaugaugggcuaaaguuguuuacuucauggaugccaggaagcaagaaagggaggaaguacuagagucaaccgacauugauuuuggagacaugccuuugaugucuucgucacacuaggcuuuaccucggaaugguucuagcaccuccuauuuguaccacagacuagcagccaagucuuuaacauauggccuuggaugacacaugagauguaaaccaacagcacuguguguccaauuucagcaucccuuuuguuaccacggucacaccagcuuuccaaggcuuguuuacucaucuguaacugauagcaccuacucuaagaucaguacauauuacauaaggauacaauuacauggugacuagagaggcucauaauaaauuacuuagaaccaaugauucuuaccucuaauugguauuauuaaugacuuuauuagaggaaauacugaguucuaagcuaucuguucuaauugagaaaguuuguuuuagugucuuaccugcuugcaugucaugaggaaggaggaggacuuuucaugcugagcaucucucucccacauacugcccuuagugcuuugcauuagguuccuuagaagaucccugguucaaggagaauacuauagaugcucaaggauuucauuguaguagaaaaguucgugaaccucguagucuagucuauaccaugcucuguuuauaauaauauaguacauuuuaauuacuuuuugucucuguaauaaggguugguuuaggcucacaauuugaaaggugucaauccaugucucuugguuccauugcuuuggacuugaggcaaggcaaacuaucauggcagcaggagaauguggcagaugaagcugcuucccucacaguagccaggaaagaacaaagaacaugccagggacgagauagcuucuucaaggacaugcucuaagaacugacuccaaccaggcccugccugauauuuucuaccauuucucauccuaucagagccuucuugcuugcuacauuucccugaagcuuaucaucuggcagcuaguugagccuuuaacaugaauguuucagugaauaguugaauucaaaccauggugcuuuuaaguccaaacuuacuaccccuuucauuuggcucugcucuguugauagcagaucuguacuucugauuugaaaaguuccaagugaucuuuguauguccucgugugaugcucagaauaccauggcacaggugauccucguccaguuuugcucgacaaaguuugaaagagguuggcugguuucucagggucauugagcugcagcaaaggagguggaguuagucacugcgguuuugcgugauccggaagcuuugcucaguuauggcauucagugugggaaucuguauuauuugucguuuauggauauuuguuugaugugcuuggaaaauagaauagaagcaucauuuuuuacuuucuccuacuuuagguccuuauucauugaugguuuugucucuguuuucagccaaagcgccaaacaaacccauucagguaguuuaugugccgucacaucuguuucacaugcuauuugagcuguucaagguaaguggaauuuuaaaacaugggaagaagucuucauuuuaaauggcuuugauucugggcauaauggauucauuagauuagcauaagaaaaagauuuugcauaaccauuuuaagaagucuauuucugauauccugugggcuuuauaaucuguacacugugagaugaaaaauugcuguguacacuauaguuuugugaauauuaguacauauugauuucaaaacuuaauuauacuuuggugacuucacaucaaaucuguacuguuuuucuuucaguuaggagguuagagaugcuuuuuagauuuucaagccuaacagaguuuuauuggugauugccagaccaaaauaaaaaccugcugcuguguggcuaugauuccggagcguuagcugugcucaugcauuagugcuucccguccugggagauccuguagccguuuuauaauuugaaucauuucagaagaccugauagaggcaggggagggaaaauguggagucuggauguaaaaggaaagaaaaccaaaucuuuuucagacucucuauggccuaagcuguugcuuuuguuauccaguugccaguuauauuuacaguagcaguguuaugaguacaggguauuugagcuaacauuucaucacuuuaauguauaaaacacuaaauugaauaccuaaagaagcaguugugcugguuucuucccaagaacacgaaugcuccugcucuaacacuaggaugggcaugcaguugugagcguucucuuugucaguuggaacuuugcagaacuccuuuuugauggauauuauccuuuuuucauuccagagauuaauuuuuaugagaaguaugaaucccuucaguuuuucugccugcauauuagaggauaggugccuuauaaaugcaagugauaaauagcauuuaaaaugcacaaaccagcuucuguagccacauuacauuuaauaaaaacauucuuucuggguugagaugaauacuuuuaaaacccuaaagccaccaggcaugauggcacaugccuuuaaccccaccagugggcagauaaaaacagauguaucccaaugaauucaaggccagcccagucuucuuagugagacccugucccaacaacucucauucccacaaaaaaaaaaaaaaucccuaagucuccucacccccaccccaccccccgcaaaggaaacaaaacuguuuaacauguggaauggggcuacaauucaaugcaaaagagaagcucagggaaaauauguccuugacaggaauccguggauagccaagcucaguggagaaaaaaaaauccacauaaaucuuauuaauaguagcuaugcaaaguaauuaucauauaaaaguaaucuugugcuuguuucguuuuugaaaucgugguuuucggggcugaggguguagcucagugguagaguacaugcuuagcauguguguggcucuagguucuaccuccagcaccaagaauaaucaguaccuuuaauauaauuguacuuugcaagucagcagcaugguuuuucagaaagaacuuauuguuuuagaacucaaugagggcaacaguugaacuacaugaagauaaaaaagaaggcuacccagcuguuaaaacucucguuacucuggguaaagaagacuuguccauuaagguaaucuuuuguuugcauuuugacuuuaucaguugauugaauaguauguauuuaauacuaugagagggaaggcaagggaccuggcaguucuugaguguguuuguuauuuguaaguaaagccauguuuuagugcuuccucagcaaugaacugaccacauauauagugguggucccauaagaugcuauugucuagugacauuguagucaucuuguucuguauaagcaccuucuaugguauuugcacaaugacacuaccuaaugguacauuucucagagugugucccucucauuuauagaaacaugacuauauugugcuggauuuuuggcuuaaguuacuucauuguauguucauuagcaggaccucggucccaagccugucaaauuuugcugcacuacucuguccccuuuguuuacacuggccccagaggaaccacuuuucagugggaguucaaagcccuugcucauuuuagagccuuccuagcguguacuuuauuuaaugagcucuuguuaccuccuucuuaagcacaaauugauuccccuuuuauuuuuaacauguugugcacugcagauaagugaccuaggugguggagucccacuucgaaaaauagaccgucuuuuuaacuacauguacucaacugcuccucgucccagccuggagccuacaagagcggcgcccuugguaagcauggcaaacugcugcagaagaaauggucuuuaauauaggcguagggagcugcccaucuccucaggugguuguacuagccuugccuaaaacugaggauguuuccagcggguuugggagcagaggcaccuuucugccuuagcuauuuagucugugaggucuuuggacugagagugcuuuucuaauuuauccaagaaacacuccaagcugaguguuucccucccaaauacagugggaaaaagcuuuucucugugguaagacugcugcuggagagccacuuacacucugcacugcccucagagagcuggacauuacccauggcugagcaaagggcccgugggaacguauggcuuccgcuuaguaggagagauuuuagugcugcccucccuuggaggcccaagucacccacagcuuuugggucaccacuguccaauuuguucauauaauuaaaauauuuaauuauaaagucauuggaauuuucacauugaauaauguaagcacaaaauauguagugauguauguauuuucagaggucucucuguagcacucuagaaauaaccuugagccuuaauucaggcagugagcauagccucugguuaccauggcagcauuucuuccugggagggccacacuuucuuccccugcugaguguuucuaauugacaaacaacaauugaacccuuuguuauuaaacacagcaauguaucuaucagucugcaaaauggcucaggguauaaauuaaguuucauuuuaaaguccuaccugacugauaagcacauaagauuauauuuuauuuguaugaauaaaaucaaacacuuuacauuguuauuugaggcagaguuuguuaacucagcauguggaagacugaggaagucauuuauacaggauucaagaaaauucauaaaagaucaauuugaaauaguauuacccugaccggggucugguacaaauuuugcaucuuccucaguuguuuaaaaagaauauggauugucuauugcacgucuuuuuaaaagagcauccugaggguagcucuuuaugccaugguuuucuuugugaaacagaggacuccaggagacugguauuuauccaccuucccaugagggagaaagggucaaagcaaaugaaugguagagcagucugugagcuuucugguauacuauuauagcugcuuuggaagaaaugcuuccauccacaucgcucccacuuaauauacuauccucaacuuuuaaguagguacacagcugugcaguucuagaaacaguuuccuuugcaaaucgcuuaggguuuuaugaaucugggccuuccuucauauauuuuuaguugaacaaauuuuaaacuuuuauguguguaaguauuuugcauguauguauguauguauguauguauguauguuugugcaccauuguaugccuaguaccagcagagaucagaaggggacauuggauccucuagaacaggaguuacacaugguuguaaccacaugggugcugggaacggagccugggucuucugcaagagcaacaagugcccuuaacugcuaagccaccuuucuagcugauaugacagauuuaaacaauuguaacuauuuguaugagagaaggaaugaguuagucugugugcaugcauuuuuaugaaguugaauucugucccuuuaccuguuuguugguccaaggacugaauucagauugucaggguugccagcaaguacuuugauccacuccaccgucucaccagcacaagaucuagucugugguggugguuucgagacaucgucugaugucauccaggugggcugauagcuggccgaagcuacagugacccugaacucuugaucuuccugcuugaagaacagagcugugugccuccucaguuuaggagauguuggggaaucgaauugaugaccuuuaguguggucagcuggcacucuacccaccaagcuacacccccagcacuugaaaugaucuuacuauacucauguaguuauauguucccaguuuaccuagauaaguuuauaggugguaccuuuuuacauuagaaauguuacuagccuauguccuauuuaugauacuggacacaugaugucugugugcacuguaaggugaggagccauccauccacccagccuauacaucugugcaguagagacaaaugauacuuuuccaugaugagguacagccugaaagucacuguuuuacacaguaggaaacgacuuaucgcauggcacaaccucaucuccauagaucugaauuucauuuuuugggaguaucuauuaugccugucagcucaugcuuuagaaggucagaagacaacucuguggggucgaucaucacuucugccuuuauguggaccccagauauugaccucagauuugucagcaaauugaaccauccuacuaaguuugacuguaugguagauacugcauagauauggcauuucuauuauaucaucaucuuuauucuugucugugaccuuuuguuuaaaaauguauauuggcugacaguuugaaaauucaauuuuuucuaaaaauacccauucacuguaucaccauacuguagcuuuucuagauccuuaggaaggaccuaagaaguauuuucagugcuuuaaucuuauugguaaaucucaacucuugccuggcgcacgccuuuaaucccagcacucgggaggcagaggcaggcaaaucucugugaguuugaggccagccaagacuacacagagagacccugucccacaaaaaaauuucaauucuuuugcuauuaauucuuacuuuagucacgagggaaaucugauaaugaaacuugaaagugaaugugguuuuguguugucaucagaucaaauuccucuugauggauguuugcuuuuuaguauacuauuuuuagucuuugaaaacuugauacaacauacuuacucuguauuucgaucauuuucuuuuuuuaaaaaagauauauuuauuuauuauauguaaguacacuguagcugucuucagacacuccagaagaaggagucagaucucguuacagauguuugugagccaccgugugguugcugggacuugaacucuggaccuuuggaagagcagucgggugcucuuacccacugagccaucucaccagccccuauuuugauaauuuucacucgccauugcuccucacagaucuccuuccuauucccucucccucuacuucccaucuuguauccuagaaaggaaggaaggaaggaaggaaggaaggaaggaaggaaggaaggaaggaaggaaggaaggauggauggauggaaggaagacacugucuugcagcagacacccugaucucucagcaguccaucuacccaccuuuccaagaugcucccugauccuuaaguauaggaauugaguuacagguuugucaacugaggccaggcacccaauggccaguugcucucugcauuauggccaguguaagcuuccauaauggucucuuuguaagggacgagagcuacuuaucgacagauguaauacguacacuugaaaaguaacacuuggagcucaggguauuguucaguugguggaauccuugccugguaugcauuaagcucuugacucuaaaccccacuacugcguaaaccaggcauggugguucuaugcuuauaaucccaguacuuaggagguaaaggcaagaagaucaggagcucaaggucaaucuuagaucauaacgaguuaguucaaggucagccuaguuacaugaaacccugucucaaaaaaagauacccugauuuuaugcucauacauagcuaaaauuuuacuuuaaaaugcuaaaaaauaaaaauaaaaaaugacauuuuuaacccaaacuugacaaguguuuuuugcuuuuuguuguuguuguuauuggcuuuuuuuuuuuaacuagggaauuucgguuauagauuauagaugcagcauuaaagagauugaguuacuaauucauuugauuuaaauccaaaucagggauucauuuuaaucuucuguaagugguccccuaugaagcuuuguacuggucucauuuuauucauuuucuuuucuuaauaggcuggauuugguuauggcuugccaauuucucgucuguaugccagauauuuucagggagaucuaaaacuguauuccauggaaggaguggguaccgaugcagucauuuauuugaagguacuguguuuuguuucuguuaguauaaaggccucuugacuuuauaaaucuggaagugcccauaacuagucaagaagaauacuguaucaaucucuuaccuagacaucagaauuaugaagccaugguaugucucacccugauuuuaugaccagacauaacaaaucauguagcauggaaauaugaacuuaaauuuuuacaaccauagauguaguuuuucaaaauuauauguccauugaaaaaccuaguugcuggagagauggcucggagguuaagagcauuggcugcucuuccacagguccugaguucaauucccagcaacuacaugguggcucacaaccaucuguaaugggauccaauacccucuccugguaugaaggcauacauguaagcagaacaauggauacauaguaaauaguuuaaaaguaggcagauaccaauaaucugaagccuucucgucuuuugcuuuaauuucucaagugguaagaagucagcaauaauaauaugcuuauauaaaauuaucuauagaucuugaaauaagugagguaaaccagacucagacaaauaccaaaugcuugcucucaugaagaucuuagcuuuuuuaaaauuguacuuuacaucccacucaaaaguuuugugggugagugguaucucaaucccucacugagguuccugccuggcuacaggagguggccucuuuagguuccauaccccacugcuaggaaucucagguaagguuacccucauugauuugggggagcuucccuuauccaaaaucucuggcacuuacucuguauguccccuaacccccaaccaucaguugcagauuuccauucauucucauggccaucaggccaucucuccugucccuccccacaccugauccugaucccuccccagccucucucccaugcaguucccuuccuccaucugccucuuaugacuauuucauuccuccuccuaagugaauucaagcuuccucacauaggccuuccuucuuuuuuaaaguucuuugggucuguggagugugacuauggguauccuguauuuuauggcuaauauccacauauaagugaguauauaccaugcuggugcuuuugggucuggguuaccucacucagguuccucucaaguuccauccauuugccugaaaaauucaugaugccuuuguuuuuaguagcugaauaguaucccauuuuguagguguaccucauuuucuguauccauucuucaguugagggacaucuggguuguuuccaguuucuggcuauuaugaauaaaacuacuaugaacauaguugaacaagugucccugugguauaguggggcaucuuuuggguauaugcccaggagugguauagcugggucuugagguagaacuauuccuaaucuucugagaaaccaccaaauugauuuccaaagugguuguacaaguuuguacuuccaccagcaauaaagcaauguuccccuugcucugcauccucguccucaccagcacgugcuaucucuugagcuuuuuaucuuagccauucugacugcuguaaaaugaaaucucaagguuguuuugauuugcauuuuccugauaacuaaggacucugggcauuucuuuaagugcuucucagucauuucagauuccucuguugagaauucuuucuuuauuggagucuaacuucuuacguucauuauauacuuuggauauuagcccucugucagauguaggguuggugaagauccuucaccaaucuguagacugcuguuuuguccuauugacaguguccuuuaccuuacagaaacuuuauacaguuucauaggguucuauuuaucaauuguugaucuuagagccugagccguugguauucuguuuuugaaauuuucucccaaaccacugaguucaaggcuauuccucacuuucucuaugagauuuaguguauccauuuuauguugaaguccuugauccacuuggacuugaguuuuguucagggugaugacuguggaucaaguugcauucuucuauguguagacaugcuguuagaccagcaccauuuguugaagauguuuucuuuuuuccauuguaugguuuuggcuucuuuaucaaaaaucauguguccaaguauguagacuuauuucugggucuucgauuccauuggucaaagugucuguuucuguaccaauaccaugcaguuuuuaucauuauugcuuuguaguacagcuugaaaucagggauggugauuccucccaaaguucuuuuauuauucaggaauguuuuggcuauccuggguuuuuuuguuuuuuccauaucaaguugagaauugcucuuucaagaccuauaagauguaguguuggaauuuugauagggauugcauugaaucuguagauugcuuuugguaagauugcuauuuuugcuacauuaauucuaccuauccaugagcaugggagaucuuuccaucuucugguaucuucuucaauuucuuucuuacuuguucuugucauacagaucuuucacuuguuugguuagaguuaugaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaguccccaaauacagaaguauuuaggaauauucaaaguauuuaggaauauucaaaauaaacuuuucuuuccuggaaaaaaaaaaaaaaacaagcuuguguaucuguguucguaagggaaauuugaucuaaaguucucuuucagucuuaaucuuugugugguuuagguauuagggugacuguggccucauagaaugagcuuggcaguguuccuucuguuucuauuuuguagaauaguuugaggaauauuggcucuucuuugaaagucugguagaauuggacacuaaaaccaucuagcccuggguuuuuuuuguuuuuuugguuuuuugguuuuuuuguuuuuuguuuuuuuuuuuggugggagacuuuuaaugcuuucauuucuuuagggggccuauggcuguuuaaaaugcuuaccugauuuugacuuaacuuaguuaaaugguaccugucuagaaaauuguccauuuucaaauuuuguggaguagaggcuuuugaaguaagaccuagugggguucuuugaguuuccucaaagucuguuguuaugucucccuuuucauuucugauuuuguuuauuuggauacuaucucucugccuuuuguuuaguuuggcuaaggguuuaucuaucuuguugauugucucuaagaaccagcucuugguuucauugauucuuuguauuguuuucuuuguuucuaaccaauugauuuuagcacugauuuugauuauuuccugucuucuacuccucuuuggugugcuugccucuuuuuuuuuuuuucuagagcuuucagguaugcuuuuaaauuucuggcaugagaacuuucuaauuuguauauggaggcacuuaaugcuuugaacuuuccucuuagcacugcuuucauugugucccauaaauugggguauguuguaccuucauuuucauuaaauucuagaaagucuaauuucuuuauugaguagaaaguuguuccauuuucaugaguguguagguuuucugguguuucuagagguuuugaagucuagcuuuagcuuuaauuuaugguggucugauaagauacaaggcauuauuucaauuuucuuggaucuguugagacuugcuuugugacugacuguauggucaguuuuggagaaggaugcaggagaugcugagaagaagguguauucuuuuugggggggaugaaauauucuauagaugucuguuaggucccuuugauucauaaugucuguuaguuucauuauuucucgguuuaguuuuuguccagaugaccugucaguuggugagaguaggguguugaaguccgccacuauuaauguguggggcucaaugugugauuuaagcucuagcaacauuucuuuuauaaaugugggugcccuuguguuugggacaggauuaaguugucaucuuggugaauuuuuccuuugugaaauguccuucccugucucuuuugauuaauuuugguugaaaauauuuuguuagauauuagaauggcuacuccagcuuguuugcuuggaaaacuuuuucccaucccuuuacucagagguaaugucuaucauuauauuucuuguaugcagcagaaagauggauacuguuuuuucauccauucugauagccugugcuuuuuuauuggggaauugacuccauugauguugagagauauuaaugaccacagguuguuauuuccuguuauuuugauguuggugugguguuuguagugugugugugugugugugugugugugugugugugugugugugugugacauguaugcuucccuuguuuuugcugguauguaauuacuuauuuccuguguuuucuugcauauaguuaaccuccuuguguuggaguuuuccuucuuguauuuucugugaggcuggauuuguggauaaauauuguuugaauuuggauuugucuugaaauauuuuuuucuccauaaucuauggugauuaaguauuuugcuggguacaguagucuuagguugggaccuguguuuguguguguguguguguuuuaaagagguuucaagauaacugaccaggccuuucuagcuuuuagagucucuguuggaaaaaucagguauaauucugauaguucuaccuucguauguuaccuggccuuuuccccuugcagcuuuuaauauucuuucuuuguucuauagaaaauauaauaaucuguuuugauuauuaugugcagggaggauuuucuuuucugguccagucuaauugguguucuguaagcuucuuguauguuuagauauaucucuuucuuuagguuggaaacauuuucuucuaugauuuuguugagaauauuuucugggccuuggagcugggacuuuuaaccuucuucuauuucuaauauucuuagguuaggucuuuuuuuuuaauuggguauuuauuucauuuacauuuuuaaugguaucccaaaagucccccacaugcccccacacacacuacaaaaguccccuacccacccacucccccuuuuuggcccuggcguuccccuguacuggggcauauaaaguuugcauguccaaugggccucucuuuccagugauggccgacuaggccaucuuuugauacauaugcagcuagaguuaagagcuccgggguacugguuaguucauaauguuguuccaccuauaggguugcagaucucuuuagcuccuuggauacuuucucuagcuccuccauugggggcugugugacccaucuaauagcugacugugaucauccacuucuguguuugcuagaccccggcauagucucgagguuaggucuuuucaugguagcccagauuuccaggguguuuugugucaggaauuuuuuaucuuuaacauuuucuuugacuuauguaucaauuuuuucuauuguaucuucuacaucugagauucucgcuuccaucuucuguuggcagugcuugugucuguaguuccuguccucuucccuagguuuuccaucuccagaauucccucuguugugcuuuuuuuuauugcuucuauuucuacuuucaggucuuacacaguuuuauuuauuuccuuuaccuguuuaauuuuauuuuucuuuaugucuuuaagggacuuguuuccucuuuaaaaaccuguaccuuuuuauuguauuuuccuguauuucuugaagggguuuauucauuuucuuuuuaaaggccucuaucaucuuuauaagauuggauuuaaggccauuuucuugaguuuccauugcauuaggauauccagggcuugcuguaguacaauagcugugcuccagagguaucaaauugcccugacucuuguugauuauuuucuuucuaggaccuuuagccaucuggaugguuuuggucccuagauguucuuguaguagguauuaggaggggggugauccucagcaguccugguauggcaggccucugauggauagccuugggcuguguaguuccagaucagcaggucugcgugguucaggauuugcagguauggugaagguauacagagagguggugggagaauggagguccacucgauguaauagacuguucagggcagcuugggugucuccgaggacucaacagagaugggugggggaagggaagcuaaucugcagacuccaggauccucaggucuguugaagguggggggagaaucagaccuuggcuuuuaauuuguguauauauguacauauguggcaaugagcauccagacaggucacaaaacuauaaagaguuccacaagauaaaagaaaggcuuuggaggauggaggaagagaagagaauagcacauaaaagcagaaacuacuagaguugaaaggaggggaugcaggggacagauguugggauggaagagaagagcuggaggggagaggaaucagcaaaaacacauuauagauaaaaguuccuuaauggaacauauuacauuguacauucauuuuuuaaaaucauacuaauagccauuuaaaaugucuaucuaguaacuaaggucuguauaaacucaguuuuucucauuuguugguaguguuagacuucuauuucugaauucuagaaucuugguauacuuacuauuucaauaguuaagagagcauagugauauuuaaaagcuucaaaggggaaaaugcaauguuucacuuauggcacuaagcuauccuucucuucacgagguacugggguuuuguuucuuacggauccuccuaaaguugauucuauauuuauaggggcuugggauguagcuccgucauacagauugugccuaacauguacaaggcuuuagguuccauucccaguaucacaaaggcaaaccagacaagcagaaaucuaauagaggagccgaguguggcagcacacacccuuaagggugcucaacacguggaagacagaagcaggcuagccugcucuguauagaaaguuccaggccagccagggauacauagugagacccugucucaaaagcauagcaacauagaaaaaucuguaauagaguuuauucuacacuuauaaaauagauuuaaaaucuaauucgaaagacauuucagcaggucaguuuuguuuccuaaguuuggaauauacccugcagaacuuuccacauugagucauguggaaguggcucauucuuuuuaccugaggcauaguugauuacuggaaaugaaaucacagcuuuacuagucauuuagauguauaucucagugaugggcuguguuugcuugcuguggugcuggagaugaaggccagagccugcugcaugguacuacgcaugcucucuacuaccacugagcuacauccccagcccauaaaugaugugauguuuaauggcacuugauggcaaauguuuauaagucuagugugaauaagacuauuucuucuugggcucuuuuugggcaacaauugccucuugaacaaaaaugauugaucuuaacacacacugucaacacuauugaguaucucaaagcaguaguaagugaauuacaauauauuguguuccugucauauuguuucaguauugauucugagugagugagugaguaaaugauuucacucauuuacaaaggguucaggauauuuuuccugguuagucuaaguaaaucuauaaaauaaauguuaauauuucaaaaguaaagauaugguuacugguuuuuaaagggguaaaaucugugaguuucaugugagaaaaauaguauccuagaucuuugguguauguauuuuuuuuguaauaggcccuuucaagugaauccuuugagaggcugccaguuuucaauaagucugcauggcgccauuacaagaccacuccugaagcugaugacuggagcaaucccagcagugaaccaagggaugcaucaaaauacaaggcuaaacaguaagaaaccacuucgauuuccauuauaaaauaucugauuugucuccagaaaguaccaggcagacaauugaacaguauuuuacaccaugcauucucuguggcuucaucauugggaaagcaaagugauccuuagaaaaaagaaugcucggagaaggacuuuuauguugaaaaggagaacaagaauuggguagcuagaauaaucguguaaguggaauucccucgguccuaggaauccuugcacuucagagggauugacaguaaauaaggguuuauucuauugugaauguuuuaaaacaauuaaguuuucaguuuauugucagucuuagaaauauggugagaauuuuuguggguuaaaacuggaaaaugaaacuaaauuuaaucaaaauguaguuaauucacacagcaaaauauuauuuagucuuuaaaaaggagauucugaugcaugcuucaauguagauggaucuugaagucuuauuugauguggaacaggccauacuuggauagcaaaugauuacauugcacuuuuauaagauaccuaaagugaccauuucagagucugaacauagacggauggaugccauggcuucaugggaggcagagcagggaauuguuaaugaauacagacuuucuguuuguggugaugagaaaggucuugguauagguaauggugaugcucgugcaaugguaugaauaugcccaagucaccaaacuuuucacuuagaaguagcugaugguaggcucucuauaauguaucguuuaucacaguaaaauauuaaaaaugaaaaguugcugcuuacagaauagcuuccacuguuuuauguuaguucauuucugaaauaccauuuaguuuauuccuucuuaccauauuugguagaaaucagaaguuguuaaaaaggcucucaguggagcuuuuuaaugcuauuuugcuggaacacuccaucaguacuguugcagaauuacauguuuagagucaugauuucugcuugaaccagaaauuauuagugaugguauggauagcccauaauuuaggugaugucuggucccuguugcagacguucucaagcuuccuaaugcucugacccucacgcuuggugaccuccgccuguaaaguuauuuuuguuuauacuucauaacuauuuugcuacuguuaugaaacauaaauaucuguguuuucugaugguccuaggugaccccugugaaagggucauucaauccccugggggccgugauccucagguugaaaaccucugccuuaaaggauaggacacaaguuucuugcauuguguuuuuaagcauuguagauuuaaauguauuuuauuauuuuacacauuauacucacugagcacuuuuuuauugaaguauauaacauauaguaggaaugucuaugaaucuuaagucuauaacuugauauacguuuacaucucuacuuuugauacccuggaagacucauuucuagccagauuguucucuuuucucuaccauagauguuuucugaccuucacuggagguguuuuuaaaagacaaaacaaaaaccacauguaaauauguccccuugucaucuuugcccacugugaaauccauucaugauauugauuauggcagucacuguacuuuuuguugcuuaagauggcacacuuuuagauggaguuauuuuugaacuugauuuucuguguuccauugaccacaguguguuaauuuuuugaaaguuguccuacuuuauuguccagcauuuauccuaagaucagccgggcgugguggcacacaccuuugaucccagcacuugggaggcagaggcagguggauuucugaguucaaagccagccuggucuagacagugaguuccaggacagccagggcuacacagagaaacccugucucgaaaaacaagcaagacaaaauuauccuaagaugaucuuccacccucugugcuccuaccccggaaucagccauuuuagaguucuuuuuaacggguauuagagacuaaucuuggcggauaggggugcacauuuugccucuucuaagccccuuuucuggauagagguucugaauacagacauacaugggugcauuguauauacccauauaccuaaguucauauugauagugucauucuauuuuaacauugauuauuucucucuaauguuuuucuuauauaguuuuucuuuauauauaauguuuuuuauauacuucuuaacauacaaaccuugauucuuaaaaucuuuaaaaugacagaacaguaauauuuaugggcaaauauacuuuauauaccuuugcaauuuuauaacauuauaguaaaugcugguguuuucuaaugagugguguaaagagucaaacagauaaaagagauaaaaggguuauccacacugcugcuuuaccuuccugcagaagaaagccaugguagagcuccaugcaacucaucucaaagcaggaaauguaaagggauuaagucauucaccaucagucagaugauaggaucaggaccauuauccccacuguccacaguggcugcuucuuuuuucccaaggaagaguugugcucugaacaccuacacaaggcuugauuguaucacuuucucuuggacacacaugcauacaggcacacaugcacacauacagagagagggagaggggaguguugucaguguuaccauucucagccagugacaagcagauuagcuugaaagccauaucagaucaguuuacuccagucccauuuucagucuguauguaagccaaguaucuuguuggacaucagugggaggcagaggcagauagauagaucucucugacuuuuaggcuacccuggucuacuuagccaaucccaggacaaguagaguuacauagugagacccauaguaaauagcuuaauguauugggugcuaauuaaaaaucaguccuacuuuccagcauguuuucaaacaaauuuuacaaaaaaacaaaacaaaacaaaacaaaacaaaaaccuaaaguagugagcuugguaguuuaaaauuguuaagcucuauaaccagaacaagcgaauacaugcucaggaaagguacacgaaugggacugucgggguuucuauggagagauggagucucuagcaaguuuuuaaagcagcagguucuuuuugaaauaugauucucauaccacauaguuugcucuuuugaagcauacagcuaaguugcuggggcuauucaacauuuacagcccucaccacuguuucaaauugagacuuucucgggcaaagaagaaggcccauaugcauuaguagccacuuuauauuuuuaauacauuuuucuuuggucuuuugaaacaguuuuucucuacauaacccuggcugucccagaacucacuguuauuccaggcuggccucuaacucaacaaagauccagcugucucugucuucugagugcggaauuaaaggcauaugccaucacaccuggcuucuaauaaaaauuuuacuugagagaacaaaacuuuuguaaaguuuacauaaauaauagaaugcuacuuuuucuggaguaacuauagaaaacaauucugagucaaggcaaagguuuuggacuuauuacuguaaauguucugaauaaguuuugguuaaaauaaaggagacuauacucaugagcucucuggauccuuuucuuuauagggacaagaucaagaguaauagaacuuucuagaaagcugagugcugucucugaagucucugaagaaagaauaccuucugcaagucaaccagagacgcguauuucuaccaacucuuaaccaugacggcacuauuguuaucccaaugcuuaguugcuuucuuuauaauggcucacuauguccauggagcccuucccauagucuuucccauuguaucuuccacuaaagcuugagcaauuuuucauugugucuugcuguggcaucauuagcacccgucacaaaagagcacagaaccuccuagcgcucuuguacccuauauucuguaucuuguuauggaguuuagugucugaagucuuccagcauucugagcucauuucugauacaaaccuccagcuagggcuugggcagucggaugcaucaguggagcucaucuugaaaauucaguaccaggguucuuccugucccauauacaucacccuucacucucugauuuggaccuuugugcccccuucagcugacuggguucucauugugaggugugguacuuggauguuagaaccuguccaucuguaucaauuuuauuuuaaaguucauuugcuuacuucuguuccauugauuaaagcacucuaaacguugucuuggaauuucucacuua

SEQ ID NO: 9615 - RNA, 6845 nt, Mus musculus
gugugcuauagaauagcauuuauuuuuaggaaucaggcuccauacaaucauggcagaagcuagggaaguaaggugugggagaaaacaguugaaggauaagagcaaagucauuauccaucaagaaucauugagggaagcuacuggaaucuauggaggguuguugcuucugucucagagagugaaccugauucauggugguuuagcagugcaagaaagcaagaaaagugggagacgaaacaaaagaaaucaaagcucacaagguuugauggaaccagugaggauuauccugucuggggcucacugccuugaaugcuucucacugagcuguauagaaacuuggcccuggauucagaaaagcugagggggaagagauccagugagagcugaaguuacagcuacugccuaccccuguuccauacuaucacuggagccucuuaacagggugagguaccaggucagcaacagugugugugaacugcagcagugccugguaccuggcagaaaucuucaagguggaacagcugaugcuccaguucugccuuccagaucacaucaguuuuuauuuugaccacuguaaccuagaacuguaguauacuccugaggcucucaacaguggacaggucuagaggaaaaacauuaggaaauguaguuaagcuuucgguaagguaacauaguauacacuugcccagggaacauucccaacucaggaaauggcaacuuuaucaugauagcugcuuaggucaaaaagcuaggaguuaaagaaucuuauuuaguaaagugucuggucugaguuuuguucuuuuuaagucugaguguuaauagcugguuauauauugggguaauaguccuuugucagugaaggcuugguuuucacuguucauuuugucaaacccucugaguggcauauuaauaugcauuccacuagauauucuaaacuuugaaaaaaauaaaauuucucauauacaaguacccuuccagcuauggaaguaaccaaauuaguuaaauagaacuuucauuuuuaaaggggaccaauggucaaaucagcuaauaucaagagucauuuucuuuauacaacuuugacaaaaaaaaagcugccgaaaauaaacgaauccauauuauugacagauggccauauugccuaagauuguccccuagucaccacuaauaguauucuuuaguuuuggucaccucguuuucccuaagauccuuuuguuugauggggaaauauuaagucauaaaacagaacauguauaagaaaaugaaaaccugucucauaagaaaaauacauuucucuaagaacuuuaaggugaaagaaaauauuuggcuguucccuaaaucaguuuaguuauuuucugucccaggaaaggacaaugggccuaaaggaaaucaguucuauaaaacguguucaccauuuucuugaucaagguaugcauuuccugcuuugaagcuuuccacagaagauuaaaaguugagcucacggccugaguuguuuuuccuguuaaaaaaaaaaaaguaagaaaagaucauuuguuuaggaguuacaucugugccgggcggugguggcgcaugccuuuaaucccagcacuugggaggcagaggcaggcagauuucugaguuagaggccagccuggccuacaaagugaguuccaggacagccagggcuacacagagaaacccugucucaaaaaaacaaaaacaacaacaacaacaacaacaacaacaacaaaaaggaguuucaucugugaaucccauaugaagguacuuuugaauuugugacaucuuuaaugcucacuacuaacaccaacaauuucugacaggccacccuagggcccacaucuguagugaugaggguggauguaagagugugggggcccucuucaugaugaugggcuagaugagguugucaggcugggcuuuggguaggauuuacuccucaaacaagucauucuuggugaagagaggcgacuauggcucauucagguuuucuuucaagauuucaauuuuucuugaaaaaugugaaacugugucuucugguaguuucuaagggcaaaaauauucaucuguuuuugcuugaguagaauacaaggaaaggauggggcuagggagauaggucagugguuaagggcacuugcuguucuucuagaaaacccaaguuugauucccaguacucaugucaggcagccuguaauuccagcuccaagagaucuuacaccauuuccaggacuccauagacacccacaugguagacagaaagacagacagacagacacacacacacaggagagagagggagaaugaacacuggagaauuacuguuuuucucaucgcccuaguggaacuaauugaaguccaggugagacaaauauauggggauggauggguagcuagccaaaguuuugggacuucugggaaaaugggaagggcugucuuugggaggacgggagagcauggagguuaacaugggagaaauagaguugccuagaguuacacaaacuuguauauauacacaagccucagaagcuuggucggaguugcagagauuaacucucagugacgcuguaugaaugguuuugugccuguuccuaucauucagguauacaaacacugcaaguucugcauaguuuccaacaugcuuuguauuuccuaacaucuguuucacaugccuuaaaaccaaagagcgcugggcgugguggcacacgccuuuaaucccagcacuugggaggcagaggcagguggauuucugaguucgaggcuagccuggucuacaaagugaguuccaggacagccagagcuauacagagaaacccugucuugaaaaacaaaaaacaaaaaaaaaaacaaaaaacaaaaaaaaaacaaaacaaaaccaaaacaaaaaacaaaaaaaccaaugcccaagaagaaggccagcaacaggagaucuaccucagacuuaguaccucaacuccuacuacugccuuagcucaauuucuaugcccacuugccacaucaacaaaaucugcaaccagagccuaaagacacccuugggaccuccaucuuuuggacagcccuaaagggcucuuuguguuuuagcaggccuaaguaagagcgaugugaacacccuaaggggaaagacuggaauuaaaaaaaaaagcaaaggugaugugcgcaggccagccugcacacagucuuagucaacagcuucuuaucugauuucaggggccuuggucuggaagcacggagucucugacuugauaugggaaagcaggagucagaguagcagcuuuaaacuaggaagucugugacuagacuccaaaaggccuuuucugagaccugggguuuuacuuaacuuguuuuaugagggcaggaggagagaagccacaggguaccugaggaaaggaagaaagugaaccccacuuggggaaaccaaacagacccuggagaagcaagaagaccuaccuuccaacauuuucauuaaacggaggaaaagccauguggaaauguggaauggugggccgaaaugggucagcuggccagacccacagucuauggcaaagcagcacuccuggaaaagcagcgaaugaacaggaaaccaagucguuaaaucuucuuccccaggccugaagaucagaugccauuuuccagccauuucuuuugguaguuuuucugauggggugaugcuccaagggccugggaaugauuaaagaaugacaaggucaaaugguagguuaguccauucaaaaaaggcaacugaggaccagccuaggaccagucccuagaccaguguccuaauaaccaggugacuuuucucagaaagucaccuuaaacucagagccuuaagaucagggcuggugaaguguucuggaguugagugagcauauccaucccugucuaucugucugcucaucucauucguguucauggggcuggaugcuccuggagaauggcgucacauuaguguugucagaauuuucuccugagucauagcagauaauguacuguagguaaggaccuuaaacucauacuaguagauccuccaugaauagaagcuauaugucacagaagacagggccagccuccuagggcauagagaagacuaaucaaagguauuuugcuuggugaugcuuggugucauccuuugaagcagagcuuauucauggaagccaccuggggagauuugaaagaacgacagcaugaguucuccagaaauucugcuucauaagccugugcuggugucuggauaauggucacuuucacaaucuucccaggggauucuaucuaauaugcuaauacaauugagaaucagccuuagguaucaaccuugccacccugaccuuggaagcuaagcaagguuaguccugcuuuaguacuuggaugggagguagcucaguuucucuauauuauagaugaaaacaauuuucucucucucucuccucuccucgccccccccccccgucugugugugugccaccguguagaggucaaaggucauuuccuuccaguaugugggucccaggaucgaacucagauugucccauggcaagugccuuuuaccugcugagauauugcaccggucuaaaugauuuuccuaugugcccaaacuagauccaauggcaggguguggcagcaaaacucauaaucagagcacuugggagggaagacugggguucaaggcuauccuggaacacgcagccagaccucauuacaaaaaagagaaaaccuaauggcugggaggcagcaaaguggguaaaagugcuugcaggcaugcaugagggccugaguuugaauccccagaauccauccgaaagccaaucaugguaagaggaacaccuguaacccacgugcuccuuagagaaagacucgccagaagcucgagcgccagcuagccuggcuuagccaacagaaacccaacgacauccugucucaagcaaggaggaaagcagacaccgaugcucaaggcuguucucugacuucgacaugaaugcugugguaugcauaagccuacauauucauucauucauccauucauccauucacucauucauacauucuuuuacauacacaaucuuagugcucauucuuuuacuuuuuuuuuuuuaauaaaucauuucuuuuuaacugcguacuucauucagaucacagccucuuuuggcugcuuccucugacaacaguuugguucccauuucuccggaaugcuacaacugacuguacugagugaaccagagcccccaaaccaggccuuuugaaacaguaaaucaacaaaccaaaguccagccucuccuuucccuuaggaagggacugguagucaaaugaucggaauucuaccuuccaacugcagacacccaagagcguggaugcacugcaaacacgcaaacaaaacacagcacagcagcccccacccauauauuccagugccacuaucugaucucuggccucuuccaguaggaacggccucacucuagcaaucuuaaggaagacguuuuggccucuacuuaauuucccaaagagacauaaaaccuacuaaaagggauacaaugggucagcauaaaucggcuuacuuacgagagacuuuucugaguaacggcucuugacuguugagaaacuucacauaauuucaaaguggcagaauccagggcacucagagaggacaguucagcaguggccuaguguugaggguaaguuucuguauaauguaggugcacacacacaccccucuuuucuucagggucaggcaagccgccaagaccucgaucaucaaaguaaguuauuuucuauauuacagugcauaaaacaagagaggaaaggauacuuucauugagagagagagcaagcgaucgaaaggcaggcguucauagugcagaaaguucuguggcuaaguaaaugggcagcagcuggggcuuguggccuucaggcgcugaaguacugcaauuugccuccagaggaggccucagcggcgucugcuuccuccuuggguuuggcuggcuccgcuggcucagcuggcuccgcuggcuccucuucauccuccucaccgaaauaguuagccucauagaaagcauccucauccucuucguccucuucauccucucccuccuccugguagucagccucguaguagauuucaucaucuucguccuuauaauaguugucuucguacugguaguagucuucaucgucauaguagucguuauuguuguaauaguuguucucgugauaguaauccuccuccuccuccuccuccuccuccucauacuccucuacuucguaguaauagucaucuucaucuuccuccuccuccuccuccuccucuaccucggcauucucaagccccucguaguaguagucaucgacaucaucguccucuuccuccuccuccuccuccucauccugcagggccuccugguagauguccgaguugucguccucgcucucgcucucauucucuucuugaggauagaugucuggguauuucugcaugcacuccuucaaggccugguacucacuugcacaaucggaccccuugacuucuucggugcugugguggaagcaggaaaaggcagacuugaaguguucuccacaggggccgcuggccauuccuccaaggcacgggcaauuccaguuaaugcugccacuuggcaguaucaguccauacucugcauggggaucauugggcucgucaaccaccagcucggcauugcugggacuuucguggucuucuuuggucacgaauacaacuuuaucuuucucuuccugcgggcuguaggccaugguagcuccggguacugcuucgcagugcuggugcucccaacuaacagcuugcagcucugagcucgaaaugcuggaaggcguggcgguagcugauacaccuu

SEQ ID NO: 9616 - RNA, 2757 nt, Mus musculus
gauggcgcgaaauuuacagaaggcuuuugagugggccgaugacauuauugagucugugcagcagcagcccccuccuccgagauuaacuuccaccagggaaaaaucucuucaugaaaaacuguaugacaucuauguugaggaaugugaaagagaggcagaggcaggggguccucaaagcaaugccaacuugcuggagaagcuucugaggaaagaggcguugccauguuuaguggucaaccuguacuccgaaaaucagggcuauucucucaugcugaaggacaaaagugggucauuuucagagaccucucaguugccuuaugacguaaagaaacugcuugaauacuuggaugcugaagaguuaccuucuuuucugauugauguccuggacaagucuccugugaauguuuuucaccaugggugugucauagcagaaauccgagacuacagacaaugcaguaacguccacccuccuggggagcuuggugcagagccugcucugucaucugacguguccucugccugguccucugcugcaucaucugcugagucgucugcugugccgucuacuacaucgccuccugcuuaccaaacucggcauauucucuuacgucccacgaugcagagucuaguaagcgauguagaguccauuacaagugauaaccggcaguggaaugaggaagaaaaacuugagcuugagcgccgacugauuuuagcaacagcugagccacugugucuggaucccuccauugcugucgccugcacagccaacagacugcuguuuaaugagcagaagaugaacacugacccugugaaacaaugcuucaagaggccuacaccucccucucuggaucaacaggagguaucaucuggguguacaugucccccugaccucacaacgaugacaccuuccaaaaaggcaaaaauagguccagaugacccagaugagcugcugcuuacugacaccgaugcauggaugcagggacccugugaacugaccaugccuucagaguuggaugugcagacauauauuaacaaggugccaucucugcucuuugaugaugaagagccaaauguccucgaaguuccugagguaaaacauggcuuuauguuugauuaugaggaugacaaucagcuaugggaaaugaauucaaauauuaugaagucccuuaaugauccauuuuucucugcugacauagggccacuuccagaggacagaauugauagccacauguauuucccucacaugucccuggaugauuaugcagaugauuucguggcgaggguagacucugagccuagggagauaguagauauaugccaagggucugcccagggugaagcuaaguguucagauaaggugacacaggguuuuaguagcucagucugucuuccucaacccucccuggagacaaagcccauagucaguguggugccaaagcccacaccuagucuugugucaaagcccacgacuagucuugugucaaagcccacaaucaguguggugccaaaguccacaacuaguguggugccaaagcccacaacaagucuggcggcaaagcccaaaaucaguguggugccaaagccuacaaccagccugguggcaaagccugcaaccagucugguggcaaagccugcaaccagucugguggcaaagccugcaacuggucuggugccaaccucagucuuagagcaggaaagcagaauucuuccaccacuugcacuuacccagaucucaaaacugggcuccucgacugucagcuguggucagaauguaccaccugcuccuaagacaagcacugugguucagcaggccacugugggcaugagcagaguuaacguccuuccucuagcucuccagccuacugcuaggucaucagaaaacaagccgaagguccagggccuuaccaguaucacuaccacagaugugaucaauguaguaaagucuaaagcaaaaccuaguuugguggguaauucaacccagguccuagggcgccccacuaguguaccagcugcugcaggaaucacucaaaacagccuucuaccaaccagacagcagccaccuaggccagcacagcgccccguaaagucgccuaugcaaaucauuauaaauaauacggcaaaucccuuaacuguaaagcuucccccuggcucugucauuuugcguccagggccucaaaagucaucccagggacagccacagcagauauauguauugauuccaaaacagcagcagacacccaaggcuccugcccccccacagccagugccaccagcuuccucccaagggccuaauaauaaucagcaguugcucuugccagcucggcaaacuagucgccuuagcacugaacaaacuggucuccuuaacacugguggggccagaggaguucaacugaccccgaccccgacaucugugguaucucggguaggcuccacccagaagagucacaggcagaguacucauuuacagagcuuggagcgcccugcuacccuaguacagcaaaggcagacucagagccagaaugugcaggugagaaucauaccacacauaguaacugugggcaaaccaggcacucagugcucugaccgugugggcaugcagcuggugaacccagugauagaacaggaggcccaccaaacaccccaaaauccugagucuuaauucucuuuaaaaugugccagcauugagcuaaaucaauucucaguuuuuacuucaccucugguguuuugaauguccuaauauauuauaguuuaaaauga

SEQ ID NO: 9617 - RNA, 49074 nt, Mus musculus
cacacaccgcacacacacacauuuacggcgggaggggggucugcgggccugcaaacaacucgagccaccgccucaggccgggacccucgcggagaggcgguagguguccccgaaggcccccgggggguggccgcggcccacaaacauggugggggguggcccgggccucccgccucucgacggugucggugggccacggccucgugcggauuuuacagccgaggcggcggcggcggcgcguguguggcggcgguggcgggcgggagcgcggagguggaaagaaggggggcgcugucacggaaacucgggccgccggagaccccgccgcagcgaggccacugggcuccccgguugcggggcgugaagggcgccaacccggggcgucagcgggacccaccgggcggaggagggggcccagcuacccuuccgcauuuuccugggucucucuccccggcggugacgugacgugcugacggcgggcccgugccggggagcugggccgcuuuuugucagcuccgagcucggccccuccucccucccuccgcccgccccaccagccggagcccggcccagugcuccagagaaaggccggccugcagcacccgccaccgucgccgaccgccgcacgaccguccggugaguccggggcgccacugcggccguagggccuggugcgcgcgcggcggccugcucucggccugcucggcggcccgcaaggcgcccucccgcgcuaggccgggcggcguggcgcgcgacgccgagcaggccccgaggaggccgcaguuaggcccgggguggcgcccgggcgcucagaacggcggucgaggcgcguucuggaaacgggcggggaccggggcagugccgcccggcgguuggggaggcggcugaggggucccgggugggcgacguggccgacccggggcaccgugcgggggcgaggccuggcgaggaggcuaaggcugcaggcaugaggugaaggccgcaggccggcccggccgauuuucgcuauguaaauaucggcgaggggggggggaagagggacgggggacaagauggcggccggccggcgccugcugcaggcuacgacggaggggguugccgggagggggagccgccauuuugaaggcggcgucugaggagaaaauuccgcuacagcccgugagggggggugugagagcgggccgcggcggcgcuagcuacggggaccggagcccgggcgcggcgucgagugugcgcgcaggggcguguucgcuccccauggcggccauugcccucgucgccaugaugagcacuuggaucccaggcgcuuggcggcagcgccaccuuccugcccagccucccacagccccgugacuggcugcuguuuccgcuguguuucaguugagcugccgcaggcggccaucgcggccgucuuggcgcuggagccaccucaucuguauggccccggggcuccgagccuuuucccggcgcuuugcugccgcuucagggugaucugccgcgguggcaguaguggagccggagacauuuucuuaggacuuuauuuucucagagguagauagacguggccguuagggugacccuggugcggugcuucuccgccaaucguugcuuucacgacucugugaauaaagaaagaaaagugaugggaaaguucucaccacucuuuugaccaauagggggaaaaaggcauccuacgaaagcggaagacuagcauaucggagggaaguuuuuguguuccuuucuguggaaacaaguuucuugggaggcugcguuugaauuuugguauauauauuuauuuauuuaacugaggaaaauuaaagggcagaaaguuauuuucuuauccaacgauguaaugugacguauuagcuagcuuucguugauucgcugugguagcccguuugugagguuuuuagaguggaaucgcaccccaugaaauuucuuucgaucucacccgguacaacuuugcugguaaccucggcgucccaugccggcugugcuaggugcugagaaagaguaaggaggguucuuguaagugguggcugugggaggcuuguuguucagaaguagaagagcaaauguugaacuguaagaagugccgcgcgaaggcuacauccgaguuaaaguggguuucagagcagacaugguuucuguuugaagcaucaggaaggaguuccugaaauagguggcauuuugagguuacaagccugauggcccagacaggcaaagggcguuucaagggugaaguuucuuuagagaacagcaaguauuuacuguuugucugaaauggauaguauagguagaggcuugcaaagguggguugcagcgcgaauggcaagggcuucugcuccgugggaagcaagugcgggagcucuccgacucccggaugacgacacccggaucugugcuugauagcuaucagcucgguugggcuaggacaaguuugagagaaguagguugugugguaggcugaccaguguuuuuauagugaugauaauuacaaagaguggucagaagccagauuuuauuacccuuuuaaaaugcuuuauugcaguuuugaaugauccauuuuuguuagacagcugguccuuuuucuauauucacuguaaauaacguuuuacucagaguuguuauuucuguaguaaacagaguuuccuaugauuucauuucccauuguugaaaaugaauccuggugcuccucgaagaagaugagaaaugaacuuuccuacaaguguucccaugauguuuuuaggaagucaguuuugaaaaugaguuuggaaggaugguuauuaaaaagcaguggccuucaguugcccuuugcaaucuguuuugcucccugcugagaguuuuguuugagaggcuaacuaagguuauuugcuaagcaagccuuccugcauguuuugauuaauauuugacuuuucuagaugcuuaugugggaaaugugucucacaguuagauaguucuucacucucggugucuucacuuuuauagacagcaacagguuggaaaucuugcuccuagagagugguuuuccuagaggccacggcaagcuuuaauuaaagaaauucucuuaagcuggacaguggcggcacaugccuuucaccccagcauucagaggcagauuuuugugaguuugaggucauccuacauacugugaucaagucucaaaaauuaaaaagaaaaucacauuuaaaaguucucuuuaaaaagacuuuuaaaguucaguucuugggugucgggguggguggggcugagagcaaucagugcagaagagacagugugaaagucuucaguuuaauuagugcagaaagcuagauaguggacauucaggauuaagaugaaauaagagucagguuguauaauuaggaagauugguaaguguguauaguuuccaccaggaaugguuauauacaaaauucuuuuuaccuuaaagaucacagacccugauagucuggagaacugacugguggaacacuauugccaacuugucagucuuggguaaacaagauacuaguuuuugauuuauguccacuuucuuagguagauggugauaucuuucuuuuuuugcaauuuccuuuuuucaaaaaacaugcucauagauuguuucaaagagauuucccauccauugcuuaaaaauguuuauagucucccaacauuguuacugauaauguguuaauuaugccuaucacagugucaguucauuuuuaagaugaaaaaaacaauuaacaggcuccugaaauccuuuacccucaucaaagauaauaauuuuuguuuguuuugagacccaaucacauuaagaagccuggcuggcuucagucuccaaauccuccugccucagccuccugaggcaugugauucagcacaacuggcuuggauuccuuguuuuguuuugacuugaccuaacugaaagucuaaccaguuaucugguugucagugucucuuccuauucuugauuuuuuuuuucuguguaggcuuuuugcuuugcuuuuugucucuauguaaggaucgcccuaccucuaucuagucuugcugucugcccaaacguuggccugccuccuuugggauggagcuuugucaauuccuuuugguugguuugagacagaguucuucucuguauguaguucuggcuguccuggaacucauugugauaguccaggcugaccucaccucugagugcagggauuaaccuugccuaauuuggucuccugcaacuuugcugguuccuuucccuauccuuacaaguguucuuugauuugcucguuguacagaaaccuccccagucuucuguuugcuuuaacuuuccacuucaccuuuuacuaaaucuaguaauugccaaaucaggacauuucuaccacaugcuaauguugucaaguguucuguuucacacucugcuuuuucugucuccuauggugggauuucccucaagguuuaucugcuggcuucucucucuggaaucuucucuguuaguuaaaugucucuucccguacccacauaucuacugucuaaucgagcauuugaagugucuaauauaucauaacacagcugaaaacaaacuuauucagcacagaugaccaguacuauuuauaggauuauuuuuaaaguccaggguccccaaacaauucccauuucuuauucuuucuguuauuaacuucaucaauguuccugaguuguuauuuuuuguuccaucuuuagcauuuaaucuccuaugguuuuuuuguuguuguuguuguuguuguuguuuuugagacaggguuucucuauauagcccuggcuguccugaaacucacuuuguagaucaggcuggccucaaacucagaaauccgccugccucugcuucccgagugcugggauuaaaggcgugcaccaccacgccuggcacaaucuccuauguuuuaauguauguuuuuauuuuugucuucuaaauggaauguagacacagguccucauuugucuuuguccccaagcaguaccuggcaugaucaucaucuucccagacaauuaucuaaauuauugggcucaguaaauuugauuuaguugaauaauuuccagcuauucaaauucaguuauuuauccaguauguucuuugaccaagggauauucauuuuaaggcacaccuaucuuguuaggacagcaggucaaacccaggugcugaguaaccucuauccuugccccauaucugauuggaauauggccaaccugcucuuacuccugccaaauuguuuauccagacagcauuuuuuaaaauccauguaaucuuaaaacuuuuuuuuuugcucagcaggaaguacacuuuaaagaaacuaaauggccuuaauguauauagccucauuccucuuuuccacaugcaaacauugcucuaauauguauguaaauuaaguauuaucugguauugccuuaagugucuuaacuguaucuauugugcauuguuguagauauugaacauguuuuguuugcuugcuuauuuauuuacuuauuuguuuaugguuuuuuuuuugagaggcuuucucuaugcagcucugguuguccgaaaacuugaucuguaggcuacacuggccucaaacucagagaucugccuguuucugccuccugaguguugggguuaaaaggggugugccaccaccucccgacuaccaagcauaguuuuaaagauccaguuuacuggcuacaggaauucuucugggucccuaauggucuuauaggagguucaugaagucaaaauuaucuucauaaugcugucauuugcccuuuucauccucauucaccuguauauuauucaggcauuagagacuacaugauucaugaugucauuauugaguaaguacagaaacaguuggaauuuaucuuuccucugugaagugagucauuagauuuacagacuauaaaauaguugcaauaaaaaacuuaaccuucuaaaauguuauucaugcuuauauauaauaagauuuuuaauaaacuaauauuuuugaauguuaaaaaagacaagaucuuacuccaguuccagaggggccugaaacuuggcaguguccuuuuaaccucucaaguccuuaggugacaggcaaugugccacuauacuggucucuuaauuuaaauuucucuaaguaugagcgacauaaaaacuucuuaugcuccuguauuuuugaaagcuuaagaauccugaaaccaaaaaguuugaaaacuacuguuguaguucauucauauuauuugugggacaaguaguggagcaagguccuuuugguguuaagcaagcucucacuaagacuguauuuuaauauauaaaaacacugauuuuauuuauuuuuaugggggacacauuaggcuguuugcacuuuucagcaguuuccagcagugcugcugugagcauccucaaacaguucucccucuugauauuguaguagaagugcaguugcuguguugaggaagucuguacauuguaaguuuuacugggaauugccaaaagccaaauugcauacacucaccagcuguuucugagcuugguucuccagaucauugccgaaagauuagauuuugcuguuuuuccgauuuguugggcauaaaugcaaucuccuugcuguuuauucuccaugucuuugguuacuauuggaguuggcuggaucgcuucccuccagauuuacuggccauuugaauuuuuugggaauuguuugugcauaaguccuugaucaacuauuguguuggacuguugucuucuucuuaugauuuguggauauuuuaauauuguagaucuuaaagauauaugauuauauauguugaaaauaucuuccuacucuggcuuuucuuguagcuuuacuuuuuguguuggaggucuuaaagugaugguaggcaguuuuuguacuugugcuuaacgccccccccccccccccgucuguguguguguuucucuagaaauucuuuacuuaaaggcaaucaugauaccgcacucuuucuuuucuuuuuucuuuuuuuuuugcauuuauuuauuuauuuauauaccccacccugcuccccuacccacccacucccacuucuuggcccuggcguuccccuguacugggacauaaaguuugcuagaccaaugggccucucuucccagugauggcugacuagaccaucuucugcuacauaugcagcuagagacaugagcucugggggaacugguuaguucauauuguuguucuaucuauaggguugcagaccccuucagcucuuucuuuucuuuuuucuugagucagggucucucuguguaguccuggcuguccuggaacucacucuguagaccaggcuggccucucucgaacucagaaauccaccugccucugccuccccaaggcuuggauuaacagccuggcugugugcuuuuuuauauacaauuuaucuggaauuuuuucucuggugggugauguagggaucucauuuauuuuugcauuucucacauaguuugagguauacugcauaacaugcauccgcacaugcuuucauuuuauuugcuuaagcguuaauuacauuauuuauuucuguguguauaucuggagcucagaugagcaggagucagcucucuccaccauguggauccuggggauugaauucagguuguuaggcuuaccugcugagccaccucauuggcuccacaucugcuuuuaguuucuguuucuguuuugauugaccuguugggcuaguucuaucacugccgccuuaauuucacgaugauagcuuuauaauuaaguccuaacuugaucacuuuuuuuuucuccgagacaggguuucucuguguagcccuggcuguccuggagcucacucuguaggccaggcuggucccaaacucagaaauccgucugccucugucucccaagugcugggauuaaaggugugcgcaaccacaccuggcaacuugcccacuuuuaaaggauuauuuuagcuguuuuuggcuuuacuuauuuuaggguuagauuuucauuuucugagaaaaugauuagauuuuuauuguauuugccuuuaccucuauuggaaacucuaaucucgauuuguaaucuuuguugccauuguaagccaaguuuucuuuuccuuuguucucuguccuuccacccugaacccccuuugcuucuaccagggauuaaacugguuaacauauacuagaccaauguuguucugcaaagcugucucugcugucucucugucucugucucucucuccuuuucccccuucguauguccuaggccguuuccaaacuagcuguauguagccaagaauaacucuugaccuucugauccuccagccucuauccagaaugcuaagauuauagacauguaccauuaugccaaguucuuuagcuagugcugcuugggaucgaaccuaagacuuccauguaugcuaggccagcagacugacuacaucuauccucagccccuucaguccugguguuuuuguuguuaauuuuuucccacauaguugcccauguuggccuugcauucacucuuuaguccaggcuagacuagauuuugagauuuauuucuccuucagccucuagaauuuguaagccaauuguguacuaccagccaccccuccuccaaauggugcugaggauugaauccauaaucuugugcaugcuagcuagacucuacagauguauauaaaagacccauaccagucuuuugcuuucuaucuuacuuucuaucuuauuuuuuauaagcagcauggugcauugauuuuacaaccuugcugaacucuggugaccauguguuauggguucugagauauacuuuuccuuccuauauuuuaacacguuaaaaauagagccucaauugauaguaucauauaauuacuuucccaggcagcugccacuauauaguuacaauuguuuguuuauuuguuuuaaagacaggauuaucuuuguguuaauuuggcuguccugaaguguacucuguagaccagacuggccuagaauacagagaucugccuaccucugccuccugaguguugggauuaaggauguguaccaccacugccuggcacauaauuauauuuugccaucacuuuaaagaaaagaauaugugcacuguugcauauuauuuauugccagacagugcaacagaacacagaauugcuaaaugguugucugccuugaaagaaaauccuacagacaauaagaaagcauaauaggaaauaacuacauuacaagcacaugcugacagaauaguuuuguuagaaacaauugaacagguuugaguuagaagagccaauguacaguagaacccucaaugucaauugggaauacccuacuaauucuuuuacacauaggugagugcaugugugugugugcaugcauauguguaaaaaaacaauaaaaacccuacccaaauaauuccaaaaguuauuuugguaagucuaaaugaaaguucaagaugaugacauaggauauccuaguaauuguuuuuuuuucucucucucuacaggugcguauaacugugcccagcuaaccuuguaagaugaauuggggagcauccccucuuuuuugaaacaggucuguugcauagagucugaucauugaaagguagacagacuccauuuguaaaacuguacuugguuccuucuuuuuuguagauuguggauuugaauuaguaauugcccccuuucuccugugauauauccauuuugcuuuugaguuugguuuuuuuugggggggggguaguugauacaaaauaguuucuuagaaacguauaaacucucgaauauucugacauaaaauacaauuuccuugaugacuagaaaauugacuuuaauuuccauuuucuuaugcguugugcuaaucagauuuuucagacuguucauuuucuggauguuuuguguuucuaugcuugucacuauuaugccuuuccuucgacuuuguuucugugugaucugacauuuaaaaagaauuaagcuggaggcuugcucacuaguaguuaacugauuuuugaacuacauguauugaaauuugaauuuucuuucucugauaacuggaucuuacgauuuugauacucuuauuuuuguuauuuuuguauuuagugguucuaaauacauuguccuuuucaugauuuuucuauuguggacaagguuucauguagcacuagcugaccucaaacuugcugcuagucauaacucuugauccuuuugccucugucuccccaagugcugaguuuauagacauguacacuguaccuauguucuggcuuuucguuucuaacuuuauugcgucaugguuggggaacauuggcuaauaacaaaacucaguuguaguuagaccaacaacaagcaacuugaaaaucaaauuuaggacaaggauaauuuguaauaagaucaaauagcauauaauacauuuuaauaaauccaaaacaugcuguaacuuuuguuuguuuugguuuuggguuuucuuuuucaagauaggguuugucuguguagcacuggcugucuugaaacuugcucuguagaacagacuggccuugaacauuuacccugccucccaagugcugggauaaaaggugggggggugcuuuguaucagcuccccauacuuuaaucauuauguuuuuaguuuaguaguauuuuauuguccucauacuuuuuaggggaaaaaaacccuuagauuauucauuccuuaaaauaguugauucuuuaguuuaguuccagggaaagauuguauaguuuaaaaacacuuauugauagucagcuuggaguauguuuauuacuggucuuguauggcaaauccagccugcucuuuuguuuaaugacucaaggauuuauuaaauuacauauugcaaagccuauugcuaauuguauuaauaaaaccugaguauagaaauacacucuacaguucugcaacugccaauuagaaaacauuguucuuguuauagaaaggcccagucuuuuauucuugccaauguuuaugaugcauggagaccauuacuguguaguauuaauauguuuaggaauaacgguaauagaaaucauauguuuauguagguaagguauagcgugcagucacuauuaguuauuuuuaguguuaguggguaggacggugauaguaacaguguuuguaguuagugugacaugauggcacaugacuuuaacccuagcacuggggaggcagaggcaggcagaucucuaguuccaggccaaccuggucuauagaggaguuccaggacaguuaggaccacauagagauacuguuucucagaaauucaauuaaaaauaauaaaugaaaacauaaguaaauguucauagucugugguauuaaguguagaacccaguuucaaacaugcuaggcagucauucuaccacugaacuauacauacacauaacuucacaguuuauaaauaauuugaauguuuuaaaaaguacaaagugaccauaugugauuuuaaaaaccagacaguuaagaaaagaauuaguuugaauaaaguaauugaaaguuacauuacauuaaacuaaaaauguaaggcagauaaaguaguuaagcaccuguaauuucaguacucaggaagcugaggcaagaggauugcugcuaguucaaggcagccugggcuauugaauuaagagacccuuuuuuaaacaaucaaaacccagcagugguaaaugacuuaccugguaaggauggcugcugcuaagucacauuaccuggguucaauuccugaaaaccacaugguauaaauagauggcuaacucauaggcugugcucugacuuucacgagaaugugggucuugaaugugcacucacacgcauguacuuagaaacacuaaaaaauaauuguaaugaaaaauuucaaaacaaaaccaaccaacaacucaaaguccuuuuaaguucuaauguacuagaagggguuuuauuuaguuuuguuucgagagagagguccccucgcucuuugaacucucccuguagaccaaauucagagaucuuccggccucugccucuccagugcuagauguuuuuucuuuuucgagacaggguuucucuguauagcucuggcuauccuggaacucacucuguagaccaggcuggccucgaacucagaaauccgccugccucugccuccagagugcugggauuaaaggcaugcgccaccacgcccggcuuccagugcuagauuuaaaggcaugcaccaucacuuagccuaaguuguugguuggcgguuuguuuuuguuuuuuucgagauaguauagccccgacuguccuggaucuguucagguugacuucaaacucacagagaucugccugccucugccuccuuguugggauuaaaggcaggguauauaucauucauugagaaagguacucaccuaaguuaacaacuaccaaaaugacuaggccagugauuaaaugcuugguuugugaaaagauuggcagaaauuacaggaacaaagcaauguguaagggaacccuuuuuaaauaacaccaacauuucuuuacccugcauuguauuugauggaaagugacauuuuaaaaaauuuacccuacaaugguuuuauuucacguauucuugucuaauguaauuuaaauuaauguccagucuauauuauguuuacauacugucuuuauccuuuuuuuauacacuccaguacaccuacagcuaaaaacagacaugugaguaggauuucuguugaaaaucucagcaaaaauuacaaagcaacuuaaaaauugucaccaugaagucaaaaagggugaaacaaagaguuguuauauucguuccauuaugauaaacaguagaauguuaugguaacaguggauuggucaauuacugggugcauuuaaagggccaugcuuuuauaaaggggacuuuauugcuuuacauaucugaaaacaagugcaaagcuuguucuguuccugccaucaggcugaucuuaaaaacauuuaacauagugugguauuguuagccgauaaauauagcuaaauucagaggauauuuuuggcagcucuuaaucugagcaggaauaggggcuuuggaaaaauaaggguuuuagguuugucacuuuagggccaacuuuuaauagauuaugauaguucagacucuuuaagcaaauagaaccaguuggcacacaacgguuuuauagaaaaacuagucuguaacaaaaacuuggacuuaauuccugagugaagcauacagaaguuccaaguggggcagggcaaugaaagagggagguaacaacagcaggcgcuuucucauugacagaggaggggagcaggauuguuugaaaaugcaguaaccuggcauaaucuguucuuauggacuaggguuugaauugaugaguuacuuaugucuaagaauauuuguuuuguugaguguuguauuauaacauguuacuagugauuugguuuuuaaaaauuucugucucauggauguuuuugcuuuauuuacacauuucuaugcuauuuucugugguauauuaaaaauuaugacuuuaaauuuaacauagugguggcgcacuccuuuaaccccagcacuagggaggcagaggcaggcggauuucugaguuugaggccagccuggucuacagagugaguuccaggacagccagggcuacacagagaaacccugucucguaaccuccccaccccccaaaaaaaauuuaacauagaaaaaacaucaaauaccuuuguucuuuuuuucuuucaaaaucauauugaagaaaaggaguaaaaauccagagccaaggaacccugaaacgaacuuuucaucagaacacuuuguccucgaauaaagcaaucugucaggggagaaaacuaagagaguuagugaaucuguggccauauacuagaaacuggcauccuauaaauacacuaauguccaaagcaaaaaggucauaggagaaagaacaaaaccauggacauagucaagugguuaaaucugagccauuucccuaucaauguagguaggucuaccucugguggucuuguagcaggaaauacauuaaauuauucugaguuauacauggauuuacaaaaugggugccguggcaagaaagguugggguaauguuuguuuaacuuugugauacuguagauugagcauaggaucauaugcgugcuagucaagguacucuacuucugagcuauuuuccaagcccucuuuuuauuuuaauuuuuacuucauuuugguuuuuuccagguaggguuuuccaguguagcccagaaaaguuaguagaaagguaaauacauaaagaggaaagucagggguuggagagagagcucagugguuaagaacacauaugacuuacagaggacuggaauugaguucccacguugggcagaucacugucacuuguaccuuuagcuccagaagaucucauaccuggccucaguggguaccugcacucacaugcucauacccauguacucgcauacuaguacccacgcacauacaugcguaauucaaaagcaaguaagaggaaaguuacuaauaauagaggacaaauuuagggguacuuagccuguaauagaaagucuaaugaaugauagagaagccagcagagugcacuuaggaguuugaggcaggaaaauugucaccaguuugaggccagucuggccugcauaguuacaagccagccuuugcuacauacacccuguuucaaaaacaaagacagacuacagagaauagaagcugguguuaaagcucagugguagagcacuuaaccccacauggacuaggucuagcuggaaucagucucugguucugagaaauaaaguguauuagcaacgucugagaaaaguuaagaaauaccuaagauauaagaacuuagauggaccuuaugacauagauauguguuaguuaggguuuuacugcugugaacagacacugugaucaaggcaacucuuauaaggacaacauuuaauuggggcuagcuuacagguucagagguucaguccauuaucaucaaggugggagcauggcagcauccaggaggagcugagaguucuacaucuucaucugaaggcugcugggaaaagacugacuuccaggcagcuaaaaugagggucuuauaggccacacccacagugacacaccuacuccaacaaggccacaccuucuaauagcgccccucccugggccgaacauauauaagccaucacaauauguaaugccagccacuaggaagacugagaggcaggaggauagaaaguuaaagccugccuggccugauaggauacauuaaaggcugguuuggacaacuuagugaaauugcuucaaaaggugaaaaagagugaaaacucagugguagaacauuugcucucuguugaagguccuugaaguuucuagugccaaaaauccaagaaaauguucuuuguuuaagaacauucuucauuuuuuuuuauguuuuuuuuuugagacacgguuucucuguauagcucucgcuguccuggaacucacuuuguagaccaggcuggccuuaaauucagaaauccgccugccucugccucccaagugcugggauuaaaggcauccgccaccacgcccugcuuacauucuucaaaucuugauugaaggguccacugaguguacauguuaguugaaaagugcuuguuauagugaucacugugaaaauaaauaaaaacugauuacuacugauaaauaaaaacucagugauagcagugaaaauaaauuaaaaacggacacaccuuuaaucccagcacuuaggaggcagaggcaggugaguuugaggccagccuggucuacagagugaguuccaggauagccagggcuacacagagaaacccugucucaaaauuuauaaaggauagcugacuuugaggguuaaccuaagagaaaugagaauauuuggagaaaugauggcuggcuaguauugaacaacauggcaagauuugggaacaaaguauuuuuuaacuucagagggaagguauuaauuagauuuuuuucuuuuuguuuuuuugagacaggguuucucuguguaacccuggcuguccuggaacucccucuguagaccaggcuggucuccaacucagaaaucugccuuucuccgccucccgagugcugggauuaaaggcgugcgcuacugcaccuggacaaauuaguucucuugaguguagcagugaaaagacuagucagccauaacauuuuauuaaaucaagguuuuuggaggaccauaagcaaaaaaaagugauuuugcauauuagcaaugugaauaucuaagaauccuuuugauuugucuaagaguagucaaggaauuguguagguauaugaaaauagaacauagccaugccuggacuauauugcaagacucugucuuucucucuuucuagaaagaaaauuaaagaaauaauaaaacaaguaaacuauccaaaauuccuaauuuaagacuuggaaguaccauugcuuuuccuauugacuugguggggguguuuauuuauuuuuuuuuaaaaagauuuauuuauuauuauauguaaguacacuguagcugucuucagacacaccagaagagggagucagaucauguuacagaugguugugagccaccaugugguugcugggauuugaacucuggaccuucggaagagcagucgggugcucuuacccacugagccaucucaccagcccgguggggguguuuauguugcccuguuuuaaagauuggaagaaaagaaguuuggggggcauuuccuggguuuuacauaguuuaauauuucucucuuucucuuuuuuaaaacuguuuagaaaaauuuauuuugaaauuuaaauaaaaggaaaauuuagagauaaaccccccuuuuuaaaaaagauuuauuuauuuauuauaugugaguacacuguagcugucuucagacacaccagaagagggcaucagaucucauuauggaugguugugagccaccaugugguugcugggguuugaacucaggaccuuuggaagaacagucaguacucuuaaccgcugagccaucucuccagcccucaauauuucucuuuaauacuuaauuuuuuucauuuugaauucuuucagaaucaugacuuuuguaccaggagggaauauuuuuccaaauaggggugacagucucagaagaguuuugagaguguuuaagacaagcaacuaaaauguuacuuuuucaucuguauuucauuguggugcucugaagcauucuguuuauuuguuuagcuuuuuuggggggguugguucgugcuccucagugcacacacuucuguguuguugcccugccccuuuuaaccacccuuacuugaucccauuuuucuaaguaguuuccauucuaacagcacaguuucauuuucauugucagagggguuguaaagcccuagguauagugauuucugcuuguaaggacaaauuguguuuuuuacaaacuugacugaguuuuguaauggcccucuuccauguuugcucgaauguuagauuaugauaagaagaugagaguaacaagaaauaauucuguccuggcauacuggguucauauuauagaguccccgaauguuggggagcugcugaaguauucugagcccaggggagugcccugaucaaagcaguggaaggaggauuagucaccacagauagcaggaaugucucagaccuuggcacuagcuuuuagucagucauucagggucccuagucauuuguuaugggagugguagaaaagcaaggccacuuaagaggcuauuuucaugccucagggaucaggaaguaugaagcugagggacaauaauaagacuggagauaauaaggacuaggauggauugcugaggagucaaguggagaagaucugaaugugaguggggaagaaggaagagaggagaguggccuaaagaguccuaagucugguggaagcagaggugcugcucugagcauguagauucuggaggucuguacaaaugauacuugaaaccggggguggggguggggguugggggugggggauggagagaaaacaguaggagaaaggaauaaguauaccagacugaggucugacucuguuguaaugugaggggaaucagggcagcuccugcuuagagaaggggaagggagggggcuaagguagcacuuagaaaagaauaggcugaaaugaacuuagaauuaguggaauugauuaucugucagagucuaauagaaaagccaaggaagauuagagcugaguaaaguaaaaguaguugcuuuacaaguugagaauuuuuaaaguuguugauaauuagucuuauauagggagacuugacagauguaccuuaauguauuuaucccuuuuguuaccuuaguuggcuuaauuucaucuaacauuucauuaugcuuauaaggauaacauauauuuaucguuuuuuauauuuaucauuuugcaauugcauuuuuuuuagaaagggaaaauaauuauacccagaguugacuuuagggagugguagugacaguuuagagcauguaccccuuauuuucaugguuaagccauuuuuuauuuauuaaucuagccauuuguuuuaauuucaaauaauucuuaucacaaacauagccauuucuugaaaaugaauagaaccauugcuagcacauugaaaaaaauuaagcuuuggguuucucaugauauuaaggacuccguggaauuuagcauauccaacuaauagggguuggacuuggucaagugacucuugcauaagcaugagggccugaguuugcauccucaacacuuccauaaaaucugggaugagguggugacagaucagucacuggagcucauuagccagccagcccagccaagucaguaagaagccuugccucaaaaaauaaaguacagauguggauccuagaauccuaucuuuaggguucaguguauaaccugaaguaaccauagaagccaagguaguagacagcagacagggcgaaaaugagaacuuuaacuggagaugggggaagaggggauggagauaaauacaggaaggauauuuggaaaagccuuggggaaaccuaaaaaaauaguuuaaaaaacaaacaaaaacaagguggagagcaauugagguugaccucuaacccuuguauacacaccaaagcccaccuaccuauaugaccaugcaugaauucaguacaugcaaauacaauucaguacauuaagcaagacauaaaauagccaugguuaacaaggauacuaagaaagauaacaugcucuggaaguucugaguagggagggcagacuuccaggcuauuguguauauguugggauuauaggggaggacauuugcaaggaaagagcucuguagacagaggcuagaucguuagcauauuuugugagguuggaggugugugugugugcuugcuugcuuguuuguuuauuuauuuuucuaacagucuugcuguguagccagguuagcuuagaauuuggcaauccuccugucugucuuugaguaguagaauuacugaugggcccuaguauacuggggagggguugggauguucuggcauuuuugcuuauuggaguaugugugcauguguggugguaaaagguacuugggagaaaguugggaaagacagaaagaaaguugggaaagguaguuuggaguuagaauuuaagauaguaugagcuugaaccuucauugaacagagaaacgaugcuuuagagaaauuuauuuguguuaaauuuuucacaagcauauaguauguacuaacaaagaacuaaaagucaaaguaagaugugucuaauaguuccauuuaguuugaauuagaaauuagagauggggaaaaugaugaagagguuucugcaguauuuagaacaugggcaaaucugugacgucugaucuuuugaaauacugaucaaaugauauuaggugguacguuacuugauguuaaggguuuguuuguuuuuggcuaaaguaggaaaaggagaauuaaggucauugggaugucuuaaaagaagugggccuuaggaaguucuguguucaggauccagaaaucuguugguaagccuuccugcuucaucuauuuucucaggacauuaaguugauuuuuuuuguuuguuuguuuguuuguaaacuuuauuuuacuagucuaagccaggaguaggaaaaugaccuacaguuccuguguuagcggccuagaccuagcaauggaggcaggcugagagugagagaaagggauggugaaaggaacggauaacugauuuuugcucaugauuucagguuuucaaggguaaaaauuuuauuuuauuggacuaaaaauguacuuacuguuuuuuuuuaaaaccauuucauagcuagugccaaucaccuuuggccaaaagaguuaaauacacugugaaaauugaaccagcauaaaugagaggauuaagaaaagugcuuacuauaauuguauuuacuauaaucauggauguugugauucuaugauuguucaguauaguguuugaaagacugcauaaguuuagagaaauaaugcaaaaacuugcacagaaauuuuccauggcagaaugauuuugguugaaccuuuaaaaaaucaguugcugggcagcaguuacuuacacauuuaaucccagcacaugggagguagaacaagcaggucucugagcucaaggccagccuggugagcuccaggacagccagggcuacaugaacaaaacaaguaguuaaguaauccugugagaggaugaugucacuuacucagaugacagugcuaggguccugaaaaugcucuauaucuugauccuggguagugacuaaaggcuuuuggggaagggaagggaaacauaaaaauccuguuaaguaacccaguuuggccuugaauauuuagggguucuccugaauucuaggauuacaggugugugccauuacaacuaggaugaagguuuuccaucuaugugaacauuuaccaacaugugugcaguuagaucuggggcaguaacucaguggguaagauuauugauuuuuuuuuuuuaaaagacuuguuucuuugauuagcccugacuguccuagaacucauuuuguagaccagguuggccuugaacacagaaaugugccuaccucugccucuggagugcuagguuuaaagauguaccaccacuacccagcucugaauuuauuuuuauuuuauuaagacagggccccacuuaucauguagccgagacugauuuagaacccucuguauagcccagauuggucucgaacuugugagugucuugccuuagucucccaaauacuaugauuauagguguguacuuggcauguaucucaauuuaaaaugagccuggauaaaggugauccauuugauuuauauguuuauauuagguagauguucaucuguuguauaacucaaguccuucagaaaugaaaaugugacauuaaaaaaaggauaccaaaacuaauacuggcuucccuugauuuagguguucuggcugaugagaauuuaaaggccauggaugaagauggacuugaauuacaacaacaagcaccaaacucauuuuuugaugcaacagguauauuuggguugcuguacuuuuuaucuaucauauugggagguuguuauggcuccaauugcuaaacucucacauuguuagucauguuuggauuucaaaaucuacaaguggaaaaugagcacauuuaucauucucuucuuaaauugggccuuuucauaaggagcuuuaauauucuugucaguauagauugaauauuccuaauuugaaaauccuaaaugcuccagaauuuaagaguacugccaugacaccacaguagaagaaaguuccacaccuuacaucaugucaucgguugaaguaaaggcacgugcauaugaacaaguacuauguaaaaugaccuuuaggcuauauauguaaagcguauaugaaaugaauuuuacauuucuacuuggaucucuaccaaugauacauuaugaaugugugaauauuuuaaaaggugaaaagucugcuaugcuaaacaccccuguucucaagcauuagguuuuaguuuuuuacacagucucuaaaauccagguugagccuuaaauucuguauccuuuuaccucagccgccugaguucuaagacggcaggugugugcuacuuuccuggucuguccuggucucaggcauuuuacauaaggaauauucagucucagacaacaguaauaucagccucuuagugguuucuuuaguuauuaucuucuugcucaguuaugaauucuguucuuuuucucuuugaaaaaauauuccgugacuacauccucgccauuugauucuccugucauguagucucucgucucauauuuaguuggcagugacauuuauuccuuacaucagaauauguaccacacauguggauuaugugauuuacucauuuucucucacccaacugguaaagucuaacccaggguccuccacauccugacacuguccuccguucacagccuucucauagguucccucaaagagucugugcaggaagacaguugugcuucauugcccagggugugcaaggguaauuuauaacccugauguggggacagcucaacugucuuuauuagaaaguauuaacuaauuuuucauucaucucucaaugaucagguuguaguauauuaaauaacaaguucaucagaaaguuaacuauauucaguagggcaucacuuuucauaggguaggcuuucaaguuuggugauuuccuuuugaugguuuguaauucuuuauuagaacaugaagcauaauuauuguucuuggaagagaaacuaaggagaaaaauccacaguauguauuugcucuuacuugugacaaggaaaccuagcuacugagugguagagugaaagacuuucauuuugguccugauuagcacuuaaggucuuuguuuaucuuagcaagucacuaaagcugucaggaccucccuuuuuaugucauaaucauaaugaaaugucucauuacaguuuuucagaacauuucccauauacucccauuugagggucacaaucuuguacaguaugcauggcacauacuacucucauuuuccugauuuucucauuuuucagugacuugcucaugaccacaaaacuacucauuuuugucuaacccucaucugugauuuacauuuuuuguuuguuuuuguuuuuugagacgggguuucucuuuguguccuagaaaagcuuuggucucaaauucacagaaaaccugccucugcuucuugagugcugggguccugggaauaaggcugugggccuucacagagaccaugcuaucuuuuguuuguuuugcuauugaguguuuggguagggaauguagugauugaauuagguaccuacuuagauuuaacuuguuuugaaaaccaagcagaaacauucaucuucugaagaguuugguuuuuugacuuguaaaacuuuguuguucucuggacuggaagccaagauacuagauuuguuguauuucucauaaagauguauaauuuguuccauuugcagcauuuauugagagcaguauuaacugcacgucauauacugugcaaacuaugaucuugguuaagucauuuaaucucuuuagacaaaaaaauugacuucgccuccugucauucuuucuaacuaagauggacucugguagagaguuucuuguauugugaggagcuacuuuggggagugagggcagggaagcagcuaaaaagaauccaguauucuguugaaguuguggguagguuccuucugcuaccuaccuuugucccacugcagcucagcagugccacuucuauacacugucuguccgcagagacagaccaaauuuucugguccuucuuuuuguguaugcccuggucuucuuauaucccagaauagagaucaaauucuaaaauucuguagucauagguagagaauguucaugauaccagagcaaaagaggaaggaagugaaggaagugaaggaaaaaaauggagucaugggaaagauggaaauaagaaaaaaaaaauacaaguucagggaagggagguagaacaagaaggaaaauacaugaagaacacauauaacaaagaaaacugaccgaucugccacccauaguuacauuacuuuuuauaaucaugccucaaguaacugaaugaguaucaaucagcaugcccagaauuuuacuaagauuuuucuuugucucaauuguauuauuaucauagauuuuccuuaucuauugauuugagaugaauacauaggguguccuaaaaagugucuuucuaauuuuauuuaaaaauagguuaaagacaccgggcguggugguacacgccuuuaaucccagcacucgggaggcagaggcaggcagauuucugaguucgaggccagccuggucuacuaagugagcuccaggacagccagagauaggguuucucuguaugucucgaaaaaccaaaaaaaaaaauaauaauaauaauagguuaaagggaaucuaaauguuugagaaaagugagaagcuacuuuuggggagaaguugaacaauaauuuugcugguugaaauacuuagugcugaaauucaugauuuuaauuacuuacugucuuagcuacuauuuuguugcuggaaagagacaucaauaacaaggcaacucacauuugagaaagcauuuaaauuggggacuuguucauaguuacagaggcuuagucuggcaucaucaugugacaggugcugaaguaguagccaagagcuauaucuugauccauaggcaaagaccuuuacauuuugauccacaggcaaagaguuaggaggaggagauagacacauacaccugcaugcacaaauguacacuaggccugcugcuuggcaugagcuuuugaaaccccaaagcccaccccuagugacacccuccaacaagucuacaccuccuauccuuauaaucugcucaaauacauuuaaauauaugagcuuauaggggccauucuuauucaaacuaccacacuuaugaguuugguuauuuuuuaggagcuggugcuacacacauggaugguaaucaaauuguuguggaaguucaagaaacgguuuaugugucagauguuguggauuccgacauaaccguacauaacuauguucccgaugacccagauucaguugucauccaggaugucauugaggauguuguuauagaagauguccaguguacagacaucauggacgaagcagauguaucggaaacagucaucaucccugaacaagugcuggauucagauguaaccgaagaaguuucuuuaacacauugcacaguuccagaugauguuuuagcuucugauaucacuucagccucaauaucuaugccggaacaugucuugacaagugaaucuauacaugugucugacguuggucacguugaacaugugguucaugauaguguaguagaagcagaaaucgucacagauccucuggccgcugauguugucucagaagaaguguugguagcagacugugccucugaagcagucauagaugccaacgggaucccugugaaccagcaggaugaagagaaaaacaacugugaggacuaccuuaugaucucuuguaaguuugggggggaguaugguguuucucacagguacuucuaaagccuguuuaucuaacguacaccaggggugaaauuaaauguccauuaaaaugaaauguauaaaaauaccuuguccaggugugaugauacauaccuuuaauccaucacuugggaagcagaggcaggcagaucucuaugaguuugaagccagcuuggucuauauagugaguuucaggacagcuaaggcuacucauagugagacccugucucaaacaaaacaaaacgacauacaucucuguaaaaugaguuuugguuuagagucuguaaggugacugaaauuugcgaagagugaaauaguugauguguuucuauauaaagaugugauagaaagagggugucuucaguuauagaaagacagacugcaaaucaugaaggaugucauuuggcagggagggauagacacacacacgugcaccagcuuuccuuaguguccucaaacaacuuggaaagaggaaaggcacaugcccaaacuacuuauauucuuguauucuuguacaggaaacaaacuacuggucagagaaagccugaaguaugaacuuagguucuuggaacuuaauguacuuuguaugaaaaguacuguuuauggaacagaaugggaaagaacauaguacugcaacaugauuucaagcaugaugaauuuauuagagcacugaagcaaacuaagguguuuugguggcauaccuccaacuguuuuaaguuggcaucugggagaauaguugucuucaaacauuucuugguacuacuuucagauaucaaguucuagguuagguagacuacaguucuaacccaguauaaauucuuacuccuuaaggcacuaaacucccauaaauaagaacuggcaaauuauuuauaaauuugcccaguuguuuucauauaugaaauuaguauaccauauaauggagucuaccagcauuuuauagaaaaccaucuuuuuaaaguuauugagauauucucauccuggugugguaugugcguaucuguaaucucagacuaaacaggcugaggaaagagggcuuugaaguaagccugggcugcaaaauaaacgaccaucucaacaaguuaugauaggacuuuugaaauacauggucuuuguaaaaaggaaaccuuuauuuagcauguauuuacaggacuuuguuuauauugcuguaggugcuucaguuauugaugaguccuaaauacauaaaguagagaaaguucuuagggggcagggcuuauagucuacuguaggagggagguuacagagugaugcagagcugugacugaauucuuguggagacuggaguagccuaccuuugucaaggaugaauuuuagcuuucuaagaugaaggaaaaggguaugggugaguggagacauuauguuuuacaaaggguuuggggauugaagggauggcucacgaguuaguguuugccauuuaaguguggggaaugggauuuggagccucagaaaccguguaaaauccaggcaagcaugguggccaacagugaucaagagguaaagaagcagguuccuucggagcaagcugacuaaguagacuagugggaaugagugagcuccggcuucagaaaggccaggccucacuaaauaaaguagacagcaaucagaggaacagaccucauaccaacuuugggucuccacacacaugugcauauaugcacacgcgugcacacacgcacacucuuacacucaugcacaucacauguauuauaaaaaaagguagccauguuucuuugugugccuguguuuguucauauaugguuuccaucuuggccuuuccuagaaacuuaagaugugcugacaucucuguacuucauuccuuguaaugauuuccagaaauagaauuacuggguaauuuaggaccagugagauggcacagcgggcaaaaguguuugugucuugcuguacaagccugauggugaucagaguucagucccuggaauccacaguggaaggagagaaccgaguucccaaaauuucccucucuucugcacaugugcucccaauauauaaacacagacacacagacaauaauacaaauuuagaaaagaugaggcauauuuacaaguuugguuauauuaccucaauguuuuguuuaauauaaguccucugguguuauaagauuaucuauuuuguuuuguauucuaaccaacacaaggcaguauuuuucuuuauaaguuuuugcuggucuguaagagaauauuugauguagucuauuucaauuuuaaauuuauuuuguaagguaauccuuguagcaauagagauuaagugaacaagagacuagggauagacaguaguugaagugguucacauauaaaaaagaguaccucaaguugggguuugguaguguaguucuguaaucccagaacuuaagaagauuccguucuagggccaggaagaccugucucaaaaacaaaaugacaauaaauaucccaaagaccuuaauaguaaagaagaucaaggagagcugaaguugagauuagaaaauaaaauggaugagaguuagucucaaaugaucugggugggacuuggauggagaaagauaaugcagagauaacugguguuugaccuuaagguuucuagguuguaagauugggccaugauaaucauucaagaaagguaguagauuuuuggggguuaagaaugauuuaggauuugcuaaaaauaugaggugcuuccuuguuggagacagucucauacuuguuuucuggacaguugaaaauauaaauuuggggcuggugagauggcucagugguuaagagcaccgacugcucuuccgaaggucccgaguucaaaucccaacaaccacaugguggcucacaaccauccguaacaaaaucugaugcccucuucuggaguaucugaggacagcuacaguguacuuacauauaauaaauaaauaaauaaaucuuuaaaaaaaagaaaauauaaauuugacauuuuagagagaggagaaauugguuagguaacagaaagauagaaaguaucucauagaagugguugguguuuucuagacaaugcuuauagaaaaagaguguuaacuaugugauguaguuacuauggacuugagugauauguguguaauguuuauauauucauucauuccuggguaucuacacgaaggaaggacucaguguaccacagagaccuacauggcaaaguuuaccgcuguaccauaagagcuaagaaauaaaaccagcuagauguccacuagcagaugaauggauaaagaaaaguuguagauauauagugguagaucuucagcuggaagaaaaaugaaauaauuucagggaaaugcaugaagcuagagauuaucuuguuaagaugugugugucagacucagacaaauaacuauauuuucucucauguuuacauuauggauugaaauuuguguauggaguaggucauaggucauaaaaguagaaagggagggggcuggcgagguggcucagugguuaagagcacugguugcuccuccagagguucugaguucaauucccagcaaccacagcucauuacuaucuguaaaagggaccugaugcccucuucuggcaugcagguauacaugcagacaaguacucauaaauaaaaugaauaaauaaaaaaaguagaaagagaccaggagaagggaggacgagcuuuggugugugauagggucuuucuauauagcccuggcuguucugaagcugaaacuguuuaggaugcacuuaaacucagauauccugccucugccugcugagugccuggaucaaaggugugagucuccacacugauagguauuuuauauguaugaauuuuuuuuaccugcauguaugugugugugacauaugcccauagaagucagaagaagguauauugggucagcugauugugagcgacugugugggugcugagaauugaacuugguuccucuuuaagagcaaccaggggcuggagagauggcucaguaguuaagagcacugauugcucuuccaaaggucgugaguucaaaucccagcaaucacaugauggcucacaaccauccauaaugagaucugaugcucuccucuggugugucugaagacagcuacagugcacuuacauauaauaaauaaauaauucuuaaaaaaaaaaaaagcaaccaguguucuuaaccaccgacccaucuuucuagccccaaggacaaauucuuuagggaaauggaagggaaaauggaauacauaugacaugaaagcagaaguggggacuacuuggagagaggaaggcagcuagcaacagugggucauaagggaguggggugaauaacaguaugcauguauaugaaaugccauaaggaaacccauggguuugugugcuaacuugaaaacagugucaguauagaucuuuuguguauaaaauguuguaggcauuugaaguuagcuuaggcugcaaggucucauuagaaagaagagaaggagguaaggugaaaugaaaauugaagguuugcagaagacacguaacaaacugagucuuuaacacuacggaggacacagagaaugccauaaacaugugucagccacugagaagaaagacucuuggugggcaauaaggauguugguauuuagauuaguuucaguaaaccacaagagaguggguaggagauggaagaauugaauuauaauggguugagaaaucaguagaagugaaauuagggguaaacacuuuguauaagccauuaugguuagucaagggacaggaagcaauaguauggcuuuugcugguuagugaauguaucucagacaugcuuauggguacagggacaaacuaauggacagggccauuuugacaauagagaaaggaaggcuaauagguggaauaagaugcagagaagaggaaggggcugguguuuagggucacaguggauagcuguuaguuguguccuaggcagagagauaaaauguuaguagaacugagaauccucucuaaaagacagaagauuagaggaauguuugagugugacagcuguuuucccuguggaacaucuucaucuacugucuuaggguauuacugcugugagcagacaccaugaccaaggcuuauaaaggacaacauuuaauuggggcuggcuuacagguucagagguucaguccacuagcaucaaggugggagcauggcagcauccaggcaggcaucgugcaggaggagcugagaguucuacaucuucaucuaaaggcugcuagcagaauacuggcuuccaggcagcuaggaugagggucuuauagcccauguucacaaugacacaccuacuccaacagggccacaccuucuaauagugccacucccugggccgagaauacauaaacaaucauaucuaccaauacagaauaagaauaagccaaagccaaaggauagugauaaagggucgagggacaugggcuaguuuaagaagcagccagcugaagaguggagauacucuaguauaaaaauuaguaaaucauugguaagguacugcaguauaaagauaauaaaaauaaugcuuuuauuuuaguuuaaaaguuuuagauuuauuuuuaugaguauuuugccugcauguacauauauguacaccaugugugugcuugguacccacucuggucagaagaaggcaucagucucuuggaacuggagcuaugauggcuguuaguaugcugggagcagaacauggauucucuuuaagagcaagaaguacucaacugcugagccaucucuccagccccuuuaauuucauuuuaaauauuuguguguaugugugcgcgcgugcuuguuccauggugucuguguagaggucagaggacaucuuguggaagucugcucuuuccaguaaaaguaucuuuuauuugccugguguauuugucauuugggaggcuuacugcgccugucggcuagucuaggccuaguccugaaagcuuccagccuccauacaaucuaaucuaggccuggaauguuuucagccucugagacuuacuucugaauaaacucacccuuucuaguucuuucugaguucugauuggcaaguucaacucagcuauucuggcucaaauuccucugcaagcugagugauucaaucuggcuucucucuuuuguccugaaugguuccacuuuggccucauacuaacuuuagcaguauguucuuugaaauaaauaccuaauaauaauaaaaaaaauaaauuuaaaaaaagcaugugccaacauacucagcaguggauaguauaauuaaaguaguaagaauuuuuuuuuuuuuuuuuuuuuuuugguuuuucgagacaggguuucucuguguagcccuggcuguccuggaacucacucuguagaccaggcuggccucgaacucggaaaucugccugccucugccucccaagugcugggauuaaaggcgugcgccaccacugcccggcauguucuaauuuucuuguuccuuccucauucucuggcugcuucuguauuauaugugucuagcuuguucuuuucuucagccugucucuuuaaaacuccagguaaaacugccuccuccucccucucugagcuucucuacucuaugguauauucuucgugaacucuacuguauccuguacuguacucucuccuuccuguacuguaugucucucccuuaaguagcuucccucuccucucucuucucuugaguguugggcauauccuauucuaccaaaucuuucuccgauucgucacuuuuucugucacccaauuagacaucacuuucaaacaugggugcuuccuuuuaugaacuaacuuuaccuucauuguuugggauuaaagauguguacuaaagguguuucuguauucuagccagagggauuaaaggugugugcuaagggcugagccauaucccaacaagaaauaggcucaaauauccuguaacaauuacuauuguccaggauccaagcauagaacauggauuguuagccuuaaugguggccuuugcccauuaagccaucuuggcccaaaacgguauuuuuaaaugccagugccagauuuucuauaacaagacuagauaacucagcaccaagguuagaggaaauaguuggcuaucucccagauugugaaggggacagcacucgggcuucuuucugcuuucugcccuucuggcuuucacccuucuagcccuguaaggguuuaccaagggguaaggcuugacuuuuauugcucuuuuagaacaccuuuagaagacaaauuuuaaaaugguuaaguuuaguagugauugagaccaacuuaccaaguauaguauugcagaaucuaggcuuuaaaaaaauucuuauuuauauuuagcugucuuuuagguccuaggguuccaauugaaguuaguauuaauggcccugaaaaaguaaauaugggcagaaauaaacguauuugaauauauuuugacauauuuuaauguuuuauauauuaaauauauucaauauuauauucacucuauucuuguuaaaagauacauauuaaaagaaaggggcuggagagauggcucagcgguuaagaccacuggcugcuuucccgaagguccugaguucaaaucccagcaaccauaugguggcucacaaccaucuguaaugagauuggaugcccucuucuggugcgucugaagauagcuacaguguacuuacauauaacacauaaauaaauaaaucuucaaaaaaaaaaagaauuguccuaaaaaaaaagauuuuauauauauaucuuuucucuucaaagagagauacuauuaaacaauccacuuuuggaaucaaaccauuguaacguguuggaaauuauuaguguuuuuuucuugguuucuacccucuagcaaagaugguucauaaagcuguauuuuaacauaaaaucuauauugacuucagaccuuuaagaauggcagagguuuuguaguaagcgaguagaggaacugggugggaugguuacauugaacaguaaaguugcauuacuuuacauauuuauuuucuuugucuugauaguacuuaagaucuauuucuuuaguuacuuccauguauacagaacauuguuauuauaaucaccuuaaaacugcaucuuuaaagcuuguucagagucuuuccuuuccuuuccuuuccuuuccuuuccuuuccuuuccuuuccuuuccuuuucuuuucuuuucuuuucuuuucuuuucuuuucuuuucuuuucuuuucuuuucuuuucuuuucucuuugcuccuccaucugaaauuguuucuguagaugaaauucacggguagaguugguccuaaguugcaucuuuauaaagaaauagacauacauuuauuuuccuucucuucucuucucuucucuucucuucucuucucuucucuucucuucucuucucuucuuuuuuugagacaggguuucucuguauagcccuggcuguccuggaacucacucuguagaccaggcuggccucgaacucagaaaucugccugccucugccucccaagugcugggauuauaggcugugccaccacugcccggcuuuucuuucuuucuuucuuuuuuuaaaaaagauucauuuauuauuauaucuaaauacacuguagcugucuucagacacaccagaagagggcgucucauuacaagugguugugagccaucaugugguugcugggauuugaacuuggcaccuuuggaagaguagucagugcucuuaccggcugagccaucucuccagccccguauucauuuucuuucucucugauagggagggcgaauauuguguacgcauucuaaauuaggcaucuacaauaaauuacuggauuauggacuucaguguacuguaauuuuuagaugccauaucuacugucacugcaaggaaucauuccuaguuuucagucuucggauggguuuacugaggcuuccuugguccuguauaaagcaugcuuagauuugcuauacuucuguuauuaguaaugaaauuauuccccaaaauuuuauuucaguuuuuaggucaaaugcuggacaagauggaacgauaauuugcuaguuucaauuuuuagaauagaagaaaaaauacaaaaaaauuaagugagagaauuccuggguagcuugggauuauugauaauuuuuuuaaauacggaguuucagacacuaaacuuuuuuuuuuuuuaucuacuaggagaugaaaauaaaggccuggguucuaaagacaggccugcucuugauuuucuucuaucuuuucacuagcuaacugacuucugaccaaguuauacaccaucucagagccuugguuucuuucuuuuuuuauggggggggggugggguucgagacaggguuucucuguguagcccuggcuauccuggaacucacuuuauagaccaggcugaccucgaacucagaaauccaccugccucugccuccugagugcugggauuaaaggcaugugccaccaugcccggcugccuugguuucuuuaucugggaaaugaagcaaaaaacuuucauagaaacaugaaauaaauagcaagaugcaaugcaaaugguaguuauuauuagaagucauuuuaauuuuaaaaaauuaugcauuucuauuuuagagaagccuuauucuaaaguacuaguucucaugacugcuaaagaagauacuuaggcagaaaucauacauagaaugacucaacuucaucgaagcuuucuuuguuuuuagaaauuucauuuuuaauaguagcuuuaaaauuacaaugaaauccugaguacuuaacaggaccaucaaaguguucuuuuaaaaaauuuucuucuguaauaauuuauauucagaauaauuucacagguugaguaggacaagcucucaaggugaaaaucugaaggucaauucuacuuuuguauaguaauagaaauagcuguugucagggaagucaggguauuugaaaugcaucuucccuucuauuuaugaaagcaaacagguuuuuugaauucuguauuauagguguaugacaguuugcauguuguaagauggcuagguuuuccacucauugaagguuuuauaaggguccugacagacaagcuaacaugucaaaacaguaagucuggccuugcucuuugcaaccagaaggauaucugacuuuuuaguaccaguuaaaauugagugggguuuuuauuguugcuucuuuuuuaaaaugauuuuauugaacuuauuaaguguguguguaugccugggugcauguuacuucugugcuagaaugacugaggagggguuggagccucuggagcuagggcuacaggcaguugugagcuaccuuacaugguugcuaggaaucaaacuugugucucgugaagagcuguaauuacucuuaacgacuaggcccuuucuccagcccauuuuuguuguuguuuugauuuugacuuuugagacaguuuuucauuauguagcuuuagcuuucugagugccuugcuuaggaucaguuugugaaacuuggcuuagagcuuaggucaaauucaucauucuugaacuguuuaaaaauaagugccccgauggugauacccauguacucuggaaacccugucucgaaaaaccaaaaaaaaaaaaaaucuuacuacuuuaauuauacuaucuacugcugaguauguuggcacaugcuuuuuuaauaauuuauuauuuuuuauuauuauuagguauuuauuucauuuacauuuccaaugcuaucccaaaagucccccauacucucccccacccacucccacuucuuggccuggcguuccccuguacugaggcauauaaggucugcacgaccaaugggccucucuuuccacagauggccgaccaggccaucuucugauacauaugcagcuagagacacgagcucuggggguacugguuaguucauauuguuguuccacuuggguacuuucucuagcuccuccauuggggacacugugauccauccaauagcugaaugugaacauccacuuauguguuugcuaggccccagcauagucucacaagagacaacuauaucuggguccuuucagcaaaaucuugcuaguguaugcaaugguaucagcauuggcacaugcuuuuauugauuuuuaauuguuuuugaaauucuaucucucuguguuugugucugggugcauuuacauauccuguaccacaauuugaggacaacuugcaggaguugguucucuccuuccagggaucaaaaucuggcuugguggcaaacaccuucaccugcugagccaucuugauagccuagcacaggauguuuaaugccaguacuuuugagggugaggcaggacagaugccucaaauucaaggccagcuugggccacagcgagacuuccacaccuggcugggcuacagaguaagaaucugucuuaaacaaauaaaaaagagccuuccuuuuccucuuuucuguuacauucucauccacucguauacgcaaccuccugacuuguauuccuuugucauauuuuucuggaaguagcuuacuagccaaauccccaaauccugcucaucccaaguagguauccaacauagccuucuuccuuagaccuacuaucuguuguuuuuauugaagguuuuggugccugucaucugcuauagcagacuaauaugugcugucccugcuuuguugaguucagcccauccacguuuucaagguuagcaagaugguauagaaauaggccucugauuucaucguugcuucaagaugucucaucacuuagagcagaugcuuucaagccucuggucaggguuagggcuuuaggguaccucuaaaaucaaucucccccuuuucuccucuuucuagcuccuaugucccuacauuuggauuauguuauguagaauugcuugccuagagaaucaccccugcccucaaguuccccaagagauuuuaauaucugaccugauugaaaaacuuccagcuuuccaggaucaaguuugagccucucugccaugggcaggaggcccuuugugaucugacuucaguuuagcaguuggcaguauucccuaccaugcccucaguccuuccauacaguuucuugucucuauaccaguguucauagguuguccuuuaccugaaugaaguaagugcccuucuccuuguuucagucucaguaaggcaucucuucuuugucuacauauaaccuuccccccccccccaagacaggguuuuucucuauagcccuggcugucauggaacuuacucuguagaccaggcuggccucgaacucagaaauccaccugccucugccucccaagugcugggauuaaaggcaugggccaccacugcuugacaaccugaaaacucuuaaauccccaaaauaaaacccuaaaauuaaaaagaaaauacaggaacacuaaaaaagacccugaaaaauaacaugggucuauguccaguaccugguggaguucacaaaugaugugguaguguaugguuagagcaucccuguuagcugaguacucggcccuucagccuagcauccugaccuucccagaugucuuuguuuuuguuuuuuugguuuuucgagacaggguuuuucuguauagcccuggcuguccuggaacuuacucuguagaccaggcuagccucaaacucagaaauuagccugccucugccucccaagugcugggauuaaaggcgugcaccaccaucucccggcuagaaccucuucguguacagugaaagcacuaucguuuuggaugcugauccucuuucauguucuauaugaacuucuuauuaaagauuggauuagagagcuuagcgucuguuuccuccuauaaaugugaguucacagguguuugcccuuucuccauaaggcaccuucauuuucuguuuguuuaaaugacacaaggaaaagcaacauuauuuaucagcaaauaagauacacauaaacgugcuggagaaauggcucagcaguuaagagcaccaacugcucuuccagagguccugaguucaauucccagcaaccacaugguggcucucaagcaccugcaauggagucugaugcccucuucuggugcugucugaagagagcaauggugaauacauaaaauaaaaagaagauacacauaaacauuuuagucauuuuugagacagggucucacauauaacucuggcugucuuugaauuuuuuuuuuaccauagauuuucuuuguguagccuugacuguccuggaucuagcuuuguagaccagacuggccucaaacauagaggucuaccugccucugcuuccugagugcuaggaguaaaagcaugcaugcaucaacaugccuggcaugcaccaacaugcccggccguuuuuuguuuuguuuuguuuuguuuuguuaaagagaucauuuuuaaagauuuuuuuaaaaugucuuaauucuagguaagucagaaaucugguugacaaauugucaguauauucuugccuuuuuugaauuuuuuuuugacaguguuucucuguauagcccuggcuguccuggaacucacucuguagagcaggcuagccucgaacucagaaaucugccugccucugccucccgaguguugggauuaaaggugugugccaccacugcccagcuguuuuuuugcuguuuuguugugugugucuguguauaagaauuuugcuuagguaaauguagauuuugaaccugcuagaggacaugacaggacuuuuagacaccacaagcaugagucgugucuuguuuuaauuaauauugguuguaaacaaaaacggagaugaugcagacuuuaaaguguuagaagugaucagaaucaccaccaucuagccuuguuguacuccuaagugccuugccuaaggaguaaauauguacauauguaaaucucauuucugcugacaaaauaucuucgguaggucaaccauucgcuaguuuuuuguuguuguuauuuuugguuuuuuuuguuuguuuguuugguuuuugguuuuucaagacaggguuucucuguguagcccuggcuguccuggaacucacuuuguagaccaggcugaccucgaacucagaaauccgccugucucugccucccaggugcuaggauuaaagacacgugcccccacgcccggcucauucacuaguuuuuuauauaauguaauugcuuuugcuaauauccgucucaaauucuagaguccaaaaguuaacaaacacagaccgugacucaugugguuugagauuuaaauucaguguaacuacaaauagucaaccuuucuagacuucuauuugcucugauguaaaaugucaacaguacuguacucuugcuucacaagguuguuguaaguaguacuuagucaguaaacaguaguuauauuuauuauugcuccaguuaaaauagucauuucucccacuggagugcagacuuuacuccgucauauugguauuucccaauaccuaauguaaggucuuaaugauguacaauuucaauucaccauuugaugaauugaguaaaacauaaauguccagccagaaagagaacagauguacgugggagaacaccagaacgagaacuagaagagaaagggaaagacuugucgauucccuuaagguuucuuuauagaccuuggacuuggaccuguuucccuucacuuggggcaagcugggccacucuaguuaguugagcucagaacagaaagagcaguuuuaugguucguucuuuucucccucccucccucccucccucucuuccuuccucccucccuuccuuccuuuuucuuuuccuuuuuuugggacaggguuucucuguacagugcccuggcugucuuagaacuugcucuggaucauguugaccucgaacucacagagaucucucugccugucucugucucccaaguacugggauuaaaggcuugugccaccacauccaggucaugucucuuuaauaggcuuaacauugauaagucuaacuuuuuaggauaaauuguccuaggugcugaguuuuuauuaaccuuuacuacacuuucuguauugccagagaugccucuaaauaaugugugagauaagguugcuuauaguggcaauuacauuuuuggucucuuuuuuagaucuagagugugauugacauaauuuuuuuuguguuuuauuuuccaaaucauucacaacaccgauuacuuuggugacuuuuaucaagcuuuuaaaaguguaguuugcuguuuaacacuuuacuaucuucuaucuucuucccuuuguuucucgcuucucuuuuucuuauggccucuuuuugucuuucaagaggacagaugugcauaucagaguguguuugaauuuauuuaucaccaaggaccuugacuuaaagucacaaguuaaaauuguauauauguguuacuuauacaagauauguuauaaguucuuguuuauuuguuuuuuuaggguuuuuguuuuuguuuuuuuggggggacaggguuucccuauguagaccaauuggccuuggaacucauagagaucugccugccuuugacuccugaaugcuaggguuaaagguaugugcaauugaguccagcauuuuauacguuuuaagcaguuugaauuagaaucuccauucuccauccuuucuggcagucaugcuuucuuuauuuuuaaacguauuauucuaaugaaaauggaucacaucaaauaauauuuaagaauaguaaccaugaaguugaguuuaugaaauauucauacaaagaccaugguuuucauuuuacuacuagaauguuauuuaaggugaagaccuuaaauauuaagagauaauuuaaaauguaggagugauuuuuacuuguguuuuagcaaaagcuaaauacauccuuuuacuuacaguuucuaggcuaccaggcauuuuuuuucugucaguaauacuuuuuuaaauaucugaucucaguuuuaaaagucuuuaguauuuauugaaccgucuacuugucuagguuaaaaucauccaauuuuaugugacucaagugaaagagaauguuuguuagcagaacucaaacaguaacuuucuguuuaagcauuuucuauuauuacuugagcuguauuuucugcuugcuuaguggaugaugcugguaaaauagaacaugaugguucaucuggacugacuauggacaacgaaacagaaauugacccuuguaaaguggauggcacuugcccugaagucaucaagguguacauuuuuaaagcugauccuggagaagaugacuuaggugagcagugcugagcagugcuucagucugauugcuuuuggguuauuuagacugagaagaugugaagucuuuucugaagauaaauaagcuuagcauaguaucagagaaauauauuugaaaaaggaagaaguggaaaugaaauuuuaaaaucgauucuuagagcugcuguuuuccuugauagguggaacuguagauaucgucgaaagugagccugagaaugagcauggaguugaacuacucgauccaaacaauaguauucgcguucccagggaaaagaugguuuauauggcuguuaacgacucucagcaagaagaagaagaacugaguaaguagaugcucuuucuguguuccuaauguuuucucugucucuuuucaauggucaguauuugaaggaaguaagcggcaucauuugagaaauuacuaugcugccauguucucagggaaucaguauucacucauguagguuuagaauguuugcuacuuuaaaacuagauuauggugaaaaccaagagaagaguuauucagcaaguguuuauuuuacaaaagcuguauucuagcuaauguuuagcuucccauuugcauauuagcugaauucaaaugaaaguaucucuccuaugagcuaugagaaccuggucagagaaguucaucuaauuuucuacuuagaugucgcugagauugcugaugaaguuuauauggaagugauuguuggagaggaggaugcugcagcugcagccgcagccgcagugcaugaacagcaaguggaggacaacgaaaugaaaaccuucaugccgauugcaugggcagcugcuuacgguaagucacagagccacucuuuggacaugaauuugugauugaaaagcaguuuuugugauuuuagguuuagaaaucggaaauguuaguacuauauaaggauuauuugauuuaaacaagagcagaggaggauuauaaaacuacuuuuuguccugauuuuaaacaagcauuuccuccuguuuacauuauauaaggaaauaaacuguaugaagcauacaggcuuuuaacuguaucagguccauagcuuuaaaaucuugggggauagcaugggaccccugggggaaaauucugaugcauguuuccauuuuggaagcuaggcauuuccaguggucuuacuauaaugaguaugcucauaaaacuuggguauuuuugucauucaugaguaucauggcuuuucauugugggaguuaauaaagaauuccuaauucuuuauaauuuauaauacuguaugauuuuguuuuuuuaauacacauuguuagguaauaauucugauggaauugaaaaccggaauggcacugcaagugcccucuugcacauagaugagucugcuggccucggcagacuggcuaaacaaaaaccaaagaaaaggagaagaccugauuccaggcaguaccaaacaggugagggcgcgcgcgagucccacagugcagcgugcuccgcaagcucucaggcaaugcuagugugcauccacagggguauugugaggguauuuuaguggcuagacuauguggagcuuuuguguauugaauuucagaauucggugauauucaugaaugauuuuauugauuaaaaaggagugggaaaugacucaaagaagaugaaaauguuuaaaacuugaauuaugugaaaaugaaagggaauccuuuuauccauguuggcaguuacucauuuuugaaaaaauuaauauuaaagaaugauuauuucaacauaaaaugggugugauugacagagcaacacaauaaguacuugaguuuguaugauguagcuuauuucuuauauaccaauuugcauauuaagacuuuuauugguauauuuaagcuuuauuauaaguuagcauaauguucuaacuaaaaaaacuuuauaugaauaauucccacagauuucuaaacugaugagacuuacuuuucaauagaaauuacauauuuguuaaucgauuuuguuaaaauggaaaaggcuaguuuuaugcaguccaaguucuuagggccagguuauuguguaucuuagcuugaaaauaagaaaagaauguguagcuuggaggcaaaugaggagcccuugacuguaguguucagagcacacauucagaguuuugaagaaacuaaaucagcauguuuugaucacuuaugcuccuuuccucucuuagcaauaauuauuggcccagauggacauccucugacugucuacccuugcaugauuuguggcaagaaguuuaaaucgagagguuucuugaaaagacacaugaaaaaccauccugaacaccuugccaagaaaaaguaccgcuguacugacugugauuacacuaccaacaagaagauaaguuuacacaaucaccuggagagccacaagcuaaccagcaaggcagagaaagccauagaaugcgaugagugcggaaagcauuucucucaugcuggcgcuuuguuuacccauaaaauggugcauaaggaaaaaggagccaacaaaaugcacaaguguaaguucugugaauaugaaacagcugaacaaggccuauugaaucgccaucuuuuggcaguccacagcaagaauuuuccucacauuuguguagaguguggcaaagguuuccgccauccgucagagcucaaaaagcacaugcgaauccauacuggagaaaagcccuaugaaugccaguacugcgaauacaggucugcagauucuucuaacuugaaaacccauguaaaaacuaagcauaguaaagagaugccauucaagugugacauuugucuucugacuuucucagauaccaaagaggugcaacaacaugcucuuguccaccaagagagcaaaacucaccaguguuugcauugugaucacaagaguucaaacucaagugauuugaaacgacacauaauuucaguucauacgaaggacuauccucauaagugugacaugugcgauaaaggcuuucauaggccuucagaacucaagaaacauguggcugcccacaaggguaaaaaaaugcaccaguguagacauugugacuuuaagauugcagauccguuuguacuaagucgccauauucucucgguucauacaaaggaccuuccauuuagguguaagagauguagaaaaggauuucggcaacaaagugagcuuaaaaagcauaugaagacccacaguggccggaaaguguaucagugugaguacugugaauauagcacuacagaugccucaggcuuuaagcggcacguuaucuccauucauacgaaagacuauccucaccgcugugaguacugcaagaaaggauuccgaagacccucggaaaagaaccagcacauaaugcgacaucauaaagaaguuggccugcccuaacaguacucuucauagcuguuuguagagaacuggccuugaaacagaaaauucauuuaaaagccaaucagucuuguucacauacaauacuguauauugauuuaugcuguguacaaauaggauuauugcuucuaguugacuguuuuuacguuuuguucaauaguguguucugaauucuauucaguuuguuuaauacaugggaaaaagcagcaacacguuaguugcuuuuacuaaaguaaucccugauucuauacugaaguuuucuaucuuagaaguuuuauauuuauuuuaaaauauuuaccuugcuuaccuugaugguacucuuguaagaccaguuaacucaugguaacucugcauugguaacugaaaggauucauguggacuuuuugucucacaaauuucucacaauuaaaucgucaagagacaucuaauggaaugggagauuuuguauggugaggucucaugcucguaacauggaagucauuuacuugucuugcuuaguaauguagacuguaugacaaugaaaguuuuccuaugaacucuugugucccuggcaucgcuguguagaagagcaguagcuggguuuguguuuaccuuucuuucugauuuuuuuuccuuuuuaguggagaaaauacacuuuuuuuuuccuuuagacucuuucuuuacaucuucugucaguguaguaaacuuuuagaaaaccuuguugaaaauuuuugcuugauccuguuguauuuugauuauuuuaucugugcugcuuugucuuggaaugguugugugcuccaaaugaaauuuaacugaagacugcauuuuggaaucuccuagggguaacuuguggcucauaggaucuuuugcaacuuuauauauguaaauguacccugaauuauauauaucuaucuauauauacacauauauauguaacauguaucuguguguauugcuuauuuuacauacuuauacacacaacccccaguaguaguucuuuaaaaucuauaaugaaaaguauuaaauuuacaguaacaugaaagauccagggaugcaagagagagcauuuuguaagucuugcucuucagagagacuacucaggugaagaauuagaaggaaaauaaggacacuaguauuuuuaaagaguaaagguauuuucuuuuaaauaucuuugguaauugaaaaauagagguuaagauguuuauagauacaauguuuucauacaguuucaacuccaugccuuuauauuuuucugaaaagcuaauggguauccagacaugaaucccccaguucucucugauaagccggagagggaacucuugucugaccaagcgagggggacagaaagggagugauggcuccguggaccagugaacgggugcuaaggaggacuuagacucggccaguugagccugcucuguuaguucuuaguuaacuagaaaaacuuaacacucgcuugucuuggauuacacgauagaggugugguccaagugugugaacagucugaggccucacuuggauccuuaccaagucuuucacaguuuuguuuuugagagcuggcaauuuguaacauacaggucugaucgcugauaaaauuuguaaaaauaaguuggauauuaagauuuuuguuaagaugucuuuuuggaaaaccguuucuagagucccuggaauuggcuguuggcacacgggucuggcacaucacgggagacuuagauguuucuucccacucgauagcugccuugcugccucauuauggugcuccaucccuuucgugccguuaguuuugaccuuccauccuucucuuugucaucaagauuuguauucaaaaguuauauuuuugggguuagaugucuugaguauuugguguuuggcaaaccucugaagugcuagaucgauuuagucuaguucuaaaucaaauucuuaaggcugguaugaaguccauccucaaugccagucaaugccaaggcaggguucccuaagcuucccacccgcuagggacuccuuuuaccuuuguagccucugcaaugugcuuuaaaaaauacaucacaacuaugauuuguuuuauugcccuguuauucuugaaagcugucuuuuuugugagaacuuuuaaaaccuacuucauuuuuuccccagaaguaauauaaaacaccugacauugaaauuuaugaaauuuaagaaucaucuacaaucaguacagaacaaaugauuggacuauuuaacauauauuuuuuuaaauaaacugaaagauaaggaacacuuuacacaauuuauauuucucuuuacauaaucuggaaccacacaguucuuuucuuuuuaaagcacaauauugaagccuuuaaaagguauuuaaggguuuggucaagugaauauaaaaugugucuguauaaaaagaaaaugaaguagucacuguuacguacugacauuaguuacaaccuaguuuuaauucuuaaaacaauuuugauuagcaaagcuaaaaaaggguguuucaguuaaauguuuuaaagagguacagauuuuuacaaggacauaauauaaguuauuguucuguagaaauauccuauuaaauauuguaugucccucccucuguauacuuuguaaaaaaaguaaaauacauaaaaagaaaaucauauaggggaugugugacauuauuguaauuguguacuugagaauaacgugcaaaaauaaaaaucagaauauuuuccuguuaacgaauguucagucuauuugauaccaguacuaaguuaaagcuuuuucuuaagaaagaaaauguacaguuuuuguaaaccuaauaaacaucaaaagcaguggauuauuuucaucccccuauuucuuaauuccuuuuaugcagcaguggaaugcaaaaugcuugguugcuuugaauuuugugacuuggaugcaaauacugguauuucaguccugugaauuugcaaguaacauugagaaguuaagaggugauuggugaguccuuugaugagcauguccuugaaauucauuuuuucuuuuaucuuuguaaaugauuuguuuuauuagcaucucugauuccuguuauaaauuacccacccauaaaguggguuugaaagcacuuaagauuuguuuuauuaucaguucacaacacauuucaucugaggcccuaccuuuuaguuacccauuugugcccagguuggaggccucuaguagacucagaucuuggaggauggucacugucguagugaaaauggcaaguuggauaaagguugggaauccugagaaaugugcagcacuuuugauauuaacaaugagauucuguaaucuagaaaccagcguuggucugagagaugaggugacaaauaacuaaaccuugagguacauguccacaagaaugugguggaagucaguugugagucugagcauaccugaucucacccauucugcuaaaauaugcugccuuaucguugccagggaucucgguauuaauuuccugcaaaaucuuacauuuguguaaggaaaugcaagcucagucagcaucuuaaagaggauccauguccaaaugaugccugucagcaagguagccugcccucuuaguccaguccccagugagccgggacgaggcaugagccuguguuucagcaggcuccccggguuguucugcuccaggcucagguuagugaaagcgauccuagagcacuugaggaacggaaagcuuacuuggugugauguuuuguguaguugucaaggggcucagcaaaagcagcuagagauggugcagugagaauacauuauaauccagagacugacugccuuuagccuuuccguaaaaguccugagucuugucagucacuaaguccguccuucagugcacgucugaacagccugucccuccuacucuuacauagcccccaguguugcauuccucaaacguaggaagacuugauaaguaaagagaaggacugaaaauuguguguucuuguguguuuaauuggcccagaguuaauaaaguaauucauauuaaaaaggacauuuugcugcauuuuacaacuuuuuaggaggucaaaguuaaguuugcccuauggauuuuguuuuuaucuuuuguuucauguauauauuguuugccuuuuucauaaaauaauucuuggauuuguuauauauuguuccuguuauuuuugacaucuuugcuauuguaaauaaauuccuauuuuguuuuaaguuac

SEQ ID NO: 9618 - RNA, 24124 nt, Mus musculus
caauuaaugcuuguuucagaaucuuguuuuauuuaaauguuuucuucauguuccaauacaacaacuuuuuagagucaaucaaauacauauaucaauagguuuccucaaaaaaaaaaaacaaacaaacaaacaaacaaaaaaaacuaucaaagccuggacuccaccccagagcuuucuuuuuccccccuucaaacuuccccagcaauucuuacgucagccagaguuggaaaucauugcugugaaagaguauuuaauuaagaaaaaacaugauuaauuuaaaaugcacagcacaagaaaauuggaggcacguggggaauagauuuagaaaccagaggacacaguuucugaacaauuucuaccucucucaaggcucaaagauuaccaauaacacaauuuccaccauaauccuaucagccaguacuacagcuaggggcaguggagacaaugguagaguguuuauucaucaugcaagagacagcuccauucauagcuuacuaaaacaaagaccucaaaaaagcagccuggacagaaccuugucaauuaucacuaaccaccaguugcuauacucuuugccagugugggaagacugagauacuaggcauaaauaauaaagacauagucucagggcacuggauuccuaaggucccacccaggaaacggguaagacagaucuaccuguguuaagggaaugggcacacaacuucuaagaguggugcucauuugagcccacuggucguauuccuucaaauuucagacaacagaaccccaaauagaaggacaaauaaagggguaagucuuuagccuuuacuaauugcccuucacuauggagcuacucacagaugaaucaugagaagagaucauuuucaucuuagacagguucaugauacaagugcuacgccaaagacugguugcagccaaguuucacuucaaacuuucauugauugauaaauuagacauuacuuuggaaugcuuaauuuuagcuacuauauagacuugauccaauguauauaguauaccacuuuucacauuuaauuuuaagccccauauuagaaguagguuacaaccccagcaaccagcagagaccccuuauuggugguauuguucuuuaucaggggcagagcagauggcaguccuuuguucauccuagcuugauggccaaaccuugucuuaugccuaggacucauaaaaaucaaauuaaagcaaggcagcacggcaugagaagaggaacacaaggucuuguagaccuccaugccacccacaguccugcccuccagugcauaagcauagauaccugcuugucaccaugacagacgggagagaaaaaggaauucaaggguggagagaaguagccuguuauaagugggcaucccugccaucagggccuuguuugagucuguggauccacaguggugggucaguguccauggcucauuauuaccacuagggaacacugggugucugaggcugugcaggucugccaccaucccucauuggauauagcacucuggacagcuggcccugccacuugucuguuaugaggugguguggaugggacacccucccccguugccaccuucuguagggagaauuggcccaggcucucacaagccgcagcacuuggaagaaugggccccagcugaccagcucagcuaccauccuggcccuuauccggggcucugaauugacccaccuaaaaucuaugucauguucgaaugguggggaucgugaaagggccacccugcuguuccaaagcugcaggaucucuaugacacagcgcagcaacaggauaacuggagggaguccugaugaggagccaacauuguuguugucacagaagcuacagcuuccacgauggcauguuuucuaggcuuuguucuguuguuggugugcuacuuugggggaggucgcaugggcaaagguuggauaugaggggaugaaugggauugggcuacaugaugucaaacaaggaaucaauaaaaagaaaaaaaaaaguagaggucacauuuucaucgccaaaauauaagaauaaauuuauagcugcuacuaguaagguaaugagcuaggaaauuaauucuuucuaguauugcuuugaaaauauaccccuaggcuaguaaaagaaauuccaacuccuucccaaggcauuguuuaacuugaagucuucagucaucaucuacaguuggcuuaauggucacuccucuucuuaucugaccccaaccaauuaaacugcaaaauaaaaacagaagagauuaugagcuucacccccaccggacuggaaucaccacacuaucauacaaccaugcauuacccgucuauuuucuaaauucagcugcuucuccguaaagaaagcuuagaccauuuucucagacuuuaaaaagcagauggagggaugcugaauagcaugacaagaaaauugucgugucaccgggcguggugacgcacaccuuugaucccagcacuugggaggcagggguaggcggauuucugaguugaaggccagccuugucuacagagugaguuccaggacagccagggauacacagagaaacccugucuugaaaaaacaaacaaaaaaaaaaacaaaacaaacaaacaaaaaaaaaaacaaaagaaaaucaaacaacgucuauaauagugaguuggguaugguacuacacgccuauaaauucaagcuuuugggagacaggaaagugaggaauuauuucauggcuaaauaguaaauguguggcuagccugggcaacaggaaaucacaucuuaaaaaacagaaacuugcuaguuguaguggugcaugccagcacucaggaaguagaggaaggcagaucuuuguguucaagaacugccuggucuacaaagugagcccucguaucaaagaaaacaaaaccuaaguuauuuggagcaauggcucaauaaugaagggcacuugcugcucuugcagaggacucuggguucaguuccuagcacccguauggugguucacaaucacagauucagcaauuucaaccucuuugagcauugggcaagcaugcagugcacauauucaggcaaaaaaucaugcacauaaaauaaaacauauuuaucuuuaauggucuaucaaaaaaacaaaacaagaacaaaacaaaaacaaaaaaccaccuacccauucagauucaccuaggggaccuucagaccacccaaauuacaucucuaauacgucuugugcacgugcgccugucugucuguauaugugguuuuuuuuuucuuuuuuuggaaaaggacuuucacuaugcaauuuuguauacuuggaaguugcuuuguaaacuagguugaccuggaacuugagguccaccugacucugcuucccauaugcuaggauuaaaggccugugccacuauaccaagcucagauuuaaaaaccaaagcaaacuguaauucuuaugucuaucuuuggaaaaugcuuucuuuccauucauagugccucaucugaucacaaugucuuuagauaacaucagcugggaaaaggagaaccacaggaacuccaagcagacugcuuugcacagcaggacuuugcuagcaauggugauagaugucccuuuaaucccaguacucaggaggcagaggcagaugggucacugugaguuccaagcuagcuugcucuauacagugacuuccagagcagccagggcuacauagagagacccugucuuuuuuuuuuuuuuugggggggggggguggaaguggugguagaaauaacaaaaaaguuaauaauuguuacacugcagggugacaugacaauucagaucaauuguuuuggcaagaaugcaaugagaaacuaucaccugcacaguaccaaagaaagacugacaaaggaauaggcagugaagaacacagccaaggcacaaggaaaauuuggggaaaauccaggcuguggaguagucuucuuuagagguauauauuuuagacaaaccuacagaaaagauuaaauggaccaaaacugguuuccagaaagaucccaaauauccucaaccagcaagaaaauauuagaaauucuuuaguguagcaucgugucaauguuuagacaacucauucugauugagcccuuaaguaucaacagauaaggcaaagcaggacuuuuuugcuacaaccuuuuaaguuaaaaugauaguguuauagaucaugaugcaucgaggaauggugaaggaguagacucaauuacuaauuugggaaagaagccagaaucagaaaucaaagauaaaugugugcuuuccagauagugcauagaccuuuauuucuaaaaacuaguucauuccuuuagagaaauggccaauucuaaaacugaagcagagagguacaaaacaagccccuuguggaagaaaauaagcuuguaccaaaagaagccauaaaauacaacauggauaaaaggauacaggaaccagcuuaaagguccccacugacaaacucuuggacaauuuguacaucaaaauaaaauauagcaacagaacaacagaccauagccuaaugaacaaaacagaacccugugaaucuguauuaugaaagcggguacucaauaaugggaaggaaaaaugccaaacauucaauaaaguucaauuuagguaaaaaugaccagugaaugauaagugcaggagggagggagauuugcauacauacacagggucucccccacacacuucucucugucucugcgugugcguauauauacacacuccuaugaauguguuucuuugagcuagcccagguugccugcaaacucugaagaugaauuugaaugaauuuggcacugaagaugaauuuggagucccaauccuuguguaccuaccucucaagugcaaggauuaauuugaacuauuacaucuagucuccuagggguuuuuguuuuguuuuuuccuaauuucaaggguaauuaagaguaaguauauagggcuggugagauggcucaacagguaagaacacugacugcucuucccgaguucaaaucccagcaaccaacagucagugcucuuaccugcugagccaucucuccagcuccuguuuuguuuuuguuuguuugauugauuguuuuuugagacaaaguuuuacuauuagcccaggcuagccuugaacagagauccaccugccucugccucccaaguacuggaauuaaagguaugguaugugccaccacaauccagcuuccucucucacccuuucuuuuuguuuguuuguuuuuuuuguuuuuccagacagguuuucucuguauagcccuggcuguccuggaacucacuuuguagaccaggcuggccuugaacucagaaauccaccugccucugccucccgagugcugggauuaaaguugugcgccaccaccgccaggcuaagacauuuauuuauuaugaacaguguucugccugcauauaugucuuuacaccagaagagggcgccagaucccauucuauaguugugagacaccauaguugcugacaauugaacucaggaacucuggaagagcaagucagugcucucaagagccaucucuccagaccagccccuaccccaacacuuuuaauuucauguguaugggugcuauacauacauauauaucuaugcacaugugucugucugguacccacaauggucagacaagagagcugaauccccuggaacuagaguuagucauuagcugucauguggguucugggaaucaaacuugaguccucuggaaaagcagucacauuaauggcuaagccaucucccuagccuuagcuaguucuuuugagauagaauuucagucuauagugcagaauggcauaaaacuuuguagcccaggcuucaauguucaauuucuggugugaauuucuggugugucugaagacagcuacaguguauuuagauauaauaauaaauaaaucuuugggccggaacaagcagggacugagugagcgagguugacuggggugagcagagguccuaaaaauuuaauucccaacaaccacaugaaggcucacaaccaucuguauagguacaguguacucacauacauaaaauaaauaaaucuuuuuaaaaaauuucuuggcuaugaaagagagugccagccgggcaugguggcacacgccuuuaaucccaccacuugggaggcagaggcaggcggcggauuucuuaguucgaggccagccuggucuauagagugaguuccaggacagccaggacuacacagagaaauccugucucgaaaacaaaaaaacaaaacaaacaaaaaagaaagaaagaaagaaagagaaugcccuuguuuuguagagauauugcuuaacuauuaagacaucaaaaggcaugacauacacaagugacuauguguguguguaucuuucuagacaagggauauuuaugaguuuucuauacaauucuugcaaugucauugguaaguauauauacuuuucuuaugugcauuuaguuuggccuacaucuaugucuagugagggagucagacaguugugagcugccauguaggugcagggaauugaaccccaauccucuggaagagcagccaaugcucuuaaccaaugagccaucucuccagcccccaauguuaacuacaaaaaaaaaaaaaguuuaugguagccagguauaguggugcaugccuuuaaucucagcacucagaagacagaagcaggcagaucucugugaguuugagucuagccagggcuaaaguauuuuuucccccaaaacaaaguuuaugaggggcagaccugggagaggcuggggaaaacugaguaugaucaaaauacuuuuuaaaaaaauuuuuuuauuuuucaagacaggcuuuuaaaaaauacaucuaauuguccuauauuacaacuuacucuguagaccagguuggccucaaacucagagaucuaacugccucugcuuucuaagugcugggaucaaaggugugcaccacuguugcccugcagaucaaaauacuaauaauuaaaauacuacuaauacuacuacuaauaauaauaaaguucaagacugauaaagauugcucagcagacaaaggcauuuaucaccaagccugacuaccugugauccccagaacccacaugguagaacaagaaguuguucucugaccuucacauacauauugugguaugugugcacaccuacaccuacacacacacaaauaauaaauaauguuuaaaaaggaugcuugcugucaaguuguaugaacugaauccaaaucuuggaacucacauggcugcaaaaccaacuacauaaguugcuauaacacacacacacacacacacacacacacacacacacacacauacacacacacauuaaacaaaugaaggggggggagucaaaagauggaaauauugaauuuuuuuuguuuuguuuuguauaggcuacaccuaaaacaaagggaagccaauugaaguacuuauacuaauagaaagaaaaauaaaucaagaguauaaauauagcuuuauagaccaaccaaagaaaaaagcuaagcacuaaagucacccuaacugcuguguucaaggggaaguguguccauacauauacuaacaagaacuuagcucuuuaauagacaguggcaaagugaacaaaacuuaccgccaguguuucucaacucuucugcuaagggcaauuuuuucuccuacuucugugcacacgggauuggucaaaacaauuuugcccaaaucagccuugacugcacuaacucuuccuccugucgacagggagccuauguugaccauaagcacuucauucuuagacagcuuuuggaccuaggaaaauaauuuggagaaagaggaacaacacauaagauagcacuuucugaagcgggagugugguggcgcacaguacucaggaggcagaggcagacuggucucugugacuuugagagcagccugauuaacaugaguucuaggacagacagggcuacuuugagagacccugccucaaaaagccaaacaaauaguuucuguuuuggugaggauuuaaaaaacaaacaaacaaauaaaacggauugccacagaguugcucuugauuucccccaccuccccacaccucaauaggauuguucuguauaguccuggcaguccguaacucagagaucucccugcuucugccucccaaaugcugggaugaaaggcuuguacuguuuccggcuagucuuaaauuuuuacuuuuaauuuaaaaaaauguauguauauuucaugugugaguguuuuacauguauuccugcaugccagaagagagugucagaucccaagauccuauuacagauggcugugagccacugcucuuaaccacugagucgucucuccagcccuguucuuuguuuguuugguuuuguuuuguuuuuggagacaggguuucucuguguagcccuggcuguccuggaacucacuuuguagaucaggcuggccuagaacucagaaaucugccugccucugccucccaagugccaggauuaaaggcgugugacaccaugccuggcuuuuuuuuuuuuuaaaaggaagucaacauacucacacauucacugcauauuaacuaugaaagaagaaaacugagucuagccuugcugcucaucccucccagaaacaugaguuauacaaagcacauaccuuugcugcuuucuugucuccuucaguacguacacccagaagacgucuaagcaggaaauaggaaaucuccaguucggugaauauuucagguaaagcuccaacugcaccgagcacuugucccaccauucugucagcucggcacaagguggggucgaucuuuguuccaacuccuaacauaaaguaagauggauauagccaggccuuauuaucuaaaauaccccuggaauaauugacuucaaagucuaguaagaacugacacccuuuuacacguacuuccauuuucauacauacauggcaagcguaacaaaauacucguucuauguuaauuggcuuuugguuuuuuugacaggguuucucugugcaggagcccuuggcuguccugaaacuugcucuguggaccaggcugaccuaugccuacugaaugcugggaugaaaggcgugcaccaccacuaugcagcauuuuuuuuuucagaugguccuaacauguaggcaaggcuggccuccaacuuacagagaucuacccgccuuugccucaaauuuaaaggccaucacaucuuucauuuaaauuuucagugaaaauguuuagaacaagccuuuuuaaaagauucuuauucucccuucaaauuuuuuagauaagguuuuccccuuuguguuuugaugucugagagcaucacgugcauguagcucccacagaggccagaagagggcgacagacaccaugcaaagaguuauagacuguugugaguuguacuagaaacuggguccccuggaagagcagcagugcuuuucaacguggagccaucucaugucuucaggcccuuauuuuucauauuuaagcuauguguauauguuuaccucuguguguggcucugcguagguuaaguguggcaccagaagaagguacuggcucuccuggagcuggaguuacagcugguugagagcugcucauaaauucagaccucugcaaaagcagugacauccccaacccugagccacauuucccccaaacaaagcacauauagcuauaguguuuugagugcuaggccaucaaacuuauucugugucaggcacagugcacagaccugaaauuccagggauuggacauagugaggcgcgggaagaccuuaaguucuaguucagccugaaauggagugaguucaaggacaagguaacuuugugagaucuuuucucaaaaggaaaaagagugaggcuggagagauugguuagugacuuccgagcacuggcuacuuuuccagaggauucagguucaauucccagcacccauacucaguucacauugucuguaacuuuagucucaggggacucaaugacuucuucugaccuuugugggcaacuaggcaggcauuuaugugcauagacaugauccacauacguaaaaauaaauaauaaucuaauaguaaucuaauuuugaaaacagaggacaaagagggcuauaucuuagugauugagugccugccuagcauguucuagacuuuaggucuaaacccuaguacuucaaaauaauagccagaaauaauuauuguugcuacuaaguaucuccuacuaaaauguacuuuaaaaauauuauucauuagcaauguggaugcuuguuugagugagcaagcaccuuuaccugagucauacugccagcuccaaaauguguucuuucucuuuaaaacauugcaagaugcaccaauaaagccagguugaugguacacaccuguaagucuaccacuugguaagcugauccaagaggguugccuugaguaccagccuagcuaaaaauacauggcaagagucuaugucaaaaauuaaaaugggcuggagauaugguucagggguuaagagcacugacugcucuuccagagguccuaaguucaaaucccagcaaccacaugguggcucacaaccaucuguaaugagaucugacgcccucuucuggugugucugaagacagcuacagcguacucguguacauaaaauaaaugucuuuaaaaaauuaaaacaggacaugguaggacauaucuuuaauaucagcacuugggaggaagaggcagauggaucuuugugaaucugaggccaauaaggacccccaaaaauaaaaaaccaaaacaaaccacccacaacaaaaacaaccaaagggcagguagagagauggcagugauuaagagcacuugaugcucuuguagagaagcuggguuuggcuccuagaacucacaaggcagcacagcaucucugaaacucuaucagacuggucugaugcccucuuuggcauugguacaagcugaacagacauauaugcaaauaaaaucauauacauaaaaauaaaaguguuaaaaacaaaacaaaccuuacaaucuaucuuugaucuuuacuaugaaauguaccaugaaucucaacaaacuaaaagagaggaaaguccuuaccaaugagaccacccggggcagcauauugaagaucauuauguuccgcaaaaagugacacaauuuuggaaaagauugguuuacacaugaguuuuccuucacugucuuuggagacaauaccgggucucacuucuaucuccuggccuaccuguaaacacauaauuggcaaggagaauuauaaaacaauacauuuauuauuugccuaccaauguuauaacaaaaaguccacaaaacuaaaaagauuacuuuuauuuacuucuuaugauuuuuauggccugcaacucacuaggcagaaguggcuggccuugaauuuagauaccagucugcuucugccucccagccgcauaccaccaggccaggucaaaaauuacuuaaaaaaacacacacacacauauauauguuuuuuugagacauuucucuguguagccccagguauccuggaacucacucugcagaccagccuggccuugaaaucagagaucugcaugcuucugccuccguauuuaaagguguacacuacuaugcucagcuauuuuuuuuuuuuuuuuuuuaaaacuggcauggaggagccagauggcucuacaguucaagagcacugcugcucucgcacaagaccagagaucaguucuuaguacccacacagcagcucacaacucauaaccaucucuaaguuccaggggauucaauacccucuucuggccuccuuggaaagauggagacaaccaccacccauaucuaugaaauaaacaaaucuaaaagaaaaauuuaaaaucagucccaucuaaguguuacaaaguaccaaauaaaccuguugucacauaaaauauguuccauguucacuggaaaacuauaguuuuagagaucacacaucuuccaaagacaaaaccaaauccauauccaauaccagacaccauggaaaaaacauuuuucacugggcauaguggugcauuccuuuagccccagcacuuggaaggcagauuaagauaaggguggucugaugaacuggcccagaggauaaaggugcuuaucuuaccaucaaaccugauagcaugaguucaaucccagagacacacuagauggaaagagagucaaccccugaaaagcugucuuaccuauauauacuguggcacuuacacacaauaaccaaauauacagaguaacaagucaaauccaauuuaccuuuaacacuccuuuuaggauacuaccaccagcuacaccucccuuaaggucaucgacuucacagccagguuuguugacaucaaaugaccugaugacuaaaagaaaaauuuaaaacaaauuaaagccauuucuauguacuucaauuuuagcuuuagaugacauuauuuuccaagucaaccuuucuaaaaacaaccuaaugauauugcuuugauguuugcugaagucuuacguguuaacaggaggaaaacaaaacaaaacaacaacaacaacaacaaaaaaccaaaacaaaccccaagaaauagcuugaaaguucauuaaaagaugguuuauucaucuguaaugggaucugaugccaucuucuggugucugacacacuaguguacucauauauguacaauaaauaaaaucuuaaaaaagaaaacaaagauaguuuauuaaaguaugucaauacuauaaaagggucucuaccauggaauaucauacauccauuugaaacuaauguuaaaauuauauguagugaucugggauagguucuguguacuguuaaagaaaaaaguagcagcugugugguggaggaggaagaagagggagaggaggaggaggcaaugaagagagacggacaguuagagcugcagaaaggagguuaucugaaauguaggaggaaagggaaagcagcccuggaagggcugcccagaagcaucuugggcagcaaagaccaaugggcuucacagaaggaaacagggcagcaaaguuaaaaguagauuuagaagguguugagccaggaguacuggaaggaaggguaugcuaaggaagacuuagaagugcccagccacugagcuaguaaggcauguuaaaauaagcuaauaaugugugugugugugugugugugucuuucauucacaggaccaaagacaguuccugggcaggcacuauagauacacggcuuauggcuuguccuucacauuuaagguucuauauaauucaaccagccaaggagaaaaaaaccuauguauugagcaaagucuuccccugacccccuuuuuuggugagggccauuaucucguaauuaucauaacuauuuacauaguauuuacaauaaauuagcuauuauuccuuaaggcguacaggaggagacuggauguacaucagugguacuauccuugccuggcauguaugaggccuugggcaucuccagcuucaccagaaaugucaaucaaugaagcauacaagagacuguacuuggguacacacaguuugccauuuaauuaauuaauuaguuaauuaauuaauuccuuuugagagagguucucacuauguagcccugacugauuggaacucacucacccguagacgagguuagccuugaauucacagagauccacuugucuuugccucccaagugcugggauuacauguguuugcuaccaugcuugguauuuuauauauagaacuuuuguguuuuauggcuucuacaaguacaaguuuacuuuuuuguuuuguuuuguuuuguuuuguuuuuuccagacaggguuucucuguguaucccuggcuguccucaaacucagaaauccaccugccucugcuuccaaagugcugggauuaaaggcgugcgccaccacaaccggcuaaguuuacuuugaaauuaagccuauugguuuuucagcaaugguacaaugccaucauuuguaucgaaacugcaccaccucaacagcuuguaaucccuucaaauucccuguuggucaccuaaaauaccauauagucagcacaaaggguuucuuuuguacucagaguucugucaaccagcaguauaaucucaagacauuauuucaaauagguuuuaugaauuuacaugcccucuguagaaagagaagauacuaauaagaagcacggaagaguccaguuaacugugacuccugucacuuaccaaugagacggggcucugaaguaaagucucuugggggcacugguauuuucuucacuauauacucacagacaacuucaauauuguacuucaguugagcagaaauuggaauaauuggugccccuucugcuacgguuccuacauaaggaauuccaaaaggaucaaaauccuuggguuuuacaaaacuugauuuauacgcuagauaaaguaauuagaccuaacagaggccuaaacauuuccacacgaauucuaucuuuaacuccugaaaaugaauuauuuguccuuuaaagggaaaacugcuaaaauuauuucacugggccuaguuaacaaaggcaaaaugauguguuuaaaggaauaaaacacgaacacuccugggaaagagcacuuuaccagcuaaaagauuccuaacauacaauuaaccuucccauaaaugucaagaggaaauuacagacucuuugauaaucaaagacuggcuggcauauauauuuuuucaucaagcaaacuggcaaagaaauagcucaaaaauaaauggauuuuaaucaaaguggauuauucuuucucguauuagaacuggauucccaacaagaaaaaguuaaaaaauaaugaacugucaauaguaacacacaucacaacuaaagaaaggaacacuguaaagauugcuguuugguuuuugagacagggucucucuauauaguucuugcuggccuggaacuagcuauacacaccaacaagcuggcccugaagucagaggucugccuucccaugccucuaggaugcuaggauuaaagacaugugucaugaugcugaguagcaaggcaagacuguauuuaaauucuuuuauucauuuuacuaucacuaagaauuuuuuuuugaaaggcagugaugugaacucaauguccuguguaugcuaggcaagcacucuaccauugagguauacauauacacuaagcucuugggauuuaaaacaguucaucugauuuccaaaauauaccuucaguuuuaacauuguacauuaaauucagaaauaccauuuacagucuuaucaggaccccaacaaguagggaguagaaaaagcaacagguaugccaaccuauauuuacaaaugaucuucugauacacuagccauuauagcuucuuaccuugcacaaaugcgaggauuugcucauauuguuccuuagccugacuuucuuuuaccagaucaauuuuauucuguaagaucaaaauaugcuugaguuucaugauuucuauggcagccagguguucggaagucuggggcugagggcaugauucguuaccagcuaguugacagagaauaaaaaacauggguaagaaugacuagaaacauccagaccauucaguuucaaaaauagaaggcagaucguuagcuggcaggcaggggcuggagggaguagaacugggcagugagggcugaacagucaggaggcucacuuuuguggucgugaaauuuuacuuguacuuccuucucacugauaaacugguaaggguuacauuaugcacauauccuaccaccaacucugcuuuacccuguaucuucacucacugcagccucacaguccuaagcaagaagcuuccaaugaccaagaaugccuucaagagcuuaugcuuaggacuucuagcucaauguagucuacauauguccuguuacacgccagcucuuaggaggcggcuuagccucaaggcuacuccuuaaacaagagugcugugagacaagcaacaguacuugacaacgggcaaauuugcucagcaugcuaagaacugcccugcucagucuguucauguguccuguacaauaauauccucucgcauaccuaaaauuaccauucauaccuguccaaucucuuaacagcacacauagggaaacacagcuuuaacucugaaaacucacaugcuuaccagaccauggcaauuacuacaaauaaaucaucuacauggaggggcaacccauaauacauaugcuuuaaggccaauucugaauggaaauaagaugagaaaccacgccacauugcuuuuaggacacucuaaggcuucucagaauccagaaaggccaggacuaauuugcuuaguauguuaugcuguuugugauaugcucgaaggaaaugguauccugcaugucacauuucuauuuaugccucacuuagauaauggacauggccucccaagguuucaguucuuccugaaaucuuccacucagauuagcucuccauucugaugacuuaccuaucaacagaagggccgcauccaucacugcugcaccguucagcaucguagccaucaaaauaucauggccaggacagucaacaaaggaaacaugccugacgauugaaaaguaacaaucagccuuaagaucaaucaaaaccacaugcaaacuauagauuucuuuuuuuuuuuaaauauuuuuaaagauucauuuauuuauuauauguaaguacacuguagcugucuucagacaauccagaagagggagucagaucuuguuacagaugguugugagccaccaugugguugcugggauuugaacuccaaaccuuugcaagagcagucgggugcucuuacccacugagccaucucaccagcccaaacuauagauuucuuaacaucaaaucacaugggagcuaguucucaauguugcucguagacuuugggccuggugcuucuggcuucuauagguacuggcacauagguaagcacagccagacaagcacauacauauaauuaagaauaauaaauaugggcuggugagauggcucaguggguaagagcacccgacugcucuuucaaaggucuggaguucaaaucccagcaaccacaugguggcucacaaccaucugacgcccucuucuggugugucugaagacagcuacaguguacuuacauauaauaaagaaagaaagaaagaaaaaagaauaauaaauaugaagaaaagagagaaugagaauuuucauuugaaaaaauauuuuguccaaaauaccacuaccccugaaaaacuagacucguguaccuuaagugagagacagcaugacuuuaaaguuaugguacucagagucaugacuuuauaagcauuacuuuucauguuuuauuuuaaucucucuucuguuuucuggcuggucaggcaagaugguucagcaguuaagaacacugacugcucuuccagaggucccgaguucaaaucccagcaaccacaugguggcucacaaccaucuguaaugggaucugacacacuuuucuggugugugucugaagacagcuacaguguacucacauacauaaaauuaauaaaucuuaaaacaaaaaauguuaaaaaacaaaaaaauguucuuggcuacugagucaucucucuagccccagagucacaauuuuaaaaauaacaaaaauguaugcucacauugccaugaucuaaaacugggaucaaggaucagaaaacuaugggccucagauuuggcccaccacaaacucauacaugaacauacaguuuacgugugcuuuuguaauagaagaacagaaauaaguacuuaggacagagacucuaaggcccacaaaacaggaaaaaaaaaaaacauuugcacuuuacaaaauuugagaagaauuaucucugaccagcgcuaggaccagagugagauaagagagguaccucagguuuacauuuuaaggggaugccuaaacaguaaaaacagacccuggaauauagauuagugguaaagcauuugccugcuagcauauguggccuuuggugcaaguccuggugcuaaagaaaaaaaaacauucugaagguccuaaguucaaaucccaacaaccaccacaugguggcucacaaccacccguaaugagaucugaugcccucuucuggugugucugaagucagcuacuauccagacacuauugcauaugccagcaagauuuugcugaaaggacccagauauagcucucucuugugaggcuaugccggggccuagcaaacacagaaguggaugcucacagucagcuauuggauggaucacacggcccccaauggaggagcuagagaaaguacccaaggagcuaaagagaucugcaacccuauagguggaacaacaauaugaacuaaccaguacccccagagcucgugucucuaacugcauauguagcagaagauggccuagucggccaucaguggaaagagaggcccauugguugugcaaacuuuauaugccucaguacaggggaaugccagagccaagaagugggagugguuagguaggggagcagggcggagggaggguauagggacuuucaggauagcauuugaaauguauauaaagaaaauaucuaauaaaaaaaaauuaaaaaaaaacugaaaacaggagcccacacaaaaaaagaugaaguuagcuacuuacauauaauaauaaauaaaucuuaaaaagcaaacaaacaaacaaaaaaccccaauagcuugccugaaaggcauaguggugaacaccuuuaaucccagcacuuuggaggcagaggcaagcagaguccgaggccagccuggucuacagagaaaguuccaggacagccacggcuacacaaagaaacccugucuauuaaaaaccaaaccaaaccaaacaacgucuuugcuacuuuguggguucuuucuuacacccuuuuuaccccaacacuacaugagagaaaaaaagauagaggggagagggagagggggggagagagaaaagauccccaaauaaagccaggggugagaaagaggaugauguuauuguuagacuacuuccugcugauuagggggugucgaggacaccaggacaccuaauuucuccuucuuguuauuucuucuuuguguacaacuaccuaacaaagugauuaaaaacaaacgaccauagcaucucaggacaguagcauuuauauacccagaauuccaaaugucacacaaccguagaaacuaucuguggcuggcaaaaucaugccucugcuagagcaggaggcaaaccagucagcugcuguggauucucugaagcagccccacauccuacaccugggacuaaaaggaaaacauagucucauaaucugugucuuuuaaagaaaccaaaaaagaaacuccaaaauugucacuacaaacaggcaaaacaagucauacagaagcaaaaaaauacccgaaaccugguuggccuguauuuaaaugucugauacuggugacuuuuuugaaagacuguccccacacccuggaguguuuguuuuucugagcaccuccucuucaucuaaguguuuaacaugcauaguaaaauaccuucaauaaaaccccaacucaacuuuguaggaaaaaaagugagcagguauggugguauaagccuuaaucccagcacugggaaggagacaaaggcaggugggucucucuaaguuccagggcuacauauugagacucuaucuaaauaaaacagaauuccaauauccuauucauuacaauuuucuuaauuauuuuuuaaaaauugaucuaaagugaggcuggagagauggcucaguggccgcucuuccaaaggaccuggguuuaguuccuggcacccacauggcagcucacaacugucuaacuccaguuagggaccuggcacccccagacaaacauacacgcaggcaaaacagcacugcucauaaaagucgaauaaacuuaaaaacgaacuguauuaaaaguauccugauuauugagacuccuuggauuccccuucuucccuaaaucuugggccugagaugaguaucugacucuguccuugaucuaaaauggccuuaugggcuugcaaccccugaagaugcuuguaacuagguaccagccccucugguaaagaaccagcacgugaaaccauucagaaaauuguugguuucaaagaaguaauuuuaaaaauagauucauaagccugguaguggugacauacgccuuuaaucccagcacaugaggggcagagauaggaaggagggccucuaaauucauggcuaacguggucuguagagugagugaguuaguuccaggacaggcagagcuacagagagaaacccugucuugaaaaaggggcgggggggggauucauucuuagcuaacaaccagaaaggaaacuguuuaaauacaaugacuugugcuuucucucccuuccuuucuuacucaugcaaugugugccuuuauagaagaguuauuuuauuuucuuaaguguuucauguccagugcacccaaagguggaucuccuggaacaggaguuacaagcggcugagccaccaggucgaugcugggaaucaaaucuggggagcagccacagaucuaacagcugagccucucuagcucccuuaugcaacuuguagaacuuuuaaaauuaauuaaaaaacaaaacaaaacaaaaacaacuuaccuuucaauuaucauuauauaaaauaaaaacaugaaauaauggcaaaaugaugaaaccauucaucaacugaguuuaguguucgguaucuuaaguacuucaaaaagcacaaagcagugauuuaagcaucaaaguuaccugacuaacuugaaguucccuuugguccccggaaugucuguaggaaacucaucuggugugcugcuuccacacgaucuguaacauucuggucuaggacaacuugggucaucaaguuuauaaaucuauaagaaaaaagaaacaacuagauuaguuacguaugcaaaaccuacaguuaagugguuucuaguuucauuguacauggaucaccuuagcauuagcauauccaagcuugaugguaauguuccuuucgaguucauuuuugaaucugacagugugaacuccagaaauagccuucaccacaguggacuucccaugagcuacgugaccaauuguaccuauuggcaaaagagaacaaaauuaacuccugcacucaaguacaccagguauuuuuuuucagaguguguugagucaaaaacucuaaccguaaacaccaauguaaauccaacagugauagggcugaugacauggcuuguagcugucuuuggcuacuuugugggcucucucuuccaaccuucuccacccuuuuaaccaccuaccacuagauaagagaggacaggaaagagaucacggaauaaagccgggguuugaaaggggucaacauuauugcuagacuacuuccugcuaauuaggggcaucaagguccaaguuccuucggggaaguuugaucuugucggacaucuaauuucuucguuucuaacaacuacuuaacaaagcaugaccaaccaacgacuaacccagucucucgggguccuagcauuuaucuacccucagaaggaaaaguccccagaauuccaaaugggacacaauugcagaaacuaucugcugcuagcaaaaucccaccucugcuacagcagaguccacuucuguggauaaacugaagcagcgucauaucccacaccuggcauuaaaugaaaagcauaagucuuuaaaauauuucuguagcugggcgaggcggggcacgccuuuaauuccagcacucaggaggcagaggcaggcggauuucugaguucaaggccagccuggucuacaaaguuccaggauggccagggcuauacagagaaacccugucuccaaaaacaaaaaaaaauuuucugugauuuuuuuaaaaaaaagaaaauaaauuccuaaacugucaucaugacaaugacucaacagguaaaagcacuugucacaagugccuuaggaccagauuccaauaccuagaaccuauaggaaagggagagaaccaauuccuaaaaguuguccugcuuuccacacauuauaaaucuucucaggcccggcggugguggugcacgccuucaaucucagcacuugggaggcagaggcaggcggauuucugaguucaaggccagccuggucuacagagugagguccaggacagccagagaaacccugucucgaaaaaaaccaagcuucucagaccaguuuuaguagaguauauacuugggaguaagaagcaggauuugaggccagccuggacaaugcggagagaugcaauaaaauuuaaaagaguagucccagcuccuggggagcagaggcagucuaagaacucacuucaacucugaguuuaagcuuagcuuggucuacaaagugaguuccuggacagccagggcuauguagacagaccuuaucucaaacaaaaauuaaauauguuuaaauguucacuugaaauguuguuauccugacugaaaaauuauucauuuacauacucuucuacuaguucaaaacaacaacaaaaccccuaaaaucacccccgaaacaaaacaaaaacaccaaagaugucaagcacacagccaucauacugucauauuagacaaacucugauacaacacacucauaacccuuguauucagaagucugaggagaaggauugccuugacuuaaaagucagcccagacuucauagugaaugccaagcuaggcagucucccuagaauagcuagccggaacacauagcaagccugucucacuuccuccccaaauccaacaucaaaaacccaaccauacccuauucauacucaagcaauaccaauucauaccucaacaguucuaggcgccaauuaagggggaggaaagaaguggacuuaauuauagcuuauauaucaaauaaaacugccauaaacuaucccguauggcagcaaagugcauuuguaccucauaauucacuacucuaugauuacauacuaccuuggacuaugaaacuuuucuuucauacauaucucaaaaaaaaaaaaguagcaauauuuuguuaguaaggguaccacagcauucuuuugacacacugaccuacucaggacaauuuccaaauaaauguccacauuacucaaugaauuacauaaaagaaaggguuaaaauuacuuguaagucaaguaagucuucaagcuaucuuaccaauauuaauuguagcuugucugcugauaacuucaugugaaaguggugucaacuugguaacauccugaaaagaaauauauuguaaaauauaaucaauacaaaccacaaguuuucccuugacuuuauauuccucggguacaacuguaugcuccguaugaacagcucucuucuccugcuaaagcccccccccccccccccccccccgccggcaacaugcuguuaagacugggaagacuauaaugacuauagugucauugucacacuaagacaaguccacucacuaagagaggucuggcgaugaaaggccaccaaauacuggagucauaacaaguccucaaaugucuaacacagugaacaguauaguccaauuuccaauccuuuacagacuuaaaccuuaacaacuuuuuaacagucucguuagucucauacuggccuccaaccagauauagagccaaaaauguccuuuaucuucuaaucuuccuauuuucaucuccuaagugcuaggauuacaggcgugcgccucuccggauggaacucagggcugcguggaugcuaagcauacacucuacgcuauauuaaucaucuccauucuguuuauuaacaaagcuuaacuccaggaauuccaagucucacaaucguuccccaguuuggggacuagacaagguacuggcgguagagcuggcacgcacgccuuggacgcuaaggcuuuagcuggcccagcucuaggauggcuccuucagcccacgcuccagccacccaggaaccaccucaucuccaggcccuccgaugcuccauucccaccccccaagaucacugggcugcucccgccgcaaagccagggccuaccaauguggcgagauccugucgggaaagauggggcugaccgagagucacuccacccucacccccagccaucuugcucggagagaaaaggaaaaugcucggcagccgccugacauaccguaggccccuugggcggagcgaaggggaagcggcgggaaggcggacugcggcauagaccugaugaaaaugauggcgaaugcagcacugaccugacugcucggacuucucucuguuugaauuugcgcaggaacgccgggcgacc

SEQ ID NO: 9619 - RNA, 24124 nt, Mus musculus
ggucgcccggcguuccugcgcaaauucaaacagagagaaguccgagcagucaggucagugcugcauucgccaucauuuucaucaggucuaugccgcaguccgccuucccgccgcuuccccuucgcuccgcccaaggggccuacgguaugucaggcggcugccgagcauuuuccuuuucucuccgagcaagauggcugggggugaggguggagugacucucggucagccccaucuuucccgacaggaucucgccacauugguaggcccuggcuuugcggcgggagcagcccagugaucuuggggggugggaauggagcaucggagggccuggagaugaggugguuccuggguggcuggagcgugggcugaaggagccauccuagagcugggccagcuaaagccuuagcguccaaggcgugcgugccagcucuaccgccaguaccuugucuaguccccaaacuggggaacgauugugagacuuggaauuccuggaguuaagcuuuguuaauaaacagaauggagaugauuaauauagcguagaguguaugcuuagcauccacgcagcccugaguuccauccggagaggcgcacgccuguaauccuagcacuuaggagaugaaaauaggaagauuagaagauaaaggacauuuuuggcucuauaucugguuggaggccaguaugagacuaacgagacuguuaaaaaguuguuaagguuuaagucuguaaaggauuggaaauuggacuauacuguucacuguguuagacauuugaggacuuguuaugacuccaguauuugguggccuuucaucgccagaccucucuuagugaguggacuugucuuagugugacaaugacacuauagucauuauagucuucccagucuuaacagcauguugccggcgggggggggggggggggggggggcuuuagcaggagaagagagcuguucauacggagcauacaguuguacccgaggaauauaaagucaagggaaaacuugugguuuguauugauuauauuuuacaauauauuucuuuucaggauguuaccaaguugacaccacuuucacaugaaguuaucagcagacaagcuacaauuaauauugguaagauagcuugaagacuuacuugacuuacaaguaauuuuaacccuuucuuuuauguaauucauugaguaauguggacauuuauuuggaaauuguccugaguaggucagugugucaaaagaaugcugugguacccuuacuaacaaaauauugcuacuuuuuuuuuuuugagauauguaugaaagaaaaguuucauaguccaagguaguauguaaucauagaguagugaauuaugagguacaaaugcacuuugcugccauacgggauaguuuauggcaguuuuauuugauauauaagcuauaauuaaguccacuucuuuccucccccuuaauuggcgccuagaacuguugagguaugaauugguauugcuugaguaugaauaggguaugguuggguuuuugauguuggauuuggggaggaagugagacaggcuugcuauguguuccggcuagcuauucuagggagacugccuagcuuggcauucacuaugaagucugggcugacuuuuaagucaaggcaauccuucuccucagacuucugaauacaaggguuaugaguguguuguaucagaguuugucuaauaugacaguaugauggcugugugcuugacaucuuugguguuuuuguuuuguuucgggggugauuuuagggguuuuguuguuguuuugaacuaguagaagaguauguaaaugaauaauuuuucagucaggauaacaacauuucaagugaacauuuaaacauauuuaauuuuuguuugagauaaggucugucuacauagcccuggcuguccaggaacucacuuuguagaccaagcuaagcuuaaacucagaguugaagugaguucuuagacugccucugcuccccaggagcugggacuacucuuuuaaauuuuauugcaucucuccgcauuguccaggcuggccucaaauccugcuucuuacucccaaguauauacucuacuaaaacuggucugagaagcuugguuuuuuucgagacaggguuucucuggcuguccuggaccucacucuguagaccaggcuggccuugaacucagaaauccgccugccucugccucccaagugcugagauugaaggcgugcaccaccaccgccgggccugagaagauuuauaauguguggaaagcaggacaacuuuuaggaauugguucucucccuuuccuauagguucuagguauuggaaucugguccuaaggcacuugugacaagugcuuuuaccuguugagucauugucaugaugacaguuuaggaauuuauuuucuuuuuuuuaaaaaaaucacagaaaauuuuuuuuuguuuuuggagacaggguuucucuguauagcccuggccauccuggaacuuuguagaccaggcuggccuugaacucagaaauccgccugccucugccuccugagugcuggaauuaaaggcgugccccgccucgcccagcuacagaaauauuuuaaagacuuaugcuuuucauuuaaugccaggugugggauaugacgcugcuucaguuuauccacagaaguggacucugcuguagcagaggugggauuuugcuagcagcagauaguuucugcaauugugucccauuuggaauucuggggacuuuuccuucugaggguagauaaaugcuaggaccccgagagacuggguuagucguugguuggucaugcuuuguuaaguaguuguuagaaacgaagaaauuagauguccgacaagaucaaacuuccccgaaggaacuuggaccuugaugccccuaauuagcaggaaguagucuagcaauaauguugaccccuuucaaaccccggcuuuauuccgugaucucuuuccuguccucucuuaucuagugguaggugguuaaaaggguggagaagguuggaagagagagcccacaaaguagccaaagacagcuacaagccaugucaucagcccuaucacuguuggauuuacauugguguuuacgguuagaguuuuugacucaacacacucugaaaaaaaauaccugguguacuugagugcaggaguuaauuuuguucucuuuugccaauagguacaauuggucacguagcucaugggaaguccacuguggugaaggcuauuucuggaguucacacugucagauucaaaaaugaacucgaaaggaacauuaccaucaagcuuggauaugcuaaugcuaaggugauccauguacaaugaaacuagaaaccacuuaacuguagguuuugcauacguaacuaaucuaguuguuucuuuuuucuuauagauuuauaaacuugaugacccaaguuguccuagaccagaauguuacagaucguguggaagcagcacaccagaugaguuuccuacagacauuccggggaccaaagggaacuucaaguuagucagguaacuuugaugcuuaaaucacugcuuugugcuuuuugaaguacuuaagauaccgaacacuaaacucaguugaugaaugguuucaucauuuugccauuauuucauguuuuuauuuuauauaaugauaauugaaagguaaguuguuuuuguuuuguuuuguuuuuuaauuaauuuuaaaaguucuacaaguugcauaagggagcuagagaggcucagcuguuagaucuguggcugcuccccagauuugauucccagcaucgaccugguggcucagccgcuuguaacuccuguuccaggagauccaccuuugggugcacuggacaugaaacacuuaagaaaauaaaauaacucuucuauaaaggcacacauugcaugaguaagaaaggaagggagagaaagcacaagucauuguauuuaaacaguuuccuuucugguuguuagcuaagaaugaaucccccccccgccccuuuuucaagacaggguuucucucuguagcucugccuguccuggaacuaacucacucacucuacagaccacguuagccaugaauuuagaggcccuccuuccuaucucugccccucaugugcugggauuaaaggcguaugucaccacuaccaggcuuaugaaucuauuuuuaaaauuacuucuuugaaaccaacaauuuucugaaugguuucacgugcugguucuuuaccagaggggcugguaccuaguuacaagcaucuucagggguugcaagcccauaaggccauuuuagaucaaggacagagucagauacucaucucaggcccaagauuuagggaagaaggggaauccaaggagucucaauaaucaggauacuuuuaauacaguucguuuuuaaguuuauucgacuuuuaugagcagugcuguuuugccugcguguauguuugucugggggugccaggucccuaacuggaguuagacaguugugagcugccaugugggugccaggaacuaaacccagguccuuuggaagagcggccacugagccaucucuccagccucacuuuagaucaauuuuuaaaaaauaauuaagaaaauuguaaugaauaggauauuggaauucuguuuuauuuagauagagucucaauauguagcccuggaacuuagagagacccaccugccuuugucuccuucccagugcugggauuaaggcuuauaccaccauaccugcucacuuuuuuuccuacaaaguugaguugggguuuuauugaagguauuuuacuaugcauguuaaacacuuagaugaagaggaggugcucagaaaaacaaacacuccaggguguggggacagucuuucaaaaaagucaccaguaucagacauuuaaauacaggccaaccagguuucggguauuuuuuugcuucuguaugacuuguuuugccuguuuguagugacaauuuuggaguuucuuuuuugguuucuuuaaaagacacagauuaugagacuauguuuuccuuuuagucccagguguaggauguggggcugcuucagagaauccacagcagcugacugguuugccuccugcucuagcagaggcaugauuuugccagccacagauaguuucuacgguugugugacauuuggaauucuggguauauaaaugcuacuguccugagaugcuauggucguuuguuuuuaaucacuuuguuagguaguuguacacaaagaagaaauaacaagaaggagaaauuagguguccugguguccucgacacccccuaaucagcaggaaguagucuaacaauaacaucauccucuuucucaccccuggcuuuauuuggggaucuuuucucucucccccccucucccucuccccucuaucuuuuuuucucucauguaguguugggguaaaaaggguguaagaaagaacccacaaaguagcaaagacguuguuugguuugguuugguuuuuaauagacaggguuucuuuguguagccguggcuguccuggaacuuucucuguagaccaggcuggccucggacucugcuugccucugccuccaaagugcugggauuaaagguguucaccacuaugccuuucaggcaagcuauugggguuuuuuguuuguuuguuugcuuuuuaagauuuauuuauuauuauauguaaguagcuaacuucaucuuuuuuugugugggcuccuguuuucaguuuuuuuuuaauuuuuuuuuauuagauauuuucuuuauauacauuucaaaugcuauccugaaagucccuauacccucccuccgcccugcuccccuaccuaaccacucccacuucuuggcucuggcauuccccuguacugaggcauauaaaguuugcacaaccaaugggccucucuuuccacugauggccgacuaggccaucuucugcuacauaugcaguuagagacacgagcucuggggguacugguuaguucauauuguuguuccaccuauaggguugcagaucucuuuagcuccuuggguacuuucucuagcuccuccauugggggccgugugauccauccaauagcugacugugagcauccacuucuguguuugcuaggccccggcauagccucacaagagagagcuauaucuggguccuuucagcaaaaucuugcuggcauaugcaauagugucuggauaguagcugacuucagacacaccagaagagggcaucagaucucauuacgggugguugugagccaccauguggugguuguugggauuugaacuuaggaccuucagaauguuuuuuuuucuuuagcaccaggacuugcaccaaaggccacauaugcuagcaggcaaaugcuuuaccacuaaucuauauuccagggucuguuuuuacuguuuaggcauccccuuaaaauguaaaccugagguaccucucuuaucucacucugguccuagcgcuggucagagauaauucuucucaaauuuuguaaagugcaaauguuuuuuuuuuuuccuguuuugugggccuuagagucucuguccuaaguacuuauuucuguucuucuauuacaaaagcacacguaaacuguauguucauguaugaguuuguggugggccaaaucugaggcccauaguuuucugauccuugaucccaguuuuagaucauggcaaugugagcauacauuuuuguuauuuuuaaaauugugacucuggggcuagagagaugacucaguagccaagaacauuuuuuuguuuuuuaacauuuuuuguuuuaagauuuauuaauuuuauguaugugaguacacuguagcugucuucagacacacaccagaaaagugugucagaucccauuacagaugguugugagccaccaugugguugcugggauuugaacucgggaccucuggaagagcagucaguguucuuaacugcugaaccaucuugccugaccagccagaaaacagaagagagauuaaaauaaaacaugaaaaguaaugcuuauaaagucaugacucugaguaccauaacuuuaaagucaugcugucucucacuuaagguacacgagucuaguuuuucagggguagugguauuuuggacaaaauauuuuuucaaaugaaaauucucauucucucuuuucuucauauuuauuauucuuuuuucuuucuuucuuucuuuauuauauguaaguacacuguagcugucuucagacacaccagaagagggcgucagaugguugugagccaccaugugguugcugggauuugaacuccagaccuuugaaagagcagucgggugcucuuacccacugagccaucucaccagcccauauuuauuauucuuaauuauauguaugugcuugucuggcugugcuuaccuaugugccaguaccuauagaagccagaagcaccaggcccaaagucuacgagcaacauugagaacuagcucccaugugauuugauguuaagaaaucuauaguuugggcuggugagauggcucaguggguaagagcacccgacugcucuugcaaagguuuggaguucaaaucccagcaaccacaugguggcucacaaccaucuguaacaagaucugacucccucuucuggauugucugaagacagcuacaguguacuuacauauaauaaauaaaugaaucuuuaaaaauauuuaaaaaaaaaaagaaaucuauaguuugcaugugguuuugauugaucuuaaggcugauuguuacuuuucaaucgucaggcauguuuccuuuguugacuguccuggccaugauauuuugauggcuacgaugcugaacggugcagcagugauggaugcggcccuucuguugauagguaagucaucagaauggagagcuaaucugaguggaagauuucaggaagaacugaaaccuugggaggccauguccauuaucuaagugaggcauaaauagaaaugugacaugcaggauaccauuuccuucgagcauaucacaaacagcauaacauacuaagcaaauuaguccuggccuuucuggauucugagaagccuuagaguguccuaaaagcaauguggcgugguuucucaucuuauuuccauucagaauuggccuuaaagcauauguauuauggguugccccuccauguagaugauuuauuuguaguaauugccauggucugguaagcaugugaguuuucagaguuaaagcuguguuucccuaugugugcuguuaagagauuggacagguaugaaugguaauuuuagguaugcgagaggauauuauuguacaggacacaugaacagacugagcagggcaguucuuagcaugcugagcaaauuugcccguugucaaguacuguugcuugucucacagcacucuuguuuaaggaguagccuugaggcuaagccgccuccuaagagcuggcguguaacaggacauauguagacuacauugagcuagaaguccuaagcauaagcucuugaaggcauucuuggucauuggaagcuucuugcuuaggacugugaggcugcagugagugaagauacaggguaaagcagaguuggugguaggauaugugcauaauguaacccuuaccaguuuaucagugagaaggaaguacaaguaaaauuucacgaccacaaaagugagccuccugacuguucagcccucacugcccaguucuacucccuccagccccugccugccagcuaacgaucugccuucuauuuuugaaacugaauggucuggauguuucuagucauucuuacccauguuuuuuauucucugucaacuagcugguaacgaaucaugcccucagccccagacuuccgaacaccuggcugccauagaaaucaugaaacucaagcauauuuugaucuuacagaauaaaauugaucugguaaaagaaagucaggcuaaggaacaauaugagcaaauccucgcauuugugcaagguaagaagcuauaauggcuaguguaucagaagaucauuuguaaauauagguuggcauaccuguugcuuuuucuacucccuacuuguugggguccugauaagacuguaaaugguauuucugaauuuaauguacaauguuaaaacugaagguauauuuuggaaaucagaugaacuguuuuaaaucccaagagcuuaguguauauguauaccucaaugguagagugcuugccuagcauacacaggacauugaguucacaucacugccuuucaaaaaaaaauucuuagugauaguaaaaugaauaaaagaauuuaaauacagucuugccuugcuacucagcaucaugacacaugucuuuaauccuagcauccuagaggcaugggaaggcagaccucugacuucagggccagcuuguugguguguauagcuaguuccaggccagcaagaacuauauagagagacccugucucaaaaaccaaacagcaaucuuuacaguguuccuuucuuuaguugugauguguguuacuauugacaguucauuauuuuuuaacuuuuucuuguugggaauccaguucuaauacgagaaagaauaauccacuuugauuaaaauccauuuauuuuugagcuauuucuuugccaguuugcuugaugaaaaaauauauaugccagccagucuuugauuaucaaagagucuguaauuuccucuugacauuuaugggaagguuaauuguauguuaggaaucuuuuagcugguaaagugcucuuucccaggaguguucguguuuuauuccuuuaaacacaucauuuugccuuuguuaacuaggcccagugaaauaauuuuagcaguuuucccuuuaaaggacaaauaauucauuuucaggaguuaaagauagaauucguguggaaauguuuaggccucuguuaggucuaauuacuuuaucuagcguauaaaucaaguuuuguaaaacccaaggauuuugauccuuuuggaauuccuuauguaggaaccguagcagaaggggcaccaauuauuccaauuucugcucaacugaaguacaauauugaaguugucugugaguauauagugaagaaaauaccagugcccccaagagacuuuacuucagagccccgucucauugguaagugacaggagucacaguuaacuggacucuuccgugcuucuuauuaguaucuucucuuucuacagagggcauguaaauucauaaaaccuauuugaaauaaugucuugagauuauacugcugguugacagaacucugaguacaaaagaaacccuuugugcugacuauaugguauuuuaggugaccaacagggaauuugaagggauuacaagcuguugagguggugcaguuucgauacaaaugauggcauuguaccauugcugaaaaaccaauaggcuuaauuucaaaguaaacuuagccgguugugguggcgcacgccuuuaaucccagcacuuuggaagcagaggcagguggauuucugaguuugaggacagccagggauacacagagaaacccugucuggaaaaaacaaaacaaaacaaaacaaaacaaaaaaguaaacuuguacuuguagaagccauaaaacacaaaaguucuauauauaaaauaccaagcaugguagcaaacacauguaaucccagcacuugggaggcaaagacaaguggaucucugugaauucaaggcuaaccucgucuacgggugagugaguuccaaucagucagggcuacauagugagaaccucucucaaaaggaauuaauuaauuaacuaauuaauuaauuaaauggcaaacuguguguacccaaguacagucucuuguaugcuucauugauugacauuucuggugaagcuggagaugcccaaggccucauacaugccaggcaaggauaguaccacugauguacauccagucuccuccuguacgccuuaaggaauaauagcuaauuuauuguaaauacuauguaaauaguuaugauaauuacgagauaauggcccucaccaaaaaagggggucaggggaagacuuugcucaauacauagguuuuuuucuccuuggcugguugaauuauauagaaccuuaaaugugaaggacaagccauaagccguguaucuauagugccugcccaggaacugucuuugguccugugaaugaaagacacacacacacacacacacacauuauuagcuuauuuuaacaugccuuacuagcucaguggcugggcacuucuaagucuuccuuagcauacccuuccuuccaguacuccuggcucaacaccuucuaaaucuacuuuuaacuuugcugcccuguuuccuucugugaagcccauuggucuuugcugcccaagaugcuucugggcagcccuuccagggcugcuuucccuuuccuccuacauuucagauaaccuccuuucugcagcucuaacuguccgucucucuucauugccuccuccuccucucccucuucuuccuccuccaccacacagcugcuacuuuuuucuuuaacaguacacagaaccuaucccagaucacuacauauaauuuuaacauuaguuucaaauggauguaugauauuccaugguagagacccuuuuauaguauugacauacuuuaauaaacuaucuuuguuuucuuuuuuaagauuuuauuuauuguacauauaugaguacacuagugugucagacaccagaagauggcaucagaucccauuacagaugaauaaaccaucuuuuaaugaacuuucaagcuauuucuugggguuuguuuugguuuuuuguuguuguuguuguuguuuuguuuuguuuuccuccuguuaacacguaagacuucagcaaacaucaaagcaauaucauuagguuguuuuuagaaagguugacuuggaaaauaaugucaucuaaagcuaaaauugaaguacauagaaauggcuuuaauuuguuuuaaauuuuucuuuuagucaucaggucauuugaugucaacaaaccuggcugugaagucgaugaccuuaagggagguguagcuggugguaguauccuaaaaggaguguuaaagguaaauuggauuugacuuguuacucuguauauuugguuauuguguguaagugccacaguauauauagguaagacagcuuuucagggguugacucucuuuccaucuagugugucucugggauugaacucaugcuaucagguuugaugguaagauaagcaccuuuauccucugggccaguucaucagaccacccuuaucuuaaucugccuuccaagugcuggggcuaaaggaaugcaccacuaugcccagugaaaaauguuuuuuccauggugucugguauuggauauggauuugguuuugucuuuggaagaugugugaucucuaaaacuauaguuuuccagugaacauggaacauauuuuaugugacaacagguuuauuugguacuuuguaacacuuagaugggacugauuuuaaauuuuucuuuuagauuuguuuauuucauagauauggguggugguugucuccaucuuuccaaggaggccagaagaggguauugaauccccuggaacuuagagaugguuaugaguugugagcugcuguguggguacuaagaacugaucucuggucuugugcgagagcagcagugcucuugaacuguagagccaucuggcuccuccaugccaguuuuaaaaaaaaaaaaaaaaaaauagcugagcauaguaguguacaccuuuaaauacggaggcagaagcaugcagaucucugauuucaaggccaggcuggucugcagagugaguuccaggauaccuggggcuacacagagaaaugucucaaaaaaacauauauauguguguguguguuuuuuuaaguaauuuuugaccuggccuggugguaugcggcugggaggcagaagcagacugguaucuaaauucaaggccagccacuucugccuagugaguugcaggccauaaaaaucauaagaaguaaauaaaaguaaucuuuuuaguuuuguggacuuuuuguuauaacauugguaggcaaauaauaaauguauuguuuuauaauucuccuugccaauuauguguuuacagguaggccaggagauagaagugagacccgguauugucuccaaagacagugaaggaaaacucauguguaaaccaaucuuuuccaaaauugugucacuuuuugcggaacauaaugaucuucaauaugcugccccggguggucucauugguaaggacuuuccucucuuuuaguuuguugagauucaugguacauuucauaguaaagaucaaagauagauuguaagguuuguuuuguuuuuaacacuuuuauuuuuauguauaugauuuuauuugcauauaugucuguucagcuuguaccaaugccaaagagggcaucagaccagucugauagaguuucagagaugcugugcugccuugugaguucuaggagccaaacccagcuucucuacaagagcaucaagugcucuuaaucacugccaucucucuaccugcccuuugguuguuuuuguugugggugguuuguuuugguuuuuuauuuuuggggguccuuauuggccucagauucacaaagauccaucugccucuuccucccaagugcugauauuaaagauauguccuaccauguccuguuuuaauuuuuuaaagacauuuauuuuauguacacgaguacgcuguagcugucuucagacacaccagaagagggcgucagaucucauuacagaugguugugagccaccaugugguugcugggauuugaacuuaggaccucuggaagagcagucagugcucuuaaccccugaaccauaucuccagcccauuuuaauuuuugacauagacucuugccauguauuuuuagcuaggcugguacucaaggcaacccucuuggaucagcuuaccaagugguagacuuacagguguguaccaucaaccuggcuuuauuggugcaucuugcaauguuuuaaagagaaagaacacauuuuggagcuggcaguaugacucagguaaaggugcuugcucacucaaacaagcauccacauugcuaaugaauaauauuuuuaaaguacauuuuaguaggagauacuuaguagcaacaauaauuauuucuggcuauuauuuugaaguacuaggguuuagaccuaaagucuagaacaugcuaggcaggcacucaaucacuaagauauagcccucuuuguccucuguuuucaaaauuagauuacuauuagauuauuauuuauuuuuacguauguggaucaugucuaugcacauaaaugccugccuaguugcccacaaaggucagaagaagucauugaguccccugagacuaaaguuacagacaaugugaacugaguaugggugcugggaauugaaccugaauccucuggaaaaguagccagugcucggaagucacuaaccaaucucuccagccucacucuuuuuccuuuugagaaaagaucucacaaaguuaccuuguccuugaacucacuccauuucaggcugaacuagaacuuaaggucuucccgcgccucacuauguccaaucccuggaauuucaggucugugcacugugccugacacagaauaaguuugauggccuagcacucaaaacacuauagcuauaugugcuuuguuugggggaaauguggcucaggguuggggaugucacugcuuuugcagaggucugaauuuaugagcagcucucaaccagcuguaacuccagcuccaggagagccaguaccuucuucuggugccacacuuaaccuacgcagagccacacacagagguaaacauauacacauagcuuaaauaugaaaaauaagggccugaagacaugagauggcuccacguugaaaagcacugcugcucuuccaggggacccaguuucuaguacaacucacaacagucuauaacucuuugcauggugucugucgcccucuucuggccucugugggagcuacaugcacgugaugcucucagacaucaaaacacaaaggggaaaaccuuaucuaaaaaauuugaagggagaauaagaaucuuuuaaaaaggcuuguucuaaacauuuucacugaaaauuuaaaugaaagaugugauggccuuuaaauuugaggcaaaggcggguagaucucuguaaguuggaggccagccuugccuacauguuaggaccaucugaaaaaaaaaaugcugcauagugguggugcacgccuuucaucccagcauucaguaggcauaggucagccugguccacagagcaaguuucaggacagccaagggcuccugcacagagaaacccugucaaaaaaaccaaaagccaauuaacauagaacgaguauuuuguuacgcuugccauguauguaugaaaauggaaguacguguaaaagggugucaguucuuacuagacuuugaagucaauuauuccagggguauuuuagauaauaaggccuggcuauauccaucuuacuuuauguuaggaguuggaacaaagaucgaccccaccuugugccgagcugacagaauggugggacaagugcucggugcaguuggagcuuuaccugaaauauucaccgaacuggagauuuccuauuuccugcuuagacgucuucuggguguacguacugaaggagacaagaaagcagcaaagguaugugcuuuguauaacucauguuucugggagggaugagcagcaaggcuagacucaguuuucuucuuucauaguuaauaugcagugaaugugugaguauguugacuuccuuuuaaaaaaaaaaaaagccaggcauggugucacacgccuuuaauccuggcacuugggaggcagaggcaggcagauuucugaguucuaggccagccugaucuacaaagugaguuccaggacagccagggcuacacagagaaacccugucuccaaaaacaaaacaaaaccaaacaaacaaagaacagggcuggagagacgacucagugguuaagagcaguggcucacagccaucuguaauaggaucuugggaucugacacucucuucuggcaugcaggaauacauguaaaacacucacacaugaaauauacauacauuuuuuuaaauuaaaaguaaaaauuuaagacuagccggaaacaguacaagccuuucaucccagcauuugggaggcagaagcagggagaucucugaguuacggacugccaggacuauacagaacaauccuauugagguguggggaggugggggaaaucaagagcaacucuguggcaauccguuuuauuuguuuguuuguuuuuuaaauccucaccaaaacagaaacuauuuguuuggcuuuuugaggcagggucucucaaaguagcccugucuguccuagaacucauguuaaucaggcugcucucaaagucacagagaccagucugccucugccuccugaguacugugcgccaccacacucccgcuucagaaagugcuaucuuauguguuguuccucuuucuccaaauuauuuuccuagguccaaaagcugucuaagaaugaagugcuuauggucaacauaggcucccugucgacaggaggaagaguuagugcagucaaggcugauuugggcaaaauuguuuugaccaaucccgugugcacagaaguaggagaaaaaauugcccuuagcagaagaguugagaaacacuggcgguaaguuuuguucacuuugccacugucuauuaaagagcuaaguucuuguuaguauauguauggacacacuuccccuugaacacagcaguuagggugacuuuagugcuuagcuuuuuucuuugguuggucuauaaagcuauauuuauacucuugauuuauuuuucuuucuauuaguauaaguacuucaauuggcuucccuuuguuuuagguguagccuauacaaaacaaaacaaaaaaaauucaauauuuccaucuuuugacuccccccccuucauuuguuuaauguguguguguauguguguguguguguguguguguguguguguguguguguguuauagcaacuuauguaguugguuuugcagccaugugaguuccaagauuuggauucaguucauacaacuugacagcaagcauccuuuuuaaacauuauuuauuauuuguguguguguagguguaggugugcacacauaccacaauauguaugugaaggucagagaacaacuucuuguucuaccauguggguucuggggaucacagguagucaggcuuggugauaaaugccuuugucugcugagcaaucuuuaucagucuugaacuuuauuauuauuaguaguaguauuaguaguauuuuaauuauuaguauuuugaucugcagggcaacaguggugcacaccuuugaucccagcacuuagaaagcagaggcaguuagaucucugaguuugaggccaaccuggucuacagaguaaguuguaauauaggacaauuagauguauuuuuuaaaagccugucuugaaaaauaaaaaaauuuuuuuaaaaaguauuuugaucauacucaguuuuccccagccucucccaggucugccccucauaaacuuuguuuugggggaaaaaauacuuuagcccuggcuagacucaaacucacagagaucugccugcuucugucuucugagugcugagauuaaaggcaugcaccacuauaccuggcuaccauaaacuuuuuuuuuuuuuguaguuaacauugggggcuggagagauggcucauugguuaagagcauuggcugcucuuccagaggauugggguucaauucccugcaccuacauggcagcucacaacugucugacucccucacuagacauagauguaggccaaacuaaaugcacauaagaaaaguauauauacuuaccaaugacauugcaagaauuguauagaaaacucauaaauaucccuugucuagaaagauacacacacacauagucacuuguguaugucaugccuuuugaugucuuaauaguuaagcaauaucucuacaaaacaagggcauucucuuucuuucuuucuuucuuuuuuguuuguuuuguuuuuuuguuuucgagacaggauuucucuguguaguccuggcuguccuggaacucacucuauagaccaggcuggccucgaacuaagaaauccgccgccugccucugccucccaaguggugggauuaaaggcgugugccaccaugcccggcuggcacucucuuucauagccaagaaauuuuuuaaaaagauuuauuuauuuuauguaugugaguacacuguaccuauacagaugguugugagccuucaugugguuguugggaauuaaauuuuuaggaccucugcucaccccagucaaccucgcucacucagucccugcuuguuccggcccaaagauuuauuuauuauuauaucuaaauacacuguagcugucuucagacacaccagaaauucacaccagaaauugaacauugaagccugggcuacaaaguuuuaugccauucugcacuauagacugaaauucuaucucaaaagaacuagcuaaggcuagggagauggcuuagccauuaaugugacugcuuuuccagaggacucaaguuugauucccagaacccacaugacagcuaaugacuaacucuaguuccaggggauucagcucucuugucugaccauuguggguaccagacagacacaugugcauagauauauauguauguauagcacccauacacaugaaauuaaaaguguugggguaggggcuggucuggagagauggcucuugagagcacugacuugcucuuccagaguuccugaguucaauugucagcaacuauggugucucacaacuauagaaugggaucuggcgcccucuucugguguaaagacauauaugcaggcagaacacuguucauaauaaauaaaugucuuagccuggcggugguggcgcacaacuuuaaucccagcacucgggaggcagaggcagguggauuucugaguucaaggccagccuggucuacaaagugaguuccaggacagccagggcuauacagagaaaaccugucuggaaaaacaaaaaaaacaaacaaacaaaaagaaagggugagagaggaagcuggauugugguggcacauaccauaccuuuaauuccaguacuugggaggcagaggcagguggaucucuguucaaggcuagccugggcuaauaguaaaacuuugucucaaaaaacaaucaaucaaacaaacaaaaacaaaacaggagcuggagagauggcucagcagguaagagcacugacuguugguugcugggauuugaacucgggaagagcagucaguguucuuaccuguugagccaucucaccagcccuauauacuuacucuuaauuacccuugaaauuaggaaaaaacaaaacaaaaaccccuaggagacuagauguaauaguucaaauuaauccuugcacuugagagguagguacacaaggauugggacuccaaauucaucuucagugccaaauucauucaaauucaucuucagaguuugcaggcaaccugggcuagcucaaagaaacacauucauaggaguguguauauauacgcacacgcagagacagagagaagugugugggggagacccuguguauguaugcaaaucucccucccuccugcacuuaucauucacuggucauuuuuaccuaaauugaacuuuauugaauguuuggcauuuuuccuucccauuauugaguacccgcuuucauaauacagauucacaggguucuguuuuguucauuaggcuauggucuguuguucuguugcuauauuuuauuuugauguacaaauuguccaagaguuugucaguggggaccuuuaagcugguuccuguauccuuuuauccauguuguauuuuauggcuucuuuugguacaagcuuauuuucuuccacaaggggcuuguuuuguaccucucugcuucaguuuuagaauuggccauuucucuaaaggaaugaacuaguuuuuagaaauaaaggucuaugcacuaucuggaaagcacacauuuaucuuugauuucugauucuggcuucuuucccaaauuaguaauugagucuacuccuucaccauuccucgaugcaucaugaucuauaacacuaucauuuuaacuuaaaagguuguagcaaaaaaguccugcuuugccuuaucuguugauacuuaagggcucaaucagaaugaguugucuaaacauugacacgaugcuacacuaaagaauuucuaauauuuucuugcugguugaggauauuugggaucuuucuggaaaccaguuuugguccauuuaaucuuuucuguagguuugucuaaaauauauaccucuaaagaagacuacuccacagccuggauuuuccccaaauuuuccuugugccuuggcuguguucuucacugccuauuccuuugucagucuuucuuugguacugugcaggugauaguuucucauugcauucuugccaaaacaauugaucugaauugucaugucacccugcaguguaacaauuauuaacuuuuuuguuauuucuaccaccacuuccaccccccccccccaaaaaaaaaaaaaaagacagggucucucuauguagcccuggcugcucuggaagucacuguauagagcaagcuagcuuggaacucacagugacccaucugccucugccuccugaguacugggauuaaagggacaucuaucaccauugcuagcaaaguccugcugugcaaagcagucugcuuggaguuccugugguucuccuuuucccagcugauguuaucuaaagacauugugaucagaugaggcacuaugaauggaaagaaagcauuuuccaaagauagacauaagaauuacaguuugcuuugguuuuuaaaucugagcuugguauaguggcacaggccuuuaauccuagcauaugggaagcagagucagguggaccucaaguuccaggucaaccuaguuuacaaagcaacuuccaaguauacaaaauugcauagugaaaguccuuuuccaaaaaaagaaaaaaaaaaccacauauacagacagacaggcgcacgugcacaagacguauuagagauguaauuuggguggucugaagguccccuaggugaaucugaauggguaggugguuuuuuguuuuuguuuuguucuuguuuuguuuuuuugauagaccauuaaagauaaauauguuuuauuuuaugugcaugauuuuuugccugaauaugugcacugcaugcuugcccaaugcucaaagagguugaaauugcugaaucugugauugugaaccaccauacgggugcuaggaacugaacccagaguccucugcaagagcagcaagugcccuucauuauugagccauugcuccaaauaacuuagguuuuguuuucuuugauacgagggcucacuuuguagaccaggcaguucuugaacacaaagaucugccuuccucuacuuccugagugcuggcaugcaccacuacaacuagcaaguuucuguuuuuuaagaugugauuuccuguugcccaggcuagccacacauuuacuauuuagccaugaaauaauuccucacuuuccugucucccaaaagcuugaauuuauaggcguguaguaccauacccaacucacuauuauagacguuguuugauuuucuuuuguuuuuuuuuuuguuuguuuguuuuguuuuuuuuuuuguuuguuuuuucaagacaggguuucucuguguaucccuggcuguccuggaacucacucuguagacaaggcuggccuucaacucagaaauccgccuaccccugccucccaagugcugggaucaaaggugugcgucaccacgcccggugacacgacaauuuucuugucaugcuauucagcaucccuccaucugcuuuuuaaagucugagaaaauggucuaagcuuucuuuacggagaagcagcugaauuuagaaaauagacggguaaugcaugguuguaugauaguguggugauuccaguccggugggggugaagcucauaaucucuucuguuuuuauuuugcaguuuaauugguuggggucagauaagaagaggagugaccauuaagccaacuguagaugaugacugaagacuucaaguuaaacaaugccuugggaaggaguuggaauuucuuuuacuagccuagggguauauuuucaaagcaauacuagaaagaauuaauuuccuagcucauuaccuuacuaguagcagcuauaaauuuauucuuauauuuuggcgaugaaaaugugaccucuacuuuuuuuuuucuuuuuauugauuccuuguuugacaucauguagcccaaucccauucauccccucauauccaaccuuugcccaugcgaccucccccaaaguagcacaccaacaacagaacaaagccuagaaaacaugccaucguggaagcuguagcuucugugacaacaacaauguuggcuccucaucaggacucccuccaguuauccuguugcugcgcugugucauagagauccugcagcuuuggaacagcaggguggcccuuucacgauccccaccauucgaacaugacauagauuuuaggugggucaauucagagccccggauaagggccaggaugguagcugagcuggucagcuggggcccauucuuccaagugcugcggcuugugagagccugggccaauucucccuacagaagguggcaacgggggagggugucccauccacaccaccucauaacagacaaguggcagggccagcuguccagagugcuauauccaaugagggaugguggcagaccugcacagccucagacacccaguguucccuagugguaauaaugagccauggacacugacccaccacuguggauccacagacucaaacaaggcccugauggcagggaugcccacuuauaacaggcuacuucucuccacccuugaauuccuuuuucucucccgucugucauggugacaagcagguaucuaugcuuaugcacuggagggcaggacuguggguggcauggaggucuacaagaccuuguguuccucuucucaugccgugcugccuugcuuuaauuugauuuuuaugaguccuaggcauaagacaagguuuggccaucaagcuaggaugaacaaaggacugccaucugcucugccccugauaaagaacaauaccaccaauaaggggucucugcugguugcugggguuguaaccuacuucuaauauggggcuuaaaauuaaaugugaaaagugguauacuauauacauuggaucaagucuauauaguagcuaaaauuaagcauuccaaaguaaugucuaauuuaucaaucaaugaaaguuugaagugaaacuuggcugcaaccagucuuuggcguagcacuuguaucaugaaccugucuaagaugaaaaugaucucuucucaugauucaucugugaguagcuccauagugaagggcaauuaguaaaggcuaaagacuuaccccuuuauuuguccuucuauuugggguucuguugucugaaauuugaaggaauacgaccagugggcucaaaugagcaccacucuuagaaguugugugcccauucccuuaacacagguagaucugucuuacccguuuccugggugggaccuuaggaauccagugcccugagacuaugucuuuauuauuuaugccuaguaucucagucuucccacacuggcaaagaguauagcaacuggugguuagugauaauugacaagguucuguccaggcugcuuuuuugaggucuuuguuuuaguaagcuaugaauggagcugucucuugcaugaugaauaaacacucuaccauugucuccacugccccuagcuguaguacuggcugauaggauuaugguggaaauuguguuauugguaaucuuugagccuugagagagguagaaauuguucagaaacuguguccucugguuucuaaaucuauuccccacgugccuccaauuuucuugugcugugcauuuuaaauuaaucauguuuuuucuuaauuaaauacucuuucacagcaaugauuuccaacucuggcugacguaagaauugcuggggaaguuugaaggggggaaaaagaaagcucugggguggaguccaggcuuugauaguuuuuuuuguuuguuuguuuguuuguuuuuuuuuuuugaggaaaccuauugauauauguauuugauugacucuaaaaaguuguuguauuggaacaugaagaaaacauuuaaauaaaacaagauucugaaacaagcauuaauug

SEQ ID NO: 9620 - RNA, 38931 nt, Mus musculus
ggaagugacgcgccugggcugaaagauggcggcauuggcguucaaccagggggaagguaaacacccgccaggcggcgcgccggcccccacggggcgccuucaggggcuaagggggccucccaggccugcucccuaacccacggcuuccaguccccgcccucucucggggacaggcucggcucugcguccucgagacccuggcccgggccccuagcccgugggccccgccccccugggcgggccccgggcggcucccucggcccgcagggggcgcgaggcccggagcggccccuggcucguggcccucucacgccccgccccuuucccgccccuuucccgcuuuccuccacccccggcgugggugaucccgaggcuccgcgcgcuuugggggcagaaacccggagacgccgucguguaugugguucccgcuggcguuucuguugcccucggcccccucagcugucccccaguuggugguccugagucgccucuccagccgagccccgugcagugccgcgacaucccccgguauuggcgaggcugggccccggccccgacgccgcgcgcgucacgccuagcccaacuguuuggacucgccacucaaccgcugucuucuuucccaggacuguuucucggggggccucgggcuugcgagcucgcccggcgccggagcgcuccggcccggccagggagcggccccuuguagagguucgaggagcuaucgcgguccaucccggcgcccgacccucccaccguucggccacuggcccacuucuuccugaugcagacugccguccacuagaggcuggacaggacccccgaggugcguagccgccccuggccgccggccugcggagcccaggcuuugcucgcggccccgaggaaggcacggguuccguggcccucaccgcacuggccgcacucaaacauuuuguagaugcugggagcuaauuugucuuuugaguuuacuuaaauuguuugaaauguaaauuuuuuucuggugggaggggggagagagagagagagagagagagagagagagagagagaggagaaaaaaaggaagaagcauaauucagccauuuuuugcagcauagagcugcagguaccaugauuauuucccccuuaaccgguuccuucccuuuaaaaauccuguuugugccuuaaauagaacuaugcgaaaugugcggcauaaugcgugcggcauaaucagaaugucuggguccgacugggcgacugagaaaaucucgcacugaggagaucucggacggagccucaguuucuuaucuaugcgguguagucgauaauagccacaucagagagguagugaggacuauaugaggucauauaugugaaaauaaucuauagcuguauagugguguaggaaaauguaaggucauuuucuuuagguaaccuuugcuugagugguuaauguggcuaacuguugcugccucuucauuucuauauuauaaguaaauaaggacuagcagaacagcgcagugauggauagcuguuuaauagucaguguucguuggccuucccucuacaaaaugccaacugcuuauuuaaauaacgguauccuuuaauucaaauuuaauguuacuguagggcuuuucaucuuucuaggccucucagcccccuuucuuauucagaauauuuaacaccuuauauuuauuuagucuuuuuuauuuuuaagagguucacuuccuuugucaaucugauuuacuguugucauuuuaaaagcguguguguuuuuuaauuucaguguuugcuuuucguaucuacagaacaggaugacugaauacuucuaaucauuugaaaaugguuuuucaagagcuuacacaugcauccauguuucucuaaugcucaguagauccagcaauguacagggaauuucaacuuguuagcacuucaugcaauauuugaggaauucaguucuuguuuuuaaucacagcacuuaguaggugcuuugagucccauuucaucagugguaaaggauguuaauacucuuuacuaccuguuaauuggcaagaaauaagauaguaaauauuuguggcucgaaaauagaauuuacuuucuagaguuucaaaacuguagaauguuuuggcuuauaauagucaauuaaaagcgaaaggagcauuuuggaguauauuauuuuuagucuucuuuuuuuuucugaguagauguuaaaauuuuaauucccuggucugaugccaguggucuuucacaguaugcuuguguauuuuuuaaaaagacagauuagguuggaaaaggaacagccagcuuuaaagugacugcuuuuauauuuuggcuuuaucccuuguucugaagauaauuuucacagaucacuacuuuacugagcauuucugaguuugaccucucugccuugcuguggguuaucauggagccaaggcugacuugacuggcuucauggauguucagaagccaggcuuuagacuugguuuaaugauguguguaaaccagcaucgcacaauauaaauaaugguagaauuugugcuaagaauugaaaauuuuuauuuuucuuuauuuaggacaacauauaccaacaaguagaaacauaucaugacaagucaagagagaugggagaaaggaaaagauguuauauuuuaguuccuuuaacaguuucccccugauuuuagcucugucccugugauguugguggccuauggucagguuuggggacugaauguuacaugaggacaaugacucuugaccugggugggggaugugcuguagauuaauucgcugucagacauuuccucagaaguagagugcuauaggccauuugggcuuuuuuaaaauuaaagaacaaaagcuggccauuagugagggcuuguugaaauagugguuuauuaggaagggguagaucucagaagacccuagcuccauaauuugauaucauaaccuuaggccaguaacuuaaucucauaguuuggauuuuuucaucuuuaaauugaagugguuauagaacauggaaguuugugaaguaaauuugucuguacaugaggcauuuacuaagcauuuccuaugugccacauacuguucuaggugcuggagauucagguuaguguuaguaguuuuaacaagguuuuguuuucucccccagucguucgcuauaacccagguuugccuuaaacuugggguuauccuugugccucagccucccauaggcacauguaacuauaccugguacagaaaguuaguuugguggcccauuucuaugguucuagcacuaggugguggagacaguagggucaguucagaaucuuccucagccuggaauaugagacccugucucaaaacaaauuacuucagcauaaaauauagggaaaaaauaaggccgagaguggagauaaagauucuuuuuagauucuuuagaggguuuuguaacuucuauuuaagcuuuguuuguuugcuuuuuuuugagacaggguuucucuguguaguguuggcugucuuggaacuccuguguguagaccaggcuagccuugaacucacagaaaucgaccugcuccuaccuccugagugcugagaauaaaggugugugccaccaaguccauuggguucuguuauuuuaagacggguuugggacaagggcucacuuccuagugaucuaaagagagucauagauaucuggauagagugauucuagccagagaggaacaacaaguggagagagucugguuuucuaggaacagcagcaacaaaaggggggaaugaagggaaggagggaaggagggagggagagagagaaaagaaagaaagaaagaaagaaagaaagaaagaaagaaaguguguguuaguugcaggagcauaucacugccauuuuaggaaccauuggcaaggcuuuuaagucaguucuguccuagguauaccuuguauuacuguuggcauaaaaauaaaugaucauggggcuggagagauggcucagugguuaaaaacacugguugcucuucuagaggaccuggguucaauucccagaauccauguggcaccuuuagacccuaaacuauauuggcucucauggccacuaggcacuuaacaguacacagacauccgcagcuaaaauccauacacauaauaaaauauuaagaaaauuuaaagcauaggugauguuuuaaaucugaaggucuccuagaucuuuaauucaaaggugugagaggcaaaagacagguucucugaguuaaggcuguccagugcuacaaagugagaaacccugucucaaaauaaacaacgugcugccccaccccuccaauagaauguaaguagauguccuuugguuuuuugauuuccuuuguauuuuugagacaagguuucugcagagcucugguugucguugaacucaccuuguagaccaggcuagccccauacuuagagagaucugcuugccucugccucucaaguacuggcauuaaaccaaggagcaagaggcuccuuuacgcauugagccaucucacuggcuguaggauccuuuaaaaaauacaauuaucugucugucugucugcuguguuugcauacauguguacaggccauacaacaugaguguggaggucaaagaaguacuuguaggaguagguucucuacugccaugugggucccagggauggcacucaagucauccugcuuggcugcaaccaccuuuacccacugaguaagcuuagucuucucucuuuaaugugagauccuuaaagcuuauugggcugggguauauuucauugauagagcacuugcaucucauguguaaagcccugggcucugucugcaagcauugagggaaaaaucuagcugaauaauugaaacaaauaagaacagauagaaaaagucuuuuuuguccuugauaauauuuuugaauuuaguuaauacugcaucgugaacuugcaggaaaucuguaucauaacagcaggagcuuccaaaagauucauguuaguuauauaauucuugggggagaauagaaugcuaacaguacaugauuugugauuucguguuaaaaugcagcuuagaagauuugggauuuuauuucccaaaugagacuguuccuagaauucucacuggaugcaaucucuaaaggccagggaagcuguuuuccaugacaucacucuugggcuccuucuucuuguaguaaaggaguauucaagaugaaaaauagcauugaaauagguggguuuuccuuaguuuucuuauauuacaggaugacuaaauacuaaacgugccugugaaguaaacuaauuggauaauaggugcagucuuaaggcuggaggacuaggucuuucuuaguuguuuaagucaucauuugcaguuuaguacuugagcuauaaaaauauuuugaugacaagaguuucacuaucaaacgaauacacaguccuuucucccaaauucagcuguguucuuuacgauuuagguaguaguauauauuugaggguaaaaggagugcuucuuagagcuuaaaaaaaaaccucaaaacauauuuugagaaguuggcugcuuugagauuguugaguuuaaaauuaacggauagguuauagaaauugugugagauuuuaugauuuggaaauuauuuuuuuaaauaguaagugucacacuuugauuucaauaugcaaguauggcguuuacuucauaggugucauuuuugguagaacaguuacaguguccauuaaggauaaacaguaacuguucgagaggcuagcuuuuauacugaacagcuuacaguuuuguaugaguuuucaggcagcuuugggaggaauaugaaagcaguuacccccaccaggcuucuuccuuuacuggucacuagagaguuugaacuguuagaaauuucagugauauaaauagcuguaauagucuuucaaagcagaauguguguguguguaugcgugugcgugcacacgugugcaugugagcucucucucucucugucugucuguauguuugcauguguucaugauuuguguagucaauuaucuucccuucacugauacuuuuuauaucucauagaauuuaucuggauucuaaagaacuuugguuuauguggguuguauugauuuaugcagaaaccaauacuagggaauuuuuaaaugcuuguaauucuuuggaaaaguagcccccuuaaaguuacauaaauaaugguuuuuaaugaaaaauuucuaucuuccauccuccaaaaaauuacaaaacuguaauuaaacacuugaaguuagguauaguggcucauccaagcacuugggaguuugaaaaagaauuugugaguucaaagucagccugagcuauagagugagacccugucucaaaaaacacaaaacaaaaauccuugauaauuauuuuacugaccauauuuuuacaaaucuuucuguaacauuugggcuuauaaaaauaugacagguauucacauucuggauacucauuaaaucaaaaaguaaagaugagagguaaguuggggggggcuguucuagguauagaauuuaggaaacucaugccugcuagguaaguguguuaucucugagcgacaguccuaguccguauaacuacuuuuuguuagcccugaagcuuucuaauauuuugagaauaaguuugaccuugacaaguccuuucaggugacuaggacucuaguucuaguucucuuuagacuauaucauaugcucgaagacaugaaucaguguuucuccuacccuguguguguguguguguguguguauguaugcaugcauuacauaugcauauaugcacguacugggaauugagcucugaauccagggcccucuaccacugagguauggacuaacucucuagccagcuccccuccccccaugcuuugucagugccaaguugauaaaacaagacacauuguucagcauuucuuguucagcaugccuuguaauuuagguucauuccucuuuuggaaaaaaauauuuuaaauucugaaggccaaguauagaauauguacacauuagguuuauaagccauaauuugcccugaucugaagauacauuaugagaaaugaggauauagaauuucugaacauuuaccauuuugugaguuaguaauaauuuucucaaaagccccuuauuaauuggauuuuuucccaauccucauugaucauagaguuaacuauuugaguuuuguguuauacuucuuauaauuauuauuuucuuucuaaaauugguauaguucuguagagaauuuuauauaagauuuuauaucuuuuuuacagucuuaaauuugcuuuuccuaauuauuuuuuaaauuuauguaaauauguguuuuuguaguauaauuuucuuuuuucuguuugaguuucaaccuugccauucuaagucuuuuuuuuuuuccuuuguaguguccagguuauggauugagaacaaguugcuuuuguuucacguguucauuuguaaguugguuauuugaugccuuaaauguugauauuauaaaucuaugcuguuuaguagaauaugucagauacaaaaugcauuuuuaaaauuuuguaagcuguaggguuuuuguuuuuguuuuuguuuuuacaaugagagaaacagguaaaauuauuuuuagauucuuuuaaauucuuuauuuuaaaagaucauaauuucaucuuuuuaaaaguuuuuauuauuauuuaauguauaugaguacacuguagcugucuucagacacaccauaagaggacauugaaucccauuauagauaguugugagccacaaugugguugcugggaauugaacucagaaucuuuagaagagcagucacugcucuuaacugcugagcuaucacuccagcucccuuaaaaguuccuuuuuuaugccccuuuuccuuguauuauuaagguauguauccucucuuuuuaacacuuaauuauaugugugaucuugaauaaugucuguucaucuauaucuauaaaacuuagugucuucaucuaucaaguaaguuacaguugcucuggguucugagaaggugggccaugauucaaaguguuguugcuaugagguuagcaggauuagauuuauuauucaacuucuucuuuuuuuuuuuuuucauuuuucgagacaggguuucucuguguagcccuugcuguccuggaacucacucuguagaccaggcuggccuagccucgaacucagaaaucugccugccucugccuacgucuccgccucccaagugcugggauuaaaggcgugggccaccacgcccagcauuauucaacuucuaaguaaaagugucauguuuacuauugggcuugaguggcaccaagagaaaggaugcaguaccaauaguguacuucacagcuauguaucaugcuaagugcuugauaugcauuaagucauuuaauucucagagcaucagauaauguagauucuauuacuauuaguacccucauuuuacagaugaagacauuaggccacagagaagcuaaauagcuugcucuaaggucacagagcuaguugagguagaauuacaauuugaucucuugagcacgacucuagauuugacugacucaugcuuucauugagagacuggaugguggugucaguucaucauggaguauuucauagcuuucugcuucuauacaugcuuuccauacaaguuacagauccuggucuaaagcuguugaucuuacuguuaagugcauugaguggaaaauacugcauaugcccuagcuaucaaacauuacuuugaaguugauuuagaucuuguauuuagauuauauaucuugguguaacuuuaaaguaucuacacucugcuugcuuguuuguuugguuuuuugagauuggguuucucuggguagcccuggcuaucuaggaacuagcucuguagaacagauugucauugaauuuagagauuaccugccucugcuucucaagugcugguauuaaaggugugaggaaccgcuccccaacuuuaguuuuaauaugcauguaagaacauugaauagcuacacaaucauaaaaaguagauuaucaaaugagaauauuaugccucuaaaguucagagauuauauuuaauucucucucucucucucucucucucucucccucccucccucccucccucccucccucucacuuuuacagagacagaaggcuaagaaaucuuaaguaacuaacagauauuuccguucuaagacuguuauuuaggacccuuugcuauaaguagaagucagcucagguaguaacaagggagacuauuccaagaacauaaagauuucuuucagaucuggaucuggggacuggaaaaugaagguguuaagaagcacccucuguauucuuccuucucaguugacugcauuuuugugauaauuaggccacaaguggaugucuauaguugcucuuugaaaugcucaauucuaguacuacauagucaguauacaucccuucuuccuuuucuccucuuuccugucuuucuagauuuguugacagaauguuauucaucuugauuaauauuucccaggucgaucugaccauauguaauuagagcuaaacccaaagaggagccuaccugcuaggaauucuagacaggcugggcaaacagaggauggcaccugguacucaaaacaggugugcugaugucuuuagauuuuuuuugacagggaguuuacuauugcuugauugccauaugauauuucuaacauaguuagguauuuugaucacuuuuuuuuggagacaaaauauuacacuguaggccagggugguuugcaacuuguagaaaucuuccugccucaacuuuccaaguagcugggauuauaggaaugagccaccagacuuggguuuggauuacuuuuugauauauucugcaagagcaucauaagcuaaggcaggccucaagugcauagccugucccccaaacaaaaauacuccuuccacaaagaaguauaccucuuuauuuuugcuucauagggguugaaccaggaaaggaauugaaccuggagacuugcacaugcuuaguuguauugcaggucauguaucuccucuaaauguugucauuuaggggcuggagagguggcucagugcuuaagagaacuuguugcucuuacagaaagggaguuugguucauaaacccacaugguggcacccuagcaucuguaacuccaguuccacugaucgaaugccaucuucugaaccaggcauacauguggugcacaugcauacauacaugcaggcaaaauauccauacacacaaaauaaacguaaaaaagagcuuuauugagauacaguuuuucauaaauguucaugaacauagcuguuugaaagcuuuuuagguaguaguaacuauuggaucguguuucuuacaguguuggagauugcuaucaggguuuuguguaugguaggcaagcacuacuaaacuccaggccuuagagaagaucucugugaugugaguugugugugugugugcauauauauauaggcaaugucaagauagcagguuaacaaaauaggaacacucuauucauagucuaugaaugguaaugccuagguuucuguuguuaaauuaucauugaauaugacuaguauaucugaauuaucagugauaauuaguaaccaugacucauagaaauuaaugaaauaccagaauuuuuauccaguuuaauuuguuaugauguuuuacuugauaauuauuuugaaaauugguaauuagcauuaugguagccuuacacuaaucagaagguuugauuaaucagauaccaugcuguuugaggucacuuuuguuccuaguauuuuauuuuuguacauaugccuuauaucacuuggaaacuuaugagcuaauuaacuuuacuuuaaaaaauguuuuagacaagcuguggacauugugguucaacaucuuuuaaucacauuacuugggaggcagagacaggcagauuucugugaguuugaggauaaccuggucuacaaagagaguuccaggacagccagggcuuuugaacccugucuuaaaaaacaaaaagcaagcagacaaaaaauuaagacaagaaaaaaaauggaugaguaguaaguagucuagcuuggcuuucaacccucuaugcaaccaggcuggccucaaauucaaucuuuuugccucagccuccugaauguuaggacuuaaauguacacuuugccugcugacuuuaauauugaauuugugaguuaaaauaauucugauaaauaugauuauguuauuuagaacaaccccuccauaucccugccucuguguucuauguuucucaaauuuucauauuaaaaaacauuuuuaguggucuugcaaaccuuuuuuuuuuuuuaaagauuuauuuauuuauuacauguaaguacacuguagcugucuucagacacaccagaagagggcgucagaucucguuaugggugguugugagccaccaugugguugcugggauuugaacucuggaccuucggaagagcagucgggugcucuuacccacugagccaucucaccagcccaaacuuuuuuuuuuuuuuuuuuuuuuuugguuuuucaagacaggguuucucuauagccuuggcuguccuggaacucacuuuguagaccaggcuggccuugaacucagaaaucggccugccucugccucccaagugcugggauuaaaggcgugcgccaccaugcccggcuucuugcaaaccuuuaaucccagcacuuggaaggcagaggcaggcagaucucugagucugagggcuagccuguucuacagagcaaguuccagaacagcugaggcuacauagagacccugucucaaaaaauuucuuuuaaaaauauuuuuaaaaauuauguuugccuuuuaaaaagcaaggucuuggggcuggugagauggcucaguggguaagagcacccgacugcucuuccgaaaguccggaguucaaaucccaccaaccacaugguggcucacaaccauccguaaugagaucuggcgcccucuucuggagugucugaagacagcuacaguguacuuacauauaauaaauaaauaaaucuuuaaaacaaaacaaaacaaaaaacaaggucuuacuguguagccauguucagccaggaggcagaggaguuagaguucaagaccagccuaauuuacauagagaguuccaggccaaccagggcuguauaguaagccccugccccuaaacaaaaaccugguuaaauuguauaauuuuaaauuaaugacauacuaaauaaauauuucaaucugaauuucauuuagugcauaacugugcuaucuuugauuagugaacauuuaauguaguagaaucaauaggccugaaagauggguuaagagauuaauggcauuggguauaguaguccaugucuauagccauagcucuuuggagacugaagcaagagaauugcugugagugugaggccaucuuguacuacauacacaaugaguuacaggaguuacaggccaguauggcuauagaguaugaccuuggcaaaaaaaaaaaaaaaaaaaagacaugggaagaagcgggcacuuagaauaucucucuugauaaaauggaaaauauaaaagaaaaaacugaguagggacagauaggauuaggauucuguuuagauauauugauuuugaaguaccaaaugcaguguacaaaaguguuuguugcacaauugauuuacuauauggcagaauggaggaaggauuaaaauauggaaaggcugucaagauaguugugaaaguagaucuuagaaaucauggauuuagacacaauuguuaagagggacacaguguuucgaugagagaaaggggcaagaacugauuuacaggugacaccaaugcucaagggaguaguuugagaaaagugaacccaugacugagaaugaagaaugaguagcauaggaagaaauucagaauagugugugcuguugacagccaugagcuacaucaugcugcagaaggggccaagaagaagagagaccaggaaaucaggcuuuuaaagauuuuucuuaauagguuuuuguaaaaacagugauaucuuuugauuguagauauauuacaaaacaaauaagcagucagugaaacugccugacaugccuccauaccaggaaaaccauuuuuaauauuuuugguauauuacccuuucaggcuauuuuuuuaagaucuauuuuuauuuuuauuuuuucuacuuuuuucuuuuuauuggauauuuucuuuauuuauauuucaaauguuauccuguuuccugguuuccccucugaaaauccccucccuccuccugcucaccaaccuacccacuccugcuucccuguccugguauuccccuacacugggacauugagccuucauaggaccaagggccucuccucccauugaugacugauuagggcauccucugcuacauauguagcuggagccaugagucccaccauguguacucuuugguuggucguuaaguuccugggagcuccgggggguacugguugguucauauuguuguuccuccuauggggcugcaaaccccuucagcuccuuggguacauucuuuagcuccuccacuggggacccuaugcuaaaaaaaaaaaaaaaaaaaaaaagcaaacugugaaagccagggggaagcaccccuucauacuucugcaucagcucuugccuccaggucccuguccuguuucagucccuguccugacuucuuuuaaugaugaacaaugcuguggaaguguaagcugaauaaaccuuuucacccaccacccacaaaaaagauguauuuuuaugggagcuggagagauggcucagccagaguuccugaauucaauucccagcaacuacaugguggcucacaaccaucuuuaaugggauccgaugcccucuacuggugugucuuaggagagcaaaaguguacucauaaauaaauaaaaauuaaaaaugauaaaagauguauuuuuaugugcaaagauguuuugccugcguguaugucugugcuagggugucagauucccuggaacuagaguuaugugggugcugggaauuaaacugggguccucuggaagagcaaccagugcccuuaaccuuugagccaucucuccagcucucagacuauuuuuaagagucagguguagcccaggcuaguuuugaccuaagcuuuguagccaaggaugacuuugaacuccuauaccccuccuucuacacugagauuucagguauaugccacuccaccuaguucagauuuuuuccuuacuaacauucuuuuguuaugugagcucaagccagauugaacacuaacuaaauagguuagaaagucaagaaguuaaaagauagagucauagauaacauauugaagcaguaggaaaucuagugaucaccucccaugagaguggaggagugguggcuuggugucuugaaugcugccuuuucuuccuuaaccacaucuauucuacagagaagauuccugacuggcacauauauccauauguaauguaguaccuggcacacaggugcuuuuccuucaggaaauaucaggggagcuaugguaauagaauagugagauuggcagguguugccucuaggaggagauagaguagugacaggagucagauguguugcccguugcuuaguuggaaaggcucuugguucaaacacccaagcagagggaaaaggaauugagauuaggucccagcauuguuacuugguaggauuucagagccacagauguugacuucuacaucuuuugauuguguucuucaaagccuggcgugaccuguagguaauguuucagcagagugcucaagcauacaauuccaaaaacaugaggaauuuuagacuguuuucaaaguggcugcauuguggggcaugugguguacuucuguauuucuaggauuugggagucugaaacaggaagaugcugugaguucagggccuggacuguagcacagugagacucugaaaccuuuucugaaaaccaccucuccuucaguagcuuggcuauaacauuccagagauuuguccauaucaguuaagcuuaguuuggugacaucuuuuugauuguguauuacuacucaccaguagggaauggccuuacaguuguuuaaaauaccucuccacugacacugaaagucugccuuaagagugaaagacagaucagccugguuuuuguuuaguuagaagguauguaggacaggcaaagaggcaaggaaaauggaggcccuggcaggaguuguuaugugauaggagaaaaguguuaagauguaaaaagugauaaaguuaagauaugauaaggcaagugaaagaagaggaagggucacuagcuguggugguuuaggcuuaucauccuagcacuugggaggcaggaggccuaaagagucuuccaccagcuugcacuauauugugccuuucuuucuuuaaaagaagcaguguuuauuaggaaguugauaguuuagauuucagauguagaguuaguucuggaugaaggcaggucuuaaaaauuugcaguggaauaaagacaguauauaggaguugagagauagugggggcugugucucaguuuuugugugcauugccuuuugugaaugcugaauaaguacauauaauucagccaggugccaggcacaugggagagccauugaucaagcaauguguaacaagagacaacagaagauggauuauauacauauuuuuaaacaauuuuuuauuagauauuuucuucauuuacauuucaaaugcuauccugaauguccccuauacccucccccccccccccgcccugcuccccuaccuacccacucccacuuccuggccucgguguuccccuguacuggggcauauaagaagauggauuuuuuuuuuuaucuuauuaaaaggcuuagguuuuauguaugaaaggaauggucagaaguuaaggaaaggauaagaaauaucuguuugucuugaaagagguuuuuuucuaagaauacugaagguagggauagaaacagcaugucuggaaggugggaauuuaaggaaaaauguuuaaaugaggauggagaagggacuuuggaccaacauauacguguaaugaaauuuguauaugauaaaggaagauucuacagaacacauuggaaggaguugugagggcauucaagaguggagaaaccauuagagaggaagcuagaagcaaagaaagagcaagauagaagauggcuugagguggguguuagugggaaaaauuacuucaauucauaaauagacuagacuaaguuaguuuauuuuugccuuauuuggcccuaauuuauuuuucuuauuuauauuuuuugugaugcuuggaauugaacccagggcuuaauacuaaauccacacucuacuucugagccauagaucugucuuguaucacuguggagcucuggcuaggcuagaacuugcuauguagguaaggcuggccuugaacucagagagauacacuugccucugccucacuuaguguuggaauuaaagauaugccuccaugcucaaacuccuagaucucauuuuaauuguacuuaguuucauuucuuaacuauguagauuuuuucuacuuuucuuuaaaauuacauacuguaaaaauaagaaaguauucaucuguuucuuaaaaaaugagguuaaucagauaaguauaaaagaaaagaagucgggcuggcaagauggcucagcauguaagggcacugacuguucuuccaaagguccugaguucaaaucccagcaaccacaugguggcucacaaccacccauaaugagaucugacacccucuucuggugugucugaagucagcuacagugaauuuauguauaauaauaaauaaaucuuuuaaaaaaagaaaagaaguguucaucauuuugguaucuguucuuccagacuuuuucucaucugaacaaauacauauguauuuuauuuuuggagguauacucaguagauugugguaacaucuaauaaacaaccuuuguuagacuaggcagauugcuaucaccacucuuaucuguuauaccauauuuauuuaauaauccguugucaaauuuguuuuuuagagugucuuguuauguagcccuggcuugcacggaacauacugcaauccuccugccucugcuucuugagugcuuggauuauagguauguuccacaugccccauaaguguuaagcuuuugaauauuuuuuuguggacagggaagauaugucuauguagcccaagacaggagcuugucuggaacuugcucuguaacucagacugacuuugaauucucagcaaguuuuguuuauuaccuucucuccauuccuccaaccaucuccauucuuccuuuucucucaccuucaucauuccuaggcuagccuagaacucuggauucaagugauuuuuccucuuucagccucccuacaguuggaacugcagaugcaugcugcugugucagauacuuuauaaugguuuauuauauauaaugcuaggaagaagaauuuuaucuguacaacuuagcauauuuauucaauuauuuucuuugggaugaauuucuaggcauuuuugaaacuuuuguuuuucuuuuuuuuucuauuuauuggcuuuuccuuaacuguuugcuuaugaaaucuuuuguauuccuaauuuugaaacaugaauauauuugaugaauuuaauauaaagucagauagguugguauuauuuauaaguuaacaguuuaccaccacuguuuaauagaucugucuuuaguagagucucuauccuagguaggaagccaaaaacauuagcuuggaaacuuucauagaagguugccuucucuuuaaggguuuauauacuuaggacuuugcacuaguagaccuaacauuauaaaaacuguuacaguucuuaauaauaccuucucaauguauggucaugauuaauaccauuuucuuuaauuacuuuuuuccaggugauucauggcaggggacguggaaggauucuguuccuccauccaugacaccagugucucugcuggguucagagcacuguaugaggagggauugcuucucgaugucacucugguuauugaagaccaucaguuccaggcccauaaagcucucuuggccacccagagugauuacuucagaauuauguucacagcagacaugagggaacgagaucaggacaaaauucauuugaaaggucuaacagcuacugguuucagccacguucuucaguuuauguauuauggaacuauagaacuaaguaugaacacuguacaugaaauccuucaggcagcaauguauguucagcuuauagaaguggugaaauucugcugcuccuuucucuuagccaaaaucugcuuagaaaauugugcggaaauuaugagacuguuagaugauuucgguguuaacaucgagggagucagggagaagcuggaugccuuccugcuagacaacuucgugccacuaauguccaggccugacuuuuugucuuaucugagcuucgagaagcucaugucuuauuuggauaaugaccaucugagcagguuuccagaaauugagcuguacgaggcugugcagucuuggcugcgacaugauagacgacgguggagacacacagauaccaucauucagaacaucagguuuugucugaugacuccauccagcgucuuugagaagguugguacauuugaaagcgauagacaggacuccucaauuuaaaguagaugucuauagcuaagauucccagaguuggucaggagucaagaaaggaguaguuuaugagaauauuuucuguauaagaugccgauuuuguuauaucuuaugcauuuagggauuuuaaaaauacauuuugugggugaagaauaaaccagguagguaguagaauaguucaacuuuucaaguacccuuaagguuggauuaugaugugauacaacuauuacagauugccuuuagcuuuucuuaaugugaaaugggcuagauuauuuuuaaaaguuaauuuaaguaauccaugcuagaauuggcauugaggauuuuuauaguucugcauggugcauauacauuaaaugcauuuucuuacuuaauuaaaaugcaguaaggucacauacaauagcucuugaugauagucuuccauacucuugccuauaucugucccucauuuaaugugaauacuaagguuaaccaugaaaacaaguuauauaucuaaaaacauuuugacauuuccaaacuaguagaccauaaaucuucuauguacacucauaaagcauuucuguguacauucuaccauauaaaucuuuuuaaaaagauucuuuaaaacaaccuuggccuuuuugcauacaagcaucuucauuucuauaucagagucucacuugugauccauucuugcccaaaggagagagcgcagcuucaguaauugcuuaacuuaauugguuucuaaucacauugguuaccucugggacucuguuuaccucuugcauuuuucuuucuuucuagacaucguaaaaacuugguugauggauauccuccaugcuaaagcacucagcuuuaguuaccagaucuuaugggaaaaaaguuucauuauaccauuuuaaaaauaaacaaauuugugccuuuaaauaauacucagcagccuggcauguuuuuuuuuccuucugaaauacuaugaagugucauuaucuuuaauagaaagcucaauuuuauguaauuuuaucuuuauucucagaauuuauuaauaugacaaauaauuuaaaaauuuacuuauuuuuauucaguaggacccaucuccacaucaucuauguaaaccguguuugcugcuuagguuuugauuuuuuucuaccuuuacuauuuauuguuuugauugcucucuuucucuggggauucaugguuugucuuuauacauuaaauccagaugcuuccucgccacuaaaacauagcaccuugucccccaguuucaauuuagauagaaguagaaaguauuuguaaaguagaaaauaaaacuucuuuucuugugguacaauaaaaugguuagcggauagcaguuaguuuguaauuuuggagcugcuaaucuacauuucaauuaucaguuuucaagauaggcagugguauaguggcuaaaagucuguuggguaguuguuuaacauuugcacuugcugauuuccuuuugcacccacaacauagcggugguuauccccacucacuaggcauuugguuuuaucauuaugaaaauguuauuaaggcuuuguucuggaauuacuuucuuaggaaaaguuaagaccccauugaggagaaaauuuuucauuuuuuguaauuauaaaaucuuuuccuucuacuugaauaagccugccuuaauaaugugugagauuuaaauuuaacaaaccaauuuguggcuuuuuaaauguugagacgcacuucaguuaugcagaucagaggucuuauuuuuagaaauacaacuuuagaaacuaaauucauauggagaauuugguuggcaaauaaauacuucagauaaaaugguauaugccuuugaucccagcacuuaggcagaggccagccugaucuacacagcaaguuccugaaacuguguaucuaaggcuaugcagagagacucugucucaaaaauuuuagacaucauauauuuuauauuucaagcuucuuaaauagugugcauauauuuuucuuguauucaaaauauugcaggucucaaacaaggccauuuucuuuucuucaaauaaggcuuuugcucuaucccaggcuuggcucuaacauguucuagagcccagucuggccucauacucagggcaucuuccugccucagucuuaucaaguauauauauauauaugcaugccacaucuggcagggaauguuaaaauggucuuauuuuagcuuuuacguguuuuuaaacuuucuauuacagacuuagguaaacacacagaaaagcugaaagaauagaaugaugauuccaaaacaaacacaccauguaaguuaauaguuguuaacauguuuucuagauagguagagguuguauaguuuuuauuagguguucuuucuucucucagaacugguucaaagaauguuguagucauugugacuaucaucccuaaaagcuuagucuaucauuucccaagauuaaggauaucauccuacauaaccaaaauaguauugucauacccaagagaauuaacaauuucuuuaauaucauguaacauccaggccauuuucugucauuucaaaggugucuuuuuuuuuuuuaguugcuuuucaugaacuaaaauuuaaucaagguuuguacaguacauuugauugucuuuguuuuaauuuugaauuguuucuccuuuuucuuguuuguuauaaggauguucaaaaaugaaaaguugaaugaauaguguaaugaguaccuguauaguguacagcuguugccuagauuaaaagacuguuacuguuacauuugccauauguaacaaaaguuucuagcuuuugaaaauaacuuguaaacacaaauaccucuuaaauacuuacuguauuucuaguaugaguaaggacuuuucuuauuuaaauacaauccucuuuuuaccuaguggcaauaacaguaagacccaucaucaaauugcaaaugcauauucaaguuuuuggagcuggccuccaaaaugcauuagagcccaguguuuaugcacugcuuuuggccaucuuguauauuuaagcugucuuaauccacagcagcccccaccuuuuuuuucuuuguuucuuguuuuguuuuguuuuguuuuuugagaaagaccaggcugcucauuaguucguuguuucagugcuucacaugcuggguguauucuagauguauuugauuauuuccuuguguguuguuuacuuaguuucuuuauacccauuauuuacuauuaacacaucuacauuuuaaaaucaugguuuuucaggaacaauuaacaggaaaguaugguaaucucagaggaaaacuuggaaaaccacuuaguugcucagcucagcuuagaaauugccaguggggcuggcgagauggcucagcggguaagagcacugacugcuguuccaaagguccugaguucaaaucccagcaaccacaugguggcucacaaccaucuguaaugagaucugacacccucuucuggugugucugaagacagcuacaguguacuuacauaugauaaauaaauaaaucuaaaaaaaaaagaaagaaauuggcagucaccacucuuuuuguauugugacuccaagcaguucauuucucugacuaaaaucaaaaaaaaaauuuauucuguguuacauuucuuuuauaguaauaaaauuccccucccuuaaaaaaaaaguagaauaauagcgggcagugguggcacacaccuuuagucccaacacuugggaggcagaggcaggaggaucuuugaguuggagacuagccuggccuacagagggauaaauagccaagguccagaauagccagggcuacacagagaagcaaacaaacaaaacaaacaaaaacaaacaaacaaaaagaauacuucaguuuuucggaguuuaaacuacguuaaauuuuaaaauugaaagagucauuuuuaauaaaucagccugagauacuacucuguagcggaaugguauaagcuuagcauaugcuauguucagucuucagcaccauccagaucagugugaaacugugacacuccaguguucaaagauuaagacaaccaaaagggggcuggagaaauggcucagugguuaagaguaauguucaauucccagcacucaaauggcagcucacaacugacuaaugccaguuccaagggauuuguggaaccacacacacauguggugcauguauaugugcaugcaggcaaaaugcccaugcacaugaaauaaaugaaucauuuuuuaaaaggcaacaaaaaggaugauaauuaucucagguuuauuuuggaucuaaagauuaaacccaggaccuuauggaugcucuccuacuaaacuguauccccagacucaaauaauuuugagauugauuacauguugaaauuguccuuuggguauauugaauucaauaauugaaaauucaccuuugugcuuuaaaaaaugugaauacugggacauauaaaauugcaucuuuuggcuugcauuugucauuuggauuauauuuuuauagcagaaaagugcucugaugcucaggaaggaaguuuucauuggcaacucugaauaggccuuuuucauguauuuaaccccaucuuccuaacucucacccuuugguuaugggugaguuacaguaaguguuaaagaagcccuagaccuaaagauuuuauggugugguuaaugaauauagcauggguuuuuucaggauccuuuuucugucuucucgaaaauaaacaccuauacaaaacuuuggggcggagcuucuuccugaaacaguagccuucagaucugagcgguggcaucuuagaagagaaagaaagaggcauucauucaguccucaguuuccagucucagcgucaggaacgaaggaugcccucuagcuggguugaaaucacuagguuuauuccacugcagaaucccccauaaucccuucugaauuuuucucagcucagcacacugcuucaauuugugcuguggccagucaccacaggccaaggcuuccagauucccugaguucuucaaaggcaucuguacuguuuauuguaacacuguauaacauagagacacacagacauacaugguguuuugugugugcauacacauguguguuugugccagguugugcacuaaguaaauguuucccacagaguccaaauauuauuuccauuuuuagggggcggggaagguucagaaagauuaggaauauuauuccuuuuuuuuuuuuugagacaaggguuucucuguguagcccuggcuguccuggaacucacucuguagaccacgcuggccucgaacucagaaauccaccugccucugccuccugggugcugggauuaaaggcgugugccaccacgcccggcuuuagaaucuuucuuaaagcugcuagacuagugagaguucuuggagguucauuaugcaugcugauccaccuugggucauuuagaaguuauuaauaggaauucuaaagugcuagcaugaacaacagcaacaacaacaacgaaaacuaagaaauucauaauccugaaagacaauauccugaaagacuauaagguaugaaagcacauuuuuuuuuuacuauauaauuaaaucuaacaauuucagaaucuucuuuuuaauuuaaauuuugugaugcuggguggggguuggaccuaggucuucacauaagaagcacucgacuauugagguauauuccaaguuagaucuugucuuuuuaaaacauaguuguuuaaaucaugauuuguuuuugucuguuucagauauuuuuuuuauagaaaacccuaaaaauuuauuauaucuucuuuuuuaaaaaauauuuuuauuagguauuuuccucauuuacauuuccaauugaaacuaaacuguaauuucaguuuuuacuuaagcauauaucuuuggcauguauuuuuuacuagcuuugaugaccuuugcauccauuaacaaaaagauaaggccuguuaucacaaugaauuucaguaaagauuuauauguuaacaaagauaaggccuguuaucacagugcauuucaguaaagauuugcuuuaauuuuguuuugugacagggucucauuuaguagcccagguuuggcuggaacucacuauauagccuaggcuagacuuggacuugagucaguccucccaccuuagcuuucuaaguguuaccauuacaauugugacccacucuacuuugcuggcuuuuuguuguuguuuucuuuuucucuuuucuuuucuuuccuuuccuuuuuucucuucucuucucuucucuucucuucucuucucuucucuucucuucucuucucuucucuucucuucucuucucuucucuucucuucuccuucgagauaggguuucucuguguaucccuggcuguccuagaacuugcucuguguaacaggcuagcauagaacuuaguuaucuuccugccucugcuucuggggggauagaacuaaaggcaugugccaccaugcccugcuuaaagaaaagaaacaauacuggguuugucagauggcugaaaaccugaguucuaucccuggaaccuaagugguggaaggauagaacugacuuccaaaaguugucuucugaccuuugcacaugccauggcaugcacaugcgugugcccacacauauauaaauagaauaaguaaaugcauuuuggcaaaauuacauuuuauacaaaaaaaucuuauuggcaacaaaauuguuaacuuauugguuagaaacauaucuguugcuguuuuuuuuuuuuuuuaacagugacauaggugguucacuccugugauucuaguacugggaaggcggaggcaggaguauugccuugaguuugaggccagccugagcuauaguauaggaucuuguuucauaaaaccagaaaauaaugacaaaauagucuagugccauguuaacauuuuuuauuuugguggugcugaggagugagccggggccuuccacaaucuaggcaaaugcaaguccauauuucaacauuugugagccuggaacauccucauaaauuauaaauguucauagguaagacucagcaugcgguuggcccucuugauacuacauugauauaaauuaacuucaaaauuacuaaguccuaugaagauagaaaaccagauuaguucaccuuucuauuuaguuuuaguggcuguguuuaaggaagcagacuguauagauguuuucugcuuuaaauaaacccaucaugcuuauuuuaaguacuuuguuuuaugaacuaccucaugauauucagacuacauagugugcuuuuuuuccuuguugauuaugcauaauucacuguuuuacccccaaauuggaucuauaugaaauuuaaaaaauuuuugugugcuagcacacccaagggcauauacucugccacugggcuauaugaugagucccuagaguuuuuuaaaugcacagcuaauguuuuuaaggagaaaaggucguaauguauauuuguuguauguauagaacuuaaaauaguacuuuucuaucacugguaauagacuuaauaaauguuuauuuuuauaaaaauguaagacuacuuuaggcuggcaagaugguucacuggguaaaggugcuugcugccgagccugauaacuugaguucaaccccugggaucuccaugguggaaggagaguguuguccucuggccuucacccacauacaguggcauguacauccccacauacauguaauagaauauuuaccccuuuggcaauuuugcuaguuuaaaauaugccuuuauuagugaaaauuaauucaagagucagugaaaacaaugcuucggaaaagcuuucuaacccuuugauguuuuaagacaggaucuuauucuagcuaucccaggagggcuuaauuuguggcaguucuccugucuuggcuuuuuugaauuaugaaauuacaggccugugucauaauguucaccuagaguuaaaagcuucaauuucagccagacaugguggguauaccuuuaagcccagcacuuaggaggcagagccaggcagaucuaugugauuucaagaccagcuuggucuacauaguuuacaaagugagacucuauuucaaaaaacaaaacaaacguaaaccaaauaauaacagcaaacuuacauuuuggugucuagggaaauagcucaauugguauagugccaugcaagcauaaggacccaaguuugauucccauguggggguggagguagaauaaaaagcccacuuugauauugcacauuuauaaucugaauauacaggacgcuagaauaaaaagcccacuuugauauugcacauuuauaaucugaauauacaggacgcagaacccugggcacuugcuggccagccagccuaggcuaaauugccaguuuuaggccagugagaaauccuguuucaaaaacagguggauaauuccagaagacuugcauccaaggucgaucucuggccuccacauacauauaagcagacacacucaaaaaucaaagcaacauuuuaaaacaagguuauaaagcauccugaagucaccuagaaacugguagaauucaaggaugaaaguuugaguaucugaaguauaccuuagaauauaguagcugucagugcuuuccacuaaacacuaacccuccacaguuucuccaucaauguaguugauguacacagcauucaguggacuguuaacacuguucuugaucucaugcuugggguaugauauucuuauucauugaaguacagccuaugcaauaaagcaaagauguuauucuuuuuuuuuuuuuuuuuuuuuuuuuaagauuuauuuauuuauuauauguaaguacacuguagcugucuucagacacuccagaagagggcgucagaucuuguuacagaugguugugagccaccaugugguugcugggauuugaacuccggaccuucggaagagcagucggguguucuuacccacugagccaucucaccagcccauaaguacacuguagcugucuucagacacuccggaagagggagucagaucucauuacgggugguuuugagccaccaugugguugcugggauuugaacuucagaccuucggaagagcagucgggugcucuuacccacugagccaucucaccagcccaaagauguuauucuugcucucuguaaucccuucauguauauuuuggaacauguugacuaaucugguucuuguccuaaguaaaacuuaacguccagccaccaaacuguuauuuguaauuuuaacauuguuuagucaaaaccucugaaaagacuuuguucauaucuaaugacuucaauuagagcuagaauauguggaaauuucccuguagcccucagaauuuuagaaauacauaagaaacaguguuguaguugacaauccauguguauauguauuguaugugcacauguguauuaaguauuuguguauuauguaggagucuguguacguguacauagaggcuagaggaggcuaucagaagucuucuaucacuuuccaccuuagauuuugagacagagucucucgcuaaacuuaaagcuugcuguuuuggccaggcuggcuggccagccagugagcuccuggaaccugcuguucucugacccccaaugcuggcauauugagguuuuucauggguacugggggauuugaacucagacuuuuucuuauauagccaguacucuuaccuaugaagccaucucuagcccuguaaaaaauauuuuuaaagaaaaaaaagagcauuugaccagaauuucuaauaagcuugaguugugcuugaaaaaguuuaaaauuaucuuuagauauuaauaguauuuaugguauuuauggagcuagaauuugaaauugcuuauaugaacaguuagcucaucuagcccuucgaauaaaaacagaaaugggcguauuuucuuuugggaacuaggccaauguuaagugaguuuucuccuuuuugcuaauccuuacucccaggcuccauagacuuagaugccuggaauuaacccauacgcaguuugaaaaaaaaugacccacaguguuuuuuaggcuuucaagucugcuguguauacagagugccuuuuuuuuucucccucugacuuggauucaguugggcuuacagauuuuucaacaaugucagaagccuagauguugacagcuguuagagccuugggaaaagcaguguguuagggggguguaguaaguagacaggaaucucuugaaaacaggaguuugaaaguugaugcuugggccaggcauggugugcguaccuuuaauccuagcacugcaaaggcagaggcagguagaucucagugaggacgaggucagugagggcuacgugagacacuuuucaaagaaaaagcauuucaauaagaaagaugaaacaaaaucaggaguguaaggcccucuuugcugauguagaagagaaguagcccuuuuuaauaaauuggaagaaaugguagaaaaacagaaaaugaaagaguuaaaggggacggaauguguagagagcuuguccuaguguggaggcaccucuggguucauuaccauugcugggaaaaguuuaaaaaaggucaaaugucaaaaugacuggagaaagguuagaaacaagggaaauguuuauauuuuaggccuugaagucuuuuauuuauuuuuuguuuuuguuuugagacagguuguguaacccuggcugucuuggaacucccucuguagaccaaacuggucuccaacucaagagauccaccugcuucugccucuugaauucugggauuaaaggugugugccaccacuaucugguuugaaguaaucauuuuuaaauuuauuaccaaaaaacuagacacauuucccuaagcagcacuacuucaugacucacugaaauuaaguuuuccuuauuuuauuucuugcuuucuugcuuucuuucuuuuggcauaggucuccauuuuauuuuauuuuuuaaaauuaauuuauuuuuuacacuucauauuuuauccccccccaauccauccucugacuguuccacaucccauaccuccuccucacauucuccauuggagaaguuuuaugacuaaaucuuuuauuuggcuuucuugccucucucucuccuuaucuaucuaucuaucuaucuaucuaucuaucgagaggcauauaugcauauauauauauauacacacauauauauauguauauauauuagagaaugauucugcaaauagaaaaauaucccucaaguuauaaguucuagaacuuauuugugcuauuuaaauauuaguacaauuagaguaaaaauuauuaacuugggcuggagagaugguucagagguugagaacacugacugcucuuccagagguccugaguucaauuccuagcaaccauuuguaaugaggucuggugcccucuucuagcuugcaggcauguaugcaggcagaacacuguauacauuauaaauaauaaaucuuuuuuaaaaaggagaaagaaaacagcuuuaaaaaccuauuaacucuauuucuauuuuuuaacuuucagauuauuuaaucuuuaauuugguagcuacucaaauauuaagaacuguuuuuaaaugauuuccuacguuuaugcacuguuucugacagugcucugucauacugaaguuguaaagaaauuaaagcaauccagagaugguuuagagcaugcuggagcaugagugcccacuaaauguuaacucugccauuuuaagauauaggagcaucagcauaaaguccuggaaccaauccuucucugauaaaaagagcugagcaucagauacuacagcuugaaaggaucugcaccuaaucggaauuuacuuuucaucacuguauuuuguuuuuaggacaaagguuuuauuuaauaaaaggcauuuuacuuuuagcuuuuuuguuguguuuuuguuuuuugagacaggguuucuuuguguagcccuggcuguccuggaacuugcucuauagaccaggcuggcccggaacucacagagguccaccugccucuuccuuaaagauaugcaccaccacuguuggguguaucuagcuuuuuauuucacauaaauauaagcuuuaguucugauccugaauauuuucugcuucugagagcaaaguucggggccuuaugaauacugggcuagaacuuuuaucacugaaccauacccuuaucccccugagcauuucauaaagacuuugacaugguaguuuccuacuacaacacauaaaagacuaccccaaauuuuacuaagaaucaaaacuuuuaucaagccggccgaugguggugcacgccuuuaaucccagcacuugggaggcagaggcaggcggauuuuuggguucgaggccagucuggucuacagagugagguccaggauagccagggcuauacagagaaacccugucucgaaaaaaaaaaaaaaaccaaaaaaaaaaucuuuuaucaaaugaaccagguaugaugucacuuccuaguaccugggaagcugagguaggaggauguacaagagcagacuaagcuacauaguuccaggccagccaagguuauauaguaugacccuaucucauaaaacuagccaaucacuaccaccgccaaaaccccaagaugaaacgaaauagcagucguggcuucuaaaagauaagaucuguuuuugcauaagccccaugguaguacuguauuuuuauuuucagauuuucacuuuagaagauuggauccugauagagaagugaggaugaaguuuacaaccaagauaaaagcuugcacauaauacuuuuugcacccaucauucugagguuuagguuagcauuuuuggauguaggaagggucagaaguaucuguucaugcagcugcuuccuauaaggaagagaacauccaaaggagugugcuucagagucucucacggaaagaaauauuaauacagaacauuuucuuugguuuggugaaaauauauuagacauuaaaaauuauuuaaucgcuggggcuguauagcuuaguggaagagaacuugucuaucauaucuguagccuugaguuugaucaccaggacgauugaaaacaugaaauaguugauaguaucuuaaauuuguuguuuaaaaaccuaagauuuagacuguagucaguuuugguagauauuugaaaucacagauuuugagcuaaaucuaguaauauaauuauauucccuuuaauacagggaaguacuuaguacauuacaaguucauucuacuucucacaauuacagguaauaaaaacaaguuaccuuuuaaauuugcucauuuaaaaauggauucuauauuuuaagaagaaacaauuuuuacucuguucuaaugacuagcuguuucaacauuuuuaaggaacuacagucagaauuaauccuuugucauauuucuuccuuuccuaacugcauauauguaugcacauaauuauauuaaauuggaaagaggaaauggccaacuaaagauucagaccacuguuauuaagagauuauucauaugucucuggauuuuauuuuaaaacaaaaugcuacuuauacauaaaauucguaacuuaagaaaaugggaaagugauaaucuuuccaaguauuaaaacaagacagccuuuuaugaauagagaaggaaaguauuucaaaacaugaaagauaugucauccuuucuauaauugucuuuugagagcgccugauauacaggugguuaagcuguuacaugaggaaugaaugaugggagaaauaccuuuuuuuuuaaugaaaagaugaaucacauuuguuuugggguaugucucaucaugaauacacuuucaaggauuucuuucauaugguuucaucccuauguuuuuuguuuuaaaguagagugcauguuugugcguauaaaauuacuuaggccaagauuuagaggcauuaguuuuagcuccacaaugaaagaaagaauugguuguguuuguugauauugaguaguuuugaaaagcacagcuuuaaguagucuuggggaaaguacaaagcagaucuagaacuuagcuuuggcugaaagaaauaggaacuaaauuucuuugguuggaagaucuuugaauuaguuauuucaaaaggcaugaauucuguuacuggggacuuagagguagaacacuuugcuugaacuuaaacauagaauugaagugcaucuuguaaguucuuuggaacccagguuucaaaggaggacaauagaaugaauggggaagaggacaaagaaaguagaagauuggguauagaaugcaagacuggaaaaugauucccaaagcagguaagguagaccaguuugaugagaucucuaagagccaggguuagaguaugucaggucaucuagccuagucuucugagacauuggaaucccugucuauuguuccugcugguaaccacaacugaacugccuccaguagcagagggcuuaucaacuccagagguccaguuguccugguuugggagaaauagauaccuucuuacugauuuguacaaaagaaggcucugauccuuguaaaaauugcauauucugaccccaauucuaacuaaccuauauagaaagaaucaaaacgggguagaccccaagagcuugcugguaguugaguacugaacacguauacagaccuccauauaugcuuucaacuguaggacaacugauuuuuauuguuugaggauauguguaguggucauuguuuuuccucauuuaacauuuugaauaucugucaguacguuauauauucacaugccauauauaagcaguaaaaauaaugguaaacacuauaguucauucuuuuuuuuuccuuugagauagggucucugucuagccugaaacuuguuauguauaacuagaacucacagagguccaucuaucucuuccaagggcugggauuaaaggugugugccaccugaggcuuuuccucuuugugguuauuaauacauuaaguaguucaugggggacagauuucacuuugucuucuagcuuuuacuuucucuaagcuguuuguuuaguaucugguauuuuguaaaguaccaacauauaugacuucauucuuacuaugacuucauucuuacaguuucauuccacucuuuauaauauuugcuccaugagcuuguuuaacaucugaauucuggauaacucucugggcacugcagcaguuuuuaaacuuuucccccucuuaucaguguguuuugcaauuaaagaguaccacuauucuucagccuccaagccuucccaaguuuccuugcaaaguuuucuuuugaaaacccuugaaagcugccugucuaguaugcaaaccuuuuuccuuucucaaucuccaaacaacaaggcugcuuucuguagaguaguagucuguuagcacaucacuaaccaaguuucuacuucaggguuugguccaaaguagguuccucucauuucuaccucacucuagagacuaacugcuaacguagcagcugaugauuuugauacauaggcacaugacagaaagcaauguagauccuuuacacauuggcucuuucagucaucugccacagagguaagaagcuuaggugcuagugcuaccccaguaauacuaggugaggaaacaggacuaaaacuccagggugguaccgcuaauguguucccaauucagaacuuuucuaaauugaaugauuaaucuccauacuggauugcuugacaagauguuuaaucucuauacuggacaaacuucuguaguuuggaaauugugugguacccagaccacugguuguacaccuuagauaacuuaaguauguaauuugagauuuguaguucuuguuaauuuaguuuuauguuuuuuucuuuucuccuucaucugucuguccaucccucuuuucacaggauaggguuuccuguagcucacgcugacauccauuuuccuauauagcugaagauguucuuaaacucuaucuuucugacuggaggauuauaccuucaucauguuaguucuuguugacuuacuugaguauggacuuuucguuccaacaaaucaggaaggaaaugauaaauggauaaagcacucuuuuagggaauuuauagaaaaagugaauaggaaaggaaaauaggaaaauacucauuuuugcuaaugaaguuuuaaacuacuaugucugucccuuugcuccauaucuccagcuaggauuucacuagguaauccaggcuggcuucuacucagccuucugggauuagauuccagguaugugccaccaugccuggcuugaaguagaguuuuaaugguuuuaauuuuuuuucaggguacuaggaaccaaacccagggcuuacauaugcuaggcaagugcccuuccauugagcuauauacccccaacucuuugagaccuguuuuaaaaguggaauuuaaaaaaaagucugauacacaauaaaaaaagaaccaaaaauguuugugaaauuccagagagucaguauuaacauagauaaacagacauaaguguauuuaaucgcuguagugccagggugccguucuuuagacagugagcagagccuuaguugggagguugguggaugcucgccuggcauucaggaccugagcucaguccucaguacuaauaaaauaacugacugaauauugugagcauuuuccauguuaauaaauaauaguuauccuuaguaaauguuauuuaaggauuuucuaaaacagaaccacuauccuguuuguuuuucauaagagauugacgcucaggucuuuucucucugguucuucacugguguuuuuaaaugugagguaaaacuagcaaaagugugggcgucuuuuucauauuuuuccuuuuuguaaucauucauuuacguuuucuaaauguuuuuuaaagauuuauuuauuuauuuauuuuauguaugugaguacacuguugcucucuucagacacaccagaagagggcaucagaccccauuacagaagguuaugagccaccauguguuugcugggaauugaacucaggaccucuggaagucagugcucuuaaccacugaaccaucucuccugccucccucauuuacaguuuuuauuugcugaaauuuuccacaauuguuuugcuagaaagaauugagcugaauguguagguuuuuuugauuguuuuuuuguuuuuuuuuguuuuuguuuuuguuuuuuuuugagacagaaguguauguagcccaggcuggcuucagauuuucuaugucaaagauugccuugcaguucugagccccuugcuucuccuccccaagugccaagaucacaaagugugcaccaacacacuaggcaugacucgaaguuuuuguuuguuugguuuuauuuguauguauguuuguuuuuuuuuuaagacaggguuucgcuguuuaacagcccugacuguccugaagcuugguuguagaccaggcuguccucagacucacagagauccaccugucucugccuccuaauugauaguuuuuguuaaagacaguuauaguuucuuugagaagaaucauuagguccagucucuugcuuuuuuuuuuaauuaaugcauauguuaagguuuuuguuuuguuuuguuuucuaaaacagaacagaagcuguauuccugacgugcuggaaguuauaugaacuucagaguaaaguugucaucagauuccagauguacuauuuuuagauauauaaauaguuugagccagccacuuaacauccuaagccucaauuuucucagcagggaaucagggaguguuacugcucuuucaccugugaaauaauuaauaauuuagcaagauguacacaugcaaaguccccaacccagcuccgguuuccagucuucuggaauuagacaagcuguucugucuuugcuaguuuagugaagcccauggagagagaaccuccauaugaaagaaaugcaaugccuggaauuacagaggaaaucacuuauauugaauacaguuaagaaaaauuuaacuuugauugcuuauuguauugucuaucauuugggacuuagcugagagaauuaaugauaggauagauuaaugaaaaaaccuaagaagggaggagaaacauaucucauuugccugcuuuugacuuuuucuugagcuaucauuuuguguuucccacagacucucagaaguuuucucauucagcacccugccagggaauugaauccuaagcuagcugcuuuucucauauugaugauccaucacucuuguguaauuccucaaguugaaauccacaaaucacuuuauuaaaguuuucacuuuucaacuuuguuuaguaucaaauuagucauggacuucuguagacuuguuuccauugcugaagaaggcacccaagaccuugccgcauaguaggcaaguacucacuacuaagauccaucucuugcucucaucuuagagauuuucucucucuccacacuguuucauuucuccuguccaaauauaagauccucuuccugccuccuugucacuaacaagcaggauccccccccccacugguuucuagcauccucuuuuacaaaggauuucuuggguguuuuaguugauuugauaaguucuuucaccuauaucuaaaguuccacuauagagagauguguucauacuuguaaacugaugcuguugaccaauuuauguuuucauuuuuauaaauacauccuacuuuuuuugaggaaauaaaccacuucuuucacuuaccuuuauaucuuaggguaguucuaguuccaaaaauagaaaggaaaaguugaccuauuguuugcugaauuauuacuguaggaaucauugcugucauacuaaguaccccuuuuugugcuuuuuugagacaggguuucacuguagcuguccuggaacuuacucuguagacaaggcuggccuugaacagacaaagucuuuauguaaaaaaaucugcuaggaauuauauauguauauaaaguuuucacuaacucaccaccacaacucuccaaaugaugcacgugagguuguuuuaugguauauauuaucauuaguuaagaaaacugcagauguguuuuuuucuacugugaagcccuguguuugaacuuauccccacuuguagccuagggccuaaccuuacaauaggugucuggcauacuuuuuccauaaaucuuguucuauuuaaaaauuaacuugugccuuaaacaaagauuguuuacuuuuaaagacuugggaacauauauaugugauucuaaaugcaacuuauaaaaauucuaaaugcaaguuauaaaaauaauuacaaugagaaagcuuuguagaaaacaaaguagauaauuuugcuaggaaacacaguuuuagcaaaggagucuuacaauaauaucuggaucauuuaguaggcauuaauaguuugauuucuguuuaucuuuugguugaauauuuuuacuuguauuccuagguuaaaacaucagaauuuuauagauacucccgacagcuccgauaugaaguugaccaagcauugaauuacuuccaaaauguucaccagcagcccuuguuggacaugaaaucaagccguauucguucugccaaaccccaaacuacaguauuccgaggaaugauuggacauagcaugguuaauagcaaaauacuucuguuaaaaaaaccaagagucuggugggaacuggagggcccccaaguaccucuaaggccagacugccuugcuauugucaauaauuuuguauuccugcuagguggagaagaacugggcccugauggugaauuccaugccucuucgaaaguguucagguaugauccaagacaaaauucuuggcugcguauggcagacaugucuguaccccguucagaauuugcuguugguguuauuggaaaguuuauuuaugcuguagcaggcagaacaagagaugaaacuuucuacucaacagaaagauaugauaucacuaaugauaaaugggaauuuguagauccuuauccaguuaacaaauauggacaugaggggacagugcucaauaacaaguuguuuaucacuggaggaauuacuucaucuuccacaucuaaacagguguguguguuugaccccaguaaagaagggacuauagagcagcggaccaggagaacgcaaguagucaccaacugcugggagaauaagagcaagaugaauuaugccagauguuuucacaagaugaucucuuacaacggcaagcuuuaugucuuugguggugucugugugaucuugagggccucuuuugaaucucagggcugcccuuccacagagguguacaacccagauaccgaucaguggaccaucuuggccuccaugccaauugguagaaguggucauggugugacugugcuggacaaacagauaaugguccuuggaggccuuuguuauaauggucauuacagugauuccauucucaccuuugacccagaugaaaauaaguggaaagaagaugaguacccucggaugcccugcaagcuggaugguuuacaggugugcaaccuacauuuuccggacuauguacuggaugagguuaggcguugcaacugaugacauuucuuccuaaaaaggaaaaggcaaauaaagcauuugugauacaguaguuuaaaagca

SEQ ID NO: 9621 - RNA, 1838 nt, Mus musculus
uaagacuaguugcuauugcuuggguucagaauguaugaggaaacuguaguucuaauuuagauuauaaauccacaaauaacuuuacauucccuuuuaaaauuaugguuuaauagcugcaagagauuuauuuuuguuauacuaaacuauggagaauuucucauagaguuuuuucaagcuuuucuguguuucauuuggaacugcuuugucuguaugcauuguauaugaccaagguugucauucuggaaaaacucaguaagugguuagaaacgauaugguuuaacuguugggaucuuuaaacugucacccuuuauuucacauuuuaaaaacuagacuucacaaaaaguagcugauuuuuuaaaaugguauuuuaccuggcaccacuuauuauuuuuuacaugucuuugaccuuccaaguuuugauguuaaagaaaauccuugcacuacaggcuuuucauaaaauacaagauucucacauugaagguuuuguauuggaagaaaugcuacugguuucuaaaaggcaaaaaauuauagaaugauuagcauuucuugauagcuuuuccugugucguccucauugcuuugcuuuguguguuacucuaauuaugaauacuuacugagcccuucacauaucuuuuuuuaaagcagcaccuuuggacaccucauucugggaagcucgcuugaauuacaguaaagaacacacacacuugugugggaagaaguaaaauggagaguuuugucuuaauuacaugaaacuaagcuuuaaaauauuuuauaacaaauuauuugagcugcauaaucuaaacaugucaaacguuuugugggacuauuuuuauauauguauauguggguguagguuauaacauuucaguuuauaauauaaauuguuauuucaguuuauaagcuaucucucaaaagagacuagcucucuugagaauacauaauuuaaaguuuuagacugaaguaaaacaacauagacaauaguguaaauuagaaauauuggagggcuauagagcagugaaacugcuagugccaguuuucuuguuugucuaccauguuuucaguucuuguuuuguuuuguuuuuguauucuaaacauuuugacugcucacacauuuguuuaauuacauuuagaguugguuugggaauaaauaucuucuaaaaagagauuuaucuuaaaaaauaaaucccccucuaguuaguuucuaagaguuuaugacuucaaacacccuauaggcauagacaggaguaggucauucaugggagucccauccuuuccuuggauuggcauaacucccacuauuauauuauagccuugagaacgccagcgccucuguuguguccuaaaauauauuuggguuuucuuuugacuucuuugggaacagcugcauuaaaaguuacuaaucaguauauccuuaaggacuggguguuuaccuuuugaaggaauguucugaagaggugaccagaaagguucucuuuucuuucuguuucuuuucuuuuccuuccuuuucuucuuuuccuuucuuuucuuuaaccuaacuuguauaugcccuaugcucuugggcauacuuugucgauagaaaaauauuuugaccuuuagguaccuuuggggccaguagucaaauaauccuagggccgauauuaaagucucagaaugauuuaagguuugccuuuuauacauguuuugaaaaccuuuacauuuuuugucagguaauuuuuuuucccaagccguggauauaaucuauucaacauguuuaugcuauccauucuguuuuuaaauugaaaaaaaguuaaaaguguuuaugaagaaaaguuuaaauaaaauauuuuuaaucuuuaaaac

SEQ ID NO: 9622 - RNA, 1148 nt, Mus musculus
aguaauuuuugucuauacuccaagcaagaauggcaagacaagucuauagcccuugauauuucucuaauuuucuuuucuuuucuuuuaaaaaaauuuuuuuauuagguauuuuccucguuuacauuuucaaugcuaucccaaaggucccccauacccacccacccccaauccccuacccacccacucccccuuuuuggcccuggcguuccccuguacuggggcauauaaaguuugcaaguccaaugggccucucuuugcagugauggccgacuaggccaucuuuugauacauaugcagcuaaagacaagagcucccggguacugguuaguucauauuguuguuccaccuauaggguugcagaucccuuuagcuccuuggguaauuucucuagcuccuccauuagggaccgugugacccauccaucagcuuaccuuuuaaacccucacugaauagcugcuguguggaugucagcaggagcaaagucagcuugggggagagggcaacugugauggugcaggucugugagcucaguuacuagcggagacagaagaacuguauguucaaagccuuguuugggcaaccuagugagauucugccucaaaaaucaaaaagaacuggagacaugguucagugguaaagcacuuguccagcaggagcaggucccaguaaaacacaugccaccacaaaccaaguaagauccacuuugcuaaugagggaauguaaacagcuaaaaaaaaucgcugaaaauaaaaaaugccagagggaaaaguagccugugaugggaguucaggaguuguguucaccgucgaggaagacaaggaccaauuugauggaagagcugacuuugcacuugucaggcaagacugacuuuuuacuaggucauguagauuaaauaggaaggauacaggaggggggaaggugccgagggaggaaagacaaaaaugcauggggaggccacacgaggcaggaugcucugaccaaggccuucaccccgacccagccuaugacuuuaaccugcuuacugaacauuuccaucuuugacucuguuguauucuacagccagcagaaauaacaugagauagugccuggcaaaauugguucugaaugaaaacaaugccuggacucaugaauuaaaaaagaaaaaaaag

SEQ ID NO: 9623 - RNA, 4998 nt, Mus musculus
ggaaggauugugggaaggaucagugagcgguaugcaaagugaauucaaagaaauuauaaaaauugaauauuuaucaaucucagcugcagagaagaguggcauaaaguguauaggacuggaguguacucaguguguuuacugagauggcacacuguuuagcaugcuagagacugccauuuuaaacuaguaugcaucuuccucagauuuaucugagauuaugaaucuauuuaggacuauuguguuuugacugcucugguuggcuuauauauuuuauuaucucuucacauagaauuguugauuucaaagauagcagugagggucuaauggaaaucugccaugcagaccaucuaagucacuuacucuucaaucuugcuucaauuuaacgagcaucagucaagccaagguaaagcccugaaaggugguccugguaccugugcauauucaugucucuaaaaccuguugggggcagcuauccugauucuugaaagacuggauuaugaaugucguugaccgagauuggcagcuuguggucucgaagcuucuuccuuggaugcagguuaaaucacgcuugcuccauucagacaaugggguucuguggcagucucccggcuagucacacagugcagggugggagaaaugugagaaccaggugcuagacaucagugagaggcuggggcagucaagguggcggggcaugugguagaagugucaggacaugagcaaguccaaauauugacagguuucccagucugaaagcaauaauauuggugaaauaauuuguaguuuaaucuagguuagcaaaagaggacaaacauuagauugcucugccucugcuucaagucccagcagucacagcucgagcauaauguggcugcuggaggggagguggggaggaccuggggggaguuggugggaugaaagcagaauccagaauauauuguaugaaacaaaucuauuuuugauaauagaacaacaaaaacaaaaauccaaaacaaaaaauaaugauucucccucucccugcagaucucagcuaucaguagcuuuucuuuaaggggcaggcccugaggagcauccuucccggagucugcacaguauugggaagguacacacagcuucugucgguucaugaauguggucaccauggcaugucuagaagacagcauuuuuuucagugucaauagucagugaagagaugcaugacuggucaaagugcuaagaggaagagaccacaugcucugaggugguaagaugcaguuugggugaauagaaucagaagccaaugaugguggucuuggugaggauggugagagaaguuuaccacaguacauacuuuuauauaguuggccccuugggcacuuuauauacagaugggagugagugugugugugucugugugugugugucugaguaagagccauugacaaaaagcaggucauaaauuugaaacagaacaaauugagguauaugggaagauuuggaggggagaaagagaagggagaaauauaguaaucucaaauauaaaagaaaagaggagcauuggaaacguaaacgaggaaaauaccuaauaaaaaauguuacaaaaaaagaggaaaauuaauagcaaugaacugacuuaaaaagacaguagcuaguggaaaaaaaaaaaaagaacagaagcagggcagacgaugaggagcacacaggugaacagcacucuugacuuuccucugacuuaguuccugucuccagcuuccugcccggacuucccuggaugguaccuucccugcaagcuccaaaaagaaguaaauccuuucuuccacaagauagagcuuuggucauggugauuuaucacaggagugcagacccuagauuccagguaugugagucuucccauggaucaagccucaaauccauuaaguggauccuauaaaucccaucuaaauaauugguuguuucgaaaccaaucaugucuuuacugcacaaguggaagcaucuugccuuuuagggugguuuuuuagguguuuagaauccagugcuagggaggaccacugaugccuuuucccugccugcaugccaccuuccagcaaugugagcaccagccagcagaguggaaggucccagcuuacuucuaucuucuuuaucuauuugccuaaucccaagucuguggcuucuucaguaacagcaccuuacuaucuaguucuagagaguguccuaggccaguggcaauaucauccuuugucugcugagccuccaaccaauaacacaagaggagauggccuaccacuggugcugagguuuuugguucaaaacuuguggcuuuggggggcagcauuauccauuccuuuagcgugccuccauccaaaauuuuuguugucaaauuggacuugagaccugcucaacaggagagaaauccuggguaguacugaaacccuagcagacugcccaggacuagugaggucauaaacccuggaggagaguguacaacgaccaguuuacuauaccaucacaguaaccuaacuaugcucuaaauaucuguccuuaugcccacagauaaguguaauccucuugccucaucgauuuucuuucucuuggcaacagacagagaucauuccagaaaacaacaagccuucgaacugcagaguugccgagcccaggcacaauggagaucuccaacacagcugcaucuaaggcucagggaauauuuuggaagaggggucagaagcagucuaagaacuagaggaucaaggaaugagaugcaaugcugugucuccuaagacugccagaagcaaccugcaaagucucagcaacacgacugcccaaacaugagcuggacaaggaagaguagacaugccagauaugggcagagggaaagcccauagggccucaaccuuaucuccaaagaacaagggcaaacuaaggagggcugagagcuagagagauaggcuuccccaggaaggagcacaacaguuguuuaucuccuaccagaggcuaguccuggaaacacgcauccaggucacaccaugaagcuugagcugauuauauguagaaaucuauaugcauguacaugaauacauugguagaggaaauaacaauugaugaagaacgggguuauuugaaagagagcaaggaaggguauaugugagucuuugggguagaagaggaacuagauaacagauguaguaauaaucacaaaaaagaaaagaaaucuuuuaguugcccucugaauuuagcaagauucuguauggcuguuggcuauguccugaguuuugguugaccccuuuccacaaccccaucaccccaagcaccaucccucuguaaggcuuucuaugcccgguauccuagaaaguccauguucacaucucaugcgucuuacagucccccaccucuggaccuccucuggaagcuccuuucucccuccaugacuucuacagacacugacuccuauucaaacauagaaagguagaacuaugcagcuggugcccacaugugagagcacauagguggcuucuguggcuguuugaccaagauaagaaaaaggaacauaggagaggagcagccauccucauugacaaauaguccuggggagaacuggauauacacaugcagaaggcuaaaaccagaccccuaacuuuagacugaagaaaauugguucuaaaaggagguaagaccugaaaugcugagggucucaggaaaaugcagggaucauuucucaagagaagcagauagacaagauucuuguuuucuucuguaagacccccuuucggggacccccacucuagucucgggagugagagagcacccaaagaaacacgagaauccauugccguaaucacaugaggcaguuuaaagacugagcuccggaccgacaugcaucucacacaggagauaacggauguccaucacaaggcuugaaagcuagggguuuuuauggggugaggagcuuagggguguggaauucagcauagcaacacacuagacacacuauuggcuuauucaaacauuaacagaaagauuacaugucagcaaaagggcaucgggacuuuguuccugugggcuggggguuuaucuuguucacauagcaaccaguugauguaugacuuuacccggcaucaaggagcaguagacagaggggagguuccggccaggugggguugacccagacaagauagcccugcuuguccuuguauuuuuucauuuuuacagucaagcuguucuuaggaacgucuuaacaacagcccugucuguucugcuuuguucuccgccccaggccgugggcucauagacaacucuuuaacaugaaucacacguuacaaaaucucauuuuccuucacuucaaagguucaacaacuccggaaauggucuccguacuugucaggugggguccucaugaauuaccaacuuccuucaccauaaacaggaauaaauuggcagagugaagagacaaaauccaaaaggggugaacaaaaaaccuuguuacacaagucaucauacagaaacuuaaugaaauauauagauaauucagacaaguacaguagaaccaaacgacucagacgugaguaaacaaaacacauuucuccuggggcauaagauauggagugcacauaaacaggagggagacugaugagguggaauagguagggggggagagaauuugugugagagucaaagggaguacaugaggccuggaaauggguaaggucugcuuuguauuugaaagugaagugcaucagacccacugacguuagcaaccuguguggacugcuuacaagugggugcaucgggcuggagacauggcucagagguuaagagcacucucuucuaugacauuggaccagguucugaucccaguaccacgugagcacagcucacaaccaucuauaacuccaguuccaaaggaucugacuuccucuucgggccgccaaugccacaggcacucuugaaaugcacaugcaugcaugcaggcaggcaggcaaagaguuauacacacaaaaauaaaacugaguccgucauuuaacagua

SEQ ID NO: 9624 - RNA, 6678 nt, Mus musculus
cacuuaauucacuuugcaauuucaacauuuauuucugauaccaaaacuugacaacacacaaggaaaaaaaaaaguaagacagaauagcaaauaaauguauuuugcaugccacucucagucaacaggauguggcucucuagauagcguguuuugaaggaaccugaggcuucagccucacucagggaaaacuauugcaaaugaugagcaguaucugugaauguaagaaaaggagaaaauaauucaauuagcuguaucaauaacgaacauaaacacccaagaguacgucucuguauuucccuuuucuccaccauggauuuuguuacuacuagcuuaggaaugugaauacaauucccccacugacccuaccugcuuaauucaaagugacuuacuuaccugacaauuuacucaacccagaagaagccaauggcaccgaaguuggcggcgaaguuggcgguggcaguaccacuggggccaaugauggggccaguaaaggccuggggaaaccuggagcgggcauucuggugguaucuggcccagaagguaaaggggauccuggaccaaggaucuccaaaaucuccuuccucaucccaggucagcagcucaaacucaaugucaucccagcuccagggaccagacacagccucaucuccaauucccaugcgguuucucgcuucagcccgggccucugccucagcugcagcagcauccagagcauccaaggcuucaucugcagcuuccaugaacugugcaguccagucacgagggucucucuucugaaccuacaaugagaaauaaaaacaagaccauaaucaguaagagggaugcaaaaagaaaauacuguacuauauauaauggaauacuauucagccuuuaaaaaugaaaauccuacuauuugugaccauaugagugaagcugaaggacauuauaguaagcaagacaauacagagacaaguaauguaauuuuauugauaaguggacaaucuaaacuagacucauaggaguagauuagaacggugguugccagggguuuaagugggacaagaaauagggacauauucauuaaaguguaugaaguucagcuagauguaaugaguaagcccuggguaucuauuaugcagcagaaugucuauaaguuaaugacuaguguauaucuauacauugcugagcugaguuuuucuuguguguugcuauguauguacacauacaugugcaggauagaagccaaccuuggguguuguuccucagguaccauccaccuuauuauuugagauagggucucuuaacaagcaggcugaacgugagccccugugaggcaccauuuccaccuccccagcacuggacugcaaaaacacaccauuacccccagccuuuuuacacagguuaaucuauccucgauuccuccauuaccucugcaaugaaucucagcacuuucaucuugcuagucucaugguaggagcggaggccccagaggaacucauacucaggaggguugcuguugggcacucgucuauaguccagguaucugagaaaaauaagaguguguuuaugggcagucugcaaaacaaacaaacaaacaaacaaacacaacaaaaaacccauacuaugcuaaaguuguugccucaggauuuuacaaucugagacuguguacuaugggaagaguggacaggccuuucuuagaaccaugcuguagaaacagucuaccuccgagaguaucuucaguaaacacuucugaguaauucugggaaccgacacaggugcgcugcaagucacguuuagagaaccuuuucugacacagaucaagcagucagaauuacaagaaccacuuacuucugcuuuacaaacucguaaguaagaaguuuucucaggucaccaaggaggggaugucucacccugaugguaaaaaggaaaacgacaaucagagaauuugccugaagagaaguaaaggagagaguuaaagauuguuuuccuaucucucuacaccauaauuuagacucccccaagaccaccagguuaaugcaauucugguagcaucccugcugcuaaaugauacuugagaugaaagagcccaaucauacccaggacguagucccaucuugcgcagugcuucccagaggacggcugugauaggaggcaagaggagacaaggcauggaaagugagcauggaaaucagacuguagccaagccccagcuccaaggucagucacuuacccucgguggcacgguugccauucaugaagauaaugcccagaaucacuaagaggaggccaagcuucggugugucuuugguccuagaggaguauaaaaagaauauagauauauacauacccagcagccaucugcaugaaaaaccccacaagcuuaccaauuuagcuucuccaguauuccucagcagagaucauuaugcccccacucugcccaugaccuccuaugugacugaauacugagacucuuaggggaaaaaagcaucacuuagaaagaccauacuccaucuccuuucccaucuuacguucccaguaugccagccagggacucagggguacugaugagaauauacagaugcucuucuuugucgauuuccuucagcuggauuccaaauuucuacagaagaaaaccgaucaaugacggcaguuaggauaaccuaccaauaggcaggcagucacagcccuguaagcccuguccuugccaucauucuuguuucucaggucugacucuuuaccuucuccaggacaaagcaugcgcgcucaaugauuucuggauagacaucaguguauucucggaugauaucccucagcauuucuguaggagagaagggaagcaccuggagugagcuggaccguccagugccagccccugugccagcccugcugaggguagcccagucagguucuucucaaguacaaucagcagcuaugggagggaggggacagaauaagcaaaagaugccccuaucaaggacaucaaggacagaacgaccuaccugagcgcuugaugggcaccuucguguagucuuuaagcaucagguacuugaccaacuuauuugccuggggagaaguaauuaaaaugauguuuguagaaaacguggccgccgguuauaaauggaaggacugcaguaaacuaaguggagaggcacagcacuuacucuuuccugaagaagggccacaucucggggcuguggaggacccugguucugugaggcacgagaguuggaggaggaucucagauuaggugagggucguaaguucugccagucagguggaauuggccagucggcggggauccagucagguggaaaaggccagucggagggaaaggaccagucaggaggcauugaccagucaggugguaccugccaaucuggagggcccugccaaucuugagggcucugccaacuagguggagccugccagcugggugggcucugccauccagguguacucugccaggccauuggguuuggccagacaauugggccaggccagacaaugggguuuggccagaucacuggauucugccagaucacuggguuaggccagaucacuggauucugccaugcaacuggguucugccaagcugauggugucugccuagcugggggacucugacgugcugcugguggggucugccuggcugucugguuuugccagccugauggguucugccaagccaguggugucugccacaccacauuagggggugcuccagguggguucugcugaguggucacuggaaccggagcagaccuccaguucccugaggccagugaggcacgccuuugauccccacuguuguucucuuccacauucaaguuauuaaccuguauaauuagagagaagaaaauuucagggucacuauuaauccuggguccucccaguugcuaucuuaggaaguaccuaggaaucuucaccuacaccucacuagccacuggucacuuugauucucuuugucuuucagacaggcguuucaucuccaaaccagacaaaggaaaaaacaaacaaacaaacagaaagugggaccuagauuucuccuuuuccugugugacuacggacagugcuugguuucacccugaacucguuucuuccugacucuguucucucuagagagugagguacaucuucaagaucuaauugauucugugugagccugccuagcuuaagacaugguguuuaaugucaaaauguaagauggccuacacacauauugccuguguccuuguaucaacucaucaucagccuguggacaaccugggcucaggaauaauaguuaccuuagcacccccuacaacugugccaaaauacagauaaauccaugcccuuuauuguguuuggagccaaggaaauuggaagaaaggagagagcccaaagcaaagggaagcuagcugggaucucaccuugcggguccucuugccccgaauuauaguccgggacuccacguucugagucugggagccaucugcugaugucugggcugcugcaccaucagcuucagagauaccugcgcuggucccuacgucagccauuuuggccugauuuacauucugggucugggcaucagcuccagggaccuuaguagugucauuccaagccuuagcugucuuaggcugguuguuggucaucucauuggcacugggagacugagggaaauuguaggugguaccggggccagccuuagugcuauucugacccuuaaaggccauuucagacuuuuuagcugauuugccugugggugcugccugggaaaagucagaggcagcauguggaccuuuaggggugccauucugugacuuaaaggccgccuuagacugauucuugggcaucuccuuggcauuacgugccugagaguaaucauuuggccccuuugugguggcauucugggccuuaaagccugucuuaggccuggcagcagcugcugaaaccucaguaucagccuucucauuggcaguugggggcugugaacucuggggacuagcauuuggcccacuggcagcugcuguggccuggcuggugggcggagccucggagaucuggauggcuuccaucaaggucugcacaagcaaggcgcugucuucaacagaggccucagccugcaaacacaggaggggcaacauuucaaucucugagccuuacauggcagaccagaggagggggggggcgcggcgcaacgcagcaggggagcuguagacaggcgucacaguacucagacgugggggcagaggcgggucaaagggaggcggggcgcgaacaaaauuuaauuaaggguagagggggcagggcaaggugagggacagucuguggcagcaggggcuggugcggaauguggugcaagcucugagccccaaauggguuuagagacggacugguuaggcuugagguggggagcucaagacccgaggagggaggaaucaaggaggauaagccgagaggguggagggggagucucgcggcguggagaaagggaggguggaggcgagagguugggggauggggcgacagacugcucuacacgcgucaggguuauggaaaaaaaaugguuccuuacccaacccgcauucucugggcagaaugcccugacuaacagggucuccccuuucucuaagcagggaccgauggcugaaaagggccgccccucccccccauucgauaaacgcuagaaaucugagagcccgcggugucuaggccggaagaagggcaaaaucagauccugccauucgcgcgaccuaaggggccgggggugggcguaaacugucagcaggggaaaaaugggggaauugggagcgggguccucaccuggaagccgcggaggccugcaccgccguccgguuucugagccauagcucucgucucccuggcaagagcagagccuaagggggggggugugggagagaggagcugggcauuacacuacagaaggaaaagacauaggaccgaauucugugugcgugugugcuuugauucugggggcgggugaggugccgaguccggggggagaaccaggccuaagcggagcgggaaaaguaaccggucgucccgcuagaccaucuccaaucucagacgcggccagggaaaagcuucagcgcugccguuuuggagucagagaggagcuguggaugcgguaguuuacgggggcggggagggagggcggcgagcggggagacacgggcguccgaaaaguugaauuaagguucugaauucagaggaaccaucuaacgggaucaaggucgggaaauaggauucggggagggaacuggagaaaagauucagggggacggacggaguuucaaauuagaaaagggucgggagcagggucugaauccgggagcaggcagagcagggggcuuccgaauccagggugaagggacugggagaaaagaauggcggaaggacgccgcgccaggggggcagaugccccgucugggggcgaaccucaccuugccucagggccgaaccccaaucccuucgcuguuuccuucuucgcgacucaagaggaucgggaauggcucuguccggcucucggcacccgcacucucuccgcguccaggagaaaaugccagcgcggcagcucgggcgaccccgccucuccgccuaauauaccacccaccgccucuggacgcgccgcgcaugcgcagcagaucacuguccaaauaagagucccgcuugcuuucccaacaaaagcuucauccc

SEQ ID NO: 9625 - RNA, 6678 nt, Mus musculus
gggaugaagcuuuuguugggaaagcaagcgggacucuuauuuggacagugaucugcugcgcaugcgcggcgcguccagaggcggugggugguauauuaggcggagaggcggggucgcccgagcugccgcgcuggcauuuucuccuggacgcggagagagugcgggugccgagagccggacagagccauucccgauccucuugagucgcgaagaaggaaacagcgaagggauugggguucggcccugaggcaaggugagguucgcccccagacggggcaucugccccccuggcgcggcguccuuccgccauucuuuucucccagucccuucacccuggauucggaagcccccugcucugccugcucccggauucagacccugcucccgacccuuuucuaauuugaaacuccguccgucccccugaaucuuuucuccaguucccuccccgaauccuauuucccgaccuugaucccguuagaugguuccucugaauucagaaccuuaauucaacuuuucggacgcccgugucuccccgcucgccgcccucccuccccgcccccguaaacuaccgcauccacagcuccucucugacuccaaaacggcagcgcugaagcuuuucccuggccgcgucugagauuggagauggucuagcgggacgaccgguuacuuuucccgcuccgcuuaggccugguucuccccccggacucggcaccucacccgcccccagaaucaaagcacacacgcacacagaauucgguccuaugucuuuuccuucuguaguguaaugcccagcuccucucucccacacccccccccuuaggcucugcucuugccagggagacgagagcuauggcucagaaaccggacggcggugcaggccuccgcggcuuccaggugaggaccccgcucccaauucccccauuuuuccccugcugacaguuuacgcccacccccggccccuuaggucgcgcgaauggcaggaucugauuuugcccuucuuccggccuagacaccgcgggcucucagauuucuagcguuuaucgaaugggggggaggggcggcccuuuucagccaucggucccugcuuagagaaaggggagacccuguuagucagggcauucugcccagagaaugcggguuggguaaggaaccauuuuuuuuccauaacccugacgcguguagagcagucugucgccccaucccccaaccucucgccuccacccucccuuucuccacgccgcgagacucccccuccacccucucggcuuauccuccuugauuccucccuccucgggucuugagcuccccaccucaagccuaaccaguccgucucuaaacccauuuggggcucagagcuugcaccacauuccgcaccagccccugcugccacagacugucccucaccuugcccugcccccucuacccuuaauuaaauuuuguucgcgccccgccucccuuugacccgccucugcccccacgucugaguacugugacgccugucuacagcuccccugcugcguugcgccgcgcccccccccuccucuggucugccauguaaggcucagagauugaaauguugccccuccuguguuugcaggcugaggccucuguugaagacagcgccuugcuugugcagaccuugauggaagccauccagaucuccgaggcuccgcccaccagccaggccacagcagcugccagugggccaaaugcuaguccccagaguucacagcccccaacugccaaugagaaggcugauacugagguuucagcagcugcugccaggccuaagacaggcuuuaaggcccagaaugccaccacaaaggggccaaaugauuacucucaggcacguaaugccaaggagaugcccaagaaucagucuaaggcggccuuuaagucacagaauggcaccccuaaagguccacaugcugccucugacuuuucccaggcagcacccacaggcaaaucagcuaaaaagucugaaauggccuuuaagggucagaauagcacuaaggcuggccccgguaccaccuacaauuucccucagucucccagugccaaugagaugaccaacaaccagccuaagacagcuaaggcuuggaaugacacuacuaaggucccuggagcugaugcccagacccagaauguaaaucaggccaaaauggcugacguagggaccagcgcagguaucucugaagcugauggugcagcagcccagacaucagcagauggcucccagacucagaacguggagucccggacuauaauucggggcaagaggacccgcaaggugagaucccagcuagcuucccuuugcuuugggcucucuccuuucuuccaauuuccuuggcuccaaacacaauaaagggcauggauuuaucuguauuuuggcacaguuguagggggugcuaagguaacuauuauuccugagcccagguuguccacaggcugaugaugaguugauacaaggacacaggcaauauguguguaggccaucuuacauuuugacauuaaacaccaugucuuaagcuaggcaggcucacacagaaucaauuagaucuugaagauguaccucacucucuagagagaacagagucaggaagaaacgaguucagggugaaaccaagcacuguccguagucacacaggaaaaggagaaaucuaggucccacuuucuguuuguuuguuuguuuuuuccuuugucugguuuggagaugaaacgccugucugaaagacaaagagaaucaaagugaccaguggcuagugagguguaggugaagauuccuagguacuuccuaagauagcaacugggaggacccaggauuaauagugacccugaaauuuucuucucucuaauuauacagguuaauaacuugaauguggaagagaacaacaguggggaucaaaggcgugccucacuggccucagggaacuggaggucugcuccgguuccagugaccacucagcagaacccaccuggagcacccccuaaugugguguggcagacaccacuggcuuggcagaacccaucaggcuggcaaaaccagacagccaggcagaccccaccagcagcacgucagagucccccagcuaggcagacaccaucagcuuggcagaacccaguugcauggcagaauccagugaucuggccuaacccagugaucuggcagaauccagugaucuggccaaaccccauugucuggccuggcccaauugucuggccaaacccaauggccuggcagaguacaccuggauggcagagcccacccagcuggcaggcuccaccuaguuggcagagcccucaagauuggcagggcccuccagauuggcagguaccaccugacuggucaaugccuccugacugguccuuucccuccgacuggccuuuuccaccugacuggauccccgccgacuggccaauuccaccugacuggcagaacuuacgacccucaccuaaucugagauccuccuccaacucucgugccucacagaaccaggguccuccacagccccgagauguggcccuucuucaggaaagaguaagugcugugccucuccacuuaguuuacugcaguccuuccauuuauaaccggcggccacguuuucuacaaacaucauuuuaauuacuucuccccaggcaaauaaguuggucaaguaccugaugcuuaaagacuacacgaaggugcccaucaagcgcucagguaggucguucuguccuugauguccuugauaggggcaucuuuugcuuauucuguccccucccucccauagcugcugauuguacuugagaagaaccugacugggcuacccucagcagggcuggcacaggggcuggcacuggacgguccagcucacuccaggugcuucccuucucuccuacagaaaugcugagggauaucauccgagaauacacugaugucuauccagaaaucauugagcgcgcaugcuuuguccuggagaagguaaagagucagaccugagaaacaagaaugauggcaaggacagggcuuacagggcugugacugccugccuauugguagguuauccuaacugccgucauugaucgguuuucuucuguagaaauuuggaauccagcugaaggaaaucgacaaagaagagcaucuguauauucucaucaguaccccugagucccuggcuggcauacugggaacguaagaugggaaaggagauggaguauggucuuucuaagugaugcuuuuuuccccuaagagucucaguauucagucacauaggaggucaugggcagagugggggcauaaugaucucugcugaggaauacuggagaagcuaaauugguaagcuugugggguuuuucaugcagauggcugcuggguauguauauaucuauauucuuuuuauacuccucuaggaccaaagacacaccgaagcuuggccuccucuuagugauucugggcauuaucuucaugaauggcaaccgugccaccgaggguaagugacugaccuuggagcuggggcuuggcuacagucugauuuccaugcucacuuuccaugccuugucuccucuugccuccuaucacagccguccucugggaagcacugcgcaagaugggacuacguccuggguaugauugggcucuuucaucucaaguaucauuuagcagcagggaugcuaccagaauugcauuaaccugguggucuugggggagucuaaauuaugguguagagagauaggaaaacaaucuuuaacucucuccuuuacuucucuucaggcaaauucucugauugucguuuuccuuuuuaccaucagggugagacauccccuccuuggugaccugagaaaacuucuuacuuacgaguuuguaaagcagaaguaagugguucuuguaauucugacugcuugaucugugucagaaaagguucucuaaacgugacuugcagcgcaccugugucgguucccagaauuacucagaaguguuuacugaagauacucucggagguagacuguuucuacagcaugguucuaagaaaggccuguccacucuucccauaguacacagucucagauuguaaaauccugaggcaacaacuuuagcauaguauggguuuuuuguuguguuuguuuguuuguuuguuuguuuugcagacugcccauaaacacacucuuauuuuucucagauaccuggacuauagacgagugcccaacagcaacccuccugaguaugaguuccucuggggccuccgcuccuaccaugagacuagcaagaugaaagugcugagauucauugcagagguaauggaggaaucgaggauagauuaaccuguguaaaaaggcuggggguaaugguguguuuuugcaguccagugcuggggagguggaaauggugccucacaggggcucacguucagccugcuuguuaagagacccuaucucaaauaauaagguggaugguaccugaggaacaacacccaagguuggcuucuauccugcacauguauguguacauacauagcaacacacaagaaaaacucagcucagcaauguauagauauacacuagucauuaacuuauagacauucugcugcauaauagauacccagggcuuacucauuacaucuagcugaacuucauacacuuuaaugaauaugucccuauuucuugucccacuuaaaccccuggcaaccaccguucuaaucuacuccuaugagucuaguuuagauuguccacuuaucaauaaaauuacauuacuugucucuguauugucuugcuuacuauaauguccuucagcuucacucauauggucacaaauaguaggauuuucauuuuuaaaggcugaauaguauuccauuauauauaguacaguauuuucuuuuugcaucccucuuacugauuauggucuuguuuuuauuucucauuguagguucagaagagagacccucgugacuggacugcacaguucauggaagcugcagaugaagccuuggaugcucuggaugcugcugcagcugaggcagaggcccgggcugaagcgagaaaccgcaugggaauuggagaugaggcugugucuggucccuggagcugggaugacauugaguuugagcugcugaccugggaugaggaaggagauuuuggagauccuugguccaggauccccuuuaccuucugggccagauaccaccagaaugcccgcuccagguuuccccaggccuuuacuggccccaucauuggccccagugguacugccaccgccaacuucgccgccaacuucggugccauuggcuucuucuggguugaguaaauugucagguaaguaagucacuuugaauuaagcagguagggucagugggggaauuguauucacauuccuaagcuaguaguaacaaaauccaugguggagaaaagggaaauacagagacguacucuuggguguuuauguucguuauugauacagcuaauugaauuauuuucuccuuuucuuacauucacagauacugcucaucauuugcaauaguuuucccugagugaggcugaagccucagguuccuucaaaacacgcuaucuagagagccacauccuguugacugagaguggcaugcaaaauacauuuauuugcuauucugucuuacuuuuuuuuuuccuuguguguugucaaguuuugguaucagaaauaaauguugaaauugcaaagugaauuaagug

SEQ ID NO: 9626 - RNA, 7186 nt, Mus musculus
ugagccuugagcggccauaucugccgccgccgcagcugugagugcagcaucugcgcuuagcugccuccgcgccgcuaagguucgcgucgcucgcccguggcccguggcuguuccugccuuacuaccaccgguagaacccucuccuccugaccugccuaccucgcuccuucuccgccgcaccccggcugcucacaccauggaucucggcagcagcagcgacucggcucccgacugcugggaucagguggacauggaagccccggguucggcuccgagcggggauggaaucgcccccgcagccauggcagcggcugaggccgcggaagccgaggcccagcgcaagcaucucagcuuggccuucagcagucagcucaacauccacgccaaaccuuucgugccuagcguaagcgcagcggaguucgugccguccuuccugccuggaucggcccagccgcccgcccccacagccuccagcugcgacgaaaccugcaucgguggcgccggggagccugaagguaaacggauggaauggggagcaccuguagaaccuuccaaagauggcccuuuagugucgugggaggguuccaguucaguuguuaccauggaacuuucagaaccuguuguagaaaauggagagguggagauggcccuagaagaaucuugggagcuuaaagaagugagugaagcaaagccugaggcuucuuugggagaugcagggcccccagaagaaagugucaaggaagugauggaggagaaagaggaaguaaggaaaucaaaaucuguguccauaccaucaggugcaccuaagaaagaacacguaaauguggucuucauugggcauguggaugcuggcaagucaaccauuggaggacaaauaauguuuuugacaggaaugguugacagaaggacacuugagaaauacgaacgagaagcuaaggagaagaauagagagaccugguacuuguccugggccuuagauacaaaccaggaagaacgagacaaggguaaaacaguggaagugggccgugcguauuuugaaacggaaaagaagcauuucacaauccuagaugccccuggccacaagaguuuugucccaaauaugauuggcggugccucucaagccgauuuagcugugcuggugaucucugccaggaaaggggaauuugagacuggauuugaaaaagguggacagacaagagaacaugcaaugcuggccaaaacagcagggguaaaauacuuaauagugcuuauuaauaagauggaugaccccacaguagauuggagcagugagcgauaugaagaauguaaagaaaaacuggugcccuuuuugaaaaaaguugguuucaguccaaaaaaggacauucacuuuaugcccugcucaggacugacuggagcaaauauuaaagagcaaucugauuucuguccuugguacaccggauuaccauuuauuccguauuuggauaguuugccaaacuucaacagaucaauugaugggccaauuagguugccaauuguggauaaguacaaggauaugggcacugugguccuggguaagcuggaaucaggauccauuuuuaaaggccagcagcuugugaugaugccaaacaagcacaguguggaaguucuaggaaucguuucugaugaugccgagacugauuuuguagcuccaggugaaaaccucaaaaucagacugaaagggauugaagaggaagagauucuuccaggcuucauacuuugugaacccaguaaucuuugccauuccggacgcacauuugauguucagauagugaucauugagcacaagucuaucaucugcccagguuauaaugcggugcuucacauucauacuuguauugaggagguugaaauaacagccuugaucuccuuaguagacaaaaagucaggagaaaaaagcaagacacggccccgcuuugugaagcaagaccaagugugcauugcccgguuaaggacagcaggaacuaucugccuggagacauuuaaagauuuuccucagaugggucguuuuacuuuaagagaugaggguaaaacaaucgccauuggaaaaguucugaagcuggucccagagaaggacuaagcaaucucuuuugaugccucugcaccauaaugugugaaagauugaccgcaaccuacugcccauugacaaacuugugcccauauuuugcagagaaauuucacagcaaaaauccacguguugucagcuuucucauguugagacuucagucgugucacuccugaaugcauacuccaguuuccucccucuauagcacucugcuuccuuggacaaaucaguaauagcuuuguaagugauguguguguaauugccuacaguccuaaaaagaauauauuuuaaaguuuucauuuccguuugggauaucuagacauccuuuguucuguggggaacagucaguguugguguguguauauguugaagauaacuaacauguaaauaaaacguugcguuugaaacuucagcauuugaaauguguuugaauaaugcuuaaauugggauggaguacuguuucauuagauuauuuucucaaguaauuaacuauacuuauuaccugggcugagaaaaagguccauucauaguuggaaaugagggauuugucgaaaccacacagguuuguacuaaaggaaaacuacgcggguaggaugggaugcagugggggugggauggaaccuaucuuagugcccuucccagguauguuuucugugucuaaguaauauuaguaaaggaguuuuucuacuuacccaguuauuaucugaaaaugauuauccuauuugucuuccauuaggucccauaacuuucagcucagcuaaaucacauauauacuuaagguuucagucaaauagacucgucucugcaaucugucauuuuuagcaugcuuugcuguuuuucacugaaauuuggggagcaagacacuguggguacaauuacugaaaagguaaauuguugcacuaugugucauuuaugaaaaccaaggacuugacaugaggaaucuguuucucaggguuuacgguucauucccaucuauucuccacaaauucuuaaggaaaacaccaguugucgauucuaagguaguuagauuuauugcuggaaggaugacuuuauggcccuuggaacuaucaacagcgggagaauuuucugucuugguaaguggguagugauuuaguguaagcgguugccugguagugugcagaaccaguuucucuuaggcauagcucucuacuuggagcaagaaacuucuuuccuaaugacuaugagcaagccgguagauguagacacugccugccacauaccugggccugugcucaggucauggcagugucuuuuccauggucuuuuccuuugcgugcucauagaacucuugacuucauguaucaggucguuacugacugaucuugucagaguuccaacaguauggcuccuaugugcaucauccacaucagagcacccacuugagaaaaagauuuuaagugguugugcaucagcuaccuuaauccagaaggggccucauacugugaugggcacagucauuuaaucaugaguguggauagcaugaguauuguuuaaucuuuagucauaaagaguuccuccucuuggucguguuaaacuuuguauagcaagccggccagucuagaacuugauaaaaauucuaccuuagcagucacuuauugaggauuucccuguagcccauguuggcuccacuguguacccuagguuggcuugaagcuugugacuguccuccuucaguauccugggaguuaaaauucgagauggaagccacuacacuaagcucuuggcagucacuuaacaaaguuguuuuaaugcugcauuagugucauaguaauuuaccaacauauguguguauuauguacaaguaucacacguacaacacacacacacaccuaucaguuggcuaaaagaaaagccaggacagaacuguuuccauucaaucugggcaauuuucaaagacuaguuucuaaaugguugugugugagagacacauaaauuccagagaaaaaugucacaaucuuuaaaaguuauuuuagaaauuaguucguugcaauucagugaggaucauauuaugcaggaaguuggggacaccagagucuagcccuuuuaagauaguagauccgagccuggcauuguggcacacuggcuugcaggcuaaguaaguauuuggaaagcucagucaagaagauauguguucaaggccacccuuggcuacacugugagcuugagaacagccaugguugcauagugacagccugucacagagaaccaccaguagaucuaaacauccaguaauauuucuguauaacuucuagguauuuuauaguuauuaauauuuaauauuuuucaguauuucaaacuaggaccauuuaccacuacagcacuaguuugccuaguauggugaacuauuuauaaagcuauaacaaggggggugcccuuugacagaguuucugcugucuccaauuaauguuaaauuaacuuuuuuuuuuuuuuuugagacaggguuucucuguguagcagcccuggcuguccuggaacucacuuuguagaccaggcuggccuugaacucagaaauuugccugccucuaccucugccucccaagugcugggauuaaaggcaugugccacuagugccccccaccccccaaauuaacuuuuaacucucugaugguuuaaauaagaaaaucccucauagacucauauauuugaacacuugguucucaguuggugauguggguugggggagguuuaggagguguggccuugcuggagguagcaugccacaaggggugggcucugauuguuuauagucucaucccaccuccaggugcucucucugcuuccugcuuucaguugaggaugugagcucucagcuuccugcuccaguugccaugccugcuguuugcugccaugcuucccugccaugaugaucgcuuaucucucuggaacugugagccuaaauaaacccuucauucuguaaguugcuucuggucaugguguuuuagcacagcaacagaaaaguaaccagugguuggaaaccagagaguaggcuguugcuguguagaccaugaccauauuucuuuuuuagaggaauauggaagaccgagacuuuggauuagaaaagugguuggaugcuuuaagcagacagucggagcauggaagauuaguucggagaguaaugcagaaugcaguugucuggcucacaagguuucagaagggaacaauauuagcaguuggacuagagcccauuucugugcuauuuuggcaaagaaacugggugucuucugcccuuuuccuaagaauucacauauggcuaaaauugaaaaacuagagcgggaauucuagccaggaaacuguugcaugugucuagaccuugacccccuucugacauguuuuucuugagcauuuucagaucucugauuaaggcauuggaucuauuuucuguugauucugcuacagagagaaggcuucguguuucauucuauaucaugugaguugauaccguguugguuuuuuuuuugccaucuuuuuaagggucaguugguuauaaaugcauauaguuauuccucuauuacacugcucuuuguuuuuauaugccaauaucaugcuuuauagguacuuccauuuugaauaugcaauagcaugaugcuuacaaacuuuguucuuuuuuucccucaagauauucugggacauuuguauguccauauuaauuuuaggauuuucuuucuaguucuguggacaaugccacuaguauuuugacaggaauugccuugaaucuauaaauuauuuuguauacuauggguauuuuaacaauauuuuuuucuaguuugugagaacuguggagucauuucuuuggcacaggaaauuacagugcugcauaaugcuguguuuguggcaugauuauugauaaugcuuuugcgagucuaugauaaagaaaaugggaaaaaagaaauucaaaauguacagauugcagagauaaagauuggcuagaagagggacuguaauuguuaaggagguuaacaccauuaaggagaggccugcucugcacuugaauaaguggaggggucccuucaggacaagacuccacccagcuaagcuucggacuugggaaagagagucucagaugguuucuguuccuggaaugcaacagcaaacauaagcugcugcuaguggggaucaggggaguguggagccaucccaaguuugcagcccaauuugacagugucguucauguggugguggcuucagagggaugaaaaaugaaagaaugaaggggcuguagagccauagcagauuucagagagccagugaggcuaagcagugugugugucugcaugauagcucuguuuguuugugaaaaugaacccccaaguuguuagugauguuagagcuguuagaccucugccuacgagagcuauauaaaugaagcaaauccagucuaauuagauuuauguuucagguagcaaaacugaaaggacagagccaucuaaaucauuugacaugggacauagagcuacaagauuuaguguugugcccuucuggguugucuuccuuugccccauuuuuccuuucuaugcuccauuuccuccauuuuggaauuuuaugcuuugccauuguauguugcaaauguguaauuugcuuuuuuuuuuuuuaauuuacagggagcuacaauuaagagauugccuugagucucauaagagacuuuggaugguggacuuuuaagcaguguuggggccauuaaagacuggggacauuuuuaagcuugacuggaugcaguucgaaugaugaucuaaccaugagccuguggaggccaugaaguggaaugugauggcuugaauaaagaaugacuccucuaggcucaugccuuugaccacucgauucccaggugguggugcugguagggacgauuaggaggcguggccuucuuggagaaagcacgccacugggagcaggcuuugaggguuuauagucuuaccucauguccaguuugcuuucucugcuucauacuuguaguagagugugugagcuaucagcuucugcauccaguugcccugcuugccuuuugcuguugggcuucucugucaucauucaugauggacuuuuaucccucuggaaccauuagccaaaauaaacucauuuuuuucugua

SEQ ID NO: 9627 - RNA, 1529 nt, Mus musculus
cuuaguuuauuggacuucugcuugauuccccacuugguccagcgcuacucucuccaggaagguagaggaaguugcaugccacauauauggggaaaauuauaucuugguuuccgagguucaccacuucuaguuguugauucuuucucagagaaagaauauuauagucagucucucuucugagaacagauuuuccaguacuguccaaugagaucacucguagacggaaggcaauuuuucucugccagaguaagcugacaccaaggccacaggauuuauucauugcacugcgacauaauauaaugcgccuguuguuauagcacacuaccaagucccagccaaaguugaagccagaccagguccagcugcauugcucaucugugaaaaguuggccuccacaccucaugcuguuuccauggaugucagacacauugauauccauucgcccaaguucccuggacugcucugccugaagaagugcuagccauugcucuuuguauacuggagucaaccaugcugcagggaucagucuauccuguucaauaaugcgugcugaaggcaggucacugaugauguagggaagccuuagucgcuggaacacugacacaaaggcucuccccugaucacuguccagaaaaggucuguuaucugacucccuucugaacuuugcaaagcucaacucuucaggcaguaauacucuuucagauccugagcaugugcgugcuuccagcugcagguacauccacguuuucaguguaauauacacauccaucuccacuccaaccaccaaaagaucugaagaggcaaugagcucuuucaugagauccacacugauuccuaacaauaguucaucauuuuuucgggucaucagguuguccaagagccacuggcagcaaacauauuugaugcucuggagcccguaauucucagcagaguaguaguaguugcacacagucucgguacugacugaggcucucaucauauccucacacugcugaauuaacucauccaauugcagcauauucgcuguggccaagacggcaaugacucgagggggaggaauuacaauucuucgacuguacaagaagccuagaacaucauugaaagccucgcgaucaauauuuucaucgggcaucugcaucucuaucguauccauauuugacucucgccaggccccacagaacaugcuagaaaaguacccagagcggcacagauaggacuugugcaaaugccacuccuccugaaacgcacagaucuuuauaucgcuauuuucaccccucaggaacagugauucauacaguguccuacgggguacuuuugccaacgguccucuacggcugcccuuccgcuuguggccucccugaccaguggaaacgccuggcuguucacuugccugcgcuuccuggacaacggacgguccugcggcuucuucggcuuccacggccuccuccccucuaccagcgccuucucuaacagguucauuuuccucgggauuucuccuggaccacauucgacugcuuagggcucccaug

SEQ ID NO: 9628 - RNA, 24562 nt, Mus musculus
cuuuagugacuggaggucccucaugagcacagaaguuuauuagcauucagcaaaugaaauauauguuguaacauacaggcaguguaucaggauauccagaugccagugagugcuagggauggagagguaacaaaugcagaugauuccaugaugucucaggaaugcggaagggaagcucaggugcagcaacaagcuacaauccccuuucuguccuggaagagagaacucuuacaccuagacucauaucuuucuucuucccccagccauuuuauuuaacgugaccuaaauauacauuucugguuuaccccagcccuuccccacccccauauacagcggggaaaauaagcaccaauaguaacaggaauaauuaaagcccccucuuaauagacccaacccucacaaauguacaugccauguggauuuucuucuuuggaaugacuacaggauggagaaaccguggaucaggccacccagccaugacuguaacagucaccauuccuaaaagugccauccugguuaaagagacaacucagccauuaagggcuaagacuuacaauaaaaaaacaaaacaacaagaguucaguuuccaaaaguaccauccacuugugagcuggaacagggaagggaaggaggaggcaggauguggagagauucucccaaaguagcaagagggaccaaggaaucaccuaaugccuuuucuggacaauguugccaucuucuaaauugcuggcaagucucauucaagggugucucccaaggagaugaccaauuccuggagguugaaauagcauugucaucugucaucccgagucuccugguguugaaugagccccuaaugcuccauuggagaaacuuaauacaacaaaccacacaauaugggcaugauacuuugcaaaaaacaagcacaaaauauaaagaaaggaaaagaauaaaagucaagaggcaggaguacuuucaaaacgucuacacaagagaaggaagggcucaaaagguaaauaaaaugaaagcuagaaaacaugcugucugccaggguccacaugcuugcguuaccugguauuggucuucgguacaugggcaucuucuguccuuaccguguggaaagagaaugaauagugugacacagccaggugggagagggaaaagagggaggguccuagacacuuugagaugacaucccucugcacgagcagcagcauuuuuugugucaucuuuuuuuuuuguuuaaaacuguaaacagcaccgcuuaaaaauaaaauauaucagaaaagaacaauugauaaacauuguuuccaugaauauaaaaugcaaacaauauaaaaauagauaauuagcuuuugauauauauauuuauauauauauauuaaaaacaacuuggaugcaacauacacauggguaaacuugaaguaucccugguaaacccccaugccucccucuagcaagugagccuaagggcugaaggcagugguggcacuggugcaggugaaaaagccacugguggcaggaugaaaucaugcacccaacauucugaguguggaaagcuacuucccuccuugaaauagcacuaagaggagggacacuggcauuuacugaaaccauuauccacgaggcuuguggucugguaucuaagcuaaagccagaugauccccaaggcagagcuuccuuggagaaucuaaagcaccaagaaauuggcauccuggcuuuggaagaggccugcuagguggcuuuccauacccacagucacugguccucuauggacuggguuacuaagaaauucucaggaucagagcugacacuauauaguaguacuggguaacaacauaaagcuagccuccuucugucagcacaucuucccuuaaagucacauccaaaugcauuguccaaggaccugcaauggagucaggagguucaucuggccacagccuuagggugaacacaauagcagcacuucugguaguuuguagcauauuuggugccagcaaaggaaguacuuguccauguuuggacagauaccuagagauugguuacauaucccauugguaaucauguugccauuaccauauauccgcagccaaaucuucuuuccccuucuaggcugcaguuaguauuugcuuuagauacucaaaaggagucugcuucuguagacaucuuggcuaucccauuuuagguuguaaauauuuugucccuaggcuagcagccagaucagugaaaggacuuggaaggcaaugauguuacccaauccacaaacuucuacuuugccucagguccuacucuaagguaugaaguuucaaagcauagcaaaauauauccaaguuauagcaggucccuucagagauauugcacugugcuguccuccugaacugugaggguagauuccuucuuccucuuccaaacaggcugguagcccuucuccagugggcuauggaggcuguggacagcucuagugccugcuguagauggcagcgacauguaaacagcaacucaagcuaccuugacuaggcaagagguguggcuuuuccuguuguaaaggcauugagugcuuacuuccugccacccaaccaggcuaaguucagccucaccuucccagaacagcuuugguaggaggccaagugguuaaaaucugggcaugugucucuuaugacgaugugguugggguaaggaaggccuuuuucacuuucauuauccagauccacaagagaugcacuucuucgugauguagccaaagucauccaagagagcugaucugagguccuugaggggugguucuagugcuggugccaugcaaaguuaugaaguuacuuacaagggguuagauuuuaccaaucaaaucugcucuuuugggggaaaggcacagggccaaucccaagcuuagaaacugugaaaaauauuaugaauauaugcccuggcaaagaaaguaugucuacaaagcaaucuugacucagaaggccaccagcaucuguucucaagguaaauugccuuauuuugagcaagagcccuauugauaucuucacuuaguagaugugaagauggcuuugaggugagaagagggacaugggcagaagauuuaaaaaguucuaacuuugaucaacauaucgauccccaaaauauuucauauuccaauacagaaaaaaauuuaaaacaaggucuaucuugcuauguagcccuaguggccuagaacucacuauguagaacaggcuggucucacacucauauaacuccaauugccucuuccuucugaguguugagauaaaaggcacauaccuccacaccgggccugauggagaauuuuaaagaaacuguuucauauagaugauuaaggaaauguugaaccuggucaagaugagccuguugcaauguuuuccugacaccaagcucuucccuaguguuuccaacauuuaggcugggcuugcuuggaggcagaggcagguggaucucuguuaguuagaagccaucguggucuacaugguaaguuccaggcuagagagaacuacagugugggaccuuguccagaaaaaaaauauagaaaaaagaaaaagaaaccugcauggaugcaagagaagagagggugcuguucauuucagaaaggacugcaacugccaugcaaaucagcccuguaguuuggcagagcaaggguacauuacaaucuuuccucucaagaagccugguccuuugaaaaugcuaagaacuuggcuaacuggaagauaaaagcuuuuuagugugccuacaacaggugagaugccuuuggcauccugucuuagacaagcuuggaaccacuuuacaaaggggcggccaaggguuuauuuauuuauuuacuuuugguuugggagaaaggaugggaaaaguuuucccuccuaaucugaguugcuucaaguuccaaagucugagaucccuucuugguguuuagauaaauggaucacccugucuguuuuccucuuuugcaucucacaacacccaaugcucuauauagucaagcccaauuuagguggcuucucuuccuuuaacucaguuaagauacuacauucauugugaugagaugaaauuuuucagggacaggaaaagggggaaguucuaaaaugccugcaacagccacaggcuuaggaaacaaacaagauagauauauuauuauuccacagcucaagaccucacagcauuuuccauaagcuaucuaucuuuguauucugcuugaauauggacagauuuaaucacccccuuaugaggauuaguguuuuugucuucaaucuagacuauggcaggccagguuaaaaggacaucaucuaguugugauaccaaaguccacagcaacagggagcgagacacaugcuacuugacccacucuaaacauaacuaacugggauaaauagguuauagucauuugaugugcuagaaaggaaugggguuaggaaggcuauguaccauaacuuuauauugcuaauagcuagcaagccucccaucucugggugagagucagugcaaaaaauuggcugcucaucagugguucauuagucagcaagggaccagagaagagggguucagccugcaauaaggaugcaucccaagcccuguauaggucacaagaaacuccaaagcaaaaauuggagcacagaagcagcagccucccuaggcagauauaauugagcugaaccuggccaaagauggcagaggaaggugggcaaagugaaaacucagaggaguuuaucuuagccaauaagauuuucaaguggaacagcacuacucaccccuaccccucugcccaacccuugacccccaauucacaugcucaggucuccauucuggaauugauaacuacuuggcuagguuuccauucauggcaguagaggaguagcugguagagagagaggcaccuugcucaccccucuccuuugacaggucaagguuggaagcucgauagugauuggguugaagcuggaaggguucaggccgcacccugggcagcugagggauaccaugggugauaccuacaggcuuggcuugagacugagaguuggcuccagaaauggaagagcaacugggcucaucuacaggcagcaguacaucccgaggcuuggcccucccacucugggaggccugugauugaagguuauagcaagggcccaugggcagggguaggugcgaaggucgagcuagcugagacacagagucuccagguguucuuccuggcacugacacuggcauugccacaggagguacacaacagguugccugcacauaggaagacugauugaaaggcucauacaacugauuagggcucauccaagcaagaccuggccccacuggaagaggacagugagcccagggaggccagucauagaccccuggagguucaguguagagagacaagggacuaucccgaccccauucuccuuccucuucuucaccuucuucaucugaaucuuccuggugggccuggagcucaucagacuccauguaacccugggcuaggugagaacuggagagcuccagcuccagagacucugcauugucaagggaacggcuucuccuauugagugccauugcagcaggaggaggucgaggguggacuccggggaguccuaaguaucgagggaggcugcuaacuccccagggcaggccuugguagaaccgacugugauagcuguugaaggcauguuugugguaauaacccagcucaaaagcuuccaaggaggcuguaagaucuucgucauuguugaacucaggauucucuucacacuugccuucuccaucucguuccacgucagcaauaucaaaggugaccauggggggcagcucagggagguuuugagugaaggaugagucagaaucagagcuguaggacaugcugguaaaaagguuuccauugcuggugaacucuacuagggccugugagaaacucacaguggcauucccuuccuucuccucuucuucuuccucuggcuccucagggggugaguaacuaggguacgccuuccugggugagccuccaaaauuugcuucuugcaugucuggcucaaacauggcaucacucuggaagagcugcauuaaacaaguacuuugaucuuuuuuggaacaaguccccucaaaacgcuucuccagaggacggaaaucccuccagucuggcucacugcuagaaguagcagggaaagcugaagugguuccccggugagaagucugagaaccuccugaugucccugccaccagacccaucacugagggaccuaagggccucaucugauacuccaaggcaggcuucuccugccguaccuuggucucuuggacucgacccucuugagaaugagccucuaaggccugaguuucucgggcucggacauuucugccauaagauucccgaguaugggugucucgggcauaagcuucucuggcaugagccucucuggcacaugccucuugagccucacgcugcucccggcgaaguucccaguauagcaacugcuucuggauggucacuagccguucuuccucgguuuccauugccccagguggccgagaagaaaagggcuccaaguucaagaaaggauccaacaucucugaguugcguccacggaggucauauaggcagucauccccagguggggagugcucaagacugucaucuggcucauagaacucauauagcgcaucaccacuauagcugucccuggguagacaaucccugugggcaagucccagagccucaccugaaucauccucaaauccuggugugguagagucauaauaaccuucaucacuauugggagcagacucuugcuggucgcucugaggugucaaaaguucuccaaggccuagauuaggauaagacugaacugggucaagaagcauguagcccugguggcugggagauauagcaguaugguagcccagauucauauuaaaucuuggguauaucugggcacuugcccacagauacucuaagucaucauuuuccucuccauccuuaaccuccucuucauccucuaauaauucuucuucuucuucuucuucuucuucuucuucuucuucuucuucuucuucuucuucuucuucuucuucuucuucuucuucuucaucaucauugucaucaucaucuggcaaggccaucuccuccccaccuccuugguagguuaccaagcaggaacuucgcuuggucccaucucgguuggcccucuggccaccagaggccaugcuaucugucaugcuguccauguccuguucugcuauaaugucaccacaaccugucagugagucaaagcuuuuuagcgauguaacauccccaaacaagaggcuuagcugauccccaacagggccauuggguggguuuacuucuccugccaccacuuuuccuucuguuucugaaguguggggcuccucuagacuaccaccuucaagaacaggcuugggcugcaugaacucugaggcacagguccuugugaguuuuucuggauuuuuacaagcugccuucucaguaguuggugaaaaauguacuugugcuggagacauuuuugguccaggggcauccugggguuuggcauuuuccuuucuagugucucggaauaucuccucagagcugggcagagagauugaacucacaugcucaugagaccugguucuugcccccucaaguuccuuggccccuggcacacuuuggucagccccagaagucuugcccuuccggugacggcggauacugcuaaagaagcuuuuuaggcuuuucuucggcuugugcacagaggguaccuucucaacuccagcuuuuucuauggcuucagucccagaugucuuauguuuagagccuaucuccaacgcuccauuggcacucugggagcuaggaaauugagcagaugacuuggacaaagguguagagaggucuguuucuucaaugacaacaucuucaggucccugagacgcuucacuuagaccaucgugagucuuacucuuguuuagacuuuucuuagagcugacuuucccagaaccuuugcuucguccacccccaaagaaacuaggcagaguacagauucccuucuugccaccaaagaguuucauggcaguuuucuucagccuaccugggccugauaagggaggcucugauguugguccuucuguugccucaguugucuuauucuuggcucccuuuucagcucccuggucuugggcaucgcuagaaguugaugcuccuuugguuugaacagcuucauccuguugacucuccaugaugaagacaauucuuccacuggauaugcugccuuuggauuccgggcacacuuauaacaugaucagucaggaagcaucacaguggggucugaaggagauaagagagacaaagacagagauagauacuagugagcaaguacacaggcuagguugguuuuuaugggugcuuacugucucaggauucaauuagaaaagagagaaaauaacaaaauagaaguagaagguacucuacccaacucauucuaugaagccacaauuacucugauaccuaaaccacagaaagauccaacaaagauagagaacuucagaccaauuucccuuaugaauaucgaugcaaaaauacucaauaaaauucucgcuaaccgaauccaagaacacaucaaaacaaucauccauccugaccaaguagguuuuauuccagggaugcagggaugguuuaauauaugaaaauccaucaacauaauccaguauauaaacaaacucaaagacaaaaaccacaugaucaucucauuagauguggagaaagcauuugacaaaauccaacacccauucaugauaaaagucuuggaaagaucaggaauucaaggcccauaccuaaacuugauaaaagcaaccuauagcaaaccaguagccaacaucaaaguaaauggugagaagcuggaagcaaucccacuaaaaucagggacuagacaaggcugcccacucuugcccuaccuauucaacauuguacuugaaguccuagccagagcaauuagacaacaaaggagaucaaggggauacaaauuggaaaagaggaagucaaaauaucacuuuuugcagaugauaugauaguauauauaagugacccuaaaaauuccaccagagaacuccuaaaccugauaaacagcuucggugaaguagcuggauauaaaauuaacucaagucaauggccuuucucuacacaaagaauaaacaggcugagaaagaaauuagggaaacaacacccuucucaauagucacauauaguauaaaauaccuuggcaugacucuaacuaaggaagugaaagaucuguaugauaagaacuucaagucucugaagaaagaaauuaaagaagaucucagaagauggaaagaucucccaugcucauggauuggcaggaucaauauaguaaaaauggcuaucuugccaaaagcaaucuauagauucaaugcaauccucaucaaaauuccaacucaauucuucaacgaauuagaaagagaaaucugcaaauucaucuggaauaacaaaaaaccuaggauagcaaaaacucuucucaaggauaaaagagccucuggugguaucaccaugccugaccuaaagcuuuacuacagagcaauugugauaaaaacggcaugguacugguauagcgacagacaaguagaccaauggaauagaauugaagacccagagaugaacccacacaccuauggucacuugaucuuugacaagggagcuaaaaccauccaguggaaaaaagacagcauuuucaacaaauggugcuggcauaacuggcgauuaacauguagaagaaugugaauugauccauuccuaucuccuuguacuaaggucaaaucuaaguggaucaaggaccuccauauaaaaccagagacagugaaacuuauagaggagaaaguggggaaaauccucgaagauaugggcacaggggaaaaauuccugaauagaacagcaauggcuuguacuguaagaucgagaaucgacaaaugggacaucauaaaauugcaaaguuucuguaaggcaaaagacacugucaauaagacaaaaagaccaccaauagauugggaaaggaucuuuaccuauccuaaaucagauagaggacuaauauccaauauauauaaagaacucaagaagguagacuccagaaaaucaaauaaccccauuaaaaaaugaggcucagaacugaacaaagaauucucaccugaggaauaccgaauggcugagaaacaccugaaaaaauguucagcauccuuaaucaucagggaaaugcaaaucaaaacaacccugagauuccaucucacaccagucagaauggcuaagaucaaaaaauucaggugacagcagaugcuggcgaggaugugaagaaagaggaacacuccuccacuguuggugggauugcaaguuguacaaccacucuggaaaucagucuggugguuccucagaaaauuggacaagguacuaccggaggaucccgcaauaccucuccugggcauauauccagaagauauuccaacuaguaagaaagaaacaugcuccauuauguucauagcagccuuauuuauaauagccagaagcuggaaagaacccagaugccccucaacagaggaauggauacaaaaaaugugguacauuuacacaauggaguacuacucagcuauuaaaaagaaugaauuuacaaaauuccuaggcaaaugguuggaccuggagggcauuauccugagugagguaacccaaucacaaaagaacucaaaugauauguacucacugaugaguggauauuagcccagaaacccagaauacccaagauauaaguuacaauuugcaaaacacaugaaacucaagaaggaagacccaaguguggacucuuugucccuucuuagaauugggaacaaaacacccacggaaggaguuacagagacaaaguuuggagcugagacaaaaggauggaccaucuagagacugccauauccaggaauccaucccauaaucagcuuccaaacgcugacaccauugcauacacuagcaagauuuugcugauaggacccugauauagcugucucuaacgagacuaggcuggggccuagcaaacacagaaguggaugcucacagucagcuauuggauggaucacagggcccccaauggaggagcuagagaaaguaacuaaggagcuaaagggaucugcaauccuauagguggaacaacauuaugaacuaaccaguaccccggagcucaggucucuagcugcauauguaucaaaagaugaccuagucggccaucacuggaaagcgaggcccauuagacuugcaaacuuuauaugccccaguacaggggaaugccagggccaaaaagugggaauggguagguaggggaguggggggggggaggguaugggggacuuuugggauagcaugggaaauguaaaugaggaaaauaccuaauaaaaaagaaaaaaggggaaaaaagagaauuaaaaaauaauuuagaucauagggcaaguaacagguugagcacagcuaaaucaaauauccaaaauuuugaaacacauguguuaccaacgucucacuuuggggagcacucuauacuugauuagugaugaccaaccugaaagaucuaugcaacccuucccaaacuuaaaauuuuccuacucccagccucaaaucuggaauacauuugguccaaaagaaaccucagauaaaggaaagcaaccuggauuaucucagaauauucaauaaaguaagccaggcauagcagcacacgucuuuaaucccagcacauggaaacagaugcagguggcuaucugugaauugggaauccagccugguuuacagagggaguuccaggauaaucagagcuacauaguaagacccugucucagaauauaaaauaaguuaaaauaggaaaacaaauaaaguaaaacaaaggucaugauucaaacaugaacaccaaaccaaaccaaaaccagcaauguaauuccuuggaggccagggaggagaagccucacacugagggucaggagcauguauuuccucaucguccucuggggaugcguuaccugagccucucugugccaacagggaacaacugcuguacagagcaaacaggaaaaaauauuuaaaauuauuugcaucaagauguucacaaaaaccagcuuuaaagucaaugguuuuguaagcagcuguaacuuuaaugccuugguucuccacagugcacaggguuacuaaaguuaggcaagaugcguuucaauaacucugggucccuguuacacauaaaugaaacaacaugguuuuuuuguuguuugcuuccuguuucuuuaugccacgcauuuccuuaguaauuuaucuugauuuucuccucagauuuuugcucuccacuuuuccuaggcugaagugaaggacuauuugacuugggauuuaccuuaaaccucaguuaagaacaauuuuaccugugacccucaagagcuuuaaucagaacaucagguuucaagggcuuuuccgccuucauuuaaaaucacccuuguacaaaugaaauaaauguuaaaaagucuaaaaaacaaaacaaaacaaaacaaaaaaaaaacaaaaaaagagagagagaaaauaaguaaacacugguaaaaccaucuauuccauauguuuuguuugcuggucuagauucuucugagcuccagggcauuuuaaacccuacaaugagcaacaggcaguucauugcagcucaucagcuacccccucacuaauccacucccuuuagacuguuuuaaguagagagcaggauuugacagaggcaauuguaggugugcaaaagcccaguugcgcaauugucucugaggaagcuuaucaguuaucagguuggggucaggaaaggaguagagagguugcuucuagcaucacugaaguuuugaaaauuguguguggggaguugcucauugagccuucauuggguucuacuggauccaggccuuaguuaaacauuaacccguacuaucaccaacauucuucugagggcugggaagacaaguguaucuacagcuuuaucuucugccuagagguucucuuaauugccccuaggacaauggccaaaccuuuggaacaccagagaagaaacaacauugaguugcagaucagagcuguaauguaggaccugcaaaaugauacgguagccuccgaaaaaauaucauccuggcuucuguauccucuguccaagaagcuuaccagcaucuaccucuuuaaguaaccccuuauggagacuauaugagggguagaucuagaccagaaucucuauugacucuuccuggcaaguggaaacaccagauucuacuguagaacuguaaggcaaaaauuucuucuacuuuguuccucguaauaucuugauucccaucuagguugcuaucuagaaagggaacuugagaacacacaacucuguaugauucaugcuccuagccuaggagauauuuaaguacauaaacuugguguaagcugcacaauucugcucaaggcuaccuagucccaaugccaauagaacuggaauuaaaaagaagggcuaaauguaaaugagcuaaauaccuaauaaaaaauggaaaaaaaaaaagaagggcuaaccaccuucuacaccaacacaccccaucauucccuugguuccugacaagucugguauuuuccagugacaguaaacaucuagcauuuaaaccagugauuagccuucagaaaucuagcgauccuuucuuagaaagcccuucccuucucugaacccucuuuguagaucuaaggguaacaaagggagacagaagagcuguugggauugagagagcaagaugcuaaaacagcaggggaagggagagagugagacugaagcagucccaggaaucacuggccagaaaacugguccagugacugaaugcuacauuaaggagauucacacaguuaaaauaauguaguccagcacuggagcugaagagaaacuagcaacuauacucuagccugugauuucauuagacaaaccucuccuacuacaauuucgugccuggugccucacuuaguuugacacauuuaaaucaucagaguuacccgaguuccagugcuuugcuaaacaaccagagucauacacuucugacagaguuacagagauaagagaaaaacucaucugaucuucucagugcagagauuuaaguugcuauuuucucaaguuaugcauuucucugugccauauaucuugacauuacacucucaacacucagcucucuaaugaauagacaguacccucaccacuaagcacaugacuaccuagaauucugugccucauguuauaaugaaaauaugggcccagcauguagcugaauuccuuaguauuaaucuucucacuucagccuugaaauuacuaacaggauugccauuauggcacuggggauggggguggcagcagugaaguuauaugugaaacuguauuuccugguguguaauuuguaaauuaaaucucucugaacauucaguaagugacagacacuaaagucgguguaucaggcaacacuaagaaguggaacucucaguccuagcuuuagagagcuuauaggcuaguagggagaaaaucuuaucuacagaaguuugaagauacagcaaaauauaggccuucaaagaauagccuauuauuucuuuuuguuuguuugguuggauuuuuuuguuuuaguuuuuuuauuuguuuguuuuuugagacagggucucucuacauaguccuggcucuccuggaguuugucauauagaccaggcuggccucaaacucacagagauuuucaugccucugucuccgagagcugggaucaaagaagcccugucauuucuuuauacucugcuaaugagccuuuagauaaaaauaaaagguaaaacauacucccugggcucagaaaaguugccuugucccaaaaccuguggcuggggagaucccagaccuuaggagagaaccuacuacuauuauuuugcuaaauggauucacuaccaaauugcuuucuaagcacuuuauacucauacaucgguacagcucucaacccccaucagggcuucuuuuugaaguagacagugauuaaugagaugcuguagaguacucaucucucaagauaaaucuguaucaugccuccuaccccaaaauucagggaucaucaaggaagagggggcagaaauacuguaagaacaagagguaauggaaggauauugcaaaaucuuuucuggauaugcuaaagcuacugcacauaugaacuuucagcaaccgugacugcauguccaagaccugcaguagaucaagucagccaaaauuucagcauggauugguaaaggacucaagagcccccuucccuucaugaagagcuaauggcaggcaaugauggcugcuguggggagggagucagcuuucuucagaaguguggccccuaguguguugcuuguguuccaguggauaguccuauauccacacauauauggcaucacuaauuggacucauugcaauagaaaacaaagaagagggcauuaaguuguaagggagauggaagauggguccugggggaggagaggggaaugauagguggguauagucaaaaucacuuuacacauguaugaaauucuuaaacaacagauacguagguagaagacaaguagacagacagauagauauauugauauauagauagaugauaaaaaagagaaaagaaaguaaagaugcuuugaggaggaagaagcuucagucuggacucugucaagcaguagggaauggaaauggcagugaucuagaugagguauguguucuuauccaucaaaggggacucauucuaguggauucaaucaggcccagggagcaguacugguuagaaugagaguaucccccauagacucagaugucuaaacaccaccagaugguggcgcuguuugaggaggauuaagagguauaagauucuuguaguaaguuuugucacuggaggcaggcucugagaguuuauaaagacuaugccaucuguaguugguucucucugcuuuaugugugaagcucaagauaugaacucucagcuuccuguuguugcuaugccugcuaacuacugcccaugcuaccccaaucauuaugaauucuaaacuucuggaaccauaaauuaaauaaacucuuugguuucuguuuguuuugguuuguuucaguuguuuuuuguuuguuuguuuguuuguuuuuugguuuuguuugguuuuuguuuuugaauguggaagauuucuuuggacuagaaaagcaguugaaugguauaagcagagcuuaaugggcugagcuuggagacagugcucagaucaaaacagacucaagaugccuggcucaggauguuucagagggaagcaaaaacuucagcagcaacuaugcuagagaaaacuuuuguguuucuuuggcaaagaaucugguuucauucugccuuugucacaagaacuuuccugaggcuaaauuuaagacuaauguacuaauuucuuugguggaggaaauuucaagguagcaauaauacugaaucucuguugugguuauucauagugacuuuuacgcagguguacaacaacaaaaaaaauagcaaguaggguagaaggaauuauaaaauguaaaguuugaagaaaaaagaaucaccaggaaacuuaaugcuacgccaaagauucaaaagcccgaggcuauaaaguauauguccuuuacccugggacagagauucuauuacuucaauguagaccucccucuuacccagaccccagguuauguuuugcuaagcaaggaucaaucuuaaaacuauguuauaucucucucuuaguuuuuuuucccuuccagaaccaugcccuugccuguguuccacagaacaccuugaaggaguacaguagaaauauuauauagaucaaagcucccuaaaucuggucuuauuuagcuaucucuacccuaaggcuucuucacacuccuuauuaaucuaucaugguccucaaacuguccuucuaaaacaugcgauucugcuuugaccuaggguaagaagaaguccuucaggagagagaacuggagcccaaaacauaaggaacagcaaaggacaaacucuaaagcucccuuaggcugggacuggcuuuccuuaggcucuugccaagaaagugguccugccaaaugcagagcuccucaacacucagauuucucagucaguguggcuggcuguuuuucagaugggcuguugggaacccuaccaagauacuugauauucccagauagagacuacuagcugcagucacugugacuguagcagaguacaggcuguggaagaaaaugauggaaccacuuaaaauccaagaaguaaccucaggccauuuugggacaagcaaaugcuggcucccaaagaagagcguccuucuuuucaccucgacuuaaaccccaaguagaagaauagccacagacucaccugaaacacuucucuugaggaagaaacaguuuuaguucaaccuugacauuuucuguucuuggccuagcccuugaccaguuuaauagacaggaaagaaccuggguacagguucagaggcguggccuuuacccaugauaguuuccagacucauuccaagcagucuuaauuuauccagucccucaguauguuaguggagagaggguaaagaagcuguaaaaaugcugaguauccucccuuuagagagcuagacaguucuucacuggaaucaacucugccacgcugggagaauucagcaaguuauccaaccugucugacccucauauuccugaacugugaaauggggcuauugagaauuucuacuuauugagauuauugucgaaacaaacccaaugcauguaaaguaccaaauaaaauucauugcacagcaaaagcucaaauguuauggcaaauuguauuaauguguaucccaacgauguauggcuggacaauuucuagcaguaaaucaaccccaaucaggcauucuccaaagcucuauagguaucucugaaaccuuuucaguuuccccuaaauauaaauuauggugauuauguaguuauaccacaggaagccuuacuugcucauuagaccaacuuuuaaugucaagggagcuaacaauguuagaucaucugcgagauuccagauaggauccaagccagaaagaucaacauuuuaaacugagcuaaaagugccacaaucaacagaaaugcaauuaacacacccucuccacccaccguguguaccuaccaguauacaaggcgcucccuauucacuauucccacuauuucuucccgguaccacauuaaucccugguccuggcacaugguaaagccuugucacugaaaagaaaaaugugcccggacuuggggaaagauuugucuaaggucucuaaugggaucaugacagaacuugaguaguuucuaggccucuugaguuccacuucccuggcacucugcuucacuugugcugggcccccaauuaaagaauuaggacgggugugaauaugaucaaaacacacuuaugaaauuuucaaagaaccaguagaacauguuuuuaaaguacugggccaggagaaaagcaaagguucccuuuauaccugugaauagcugucguuuccuuucauuauucugcccugucucagcucacuuuaacuuuuccugaaggguuucuugucuauagcuguuuuuggucuuacccagugcauucaaaaaacaaaaccaaccaaccaaccaaccaaccaaaagacaaaagccccugaugaccucaguacucaggugcuaucuauucagcuggugaccucuucccucaucaauaaaugcugucaccacuccuuucaaacuacgggacauaucuucuguuuuguuuccuugggagagaaguuugagguacaaaaauuuuuuuaaaauuaaaaaaaaaaacccaaaaagcugaacuagaaagcuaacacaguggacaauuuugaaaaguuugaccuacuuaaacauaauguccucugcuacucaaguagcacauuacuggugcccauaaccaccugaggucaaaauguucaugguaugaaagaagggcuccugguuuggaacaguggaaaugaucgaaagagucccccuuacccacuccugcaccacucuucuuuccgaauuugcagcauucuuuucagaaaacaacucaucaguucccgaugauccacaaaucccaaagcuggccuuguaucccugccuugauucccucugucuucagcugcccuguucacacaugcauccuugcuuacuuccuucuggcaggcuucaguguguccacugagguucucucacaaggccucucucagucacugcaucuaccuuggagcacgugcuugggaugcugguucaguuggacucuaacucagcuggaguuugccagccugaaacuggaaugccagucucaccccuuucaggcagaaccauuugagaaaguaucucucugagacagaaguguccugcaugugugaaaugaagagaaaaauacaccauaucuugcaaaacugguuauggaugcaaaggcaaacuguuuacuaugcauggagcagauaacuacauaaugggcucuuuggaugaggcugcuugcagccaaggcaccuugucucuauuugucaauugguccccaccggaguccucugaaguugauacaagcuuucuaaucaaaccccuuugucugaccuucaauaucugcuuuucccaaacgcccacugaaaguuuuucagcuuuauuucucuacccuaaggucucagaauauacagggaucuuauucaguucagaagacaggguaccaaaacacagcccugaaaugagccuucuugaagguuucuuuuuuucuguuuuauuuccggguuguuuguguuuuggugcugggggaauacacacagcaucucauaugugcugggacaguauucuaauccucagccccacuccaccccaccccaccccugaggagcauccuaaugccucagcuuugaucauuucucagcucacaaucagaaucuuuaagauccacuuacuugccccugccuuugagucucaucagagagauuauuuuaccaaguagaagcuaugucugcacaacgcacccccaccccccugcagugugucaguacuagccaagcaaaggcaaaaucagagacaggcuguaccugcuccaucuauucagaaaggguaggaaauauuuccucuuggggcuaaaacuuuaucaucuaguucaucugccuaaacuggcuuugcacagagaagcucaggagaugacauccagagucucccuuuuccauuuuagguagccuaacugcgaaggagugagagagcuagaacucccuucucugucuuugguucugaggaguuacaaauauucccugauaaagcagaaagacaaggaguccauggcuagguaauaaagauggcaaacuuccucacccugcaggccugagacaaaagccuggcagcuuaaaacaaaagccuugcaggcuuuuucuccagguagaaggccucuugcugauggacuggcucaacaaguuuaaggccagaucaggacauguuuacacaacaguuuugggucaaucagccaucuggccuuucuucaaacugaccaauccuaaauuagugaaggaagacccuucagaaacuuaccaagaaaaaaaaaaaaacaaaaaaaaaaaccaaaacacaacaacaacaacaacaacaacaaaaagaaaagccaaauaaauaaaacgaagccccuaaggagccucugagcucuggcucccugaguaccccucuaucuugugaugggucuuccccugugcaugcuugcuguguguaucucuguguauguuucauacaugucauacaagcauuucuuuacaagcacuguguugcuguuugcuccucugugcuguguuccagaauuuucccacugcuagcugcauguucaagauuuuuccugccuuuaaauuauuuaacaggcagagaaaacaaagcugaucaggaccccuagacagcaaagguucuacaaguaaacucaugagaagauaagccugcugcuguuuuccuuauuucuuuggacuagugaagcagggguauuucuuccauacacugagugcaaauauuacaguucuugaggugccaacuuuucccaaauacuucccuucuccagauacuuccagcccccagcaggcugcaagccuuaaucucuugacugagaggaaaaaaaaaaguguucccagaaugcaacugccacauaaacccaggcagcuuucacuuuuaaggacuaggcuagugggaggagggaguaguaguucaucaaaugugcacugacugaguggugcuuccuggagaccuugggcacaacauaaaggacuaccacaaaagagcaauaggcuguaucuccucaaauugcugugucuugcuugcuuucuaggccacaucuaugaccauagggggcuuaacugcuaguccacacaaaaaccuguguagcugagagaugugggggguaaaaagaggccugaaggauauuucucuagcuuuuagcaaauaaguauuuaggcccaggugcuccuccccaaccuaugaaaugccaaaaggaaucuuacagugugaaauuucccucuugugauagcaugccccuccccacaccucuacuuagaacuuuagagguaaccuguuaccuaccuaacuuguaggaugcuuucaaucucuaagaccccauuuaaaaacccuuucaaaaacucuauuauugggcugguggugguacaccccuuuaauccuagcauucaacacaggcaaauaucgaugaauucaaaggcacuggcuuacaaagcaaauuccagaacagcugggacuaccuagugaaauccuguuucaaaauaauaacaaaaccccaaauuaccccaauacaaauacccccaaacaaucaaacacccuuccauucuuaucgcugguucgaaggugcauccaccacccccaaccccugacccugaccagccuuuguucaaugaucuaaagaucuucgccuaaaaagauuagaucaccauuucaaggcuugauguuuggcaguucccaccacuggguccuaaacucuuuugcaccucugaguuaugccaccuccaccacucacccugccugccaggcacucccuuucauuucucauucugucuauucuuucucuaccaaacuccuguacuucccagcugcuuucuaaaugcagagagagagaucucuccauggcacuuugccuguaggcucaugaaucagcaaccaaaaguaugcagagcuccaggguuugagcaguccagacccugauaauagagggaacuaauuaugacuuucuuuuugaauguaguagcaacccaaucccucuuuccacccacacuagguauauuauauccauaucugagccuuaggcacguuuacuuuauguuucauggauuaaggcaaacacaaguugggaggauaaaggucuuuucuaaaguucuacaaagacagaaaguccuucuggaacauucacucauuaauugcuuuauaaaucuaggauccuagaggguuguagcugaggccuaggcuuuauuuaccccuaugaggguucugagagaaccuaaauaccuauauaagggaaacaaagcagagucagugaaacuuaacuguacaggaguuccaagaggucugcucaucuagaagcagccugaaaugccccaaagagaaaguugguugagaacugaggccugaaagggagggacuuggacaaguguaggaugagaguguuugagugugggaaaggugcuggacugaagucaaagcagggcagagucagaugcuggaaauaaaagaccagcugcaaagauguguugaggucuggucaauuagguaggggugaaaauaaugugguauccccaauccuagcuuggguguaugugugugugucuauauagcuauaucuauagauagauagauagauagauagauagauagauagauagauagauaucccauguuaacguuacaaaguaagagauuuauuuacugggucucaaugccccacuauaaagcuguccagccugcacagucccuuagucaaauccccucucuuauucuucaggaaugccuuaauaguccagaguggugcacagaguagggcacucgaaggaaugggcuuuguuggaaucuccaaugguaggacagaaaguccaacaaugcagugcccggagaccaguccauaccaguguugcugaggcaggccagccagagacgcagaagacauaugcgaacagggcugucuacacuucucucaaggcgaguccagcgacagggaggaugguccugcuguauuagucccgcugccgccuuugccucccauggcucaucuggcaagcuuagccccucaaaggggagcucaggagaaaucacgccuuugggcggucaccagugucagaggugucugcagcagacaaugacagcagucuggcaggcuggguauuuuaaguaacugagaaguuguaggauuugucugccuuauauauacuguguguucuuuacuacaacgacggcccccuccgccucuagcagggaaauccccccacaauauugugccuauugcuauuuuaaaccaaaggcuggagagaaaaagaaaaaaaaacgcgcccuaugcccuacaagggaaaagaggcgcguagggggugggggcggcaacaaagcggccuugcagcucuaacccaagggccaguaagagcuccugguccagcccgccugcaaugggggugggagccaaacgacagacuggaggcccaggagggggugcggcugguugggaccauaggaccaagguuccaggauaagugggaaguucagaaacccaacugugcucccuugaggaggaacagacuguggauaucuuaauccacccuaaagccagucucagucuggccauaagcgagcgcgccagcuuccucugcagaggagagacauaggagaugcaccgcagaggggaggggccacagcaaggccucgcgggugagcagcaccggccuaacagcuguuccagaaaauauacuacaaacaaagauaaggaguucccggccugcaaaugcguucuccgggugcuggcuagcggcgcccuucccggaaccacgcaacagcacgugugggcccaucccagccucccauuacaaccuagaggcguagcccaggauaguccgcccgccuuccggcccucccaccccaccccccagccacggucgcccggacccuaaagacuaacggccgcugggcccuucgcuggacaguacgcaaagcgaguucaaagaaagaccagcaagaggcugggacuccgaucagccaggcucuggaaacccuaguccaggagaccagagcggagcacgcggggaugcacuagaccuucagcaggauggcucuuagcugugugcaaugcuuacccugccagguccagcucccagcgcuguuuauugucugcugcgcugcuccgauuugagcuggagccucugcugagaacgccaccacugcuccugccgcagccuucaccgggacuacagcagucuucugcgccgacuacccuucuccaggcucugggcagcucccccauacccccuucaccccggacuccacaguuauagggugggacguccgugaua

SEQ ID NO: 9629 - RNA, 24562 nt, Mus musculus
uaucacggacgucccacccuauaacuguggaguccggggugaaggggguaugggggagcugcccagagccuggagaaggguagucggcgcagaagacugcuguagucccggugaaggcugcggcaggagcagugguggcguucucagcagaggcuccagcucaaaucggagcagcgcagcagacaauaaacagcgcugggagcuggaccuggcaggguaagcauugcacacagcuaagagccauccugcugaaggucuagugcauccccgcgugcuccgcucuggucuccuggacuaggguuuccagagccuggcugaucggagucccagccucuugcuggucuuucuuugaacucgcuuugcguacuguccagcgaagggcccagcggccguuagucuuuaggguccgggcgaccguggcugggggguggggugggagggccggaaggcgggcggacuauccugggcuacgccucuagguuguaaugggaggcugggaugggcccacacgugcuguugcgugguuccgggaagggcgccgcuagccagcacccggagaacgcauuugcaggccgggaacuccuuaucuuuguuuguaguauauuuucuggaacagcuguuaggccggugcugcucacccgcgaggccuugcuguggccccuccccucugcggugcaucuccuaugucucuccucugcagaggaagcuggcgcgcucgcuuauggccagacugagacuggcuuuaggguggauuaagauauccacagucuguuccuccucaagggagcacaguuggguuucugaacuucccacuuauccuggaaccuugguccuauggucccaaccagccgcacccccuccugggccuccagucugucguuuggcucccacccccauugcaggcgggcuggaccaggagcucuuacuggcccuuggguuagagcugcaaggccgcuuuguugccgcccccacccccuacgcgccucuuuucccuuguagggcauagggcgcguuuuuuuuucuuuuucucuccagccuuugguuuaaaauagcaauaggcacaauauuguggggggauuucccugcuagaggcggagggggccgucguuguaguaaagaacacacaguauauauaaggcagacaaauccuacaacuucucaguuacuuaaaauacccagccugccagacugcugucauugucugcugcagacaccucugacacuggugaccgcccaaaggcgugauuucuccugagcuccccuuugaggggcuaagcuugccagaugagccaugggaggcaaaggcggcagcgggacuaauacagcaggaccauccucccugucgcuggacucgccuugagagaaguguagacagcccuguucgcauaugucuucugcgucucuggcuggccugccucagcaacacugguauggacuggucuccgggcacugcauuguuggacuuucuguccuaccauuggagauuccaacaaagcccauuccuucgagugcccuacucugugcaccacucuggacuauuaaggcauuccugaagaauaagagaggggauuugacuaagggacugugcaggcuggacagcuuuauaguggggcauugagacccaguaaauaaaucucuuacuuuguaacguuaacaugggauaucuaucuaucuaucuaucuaucuaucuaucuaucuaucuaucuauagauauagcuauauagacacacacacauacacccaagcuaggauuggggauaccacauuauuuucaccccuaccuaauugaccagaccucaacacaucuuugcagcuggucuuuuauuuccagcaucugacucugcccugcuuugacuucaguccagcaccuuucccacacucaaacacucucauccuacacuuguccaagucccucccuuucaggccucaguucucaaccaacuuucucuuuggggcauuucaggcugcuucuagaugagcagaccucuuggaacuccuguacaguuaaguuucacugacucugcuuuguuucccuuauauagguauuuagguucucucagaacccucauagggguaaauaaagccuaggccucagcuacaacccucuaggauccuagauuuauaaagcaauuaaugagugaauguuccagaaggacuuucugucuuuguagaacuuuagaaaagaccuuuauccucccaacuuguguuugccuuaauccaugaaacauaaaguaaacgugccuaaggcucagauauggauauaauauaccuaguguggguggaaagagggauuggguugcuacuacauucaaaaagaaagucauaauuaguucccucuauuaucagggucuggacugcucaaacccuggagcucugcauacuuuugguugcugauucaugagccuacaggcaaagugccauggagagaucucucucucugcauuuagaaagcagcugggaaguacaggaguuugguagagaaagaauagacagaaugagaaaugaaagggagugccuggcaggcagggugagugguggagguggcauaacucagaggugcaaaagaguuuaggacccaguggugggaacugccaaacaucaagccuugaaauggugaucuaaucuuuuuaggcgaagaucuuuagaucauugaacaaaggcuggucagggucagggguugggggugguggaugcaccuucgaaccagcgauaagaauggaaggguguuugauuguuuggggguauuuguauugggguaauuugggguuuuguuauuauuuugaaacaggauuucacuagguagucccagcuguucuggaauuugcuuuguaagccagugccuuugaauucaucgauauuugccuguguugaaugcuaggauuaaagggguguaccaccaccagcccaauaauagaguuuuugaaaggguuuuuaaauggggucuuagagauugaaagcauccuacaaguuagguagguaacagguuaccucuaaaguucuaaguagagguguggggaggggcaugcuaucacaagagggaaauuucacacuguaagauuccuuuuggcauuucauagguuggggaggagcaccugggccuaaauacuuauuugcuaaaagcuagagaaauauccuucaggccucuuuuuaccccccacaucucucagcuacacagguuuuuguguggacuagcaguuaagcccccuauggucauagauguggccuagaaagcaagcaagacacagcaauuugaggagauacagccuauugcucuuuugugguaguccuuuauguugugcccaaggucuccaggaagcaccacucagucagugcacauuugaugaacuacuacucccuccucccacuagccuaguccuuaaaagugaaagcugccuggguuuauguggcaguugcauucugggaacacuuuuuuuuuuccucucagucaagagauuaaggcuugcagccugcugggggcuggaaguaucuggagaagggaaguauuugggaaaaguuggcaccucaagaacuguaauauuugcacucaguguauggaagaaauaccccugcuucacuaguccaaagaaauaaggaaaacagcagcaggcuuaucuucucaugaguuuacuuguagaaccuuugcugucuagggguccugaucagcuuuguuuucucugccuguuaaauaauuuaaaggcaggaaaaaucuugaacaugcagcuagcagugggaaaauucuggaacacagcacagaggagcaaacagcaacacagugcuuguaaagaaaugcuuguaugacauguaugaaacauacacagagauacacacagcaagcaugcacaggggaagacccaucacaagauagagggguacucagggagccagagcucagaggcuccuuaggggcuucguuuuauuuauuuggcuuuucuuuuuguuguuguuguuguuguuguuguguuuugguuuuuuuuuuuguuuuuuuuuuuuucuugguaaguuucugaagggucuuccuucacuaauuuaggauuggucaguuugaagaaaggccagauggcugauugacccaaaacuguuguguaaacauguccugaucuggccuuaaacuuguugagccaguccaucagcaagaggccuucuaccuggagaaaaagccugcaaggcuuuuguuuuaagcugccaggcuuuugucucaggccugcagggugaggaaguuugccaucuuuauuaccuagccauggacuccuugucuuucugcuuuaucagggaauauuuguaacuccucagaaccaaagacagagaagggaguucuagcucucucacuccuucgcaguuaggcuaccuaaaauggaaaagggagacucuggaugucaucuccugagcuucucugugcaaagccaguuuaggcagaugaacuagaugauaaaguuuuagccccaagaggaaauauuuccuacccuuucugaauagauggagcagguacagccugucucugauuuugccuuugcuuggcuaguacugacacacugcaggggggugggggugcguugugcagacauagcuucuacuugguaaaauaaucucucugaugagacucaaaggcaggggcaaguaaguggaucuuaaagauucugauugugagcugagaaaugaucaaagcugaggcauuaggaugcuccucagggguggggugggguggaguggggcugaggauuagaauacugucccagcacauaugagaugcuguguguauucccccagcaccaaaacacaaacaacccggaaauaaaacagaaaaaaagaaaccuucaagaaggcucauuucagggcuguguuuugguacccugucuucugaacugaauaagaucccuguauauucugagaccuuaggguagagaaauaaagcugaaaaacuuucagugggcguuugggaaaagcagauauugaaggucagacaaagggguuugauuagaaagcuuguaucaacuucagaggacuccgguggggaccaauugacaaauagagacaaggugccuuggcugcaagcagccucauccaaagagcccauuauguaguuaucugcuccaugcauaguaaacaguuugccuuugcauccauaaccaguuuugcaagauaugguguauuuuucucuucauuucacacaugcaggacacuucugucucagagagauacuuucucaaaugguucugccugaaaggggugagacuggcauuccaguuucaggcuggcaaacuccagcugaguuagaguccaacugaaccagcaucccaagcacgugcuccaagguagaugcagugacugagagaggccuugugagagaaccucaguggacacacugaagccugccagaaggaaguaagcaaggaugcaugugugaacagggcagcugaagacagagggaaucaaggcagggauacaaggccagcuuugggauuuguggaucaucgggaacugaugaguuguuuucugaaaagaaugcugcaaauucggaaagaagaguggugcaggaguggguaagggggacucuuucgaucauuuccacuguuccaaaccaggagcccuucuuucauaccaugaacauuuugaccucaggugguuaugggcaccaguaaugugcuacuugaguagcagaggacauuauguuuaaguaggucaaacuuuucaaaauuguccacuguguuagcuuucuaguucagcuuuuuggguuuuuuuuuuuaauuuuaaaaaaauuuuuguaccucaaacuucucucccaaggaaacaaaacagaagauaugucccguaguuugaaaggaguggugacagcauuuauugaugagggaagaggucaccagcugaauagauagcaccugaguacugaggucaucaggggcuuuugucuuuugguugguugguugguugguugguuuuguuuuuugaaugcacuggguaagaccaaaaacagcuauagacaagaaacccuucaggaaaaguuaaagugagcugagacagggcagaauaaugaaaggaaacgacagcuauucacagguauaaagggaaccuuugcuuuucuccuggcccaguacuuuaaaaacauguucuacugguucuuugaaaauuucauaaguguguuuugaucauauucacacccguccuaauucuuuaauugggggcccagcacaagugaagcagagugccagggaaguggaacucaagaggccuagaaacuacucaaguucugucaugaucccauuagagaccuuagacaaaucuuuccccaaguccgggcacauuuuucuuuucagugacaaggcuuuaccaugugccaggaccagggauuaaugugguaccgggaagaaauagugggaauagugaauagggagcgccuuguauacugguagguacacacgguggguggagaggguguguuaauugcauuucuguugauuguggcacuuuuagcucaguuuaaaauguugaucuuucuggcuuggauccuaucuggaaucucgcagaugaucuaacauuguuagcucccuugacauuaaaaguuggucuaaugagcaaguaaggcuuccugugguauaacuacauaaucaccauaauuuauauuuaggggaaacugaaaagguuucagagauaccuauagagcuuuggagaaugccugauugggguugauuuacugcuagaaauuguccagccauacaucguugggauacacauuaauacaauuugccauaacauuugagcuuuugcugugcaaugaauuuuauuugguacuuuacaugcauuggguuuguuucgacaauaaucucaauaaguagaaauucucaauagccccauuucacaguucaggaauaugagggucagacagguuggauaacuugcugaauucucccagcguggcagaguugauuccagugaagaacugucuagcucucuaaagggaggauacucagcauuuuuacagcuucuuuacccucucuccacuaacauacugagggacuggauaaauuaagacugcuuggaaugagucuggaaacuaucauggguaaaggccacgccucugaaccuguacccagguucuuuccugucuauuaaacuggucaagggcuaggccaagaacagaaaaugucaagguugaacuaaaacuguuucuuccucaagagaaguguuucaggugagucuguggcuauucuucuacuugggguuuaagucgaggugaaaagaaggacgcucuucuuugggagccagcauuugcuugucccaaaauggccugagguuacuucuuggauuuuaagugguuccaucauuuucuuccacagccuguacucugcuacagucacagugacugcagcuaguagucucuaucugggaauaucaaguaucuugguaggguucccaacagcccaucugaaaaacagccagccacacugacugagaaaucugaguguugaggagcucugcauuuggcaggaccacuuucuuggcaagagccuaaggaaagccagucccagccuaagggagcuuuagaguuuguccuuugcuguuccuuauguuuugggcuccaguucucucuccugaaggacuucuucuuacccuaggucaaagcagaaucgcauguuuuagaaggacaguuugaggaccaugauagauuaauaaggagugugaagaagccuuaggguagagauagcuaaauaagaccagauuuagggagcuuugaucuauauaauauuucuacuguacuccuucaagguguucuguggaacacaggcaagggcaugguucuggaagggaaaaaaaacuaagagagagauauaacauaguuuuaagauugauccuugcuuagcaaaacauaaccuggggucuggguaagagggaggucuacauugaaguaauagaaucucugucccaggguaaaggacauauacuuuauagccucgggcuuuugaaucuuuggcguagcauuaaguuuccuggugauucuuuuuucuucaaacuuuacauuuuauaauuccuucuacccuacuugcuauuuuuuuuguuguuguacaccugcguaaaagucacuaugaauaaccacaacagagauucaguauuauugcuaccuugaaauuuccuccaccaaagaaauuaguacauuagucuuaaauuuagccucaggaaaguucuugugacaaaggcagaaugaaaccagauucuuugccaaagaaacacaaaaguuuucucuagcauaguugcugcugaaguuuuugcuucccucugaaacauccugagccaggcaucuugagucuguuuugaucugagcacugucuccaagcucagcccauuaagcucugcuuauaccauucaacugcuuuucuaguccaaagaaaucuuccacauucaaaaacaaaaaccaaacaaaaccaaaaaacaaacaaacaaacaaacaaaaaacaacugaaacaaaccaaaacaaacagaaaccaaagaguuuauuuaauuuaugguuccagaaguuuagaauucauaaugauugggguagcaugggcaguaguuagcaggcauagcaacaacaggaagcugagaguucauaucuugagcuucacacauaaagcagagagaaccaacuacagauggcauagucuuuauaaacucucagagccugccuccagugacaaaacuuacuacaagaaucuuauaccucuuaauccuccucaaacagcgccaccaucuggugguguuuagacaucugagucuaugggggauacucucauucuaaccaguacugcucccugggccugauugaauccacuagaaugaguccccuuugauggauaagaacacauaccucaucuagaucacugccauuuccauucccuacugcuugacagaguccagacugaagcuucuuccuccucaaagcaucuuuacuuucuuuucucuuuuuuaucaucuaucuauauaucaauauaucuaucugucugucuacuugucuucuaccuacguaucuguuguuuaagaauuucauacauguguaaagugauuuugacuauacccaccuaucauuccccucuccucccccaggacccaucuuccaucucccuuacaacuuaaugcccucuucuuuguuuucuauugcaaugaguccaauuagugaugccauauauguguggauauaggacuauccacuggaacacaagcaacacacuaggggccacacuucugaagaaagcugacucccuccccacagcagccaucauugccugccauuagcucuucaugaagggaagggggcucuugaguccuuuaccaauccaugcugaaauuuuggcugacuugaucuacugcaggucuuggacaugcagucacgguugcugaaaguucauaugugcaguagcuuuagcauauccagaaaagauuuugcaauauccuuccauuaccucuuguucuuacaguauuucugcccccucuuccuugaugaucccugaauuuugggguaggaggcaugauacagauuuaucuugagagaugaguacucuacagcaucucauuaaucacugucuacuucaaaaagaagcccugauggggguugagagcuguaccgauguaugaguauaaagugcuuagaaagcaauuugguagugaauccauuuagcaaaauaauaguaguagguucucuccuaaggucugggaucuccccagccacagguuuugggacaaggcaacuuuucugagcccagggaguauguuuuaccuuuuauuuuuaucuaaaggcucauuagcagaguauaaagaaaugacagggcuucuuugaucccagcucucggagacagaggcaugaaaaucucugugaguuugaggccagccuggucuauaugacaaacuccaggagagccaggacuauguagagagacccugucucaaaaaacaaacaaauaaaaaaacuaaaacaaaaaaauccaaccaaacaaacaaaaagaaauaauaggcuauucuuugaaggccuauauuuugcuguaucuucaaacuucuguagauaagauuuucucccuacuagccuauaagcucucuaaagcuaggacugagaguuccacuucuuaguguugccugauacaccgacuuuagugucugucacuuacugaauguucagagagauuuaauuuacaaauuacacaccaggaaauacaguuucacauauaacuucacugcugccacccccauccccagugccauaauggcaauccuguuaguaauuucaaggcugaagugagaagauuaauacuaaggaauucagcuacaugcugggcccauauuuucauuauaacaugaggcacagaauucuagguagucaugugcuuaguggugaggguacugucuauucauuagagagcugaguguugagaguguaaugucaagauauauggcacagagaaaugcauaacuugagaaaauagcaacuuaaaucucugcacugagaagaucagaugaguuuuucucuuaucucuguaacucugucagaaguguaugacucugguuguuuagcaaagcacuggaacucggguaacucugaugauuuaaaugugucaaacuaagugaggcaccaggcacgaaauuguaguaggagagguuugucuaaugaaaucacaggcuagaguauaguugcuaguuucucuucagcuccagugcuggacuacauuauuuuaacugugugaaucuccuuaauguagcauucagucacuggaccaguuuucuggccagugauuccugggacugcuucagucucacucucucccuuccccugcuguuuuagcaucuugcucucucaaucccaacagcucuucugucucccuuuguuacccuuagaucuacaaagaggguucagagaagggaagggcuuucuaagaaaggaucgcuagauuucugaaggcuaaucacugguuuaaaugcuagauguuuacugucacuggaaaauaccagacuugucaggaaccaagggaaugaugggguguguugguguagaaggugguuagcccuucuuuuuuuuuuuccauuuuuuauuagguauuuagcucauuuacauuuagcccuucuuuuuaauuccaguucuauuggcauugggacuagguagccuugagcagaauugugcagcuuacaccaaguuuauguacuuaaauaucuccuaggcuaggagcaugaaucauacagaguuguguguucucaaguucccuuucuagauagcaaccuagaugggaaucaagauauuacgaggaacaaaguagaagaaauuuuugccuuacaguucuacaguagaaucugguguuuccacuugccaggaagagucaauagagauucuggucuagaucuaccccucauauagucuccauaagggguuacuuaaagagguagaugcugguaagcuucuuggacagaggauacagaagccaggaugauauuuuuucggaggcuaccguaucauuuugcagguccuacauuacagcucugaucugcaacucaauguuguuucuucucugguguuccaaagguuuggccauuguccuaggggcaauuaagagaaccucuaggcagaagauaaagcuguagauacacuugucuucccagcccucagaagaauguuggugauaguacggguuaauguuuaacuaaggccuggauccaguagaacccaaugaaggcucaaugagcaacuccccacacacaauuuucaaaacuucagugaugcuagaagcaaccucucuacuccuuuccugaccccaaccugauaacugauaagcuuccucagagacaauugcgcaacugggcuuuugcacaccuacaauugccucugucaaauccugcucucuacuuaaaacagucuaaagggaguggauuagugaggggguagcugaugagcugcaaugaacugccuguugcucauuguaggguuuaaaaugcccuggagcucagaagaaucuagaccagcaaacaaaacauauggaauagaugguuuuaccaguguuuacuuauuuucucucucucuuuuuuuguuuuuuuuuuguuuuguuuuguuuuguuuuuuagacuuuuuaacauuuauuucauuuguacaagggugauuuuaaaugaaggcggaaaagcccuugaaaccugauguucugauuaaagcucuugagggucacagguaaaauuguucuuaacugagguuuaagguaaaucccaagucaaauaguccuucacuucagccuaggaaaaguggagagcaaaaaucugaggagaaaaucaagauaaauuacuaaggaaaugcguggcauaaagaaacaggaagcaaacaacaaaaaaaccauguuguuucauuuauguguaacagggacccagaguuauugaaacgcaucuugccuaacuuuaguaacccugugcacuguggagaaccaaggcauuaaaguuacagcugcuuacaaaaccauugacuuuaaagcugguuuuugugaacaucuugaugcaaauaauuuuaaauauuuuuuccuguuugcucuguacagcaguuguucccuguuggcacagagaggcucagguaacgcauccccagaggacgaugaggaaauacaugcuccugacccucagugugaggcuucuccucccuggccuccaaggaauuacauugcugguuuugguuugguuugguguucauguuugaaucaugaccuuuguuuuacuuuauuuguuuuccuauuuuaacuuauuuuauauucugagacagggucuuacuauguagcucugauuauccuggaacucccucuguaaaccaggcuggauucccaauucacagauagccaccugcaucuguuuccaugugcugggauuaaagacgugugcugcuaugccuggcuuacuuuauugaauauucugagauaauccagguugcuuuccuuuaucugagguuucuuuuggaccaaauguauuccagauuugaggcugggaguaggaaaauuuuaaguuugggaaggguugcauagaucuuucagguuggucaucacuaaucaaguauagagugcuccccaaagugagacguugguaacacauguguuucaaaauuuuggauauuugauuuagcugugcucaaccuguuacuugcccuaugaucuaaauuauuuuuuaauucucuuuuuuccccuuuuuucuuuuuuauuagguauuuuccucauuuacauuucccaugcuaucccaaaagucccccauacccuccccccccccacuccccuaccuacccauucccacuuuuuggcccuggcauuccccuguacuggggcauauaaaguuugcaagucuaaugggccucgcuuuccagugauggccgacuaggucaucuuuugauacauaugcagcuagagaccugagcuccgggguacugguuaguucauaauguuguuccaccuauaggauugcagaucccuuuagcuccuuaguuacuuucucuagcuccuccauugggggcccugugauccauccaauagcugacugugagcauccacuucuguguuugcuaggccccagccuagucucguuagagacagcuauaucaggguccuaucagcaaaaucuugcuaguguaugcaauggugucagcguuuggaagcugauuaugggauggauuccuggauauggcagucucuagaugguccauccuuuugucucagcuccaaacuuugucucuguaacuccuuccguggguguuuuguucccaauucuaagaagggacaaagaguccacacuugggucuuccuucuugaguuucauguguuuugcaaauuguaacuuauaucuuggguauucuggguuucugggcuaauauccacucaucagugaguacauaucauuugaguucuuuugugauuggguuaccucacucaggauaaugcccuccagguccaaccauuugccuaggaauuuuguaaauucauucuuuuuaauagcugaguaguacuccauuguguaaauguaccacauuuuuuguauccauuccucuguugaggggcaucuggguucuuuccagcuucuggcuauuauaaauaaggcugcuaugaacauaauggagcauguuucuuucuuacuaguuggaauaucuucuggauauaugcccaggagagguauugcgggauccuccgguaguaccuuguccaauuuucugaggaaccaccagacugauuuccagagugguuguacaacuugcaaucccaccaacaguggaggaguguuccucuuucuucacauccucgccagcaucugcugucaccugaauuuuuugaucuuagccauucugacuggugugagauggaaucucaggguuguuuugauuugcauuucccugaugauuaaggaugcugaacauuuuuucagguguuucucagccauucgguauuccucaggugagaauucuuuguucaguucugagccucauuuuuuaaugggguuauuugauuuucuggagucuaccuucuugaguucuuuauauauauuggauauuaguccucuaucugauuuaggauagguaaagauccuuucccaaucuauugguggucuuuuugucuuauugacagugucuuuugccuuacagaaacuuugcaauuuuaugaugucccauuugucgauucucgaucuuacaguacaagccauugcuguucuauucaggaauuuuuccccugugcccauaucuucgaggauuuuccccacuuucuccucuauaaguuucacugucucugguuuuauauggagguccuugauccacuuagauuugaccuuaguacaaggagauaggaauggaucaauucacauucuucuacauguuaaucgccaguuaugccagcaccauuuguugaaaaugcugucuuuuuuccacuggaugguuuuagcucccuugucaaagaucaagugaccauagguguguggguucaucucugggucuucaauucuauuccauuggucuacuugucugucgcuauaccaguaccaugccguuuuuaucacaauugcucuguaguaaagcuuuaggucaggcauggugauaccaccagaggcucuuuuauccuugagaagaguuuuugcuauccuagguuuuuuguuauuccagaugaauuugcagauuucucuuucuaauucguugaagaauugaguuggaauuuugaugaggauugcauugaaucuauagauugcuuuuggcaagauagccauuuuuacuauauugauccugccaauccaugagcaugggagaucuuuccaucuucugagaucuucuuuaauuucuuucuucagagacuugaaguucuuaucauacagaucuuucacuuccuuaguuagagucaugccaagguauuuuauacuauaugugacuauugagaaggguguuguuucccuaauuucuuucucagccuguuuauucuuuguguagagaaaggccauugacuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugaucuccuuuguugucuaauugcucuggcuaggacuucaaguacaauguugaauagguagggcaagagugggcagccuugucuagucccugauuuuagugggauugcuuccagcuucucaccauuuacuuugauguuggcuacugguuugcuauagguugcuuuuaucaaguuuagguaugggccuugaauuccugaucuuuccaagacuuuuaucaugaauggguguuggauuuugucaaaugcuuucuccacaucuaaugagaugaucaugugguuuuugucuuugaguuuguuuauauacuggauuauguugauggauuuucauauauuaaaccaucccugcaucccuggaauaaaaccuacuuggucaggauggaugauuguuuugauguguucuuggauucgguuagcgagaauuuuauugaguauuuuugcaucgauauucauaagggaaauuggucugaaguucucuaucuuuguuggaucuuucugugguuuagguaucagaguaauuguggcuucauagaaugaguuggguagaguaccuucuacuucuauuuuguuauuuucucucuuuucuaauugaauccugagacaguaagcacccauaaaaaccaaccuagccuguguacuugcucacuaguaucuaucucugucuuugucucucuuaucuccuucagaccccacugugaugcuuccugacugaucauguuauaagugugcccggaauccaaaggcagcauauccaguggaagaauugucuucaucauggagagucaacaggaugaagcuguucaaaccaaaggagcaucaacuucuagcgaugcccaagaccagggagcugaaaagggagccaagaauaagacaacugaggcaacagaaggaccaacaucagagccucccuuaucaggcccagguaggcugaagaaaacugccaugaaacucuuugguggcaagaagggaaucuguacucugccuaguuucuuuggggguggacgaagcaaagguucugggaaagucagcucuaagaaaagucuaaacaagaguaagacucacgauggucuaagugaagcgucucagggaccugaagauguugucauugaagaaacagaccucucuacaccuuuguccaagucaucugcucaauuuccuagcucccagagugccaauggagcguuggagauaggcucuaaacauaagacaucugggacugaagccauagaaaaagcuggaguugagaagguacccucugugcacaagccgaagaaaagccuaaaaagcuucuuuagcaguauccgccgucaccggaagggcaagacuucuggggcugaccaaagugugccaggggccaaggaacuugagggggcaagaaccaggucucaugagcaugugaguucaaucucucugcccagcucugaggagauauuccgagacacuagaaaggaaaaugccaaaccccaggaugccccuggaccaaaaaugucuccagcacaaguacauuuuucaccaacuacugagaaggcagcuuguaaaaauccagaaaaacucacaaggaccugugccucagaguucaugcagcccaagccuguucuugaaggugguagucuagaggagccccacacuucagaaacagaaggaaaagugguggcaggagaaguaaacccacccaauggcccuguuggggaucagcuaagccucuuguuuggggauguuacaucgcuaaaaagcuuugacucacugacagguuguggugacauuauagcagaacaggacauggacagcaugacagauagcauggccucugguggccagagggccaaccgagaugggaccaagcgaaguuccugcuugguaaccuaccaaggagguggggaggagauggccuugccagaugaugaugacaaugaugaugaagaagaagaagaagaagaagaagaagaagaagaagaagaagaagaagaagaagaagaagaagaagaagaagaagaagaagaauuauuagaggaugaagaggagguuaaggauggagaggaaaaugaugacuuagaguaucugugggcaagugcccagauauacccaagauuuaauaugaaucugggcuaccauacugcuauaucucccagccaccagggcuacaugcuucuugacccaguucagucuuauccuaaucuaggccuuggagaacuuuugacaccucagagcgaccagcaagagucugcucccaauagugaugaagguuauuaugacucuaccacaccaggauuugaggaugauucaggugaggcucugggacuugcccacagggauugucuacccagggacagcuauaguggugaugcgcuauaugaguucuaugagccagaugacagucuugagcacuccccaccuggggaugacugccuauaugaccuccguggacgcaacucagagauguuggauccuuucuugaacuuggagcccuuuucuucucggccaccuggggcaauggaaaccgaggaagaacggcuagugaccauccagaagcaguugcuauacugggaacuucgccgggagcagcgugaggcucaagaggcaugugccagagaggcucaugccagagaagcuuaugcccgagacacccauacucgggaaucuuauggcagaaauguccgagcccgagaaacucaggccuuagaggcucauucucaagagggucgaguccaagagaccaagguacggcaggagaagccugccuuggaguaucagaugaggcccuuaggucccucagugaugggucugguggcagggacaucaggagguucucagacuucucaccggggaaccacuucagcuuucccugcuacuucuagcagugagccagacuggagggauuuccguccucuggagaagcguuuugaggggacuuguuccaaaaaagaucaaaguacuuguuuaaugcagcucuuccagagugaugccauguuugagccagacaugcaagaagcaaauuuuggaggcucacccaggaaggcguacccuaguuacucacccccugaggagccagaggaagaagaagaggagaaggaagggaaugccacugugaguuucucacaggcccuaguagaguucaccagcaauggaaaccuuuuuaccagcauguccuacagcucugauucugacucauccuucacucaaaaccucccugagcugccccccauggucaccuuugauauugcugacguggaacgagauggagaaggcaagugugaagagaauccugaguucaacaaugacgaagaucuuacagccuccuuggaagcuuuugagcuggguuauuaccacaaacaugccuucaacagcuaucacagucgguucuaccaaggccugcccuggggaguuagcagccucccucgauacuuaggacuccccggaguccacccucgaccuccuccugcugcaauggcacucaauaggagaagccguucccuugacaaugcagagucucuggagcuggagcucuccaguucucaccuagcccaggguuacauggagucugaugagcuccaggcccaccaggaagauucagaugaagaaggugaagaagaggaaggagaauggggucgggauagucccuugucucucuacacugaaccuccaggggucuaugacuggccucccugggcucacuguccucuuccaguggggccaggucuugcuuggaugagcccuaaucaguuguaugagccuuucaaucagucuuccuaugugcaggcaaccuguuguguaccuccuguggcaaugccagugucagugccaggaagaacaccuggagacucugugucucagcuagcucgaccuucgcaccuaccccugcccaugggcccuugcuauaaccuucaaucacaggccucccagagugggagggccaagccucgggauguacugcugccuguagaugagcccaguugcucuuccauuucuggagccaacucucagucucaagccaagccuguagguaucacccaugguaucccucagcugcccagggugcggccugaacccuuccagcuucaacccaaucacuaucgagcuuccaaccuugaccugucaaaggagaggggugagcaaggugccucucucucuaccagcuacuccucuacugccaugaauggaaaccuagccaaguaguuaucaauuccagaauggagaccugagcaugugaauugggggucaaggguugggcagagggguaggggugaguagugcuguuccacuugaaaaucuuauuggcuaagauaaacuccucugaguuuucacuuugcccaccuuccucugccaucuuuggccagguucagcucaauuauaucugccuagggaggcugcugcuucugugcuccaauuuuugcuuuggaguuucuugugaccuauacagggcuugggaugcauccuuauugcaggcugaaccccucuucucuggucccuugcugacuaaugaaccacugaugagcagccaauuuuuugcacugacucucacccagagaugggaggcuugcuagcuauuagcaauauaaaguuaugguacauagccuuccuaaccccauuccuuucuagcacaucaaaugacuauaaccuauuuaucccaguuaguuauguuuagagugggucaaguagcaugugucucgcucccuguugcuguggacuuugguaucacaacuagaugauguccuuuuaaccuggccugccauagucuagauugaagacaaaaacacuaauccucauaagggggugauuaaaucuguccauauucaagcagaauacaaagauagauagcuuauggaaaaugcugugaggucuugagcuguggaauaauaauauaucuaucuuguuuguuuccuaagccuguggcuguugcaggcauuuuagaacuucccccuuuuccugucccugaaaaauuucaucucaucacaaugaauguaguaucuuaacugaguuaaaggaagagaagccaccuaaauugggcuugacuauauagagcauuggguguugugagaugcaaaagaggaaaacagacagggugauccauuuaucuaaacaccaagaagggaucucagacuuuggaacuugaagcaacucagauuaggagggaaaacuuuucccauccuuucucccaaaccaaaaguaaauaaauaaauaaacccuuggccgccccuuuguaaagugguuccaagcuugucuaagacaggaugccaaaggcaucucaccuguuguaggcacacuaaaaagcuuuuaucuuccaguuagccaaguucuuagcauuuucaaaggaccaggcuucuugagaggaaagauuguaauguacccuugcucugccaaacuacagggcugauuugcauggcaguugcaguccuuucugaaaugaacagcacccucucuucucuugcauccaugcagguuucuuuuucuuuuuucuauauuuuuuuucuggacaaggucccacacuguaguucucucuagccuggaacuuaccauguagaccacgauggcuucuaacuaacagagauccaccugccucugccuccaagcaagcccagccuaaauguuggaaacacuagggaagagcuuggugucaggaaaacauugcaacaggcucaucuugaccagguucaacauuuccuuaaucaucuauaugaaacaguuucuuuaaaauucuccaucaggcccgguguggagguaugugccuuuuaucucaacacucagaaggaagaggcaauuggaguuauaugagugugagaccagccuguucuacauagugaguucuaggccacuagggcuacauagcaagauagaccuuguuuuaaauuuuuuucuguauuggaauaugaaauauuuuggggaucgauauguugaucaaaguuagaacuuuuuaaaucuucugcccaugucccucuucucaccucaaagccaucuucacaucuacuaagugaagauaucaauagggcucuugcucaaaauaaggcaauuuaccuugagaacagaugcugguggccuucugagucaagauugcuuuguagacauacuuucuuugccagggcauauauucauaauauuuuucacaguuucuaagcuugggauuggcccugugccuuucccccaaaagagcagauuugauugguaaaaucuaaccccuuguaaguaacuucauaacuuugcauggcaccagcacuagaaccaccccucaaggaccucagaucagcucucuuggaugacuuuggcuacaucacgaagaagugcaucucuuguggaucuggauaaugaaagugaaaaaggccuuccuuaccccaaccacaucgucauaagagacacaugcccagauuuuaaccacuuggccuccuaccaaagcuguucugggaaggugaggcugaacuuagccugguuggguggcaggaaguaagcacucaaugccuuuacaacaggaaaagccacaccucuugccuagucaagguagcuugaguugcuguuuacaugucgcugccaucuacagcaggcacuagagcuguccacagccuccauagcccacuggagaagggcuaccagccuguuuggaagaggaagaaggaaucuacccucacaguucaggaggacagcacagugcaauaucucugaagggaccugcuauaacuuggauauauuuugcuaugcuuugaaacuucauaccuuagaguaggaccugaggcaaaguagaaguuuguggauuggguaacaucauugccuuccaaguccuuucacugaucuggcugcuagccuagggacaaaauauuuacaaccuaaaaugggauagccaagaugucuacagaagcagacuccuuuugaguaucuaaagcaaauacuaacugcagccuagaaggggaaagaagauuuggcugcggauauaugguaauggcaacaugauuaccaaugggauauguaaccaaucucuagguaucuguccaaacauggacaaguacuuccuuugcuggcaccaaauaugcuacaaacuaccagaagugcugcuauuguguucacccuaaggcuguggccagaugaaccuccugacuccauugcagguccuuggacaaugcauuuggaugugacuuuaagggaagaugugcugacagaaggaggcuagcuuuauguuguuacccaguacuacuauauagugucagcucugauccugagaauuucuuaguaacccaguccauagaggaccagugacuguggguauggaaagccaccuagcaggccucuuccaaagccaggaugccaauuucuuggugcuuuagauucuccaaggaagcucugccuuggggaucaucuggcuuuagcuuagauaccagaccacaagccucguggauaaugguuucaguaaaugccagugucccuccucuuagugcuauuucaaggagggaaguagcuuuccacacucagaauguugggugcaugauuucauccugccaccaguggcuuuuucaccugcaccagugccaccacugccuucagcccuuaggcucacuugcuagagggaggcauggggguuuaccagggauacuucaaguuuacccauguguauguugcauccaaguuguuuuuaauauauauauauaaauauauauaucaaaagcuaauuaucuauuuuuauauuguuugcauuuuauauucauggaaacaauguuuaucaauuguucuuuucugauauauuuuauuuuuaagcggugcuguuuacaguuuuaaacaaaaaaaaaagaugacacaaaaaaugcugcugcucgugcagagggaugucaucucaaagugucuaggacccucccucuuuucccucucccaccuggcugugucacacuauucauucucuuuccacacgguaaggacagaagaugcccauguaccgaagaccaauaccagguaacgcaagcauguggacccuggcagacagcauguuuucuagcuuucauuuuauuuaccuuuugagcccuuccuucucuuguguagacguuuugaaaguacuccugccucuugacuuuuauucuuuuccuuucuuuauauuuugugcuuguuuuuugcaaaguaucaugcccauauugugugguuuguuguauuaaguuucuccaauggagcauuaggggcucauucaacaccaggagacucgggaugacagaugacaaugcuauuucaaccuccaggaauuggucaucuccuugggagacacccuugaaugagacuugccagcaauuuagaagauggcaacauuguccagaaaaggcauuaggugauuccuuggucccucuugcuacuuugggagaaucucuccacauccugccuccuccuucccuucccuguuccagcucacaaguggaugguacuuuuggaaacugaacucuuguuguuuuguuuuuuuauuguaagucuuagcccuuaauggcugaguugucucuuuaaccaggauggcacuuuuaggaauggugacuguuacagucauggcuggguggccugauccacgguuucuccauccuguagucauuccaaagaagaaaauccacauggcauguacauuugugaggguugggucuauuaagagggggcuuuaauuauuccuguuacuauuggugcuuauuuuccccgcuguauauggggguggggaagggcugggguaaaccagaaauguauauuuaggucacguuaaauaaaauggcugggggaagaagaaagauaugagucuagguguaagaguucucucuuccaggacagaaaggggauuguagcuuguugcugcaccugagcuucccuuccgcauuccugagacaucauggaaucaucugcauuuguuaccucuccaucccuagcacucacuggcaucuggauauccugauacacugccuguauguuacaacauauauuucauuugcugaaugcuaauaaacuucugugcucaugagggaccuccagucacuaaag

SEQ ID NO: 9630 - RNA, 4110 nt, Mus musculus
ugugaauuaacuuuuaaggguuuuuguuguuguuguuauuguugguuucuugagacaggguuucucuguguagcccuggcuguccuggaacucacucuguagaccaggcuggccucgaacucagaaauccaccugccucugccucccaagugcugggauuaaaggcgugcgccaccacugcccagcuaagguuuuuguuuuaguuuuuuuaaauagaaaucuuuaaaaucaaaaguaacaugauuuuauugcauggguaucugaucauucaauaucuuuaaccaguauagggucacauugaggcuucuagagaaauagaugaaccuuccucuuagcaauucuacugcauguaugaauuuacguauuugguuucagauguguuugucucucugguaucaacuuuucuauagugacaagaugggaaguucuauacagucuauaguuuacaucuguauagaucacacauacaacuugauuuugucacaauuuuauaguuucaauucgauucaaaagugaaaucacaugucgacauuuaaauuuugcuuucuuaaagaccagaguaaagcagcuguauuucuucuacauauuuuacuugaccacauuuauuaaccauucuuagcuuucagaaagucuuuucaccuuagcaaauuaggggucaggcugaagccuucuauagaggaacuagucuaugagcuuauguucaacacuuaguauguauaucauacacaagugcucaagagcuggaccaggaccaagggacuuacauagcagaaucuacugcccuuauccugggagggauggcauucagugauagcuacagaguuggaaauucugacaaauucaacauuacaggacaauguguagugaaagagagugcagaggcauacaagccacugucucuagcuguccaccauuugagcaauaagaucaguaaucaauagagcagaaugucuuuaggaaaccaaaccaggguauuuucuagguggcaaaagcaguuuccaaaggggaaguguucugcuacgcacuucaaacccaugcaaagagggugcacuggauuagcucauacugaaaggcauuauuaaaugggccaggcagcaccauuugcacaauuugaaucuuauucuagguagaaucauuuguagcuacaugccucuagaaggggcauuuauuguuuuuugguuuuuuuuucauuuuuguuuuuuuuuaagaugcauuaaaugagcccuccuuucugaauucacuguauauuucaacauuuugaaccaugaccagcucccaauuucugaggcuggcacuuacuaacuucuacaguccuuuuucaugagaguugagaaggccuggccuuggccuuuuguuucuucaugagaagguguaauacugccuauaaauguuucuuacugugaaacacucugacugugaggcuguagucaggguuguuucuggugguuugauaauggcuuccaugcugcuuuccagcuuucucucucugugaaaguugaugaauaguacaucuuaaucaguauucacuuagccacgauuuuacaucugucucuuccuacccucuaauaguuccauuccccaguauacugauaaaguguaacaauauuuucuaucgagugggcccagcaaacuugacaguugccucugcagugcuuguugucucacacaagcaccucuucauaccuugaacuucuuggaccuucuaaaucuuccccuugacuagaucaggguauuugacaaucucagaguauuccgaugccuucguacaauuaguucaucuuccuaccaaugacacugcaguguccauuggcuucccaauuuguggggaaagcccaagauucgucuugucagcugcaauucaucuggaauauguucauguuuaaaauucaaagaaaaauaaauaguaagcuccucccagucaggggaauuuuuuuagagauagcauauggauuuuuuacuuucuaagaaaggauugccuuuguucucuccuuguaaaauguggaugaaccaaagcagcuaagagcaaugccucaaauaaccagaaaugaccuuucguugauacaaauuguaucucuuuuucuccugauuguauagaaacaaguauacaaaacucaucuuaaacuauguuuaguacuuaauuuucaccauauuuguggcacugugugucacaggaaaguagcccaggggugacgagggagcuuuuauuuccaaagggcaguaguaguuuauagacaaauacaguuuucaaggccucuuuauuguuagaugcacaacuacuguguguacaaucugcaacauugugauucucuuuagccuauuaaauuuaauauguccuuguaaaagggauuuuuauaaagugucaauaguaauacaccauauguaagaauccuuaaggagcuguauaaauaugaaugcauaaauccaacuugguucuuacauuagagaaacauuuuuuauaucaagaucugcauacuucuugacuuuuccauuuugucuauaauuauaaaauagcaaauaaagaagagcauugagaccucgguagcacccuucuaggggcuaaaugugucguccuucaggaaacuuaccuccaaguacacagcagggguuaaggcacagcguucuguguggucuucaagaagcagcggauucuguaagaggugcuuugucauuugaauuccuucacugauuuuucugaccucauagcaaaucugugccuguccaggccuuagacuuuguauuuucugauuuuuguuuucuuguugugaccuucuuauuguuguuguuuucauucccaccuaaaggagaaaugugacucuggcagggcauggucaaugcagagcaccuuuucuauaggacagcucaaagaaagaggagccuuucaaaggaacuauugaacucacuuaagguaccggcuauggaagggagcauggcagaugcuguauggaaauggucuguaaaacuuuucuucuaaucaaugaagcauauggcaugauuuuucucucccuuucuuauucucucaaacccuuucuaguuucuaagagacuacuucuucacaauccuccgccccccacuuuuuuuuuaaaucucggaauauaugaccuuuauaaaacaauucaaucauuaauaucuauuaauauuuguuacaguuucccucuaacguggaacaguucguugugaagaggcucucaguuaacauucuaucugugcucuuaagugugcgaguuuguacaagugcccuuuuggagggccaacaauuccaauagaguuuguuuugcucuguaaaucagguuuggauuugcacagggaaaguaaugccaagcuguccaaagagccccgcucaggucuccuccuaccccuuuucuuccaccuccucauaugcuucucuucagguacgaaacugaggagugcauaaugugcaaccaaaauggcacuaguguuaguuuuccuuugaaagcaguguauuucuagaacucgcuugucuaaaguagucaacgccucugugaagacucagcauauuugauaucuauuguauuauagcuagcuauacacauaggcagauugacuauuuuuuaguccugguuuguguaucauugagcuauaguaauuuguuuuauccauuugugggauuaaacaguauuguuuaaugguuguaaacuuuuuauaaaaccacuuuggguuccuuguuugacccaaacauaauguaagucucaaugacaaaauacacagagccaaccugaggugagugaaaauauaacccuucccguuuuguccgccucuauaaugcaugugcaaugcuuuauacaauauucucacucgcaugaauguacuuaugacuucaugagguuuuuauuuguuucaccuauaauugugaugaaaaugcuguguuguugacaacaaugaacuguaaacccauuuauugcauaaacuuugucuacuaaucacugauggcucuuucuuuaagaacaucagcaacaaguaauuguacacacagacaugcacauuccaauucguuccugaaauacuaagcauauauccuuuggaguuaccugguuaaauaaacaguggggaaacagauccccagcccccaucccagaguucaccugaacuuua

SEQ ID NO: 9631 - RNA, 21664 nt, Mus musculus
cucacaaacaccaugacaaaaaucuguuuauuauuuuucaaaacacaacagaaaacgggggaaaaaucauucagauuuccauugugguaaaaagcugaauuaauaaggcugaucugucucucagguuguccagucuguaccauggguggauucuggacugagcugugccaauggcagagcuacauggacacuggcaucaggacagccaucagaagagcugcaggccagcuuugagcccaugcauuuguccuugguuccagagaaggcccuccauguugccgcugcugcugcuacugcuagaguugguauugcugccaccacaacauaggcucagagugcugcagagagaaugggcaguuggucagggacagggacagcucuaaacucugcaggagcuaagggaacuuggcauguaugugccugugggaagggccaaccucccgccugucuuuauaaagaagagccaggagcuacucuaacaagugauuucagaugagaaccaggguguggcucugcccccagccugcccccccucaaaccuugaaggguggaacuaaaaugaagcauuaugcagaacugcaguauagaaacuaggcuuguagagcggggccucuagaaaguccuacccacgaaaauaaagaggcugccucagcagggccucuuuccaaggccuagagcuuaggggcccaaagaagacuuggcuggaucccucccacaucuaauaacuaguuaacagcucaaggugaggcuugggauauagagauaagaugucccaaccccacuccauauuuuaagacugcuugaaguacccucugucucuaaccugacucaaauacacucaugucccugcuuccuguaggucaaaggacuuuccaacuagauguucacucacucaggcagauguauaguuauacuacuguaguggaaaaaugcuuagaagcacucuagucccacccauucccaucacccauaacuucacaaacaaggaaacggagauccagaguugaguaagaaauuauuugcccaaagucacauagccaagucaagggugaggcugagaaaagaauuaagggugggcauuucaucugucaacuacuaacggcagagggcugacaagcugcgacaagucacccgcucuaccagcaacacuuccccuuuauauccgggcacucacugggccaagcuauggucagguuagcuggaagagaauggagccucuaacaaugaaaucuuggaacaguaacuuauucaccugagguaauuguaaucucugagguuuacugccuccaucugcuaaucuaggccuaguccuagaagcuuccagccucgaaacaaucuuagcuaggccugggauguuuucggccucugagacuuacugcuaaaucagcucccccuuucuagggcuuucugagcucuggcuggcuggucaacucagcuguucuggcucaaaacuccucuccaugcugacugauucaaucuggcuucucucuagaccucuccugaauuccucugcguggccucaaacuaacucuagcaaucuguuccaaucuucuggauccuucucauucucuggcucaguuugucuuuaugaaggguuaaaggugugugcuaauggcugagccguaccacaacuagaaacaguuuucucaauacaaucucaggauuaacagugugaucaaauauccugcaauacaauucuacuuguaacuggcuuccacagcuacguccuuuauucaccugagucgaggacacuuggcuucuaaagccuucucccagaagguucguguacaagggaguucaggucaucucuagggaauaagcaagcagaacaggaacggacucucaauuccaauggccuacagaccagggcacgcacacacuugcacacaaacugcucucaaccuggaagggaugucaaaucaucuguguggcgacuucaucaccucucuacacuaggguaaagaaauucuaagaggcacuggcuuauuuuccccacuuuguuucuuauucagaagguagcaaucaaagaggugagaaaucccacugccacagguacucaccuacuuuuggacuucugggguucuagccggugcucuauuacagguugguccaaaagauacauggugucauaauuauccagcauaagcucugcuggguccucagucuggccugguagccggccuagagggaauguaccccaucgcacaucuucuguagaacagaggagaaaagucaaaauuauacucacauucaaaauuacacucagauuccaucuuaccucagucagaauggcagagauuacgaaaagcaauaacaauaaauaaaugcugguaaggauauagaaagggaacucugauacgcugcugauaggaauguaaaccagcccagccacuguagaagucaggauacagguuucucaaaacaaacaaacaaaaacccccaaacucagaguaccuuucuacccagguagaccacucaagaguauuuacccaaaggacucuauaaucaacacaucacacaaauauuugcacaucagugccuuauacagcauuacucauaguagauaagucauggaaccaacauagauauccaagaacagaggugugacuaaugaaaaugugauauacauaaaaaucaaagguuuuuuucagcucuuagaaagaaaauggaugcagcugcagaaaaucauuaagucugccaagucucagaaaggcaaauaucaugcuuuaucucauuuaugcuuucuagaucuuauaaagaugcauauguacuguguuaggcauuaauguagaaaucuuaacuaucaagggaaaugaggugaacuaaugaaugaggaguuaugaaaugaggauaaggggauauggugggaauauguuuaacauacaguguauacuuucacgaaaacuuaaaagauuaauuuuaaaauaucaaauaauguuuacagaaaaaaguggguugauaagcugguuuuccuacuaguacacaggcccacccccaucuaccuacccagcccucuuagcuaauucagcaugggcuuucugcagauccccuggcucuguccucacugguaccacuucucaaaaacaccucuuuguacaucuuagcacuuuguaccucuuaacccuggauacuuacacuauauacacauacacauagcuagacauauuuguuccuucuuucauucaucuuagguagaucgccacauaaacauggacaucuucauauguagcaaugcauaaauuaauagaaaucacagaauucuuacagcaugccuucuccauacccaccaauaccgaggauucugagugacugaaauuguuuaugcagcuauaccccccuccccauaauguguuugaaugccauauucuuucuuaguggccuuguccaaagauacauacacacauaccuaaggaaagauacugacucagguaacaugcucccuagacucuguacaagguuaucagucccccaaaugcacagaaagaacaccgcauauucuaccccacaaggauaugcagaagagcacacacauuccauccaaugaaugucuccugcuccacuuccugccuccuacaacuuauuuauagguggaaaccccagauaucuuaaugucaucauacauguacacaugcacgcacgcacagagggagggaagagaggcacacacauggaucucaugguuuuuaguugauucugcuuccucuucagaaaauauauacacuauggccuauuugagauucuuuucacagccccaacuuuucucuuauacccacaucuaccaccccaccccacagacacaacuguucccauaccaauuccucucuuuuuugcuauuuacaaaaaccccaacuucagccuuccuugcccuaagagauuuuuuuuugucacuaagucauaauuucccuaucagguguggacaaacacacacacacacacacacaguaugcucacucaccccuagcacucccacuugaguuuuuauacaacacuuccacaccuguccucauagggcaagggcuacagcuuuccccaugagcucaugucugauuauaucuuacuccucacugagcucagcuacuuccuuucccuucuccagguacaugggccaugucccugucucuggugaucauguacauaaaaacacguuccaccccauagugacuguucuacuugcuccaugucugccucccuugaggcuccuccuucuuaaacuaaaugaaguccuucaaaggaagacccucaguggagcagauugaugcacucacuccccaucaccaaacuucccuguauccuuucugagcuucaauuucauagacuuggauaaacaucuaaaaucugaaccacuccauauuuucuuuugauccaguuucucugacuuagugcccuggguuugaauacacauagcaaaacccaguuuuaccacacugaguguacauaaaagcaugugaucuaauauauuuuaccccucaccuuucacaugucuuugcucuuacugaccaguaagggcucacacacagcuacuuauaugaaacagcgaucagucugacaguugucccugauguuuacauacuccaaccuaagaggaaagccaguugccauucauguauccaguugccucugaggcuugccauauacuguucacaucuuacuucuuucuuauauagucucuagagugaaggaaagccucaaggguuggccagcagagcauaguaguaucaaacuauaaccucaccaauucaggaggcugaaagacgggagaucuucaggcaaucuucauuucaaaaagaguuauagcuguccggauacugggguaugcaaucagaaagcuuaggccccaggaucucaagucugagauuacacugacacuaaaucucaagagagguaggaggagaggcagagggagacagaaaggagaggaggggcccaucaagaauggagggaaaucaaugauggaagaaaauaaaaguggguguuaaagacuccuuaccagagcuuacuugccaugcugaacccugcagugcuucucucuuccgagacgugguccuaguauucucaaaaacacuggaucccugugcaagagagaaggcccccacuuccauccugucuucuucuucaucaucaucauagucaucaucuucaucuucuucuucaucaucuacuucuuccucuucuucuacaucaucacuuuccucaacaucugccuccaucugaucuugaaagaccuuuugguucucuuccuccuccuccuccuccuguucuuccuccugguguucuuccugcuccugcucuuccucuuccuccuccuuuucuuccuccuccucuucuuccuccuccuccaucuccuccuccuccuucuccucuuccucauucuccuuuuucuccucuugcuugacauccuuaagguugccuugcuccuucuguugaauacuuucuucggacucacaguugguaccaggugguuguagguccucauguaagguauccaguguguacggagcuuugccaguggaggaggaggaggaaccuucaaucgccuuugccaagccauucucuccauucugaguauaaauggaacagacucgcagcagcuucuccugcucuucaucuggcaagaccugucccauggcuuugaagacucuaagcaaacagagggacagaguaggaaaaaggucagugucucaaaguuaccucauagcucaacacucuggaguuugaacuugcucacugaacuucacaccugccucugaaaggcagcacaaaagagcagauagaaugcaaaauccaacaggaccauguaugcugaaccagcucucugguacaucucuguuuuacuucuuauuacuuuucauuagaaugaagagaaaaacagaauucaaauucuagcguucuuggggguaagaaauaagaaagcucacauagaaugccuggcagagugccuggcacauaaugguaagcaauuaaugauagcuacuagucugcacugaaacacuacauaaauauacaaacgagcuaauaggaaugcaaggcuggaaaugagaacaggagaaaacuggaggaaucuguccugggggccaaguauauggagagcagugugcuggcuucuucuguuuggaauacagcaugugauuccuuauggaagcagcuacagcccugccuggaauggaggaaaagaaggaaaacagcagcaguccacuagacaaagccaaugugcaggggagaccugaugagcacugugaagugacuguggaugcuauaggagcuaaggggaagcagagaacacaaggaggguguagagacugggggagggcuucauggaggugaggcccagguggcccaggggcaagagggccaacacugccuguggccagaguagccuggcugaaggguaaggccugugucagggagcuggaggaagaaaaggcugggaagggaagugaagugugugcauuaugaggcaggacaccugccaacuccuaggacaggucaaaguugccauuucugaagaucaccauguuaacuacagggaggaccacaagggcagggcagggcagccuaaaggcaagaugaccauggaggcaccugucuucacaauccaaaccgguuaguaaggguggaccucagguauuguugggagacaugggagggaggaagcuguagaagacagacacacagcagcagagcccaauuugcugaccaauggagauggucaaacagaggaguauuaaacaagacgauacugugcacauacaagacggugcuaagagcaaaaccacuaagggguagagagcugcuagggaggaugagggugagcacacuucacagagccuguccucuaagagguagccugcacugugggacacacagcaggagggagggaugggacauauccuucuagaagugucaggugugaagcaugcaugcuuuguggagggaacacaagccaucaugcagacuggucacaugugucuuuggggacagagcugggaucuacugacuagacugggagucccuguugacaggacucauuucauauucuaagaggacacugguucaaauggaauugaucuccuggcuggaggaagauccugaaaugcuaacaacuuuaugugaggaaaggccaggaagaaacccuccucucuccucccugucguccauuagugugauuaauaauaaauauccccgggcacuuggugcuggcaagaugccucgucacugcuguucauuacccauccgccauccccagcuuccaggcugcccauuaggugcuauggugagaggagucauaaaaugcacuuccccuccuugagugugccugucacagccugggacugaggccauguguuuaggcugguggaaagaaaguggaguuuauuuagauccacagaacucaaggccagauucccaucccauuaucaacaaaccaccaugauuuuaaggcacaccaauccucaguuccuagauaucuuaucuguaaaaauguauuauacuuaaaggaaauugccuauuuaagaaaaaaagcaugaugucugauaauuaacuauccaugguaucuuuuauauuucuuuccuuugggaggaaaaaaaaaccuaccagaguuguguauucacacaguaacagaaguuuucugccagaguucaaucuauaugaaauauuagggaaaacuccagacuuaaggaccggcuacagggauuucuggcccuagccaauauacagcauaccuaggcauaaccccucuauuucucucucuguaaauggaugaaucaaucuaaauucauugauuaucugagaaagguaggaucugugcacaaggaaucauacccaagugagccacuguuaucaguggcaugugucacaucccccugcuaugcuuggguuaggagaucucuguuguucagacuucuccacucugcaggcacuuaggauuggaaaguaucuugaaggucaucuaaccaagccucuccauguucuuuucacucccucccaaguacacaagcauccuauaucccuucuauauuuugaaguuuuggguuguuuuucuccuugaaaugcucaaaugcuucuccuuugacauucuagccugacuccuauagaaacugcuaauuugauucccaguuucuuauucaugucacuuauaguucagggcucacacaucuggcaauguggcucuauagcuuggucccaucuccuggagcucuugccuuggcugaauuugucuguaaggccacauuuuuuauuuuauaaauaugucuguagcccagauaccacuaaggguuaaagaaagacucuuggaucaaauagauggaugacaaaacugacacuguuuuugcaucccgucccccacuucacucauuccucagacgcugggucauccccuuccgauagaagaggauauuucauucaguucaagggcauuuaccaaggccuguauggugacuagauuugugugaugugcugggcuacagauaguuaauucagagcucuugcccuuguaaagcuuagucuaggagagggaaggagacacacaggcaaggcgaggagacagggcaacacaaaucucaaccuugugaaauauucaggagucaacaggacaggcuaggcugugcuaccaccaagugagaucuguaauaguuaagggcucuggacuuggacugcccauccaaaggcagauagauguuaagcuacaguugagcaguagaaauggaauuguagaagaaaagacuggaguaaggagauaugggcugagcaguuuauauacaccagaaagaagcacuggcauuucuaggaggguguggcauccagcauuaaugaagcagauacagggauuaacaaggagcucugguuuggauguaggucacgggagcuuugggacuuaguaccaaccaaacugcagcagguuaaggaggaaaaagaaugagaaaaaaaaucaagaugagaaccauuguuuggagaugggaaaagaaaaaaaacaacaacaaaauacacaugggcaaagcacauguuacauggguuguuauuacucuuuuaagaugaaaaaaaaauaacccaaacaucagacacauucauaaaggguaguaaccagcuaagcaaaggagacaaagagguagggccuuaacaaugcuggcauacuugccuccagagcacagaaagaauagacuuugaugcagugcaagaccaccucaaacuaagauugcugguguggcuauauagacagaucagcucaagagggcucaaccuuagguugagggagaccugguacaugccuucauacacuggaggaagcuagggggaaaugggagaggagcagggacuugaagucaauguauauguucagaauaguccaggacuggagacaaaguggucaguaagcaaaugaucagacagagcacugaagccuggcaugagaucaaaaccuguaagucuacaguggcagcaaagagcagugcuaugugauucucagagagaacucagcuacccaggcugaagaaugcaaagccccagagcagagaaaucagucccaacacgagaggcuggaaggcagacacugccagggcauuagcagagcagaagcuguuaaggaugagugaaaugauaaacuacagacaacgauggggaaacaaagggaaggaaagaaagaaagggaaggagguugagacacaagggaaaagcacugccacaggauaggaaguucagaaaccaaagggacaagacccggaggccacagagugggacacuggacugucagcuuucagaggaaaguucugaguaaugaaaauaugcugcuguauacagugaagaaugaaaaucucuggaguugaggaaaugcaagggucaaaugaauuguucaaaaccaauacugcuuuagcaagcaggaagagaaucagguacuaaaggcuucuagaagaaugagggcuuagggccaggaacugacaaagaagagggaaaagaagacaaccauggguauuuauaggaaucaaaacaacauugcagccggguagugguggcgcaugccuuuaaucccagcacuugggaggcagagauaggcagauuucugaguuugaggccagccuggucuacagagugaguuccagaacagccagggcuauacagagaaacccugucucaaaaaaacaaaacaagcaaacaaaaucaaaaaacaaaaagggaaaaaaaaacauugcaauugaccacacaacauggagagaacagaguaaaugggucuuccagagagauaugguuaucaugauagguagguccagaaccagaaagaucacuaaaugucagguuaaccuuugcuuugcuaagaaggaaggcauuagggauuauugaguaacuuucaaagcuauacucagggaagcaaauggaggagacagcacugggcuuggagccagaagaccuggguccacuaauaaacaccagcaacuauuuauuguacacuuacucugugcaggccacuaugcuaagcguucucccauuagacucaguuuagccaagccuuacacugcgugacuauaggcagcagcauccuauccucccccuuccagacucaauucucucaucuuauuacuggaagggauauggaguuagucaucaccaaaaaaagccuuccaauuuugccagucuaaugcggagaggcccugagccuuccagggccauacccucuuacuagauggaauuaagucucuugugagacuaugccggggccuagcaaacacagaaauggaugcucacagucagcuaauggauggaucacagggcucccaauggaggagcuagagaaaguagccaaggagcuaaagggaucugcaacccuauagguggaacaacauuaugaacuaaccaguaccccggagcucuugacucuagcugcauauguaucaaaagauggccuagucggccaucaguggaaagagaggcccauuggacacacaaacuuuauaugccccaguacaggggaaugccagggccaaaaagggggaguggguggguaggggaguggggguggguggguaugggggacuuuugguauagcauuggaaauguaaaugagcuaaauaccuaauaaaaaauggaaaaauaaaaaauaaaaaaaaaagacuuacaccugaaggaguugagggcuggcccagcauggugagcccaagcaggacucgaucaccugcggccagucaaggguggcagagcaauugaacagccuccagcucuuucuugcuucccacuggcuugcagaaaaccgccgagcauuccguccugaaagaaaacaaagaggcuuaggagaaagaagcauguggguccuucacccauucuucaaccucaaaagggauuaggcuccaucucucuucaucuccccaaauucccacgcugucauuucuaacuacucaaagcauccagagugccuccuuucuguggcauugagaagaaaaaggaaaagggagauuuuucuaauucccgcagcacucuuuggcaacuguaaacuuuuaaaaggcugagcugaggacacuggcagaugcuucuccuugggaugccuggcccccgggacuagggcuaguuuuccucaccagucuugguguuggccacgaucaguucaacgguccaucuaaggauguagguaggccggaucccagugcuccccacgguagacaacucggagaacauccucucuagcagggccugcgugaaggucugggagugcaggccccugagcaggggcugccagaacugagagaagggcuuuggcaccaacacuucauucaagucgauguuuucugguuugugacggauaccaguugaugauggaugggaagggcaaugggaccaagaucaagagaaugagagagcaccaaaacaagccagcaagagggguaggcagaagaaaagaaaaaaauugcacaccaaagagagagaacagacacgcccaaguucaaacaacaagaauugccauugcagaacaagagggaaggagagcaggagagcaggagagcagaagagcgggaaagagaaaccaguuaguaucuggcaaacaacaacugauacaaaaccaaguauaaaagaaagaacucuuucugacuucagcuucgucaauaacucacugugugaauuugguucaguaacuuccccuuucuggaccucaguuugaccaucuguaacaugaggauguuggacuagaugaccucucaaggccccuccaaugcugcuguucuagcucucuagcuaguggcuaaaucauauuugacaaggcacaacaacaguguuaagaaaccccaccuacccauuccaacccaccuuaacagauucaacgccaccuagaaaagucccaggacacaucagcaggauuaccuauucuguucagccaaaagggcugacauuucagccccaccccaccccacacuccagccuacuucuggaguucgcacauaagaaacacagaacccuaggguuucagugaacacccaggacccuaccuucauacucuaucugcaaagcugccaacugcucaaacguaggaaugaggaaaccaucaucuagaaaagcauccagcacagcaucccuaaggcaaauaaacaguuaguuuagagaggcaugguugcacaugccuauagucuagucccagcuacucaggacacucagagacugaggcgagagcauuauuaaauucagaaccacccuggguaauauagaaaaaugagucuuuaaaaaaaaaaaggugaccuuuccaaauaggcuggacugccucacugguuguuuaaaguugaaaugacuuaagggucuggaauauggcaguaccucagugguacaagacuuaacauauugugcauaagggccagagucuaauucccaguaccaagaaggaaaacgaaaaggcacacuagaaugaaaccgacaaaaagacaccuauuccugcaacacuucaagaacagcuaauagcucugguucaaauggccaaagugccagugguagagaguaaucagaagacaaagcuauuaggcuucagguuccugggacagggacugagucagagucuggagucaguaggcuuuaaacacucauguaugaagcauguggugaucuaagucccagaaaugagagcagaggugacuaaacagcucaaaucacagcauaaaaguccuagacugacagaagaaaugaaacgccugagauggccaagugcuuuuagaccucaguuccugcacuguuuuuguuucuccuguccguuucucuagccuucacacugguuaccuccuucuuuucgauccuagaggucaaacuacuagguaugcaacugcuugucuggagaugacucaggcuuccucacagauaacccaaaucaaagucagaggggucggaaacaucagcaacaggggagacuucucaacuucagcuagcucaaaccuaaagcagcaagagcgaagucuccagcuccuggcuugcuaagagccucuccuagcugacuaggucuagcaggagucaagcuuucaagaugucccaguaucuagcgggaugacaacacaguuggucagcuccuucuaucuauccagcagagcaagaugagaaaacaacuguccuuacacucaucccucaucuccucagauaaaacuccuaaaacguaaaguaaccuaccagcugccugcucagcaagcaaaggcaguuacuacgcacagaaguaauuuuucccagcugcuggggaagcugucccuccaacuuuugcugaaggguauagcuaacaagucuagcauggguaaacucuaaugaaaugucuuuggagcuaagcaucguggaguauagauauuuaauccaagcacugcggaggcagaagcagguaaauugauauuugaguuccaagacagccuagucuacaacagccacagcuacacagggaaaaccugucucaaaaacaaaacaaacaaacaaacaaaaaaacccagcaccauuaccuuugagacuagucuucugggaauaaagacaagaaaacaagaggagucccagcuuacauggcaagcuuucauccaaacucacuuauaucagaucuaguauagauucuuugcaacucuguaucuuagauuucuuuuaacuuuccuuuacuguagggccagcauugccuccauaguuuuuucuuuuaucuucuuuuuggcacugugagucaaaauaaggccuugugcguacuaggccacugcucuaccacugaccauuccacccccaagccuucuuccacagcuuauuggcagcaaguucuccaaagaccuuucaaacugaacuuaggcagaauacacaaaagcagcaagucuugccuacucugcuugaacugaacacugugggcagggcaacacacagccauaaugagaggagggaaccuagccuagcuuccagcagccaugccccaagaagaccuguccucuaucugccuggccaggauuacccaaaagaugcugacaucuuccaaaagcuguuugaaaaaaacagaccagguggggaaguguuauauaucaaaaagcauuuuucuauuugucaagucugucacauuccaugugacagagggaaaaaguugccagggacugcaugacuacaggcauuuauagcugguuauucaguaacucucaauaggcaaccugguagcuggcaggguuggaggcagaucauacagaagacauaaucaccgcuuaggggaggaggauuaacucuaggauuuccuacaagagaaaucaguuagcuacaacaugacaacggcucucuuucugcuacuaggaauugaacucagggcaauguacaugcuaggcaagcaugaucccagccaguuuucuuuuucccccucaacuauuauuuuugagacaggaucucacuaagcugcccagacuggcuuugaacucauucuguagcccaggcuguaaauuugcaaucugucuacucaaccuuuaaaguagcuaagauuacagaucuacaucaccaacuaugucuugucuugacacccaauuucaaugaggcuauuacccucuacuguagagaauaggcaacccugaguuaccaaguuacaaaccuguucucccaugaaaugcucuugaguucuucuaggauacauuguacacguggggaaagauuauuccacacuuuaauagccugaagcaaaugccuguguuucuccagcaccugacagcaaaaagaguccaaucagaagucugacucugccaaggacccuaccccaaaccccucaaggaucccuucucauaggaccucagcacuguccuuaagggaacaggacaaagcaugcauggugagcccacaacuccuuuauaagcccaacaaguaaaaagaacuagauugucuccuucucccgcucuccccacuccaaauccucuguggcucccaaacaucagaaguucugaugcucaggugccaauuggaaacauuugguuugagaugagcagagaucuuugggccaaaggguuaaggagaaaauaggagaaaugaguugcaggagcaaggagaauuguugagacccagguucccauccuaguucugccauaaacuauguauauaacccugaaucugucccuuucgucauccaagguuucaaucugucagugcaaaagggagaaaagaaccuaaauaguuuccaaggcuuucuacaaaacguacaucuuaagucucaucugauuagggacucuuacaccccaccugcuggucaucuugagaaucacagggcuauacagcuauaccccauucccaguucucuacauccgagcaaaugaaguccaugaacuucauuaucugcuugcucucuuccaucaguucacaggaucaucugacuagacucugcuggucuccuuccuaggucccacccucuccaagaaguaccuuuaugcuuugccacuuuucuuccaaauucucugagaacuucccucauguuuugccacuuucaaacucuuucucaagacgucucuuucaggcagcuggcaagagggaagaaauggcuaggacaggugacagcauaucgcaccaaggauacuaaccuuaaacuguuccucuucauaggauaccagcaauucucgcgcuuucucugaaaccagaaugaaaaacaaugaaggaagccuagccucucauucucucugggcaucugagcuuccuguaccuugagcuauaagcugacaacuagaauugcuucaacaauugaacaacaaucagauuccuucccuauuuacuucauauaacucaaaaaagauggugaggcaaauacaauauccauucaccauggaaacucuccccguaagauaguuugugacagugauuuuuuuuuuaaagauuuauuuauuauuauauguaaguacacuguagcugucuucagacacaccagaagagggcaucagaucucauuacagaugguugugagccaccaugugguugcugggauuugaacucuggaccuucggaagagcagucgggugcucuuacccacugagccaucucaccagccccuuuuuuuucuuuuuuuuaaugcuggaacuccaccacagcauacagaaaauaaauuaucaaggacaaaaggcaguacugaccucaagcuuccgugcucgcggcacaugcgccccucuuugccccacaaauaccuaccauacaacuccuugugucuugaagaugguucuggaugagaagccaccuccucauugccuuuaguauuugcaucauccucgacagccaacucuucaucuuugucaucauccugaggcucugguaucucuucaaguacaucaucggcaauaauuucacguuccucuucuucaggaucuucugcaucuagcugguccucauccaacucccagguuucuuucaggcugccuuccaguugacggcuccaguaugucuucuggagccaguugaggacaaaguagcaaccuagaagaggcagggguggauucaagagauaugccauaggaccaauuauggacaaguaauuaacagguccccaguucucuuagccucuauucucauacuguaugcauaaaggaaaagucuaaggaagagacguggcucuaaggcucaaaucucauauauuugcauauauccucucuuguauucuccugcucacugguaucuuuccuggggguugagggagugcggauauaauccuggcuugagacaugggugucaaauaaagcaaggggugguaaaugggagaacugaaaccuagguauaccagccacuuacacagccuuaaccaagucuuucccuuuucuagaucucaguuuccugauuacaagggaagagccuaaaucagggauuuuuaaucgagaugaaaugagcauaaaaagaaugccugaguucaugacacucugguucauaccucucaacucaccccuucagacuacuauacuaccuacagaggcagacugaagaggaaagcaauacccuauaauuaaaacagcaaagaggaccauaacagaggcuacagagacagcucagcagcaaagagcauuugcuggaccugcagagaacucaggguuagaucccaaugcccagagcagguggcucacaucugcggguaacccuagcuucaggugacccagcaaccucuccgggccuucagcauccauauacaaauagcaaacacacacucacguacaucaauaaaaauaacucugagguuuaaaaacgaaccagaauaguacacugccaagccauauuaaacaagguaauacuaauccugauuucauuuuuucauacuuuccacauggacuuuuuucacuaugaaaaggcuacacauuaugaucaguaagcuugugaaagccaagccuuauacuguaaccaaaaacagucuauacuauauuucaccuggugcugacaccaaguauaauccuccucuuuguuccucuuccccaaaugccacccagcccgggcccaugagcuuaacacacccacagcacucaccucugcggcacucauuuauauggggcauuuucuugugggucaaguuguggcgaaguucaacaauccagucuggaauguucaccuaauuagacaugagaaaauaauaaagcuugcagaaacccaggaauuaaucacccuggcuauccaucccagugaaguuuccagucuuagauuacaauccaagguuccugauuauauuuuacugcucacuggaagaagucuuaacaugagaaaaggcaauuaccccccaccccccagccauucuccucuaagagcugucugugaugggcauuacgaauaagcuucucagucucccucugccuuuuccuucuuccuagguaccuuuauucuuccuugccucucaaaagagcuccagcaaguuuuucuucaggcuugagaacacaucugccaucaaacccauauacaacuaacauacuuacugaagccagagauagcuggcuuuuuuauuuuauuuauuuauuuauuuauuuauuuauuuugcugcuugggugagcuguuucuuuccucagauuacuuacugaagccagagauagcuggcuuuuuuauuuuauuuauuuauuuauuuauuuauuuugcugcuugggugagcuguuucuuuccucagauugccggcucccugagggcaggcauucgacuguuacucuuuugugucccuagccaguggcauagucaggcuccucacuuucacugggccacugcaaacuagcagagccagccaagcccacggaaaugcaaguaaggagaaauaagggagcaauccucuuuaaaaccggacauucaaccguccagucaaaaccuuuccgguauggacuccacuccaacagcacaagaaauaauccugagacucgacaaauggauugcaugacauucuuuaaguuucugcacaucaaagaaaauaacagagcaaagagauagcacagcuuagaaaauucgagaaaaauaucugccaaguguauaucauacagaucauuaguaauaaagaauccaaaaaaauuaaacaauaaaacaucaccuaaucaauaaauguacuaauauauaguucccaaagaaacaugcauggucaauaaauauuugaaauagugcuuaacagccuuagucauuaaggaaauaccaauuagcggggcgugguggcacacaccuuuaauuccagcacuugggaggcagaggcagguggauuucugaguuugaggccagccuggucuacagagugaguuccaggacagcuggggcuacacagagaaacccugacuugaaaaaaacaaacaaacaaaaaacaaaaaaacaaaaaaggaaauaccaauuaaacuuuuucaagauuugaucucagcccagucaagauugguauuauuaaaaaaaaauaagcaacaguaaaugcugguaugguauauucagguauugaagaucaguaugugaagcaaacaaaauaagccaggcucagacucagaaagacaaguguuucaaaauuuuucucacaugcagaaucuagauguaaauuuguauauguguguauauauguuuagggcaaagaauagagaaagaggagugugggcaagggaggaagggggcuaacgaaagggacaaggagagcaaggaaagcuaauggagugugacaugcacacaacaggaaggguuauuugaaagaggguggauaggaguggaaagcagagaagggcaaauaaaaaacaacuauagcaguaauauauguacacgugcccucguggaacauacuauuucaugaguuaacaaccaccaaaaacuugaaagcuaagggccuaaagcuucuacuggcuuaucugguagugaugagcuaaacugguugauuugcauaccuuaccccaugaccuacuuaggaagcccuccuagaaaaagagaaugagcaaugcaaccuuucgcacauaccuccugagccagguauuugaggggaagguuagaacauuuugucuuccucucugagauaagauucacaaaccuggguugggagagacauaaguggcauaguccaaaaaacuguuuuacucaaaauuccuuaugaaguaccuuucuacugacuuccccauucuuaugcuuggugucagccagagcagggauagucccuacccaccccaacauuuacuaagggaaacaacacagacaaauaagacacuucuggucuuggcaaauuuggucuagaauaaucaugacauauguagaacacaauaugcuguagaugucagaauaaaugacuacaugaaauaauauggggaacacagauaagugacagaaacagaggacaaagggagagacauccaaacagauugaacaaggcuuugucacaugagaaaacucaguaguagcccuccccccaacauguaugaaauauucugaauuucauaccuccuacacauucuagaagggaaggaagaacagaagagaaaaaacuuucuggaaaagggaaagaggguuguguggacaagacauaccugugaacaagacauagucauggccacguuaaaaaaacaaaaacaaaaacaaaacucagagguugauucacccacaaaggcccauccguggcuuuuuguuucagguaguacccgaauccauguuuaccaguucccaaagccaacaccccagucuuacccugugcaggucuuaccugaccaaugccaugccauagagcagucuaaguucaucagugcccaagguaccggcugcaucgaugagcuugcaucuuaccaggucagcaguagaagccacugccaggggcaguucguugccuaaccuaaagggccacagcaccaucauaaaaaucaguacauuguucuauccucuaccagagaagcuuggucguuguacuauacaccccccacccccccccuacauacugaaaagugcacggagauacaaaacccuguggaaaagacggggucaaguccccgggauccaacaauaauaaaggaauugagaagcuggcuggggugaacaggacaucaacaguuguguggacacaguccguuuucuccccgcucaaauuauuuagguaugggaaccccaaaucucuauaucccgcccccaucaaacgaacugagccuucucaauccugaaucuaaccuaaacggugacaguccaaucccuaacuggaaccagaaagccacccuaacauaucaaccuacucuuuuagucccgggcucagguucccucuauuuuggacauaaaacuuaaaccucacagacacaaaaauauuauuggaacguacgcccuguuuuccuucgacgaguacaggagcauggcugcaacuuuuccccaggcacuuaggagagaggcaccauaaggcaauuucagggaaggcuauagaagauguggccguaggggaauucgaccaaggaaggagugaggcaccaccagcgcccaggcaggaggguugacccggccgccuuaccugcuccuccauacuguaauucgguucagcgcauacugcugcaacuugugaucaucgcagaacagauaaaccgucacuugcucccacucagcccugcugagccaagagacgacgauaccccuggcacucggcgacucaggcugguucucuuugaaggacugcccgucccacgcacgccacacgcgauccaugcccugggagccaagagcaggucuccgcccggauucccaaccucaacugaagugcgcagcaugcugcgcuacacacugcccuugcuccaaacggcacaccauuagccaauuggagaauaugaccccg

SEQ ID NO: 9632 - RNA, 9142 nt, Mus musculus
ccaaugacaaaugggaacgauggaugagagcacagugcaaggcagcacaugagaaauaucaggacugucaaaaccacuauauaauuaguaaacacuccaguugcugaauccucccaagugacugggugggccaaagcaggaucaggcaccuaagcccaguagacccccacacuuucugccaacgggacagagaauaaugacagaaaugcugaaacuaagcgaguaggagaaauacguugcccuuuggccuugaccacuugaaugccuucagcaguaaaguguuuaaucuguuuccaagucuggaacagacgcuucuggguagacuggauaggacgcuuugggcucugcugugccuugaaacucaucaucuucugcacccucaacuucuggcgccugugaugcagccaucgcuuuugugaucugggaguguuugacaagacucucgggaacccaagacggaccaucaccuuccugugggaaaauucagauguaaccuuucccauacauuagcaugaaaucgggccuguaccaauucccuguaacaagauuuuuucauauaaccucuccuucuggagccuauuuaccucuuaaaugcugugcaccugucaauaccuguagacucauucugaaaaaauuuaaauaaaauaaaguauaauuggaaagauuauccaggaguaggaggguaaaaguauaaauaucccuauuuuuuccaagcaaaacuuuuaauagauccaugugucuuugaggacauuguaagggacaccuacuuauccucaauccugaagguggaaguacaaaacuucuuaaaggcaccagaaguauauaaaggaguauuauuaucuguauuucaacauuuuuggaagggcagcuacaaaaaaaacaacagcgggcaaugcguaaugcaaugcucaacagcuugcuuccauccaaaggccauaauguauuaggcaauaagucuaaaggauuaauaccauaacaaggagcaggcagagaagcuagguaagcagagcaucuggaacaauuuguugugccuguucuccagauaacugaaauugauaccaaguguagcaggugguugaugagggcauacaugagauucuguagcuugcuuaagucaaacagacucagucagcaccugaauaagagcaugagaggcuacauguacaaugagauuuaccucugccaaaagaccaaggagaccagaauauacucgaauguauuggagaaaauauggugccuccuaauuugggaacuguugccgaaccuguugaaacaaaugaaguagguuuuuagccccagucccuuuuauaaaagcaccaggaaguauuuggagaaccugucccacaaacaaucaccauaauauccagagguuaagggaauagccucaaagcauggaguaaaguaaagaaagauucugugucuccaucaacaguaaagugacucacugccuguaagaggugagacacaaaguugugagagagcucuuccagccucugaagaacuuaugaaaauucuucaggguucuaugguagagucucugagaaaacuguugcucauuggcauuaauuagaucauaggaagucccugagacuggccagacucacuaggcccucuccuugccagaguaaacaauaaaggcugcucagaguugcucucagauagccaggcugcacagaagccucggagaccaggccaacugccuguagaagcagaaagcagcugaacuuccugacagagauguagaccaagugagucaguuggaagugacauucugcaaacucaugagcugccuggaggcuguuccuugugaccgaaguucccagguuugugagcugucacucagacccuuggugguggcccuuagucaugcagcugucuuugagucauuucugcuccugggaacaaccccucaccuguauuccuguaagugaccucaauaaaaucuauugcuucacuaaguugguguuugguggucuuuccuuuggcuguuguggggucccuaucuggagugaauaggcauguguguuguaucuccccaggaaaagucuuaccaugcaacagggugucaaaguaacuuuuuuuuuuuuuuuugguuuuuuagaaacaggguuucucuguauagcccuggcuguccuggaauucacucuguagaccaggcuggccucaaacucagaaauccaccugccucugccucccaagugcugggauuaaaggcgugcaccaccacgcccggcucaaaguaacuuuuauucuccugauggaaauggcaucucggaggcucauugccucagucagcuaaccuaggccucauccugaaagcuucuagauucuguacaaucuuacaugggacuguuuuuacaugggguucaggcucaccuggcuucugaaaaugaaguucaggaggcuguaacaggggaccuaauaaucccuuauuugaugaaggaggggcuuuucacucagucaaacugguaagagccacuucgagugauuuuagaacuaugucaucaagcaaaaaagaagguuccucugaggcaucauggagauaaagaaauucaagaaacuaaagcugcuuccuuguccucagggccuuuuagcucuacuucuuggcuuuuguuuuuuuucugucuucugcccccuagucuguuuuggaguagacugccuagcuucaaaggguucuugaauuacuacugaaucaaauuuauacugugggucuaaacaaucacauauaaaucccacagugcuaacccaucagugugaaacucacacagcugaaguaggugagacucugguuuuuaaagucucaucugugcauucccaugucuuuaaauguacagaaaguucuucagugaaccaaggggaaauuuuuuaaaugaaaauaaagaacuuuucuaaaaggguuagaaaauaacaagaacaacaaugcagaagaggcaaauggagcaucuguagacaaaggaaguguucuucaggcucuuucuggccccauauuucacuccugaccaucaccauugccuucacagccccccccccccacccccgacagacuucucuuauuuaucuauauauuacagucauacuuacccuuuucuccuuacucuggucucuguucaggugccaauuggguugggccaaugggucauucuuugugacagggcccuagagagaagcagcagaagaugaagaagacaggaacguuugggaucaggaggucuugcucaagccaguuucuuaagccacacagcuuaguacuuacuguuggcaggggagacggauagucaaggucagcagaaagcuaaacgauacaaugauggcaaagagaacacggaaugcuucacacacagcacccggaaggaggacugauagccacagcccagaucccagaaacugcaacucugacuccucugaggcccuggcccaagccccagacugcaccugaucaaggacacagaacuaauguucccuuuuuccauucguuggggccccugagaaagccuuguaucagccuguuucccaacacucucccuuugcaguuuucugccucucuaacuaggcuuuagcucuacuuucgccucuuugccucucuuugccagccucucugccuuuagaguucugggcaucuccauuucuuaccuugccucucugccccucuaccccugcuuccugguuuucuugccucugucuguguuauuucagcuugugccuuucugccucucuaucucuacuucacucugaauuggccuguguggcucacugccucucaaccucugcuucugccucuguguccaggccucagccuccacuccucugccuuucuaccccuuagccugucucccccuacauuucuuccuuugcuccucugcuucugucucuucuccaagucucuacccucuagcccccuucucugccuccaccucugucuuugugcuucugauuuucagccucuccaccucuauggcccacauccucuucuacccucugcuucucugucccucagcuuuaugccccuuggccucugucuguaugugauuaacccucuaugcaucuccgccucuaugcccugagaccucuuugucccucugugucuaugcccaacagccucuccagcccuccaacucuuacgcgucaacguccauuagccacuaugucccuuggccucuuucccucagccucuccuagccugucucucuagguuguucugcaucucuguccaggaaccucuaugucccacagcuucucugucccucagccucuccuauccucagcugcugucucuaaaccccucugcaccugccccuucuacccugucuuuaugccucucagccucuaugucccugggccucucuuuuucccucaggucguaugcccuuuggccucccugccccucuaccucuauggcccucacccucuccggcccuuuggcaccucuguaucuauucagcuuggccucuaugccccuggaaccuccuugucccuuugucuuuaugccucucagccucuccuccuuuaggccugucagaacucuuggccucucugucccucuaucucuauggcccugagcauaucgggccccucacccuuuccuuuccuaggccugucucuauagagcucagucuauaugacacgaccucucugucccuccaccuuuuugucccuccuagccucugucucuaagacccucugcaucuuugucugugagacuauucccaucaaccucucugucccucuaucuuuaugccccccauggccccucugucucuaugaagcucagccuguguccccuguggccugucucuauacaguuaagccucuaucccucaccuccaccccacuguggccugucugacucuaugcaguucagccucuauguccucagugguaucucugucuuuauucagcucagccucuaugccccucugccugucagccucuguuccuauuucuuuauggcccucgggcucucuuucccucagccucuaugucaccuccccaacccccguggccacucuaucucuaugcagccuggccuguaugccccucaaccucucuguuggcccucuguaucucuauggcccucggcaucacuuucacucagccucuaugccccacuacccccgcagcaucuccgucuuuauacaggucugcuucuauguccauuggagucucugugucuaggccccuuggccucuacggcccuucccauggacagucucucuaugcagccucagccucuauuccccuguguucucucugucccccuauuucuaugucccuguguuucuauggcccucgggcuaucuuuuccucagcuucuauagccccuccgguagccuuuaagccccuuggugucucuaagaaucuuggccucuauaccuucguaucucugugucuaggaacuuagccuuuauguccccguccccaccaauggccucugugucucuaggcagcucagccucuaugccccgcguggcuucucuguugcugagacucuaugccccuuaguaccuauguuccuauaucugaggcucucugcaucuccgccccucucuauucaccauuguuucuauggcccucggacucuuucccucagccucuaugcgcucaccauucccccaagccuucucuguccuuauauaccuuggccucuaugucucuaccaccgaggcucuaugucuucugaggccugugugucuauucagcucagcuucuauacgccccgugaccacucugugucuauguagcuuggguagcccccacccuguagacucugacucuauacagcgcagcuacuaugccucucagccucucugucccaacauuucuguagcccaaugaaucucugucacucuuuaugucccauugucacuauggcccucggccucucuuucccucagucucuaucccccggcccccgcggccucucugucuuuaugcaguccggccucuaugccccgucccccgccccucuguuucuaugcaggcucggccucuaugucgccauggagcuugggcucuauggucccgguggagucucagacgcuauacagcacagccucuaagaccuucagccucucugucccaacaucucuguagcacuauggcccuuggccucucuuucccucagccucuaugcaccccacguggccacucucuauacagccaagccucuaagccacgcccaccccaccguggacgcucugucucuaaccuaaacucuauacccacccccccccccacccccgucucuaugaagcuccgccucuaugcucccccucuggccucucuaucuccacucagcuuggccucuaugcccccucccggccucucugucucuacacagcccagccuccaugccccccuccccccucuaucucuaugcagcuuggcuucuaaccaccauggccucucuggcucuuugcacuccagccucuaugccccucggccucuggaccuacaucucuguagccuaggcaucucugucccucgcucuaugccccuagaccucucuuuccuuccgccacuauguccccgcucccccgccccggccucucugucucuaugcagcccagccucugcgccccguccucccucgccccucugccuauagggcauaggccgcuggagcucugcgcgcccccaacacacacaucguggccuuucucuccagcccagccucugcgcccccuguggccugugucuauguagcuagcuccggcuccaugguccccguggacgcucagacgcuauacagcgcagccucuaugccccucagucuuucagucccaacaucucuguagccccauacaucucuguccuucuaucucuauaccccauugucucuauggcccuccgccucucuuucccucagccucuaugcaccccacguggccucucuuucucuaugcagcccggccucuaugcaccuccccauccccguggccugucucuaugcuauccaaucucucugcccuuccuuagcauuuugccuaggcuccgcccccacaguuaccuagcaacagccaggcaugccugagucacuauaaaagggcggcuuucccccuccuuguucucuugcucugcccucucauuccucccccuucuuucuccuccugcucauggccagccucuacuccucuacucugucuuuuucugccucuacuacccucuuauaaacucuagucuauacugucauguggcuggugggggggggagggagaggagggaugccucagcaugggcccaccauggcacccccuucccccauacuuaccacaccuccauagaacauaucccccaccucuuuaccuuuuauaaacacaacagcacccccccccccgcgucucuguacagagcccagccucuacgacccccuggagccucucuaucucuaugcagcuuggcuucuaugacccccgugacuucucuguucucugugcagcccagccuuuauggcuccuccucccauugcuucucugucccuaugcaggugguacuuggccccaacccaccguggccucugucucuauacaguucggacucuaugcccccuguguccucucuugcuuuauacagcuaagccucugugacccucugccaucugauccuuagcauuuauguugccccucagucucucugucccuguaucucucuuggcuccuuuuucacuauugcucuuggcauuuguuuuguuuuguuuuuugagacaggguuucucuauguagcccuggcuguccuggaacucacucuguauaccaggcuggcuucgaacucagaaauccaccugcuucugccuccugagugcgggauuaaaggcauaagcuaccacgcccggcugcucuuggcaucuuugccuaagccuguaugcccacgccccccccccccccacacaccucccuguaucuaugcaacaaguucucuaugcccuccucuuccccuuucugucuggauacagcccaaucucuaugucuaccacccauggucucucugucuaugcagcuuggucucuaccccccuauggccucccugucucaauacagcccagccuuuaugucccuuagccucuguaaccuaagcaucuaugucccuuugucucuaggguguuuggucucucccgcaaccucuaugccccgcccccccucccgaguccucucugucuaugcaguccaaccucuaugccccuucccgccucuccgucucugcgcagcuuggccucuaugcucaccucuggccucucugucuccauuaaaagcuuggacucuaucccacccuucuuggccccuuuauguacagaacucacccucuacgccccacgccucucugucucuauacagcccagccucuauugcccuuuggagccucucucucucuaugcagcucagccucuauguccccucccccauggccugucuuuauacagccaagccucuaucacacacccacacacucucuguggaacccagcuucuaugcccccuguggcguuuccaugcaguucuucuucuaugaccuccauagucucucuguuucuauacagcucaaucucuaugccccuuggccucccuguuccaagcauuucuguucccccugucucuaaugcuccuuugucucuauggcccuuggccucuuuuuaucccccagucucuaugacaccucugcaucuccuagccucugucucuaagccccucugcaacucugucccugagacucuaugcuucuuagcccuucuguccccauaucucuguggcccucaccauuaugggaccucucaacuucugugucccuauggaguucagccucuuugccccuuggccucucuauuacugggaucggccaagccucugucuuuaagccucucugcauuucuguucccccugucucuaaugcuccuuugucucuauggcccuuggccucuuuuuaucccccagucucuaugauaccaguggccugucucuaugccucucagugucuaugucuuuguuccccacuauuuggcucauacuuggggaguccacuuugaccauaccacagaauacaaguauagcuuagaauucauugugggguggggcacuuacaagcaagccaaaaagcaguagaacaggccaucuccugaacucuccuuguucuguagguuggucacagaucuucua

SEQ ID NO: 9633 - RNA, 72567 nt, Mus musculus
gucauagugaagucuuccuaaauuuuauuggcacugaaauagaacacagauugagcauaaaccccuccaaaacaauuauuuaaaaaacaaaaauacacaaaaaaaaaaccucaauauaaauccuacccuucuccccagccucuauggggggguggguuauugcccuuaaugcagcuagauugcccccacaauuccagguuugaauuuagccaauauaagacagcucaccaacugucaauauaauucacagcaaugcauauaagauuccccaagauuaaguaaaaggggcaugggcugagggaugcucuggacuaaggauacugcauagagggacaagacagccuuuuggggacugaacccuggggaaaaagcaaacaggaacaauaaaaccaaauacuaaguacauuuuaaauguauuguaugaccuauagugacagguaagucgcuaauacugaaaucuucuuacauaauguuuuuggcaaaauaucauuuuuaauauaguauauucuucucagauguggggugacaguaguaaaaaauaaugaagcuaaaaugauccuuucccaagacuaauaucucuaauagugcauuagcaaaaaagguagaaaccaauauuguuagauaucacuagaauauauaauacugguaaaaauuaaaagagcacacaugugacaaaaaagggggagcagcugcuccaaaguggagaaaagggugugggggugugaagggacaaggccagaauacccagcagcuuucuguaucuccaagggacagcacaaugagugaugaggccugaguuagagauuugucagaagcagggccuacucaccacuuugcacuggguaagaugagggaggauugcugggugacugacagacaagggcuacucuuacucaucauauuuuguaucugugaaacaggaacaguggucaaauuagcucugggggaaguaguuuagaaguccuggcaggaaaaauacuaaagccagguacaaaaaaguuucuuccuuuguggcaacaaguuuagaugcaacuggcuagguuugaggguacucauccucucuguccuagcuggaagagaucugaggauuggagaggguagggacagauuuagaaaaggaaccaagaaccuggacuaucaugggcagggguagcccugaccacagaccucacucaagagaagaaaggcuccaaagaugugcuggggcaggggccuuucuagguuguuagugaaucucuugaaugcacuauuuccuuuaucucuucaucccaucuugauuagaaacuaaaucccuaaacacagagacaaggcccacugggacuagauuuguaauagguccaauaugggagguagaagaaauaagaauggcuaaacaucucuuuuauccuccaaucgguacaaagccuaaguaacuguaaaagggauagacuuaauuaagaggcuaaauccuaggucaucugacauacuaaaugauaaagccaauucccuccuucugucccuaaacaacacaauauuccaucuuugcaaaucacaggacuggcaagggaugggagcuagcuguuaaccuacuucacacaugagucccagaggacaacaguaaguguauauggggagggggugcuugucaaaccaaaaggaaugcgugucucugagcuggggcggggagaaaugcucuauucuagagagcuagguugaaugagugugacaaagaaggaaaaggagauuccauuggcaccacagugggccauuuguuugcccgaggguaugaguggggagauuaaguuuggucccauggcuauacugaacguuuggcauggcuccaaggcuuuucuaguuaguggcuccagcacaguguuaguuaggcaaaacuaugggaguguggggacaaggaagaaggaggaggggucccugaaggcuggacgcccacuacauggacucaaacucaucaaugcguuguuugguguugcccugccggaucuggcgcagggucuuguauuugucucgucccagucgcauguucucagcauggaucaugucauuggcagucuucuuggacucaucucgggcauuggccagcucugaaguaagggccugugaggaugcaagaugagucaggggucaauggcuuccucucauuuuaauuccacuuuuuugagcagaguuuguguuuguuaaguguuuucccucuuugcuggccauauaauccuuaugcacgugugaacaugcaccgcauaaauacauuauaagauaaauuaaacgaugguuaucucuugagaguagaucagaauaacauuccaaauauugaaguaguaaguaguuuggcuagcuauaaauuuucugauuguacgaguggagaguaauaggcuagugacucacagucucccugacuguuguuggcccugccugcuuaccuucagaugcuucugcacacgcucauucuucucugccucagugguacguuccuccucacugcgguccuuggccauagcaucagcccgcagcucggcacuggccucugcuccauucucauccugcucaucauguucauucucagcaggcucugccacaugagguguacucauggcagucuucagcucagcacgagucuucuccaagucuuccuguaccaucugggccuguucagugacagaaagaggacuggcagucagaucagguaucuuguggcaacccaaucauaccuugaaagacacgucuaguaagagguagaugccaguuaggacgaauaguuaggacauggcucuagaugcauauguagcagaggauggccuagucagucaucaaugggaggagagguccuugguccugugaaggcucuaugccccaggacugccaggaucaggaagcgggaguggguggguuggugagcagggggugcgggaaggggauaggggguuuuuaaaggggaaaugaggaaaggggauaacaucugaaauguaaauaaagaaaauaucuaauaaaaaaugguuugcaucaaaaaauggggagucuaaaucuaagaaauguaagaaacuagaauauacacauauagcauaguaucucccacagugcuuuggccuggauucuguaucuuaccuuuugcugccauuccacagccucacuuuccuucuucuuucgagccauuuccaacugggagauccgugccgucagcucugccauuucugaagccuacaggcauauuagaagccuugagagcuugaccuuuggguuuucuggguccagaugccuguaaccccaguuccucugauaaacugguaggaaaccggcugcuccauuucuugcugaccuagugacuuuuaaccaaauuacuccacccuuuacuccuucauaggucagagauccccuccuauacuacaggccuccuggcagacaauugguucucucccccccccucucucucucccucucucucuccuaagauuuauuuauuuuauuuauuugaguacacagucacugucuucagacauaccaguagagagcaucagaucucauuacagaugguugugaaccaucaugugguugcugggauuugaacucgggaccucuggaagagcagucagcgcucuuaacugcugagacaucucuccagccccucugucucucuucuuuccuucuuccccuuuuaauguugccaaauaugcaugcagcggggccucagcaaagcuuggaagccacugcuugaaguagcaaacccuucacuguuauccuaggcuuccaccaagacugcuaccagaauuaauaaauacuaauaucauagaaaaccucuacaauauggaaaaguuucugcacacccuuaucccucaggcaaauuucucaugacaucuucuuccugagagauaccagcacaccaguacuacaagggaagggacuauuuuaagccauugauucuuaacuuucaagucacagaucccuagcuuaacacaugauuucagggagggaaucuuuccaauggagacagaaauguuuguagaccuucaucaaacauagcugugaccuuugaccagucucuaggccuccaugauugccaauuugcuuauuuggucacauuauucuguaugggauuuaauuccauaaggcaaagaaagaaagaaagaaagagagagagagagagagagagagagagagagagagagagaaaggaagaaagaaagaaagaaagaaagaaagaaagaaagaaagaaagaaagaaagaaagaaagaaagaaagaaagaaagaaagaaggggagaggaggaaaguggaggggaggggaggggaggggaggggaggggagggaagggaagggaagggaagggaagggaagggaagggaagggaagggaagggaagggaagggaagggaagggaagaagaaaugaugcuaaagaaacaccaguagguacuuucucuuuuccuuucuuggguuacagguugagaucuauauguaaaaaaauuaaaugaaagccaaggccuaugaaagagugugggccauaccagugaugccgcagcuugcuuuugaauguacuauuaucuuugggauacaaacuagaaagacacagguaugcaggcaaagggauuuauaaaccaguaagcaggguauaggggucaagcaagaaaaaugcaugcacacaacccagcccaggauucaacuuuaccagcuguuccugggucuucuucuggucccgagaagccugcagcagggccucuuuggcuucuucagcuucuugacgcuccuuggcuagcuuuucggccucacucugggcacgcuuccguuccugcucaaguucuagggcccugcgggucugcucuuccagcucugguagaaaaacaggaaacugaugaagggcucagagaugaagauggcacaguaaccugcuuccugggaauuuuccacuucauggugcaguaggugaggguucuaaggauuuuucuugauauuuuuuauauuauuauucuguaccacaccuagacuauguaguguuguucugcagcuccggggggaaaaagaauguccaccuuaggugaggaucugaagagccucaacuugcacagugaacacaagccucaccuugcugagccuucuuagucugcuccucaaucugcuucagcuucuccaucagcucuuccuucucccgcucaaucuucuccuucucuuucucagccagcucacgcuucuucuucucauuuuccaggagagcacuagagaagaaaaggaggggugaaacaggauagcaaggcugcgugcaaucuugagggguuccagggaauaagucucucaggccucagccuccccacacucucauauaaccgagucaucacaccauaguuccacauaggcuuccaugcucaguacauuuaccuugaacgcacaaggcuuaaaagggaaugcugguaaggcaagcaaccaacuagauggcuuugcucuccuucuccaccuuccauauguaacaugauuuacuaacuuugcacacugucuuauagcuucacagaaaggcaaguuuugguuuugugcuccaaauauuggcuagggcuaaccuugucugccuucaaccauagcucuggguucccuccucucagauuuuauugcagaucuagaauaaguauuuacuuuuucuggccucacuaucuauucaaggaagcaaucuuuuuguuuuaaagacuuuacuaauuuuuauuuuauuuuauuuguguguguguguguguguguguuucccaugcauauauaaguguauaacaugcaugcaguacccauggcauccagaagaaggugccagaguuauagauguggaaguggaguuacagaugguugaaaacugccauguggguucagggaaucaaaccuggguucucagcaagagcacuaagugguccuaacuguugagccaucucuccacccucuaggaggcagucuuacaccgcagcaagauguuuuacucugagaccuuucagaaugcuuggcacgcacuuuuccucaacacuuuucacaauugcauaugcuaaauaauuuguuuacuuuaucugucuucucccacuagaauaucaacuucacaagaagagaaauuguucacugcucagacuguaugagaaagaugcucugagcauauauauauguaugcacaucccucacucuuguuguuacucuacugugagguuuaacaggguuuggccuaguucacuaaacuacucccaaaaucuugauaauauuuuucuuaauaaaugagaacacugggcugucaaaauagcucaguuauagaguacuugccucauauucacaggguuuugagucuaaauucuacugcuuggggguaaaaucaauguuaguuacauauguguuguauguaugugugaaugcacgcaugcauuuguguguauguguguaugugugugcauauaugcauuagaaccaguuucaauguucaaagaaauauaugaucauuuuguuuuuauuuacauuaagacagggucucacuauuuaagcuuggguggccuugaacuuguaacaacuuugugccagcaagcuaagcuauucuuaccuucuaaaucaucauauaugaagucauuucuccacauuucacuucuuccagaaccuagaagccaccaauacacacugguguguguguguguguguguguguguguguguguguguguguguguauguguguacuucauuuggggauuauauuauauaaauagaauauauaauauauaacuugucauacuucacacuuuuuucacuaagcauaauguuuagaguauaucacauugcagcacagauggauaaaaacuauucugcuaugguuugucuccuacauaaguucguguuuuagagacccuguccuuaguguaaaggcacugaaaggcagugaaacuuuuauuagaugggcaugaguggaagaugauucggguagucacuuucaaaaaggaugcucaggaggaguuaaguuucacaagaugguuuuucuucuucugagaagagguggucacaauuaacuuuaccaucucuucugaauccucaugcccacuguauuacaacgcaauauggggcucuugacagaucuggccauccuaucuuggauuucucagcauccaaaaaaacaugaguaaaaacacccucuuuauuuuugaaguacucaguguguuaggucauuuauuauaacaacauaaacuagauuaauauauauucuaugggauagagagauagauuaguguuuaaaagcaauugcuggucuugaagaugaucaaaguuugguugcaaggcccugcaugcaguagcucacaaccaccuuuaaucccagcuucaggguauuugaugagcucuucuggccucucuacauacaccuguacuccaggaaugugcucauucaggcacgugcauucacaagcacacaauuaaaaccaaaauacuuauuagaagauacauucuauuguguauaauuagaacuuauauauuuaucucuugguacuaacuagauuauuuucuaccauuuaagugucuauauagugguauugugaacacguguguacauacaaguuugcacauccauuuuucuuuucuuuugaggguuacuuuaccuaggaaugggauuacaagauuauauaguaauucuauauuuuaucuuuuugaggaacuagcuucuaccacuuuauacucccaccaguaauaugcaugaauuccuaauuuuucagaacaucaccaguacuuauauuucaauuuuauuucuuauauccgcacuaauaagcauaaaaugguaauugauuacgguuuucauuugcauuucuguaaugauuaaggauauuuuuauguuauugacuguuugucuaucuucuuuggauaaauaauaaccuacaauccuaagauacugaucagaaagucagagacuggaaucucaguuccuacuucucuugcuccuaaccuucagauuacacugaauacacuaagggcauuguaggggaaauucugagggcucugcuuguuucugcucaacccaaguacaacuguguacagacucuucagcuacuaccauacuacuugccaguuaaccaauagcaacccauaauguaccuggcacaguaauggcacgagagucauugacaacaggaaacuaugaaaggcuccucccucuuacaaccucugaaauccaagauuucugaugccuguuucugugcugagacugaauaucugggguguccucccuuccaauucacaagucccuuguccugggaugauuccacucccuaagcaagccaggaaccuuccaaagcuuccuuaccacugcacucguccuaauuccagcacucuauauagcaccuaccgcuccaucugcuucuggugcuucucuucccgagccugggccuucaucugcugcaccucaauggugucaggcuugcgccgacgcauguacagcucaugauuucccaugcacagggccaagauccgcuuguuaauccgaagccggggagcauagaacacaaaguccugaagggaaaaccaaagguuuuagggcuagcaggauggcugacaugugcccuugagcaggcacaugcaugcccacacguaccaauaauaauaauaauaauaaacuuuaaaaauaaaauuuugaggaaagcuuucuauaaagcuaaguucaaaaguauuggaaagaugauauaguuuaacccauuuguauuccaguugggaguauuaauuaccagaguaagggaaauauuuuuugcagagucagguaucagaguagugguagacuuaagaguagaacccaugauucuuuucuuugacaccaguccucuuaccuccaaaccacaguuuuucuccaacucugcucacgaaaaacacccuggggccagcaagauggcucagaaaguuaagcucucaggcuuaauaauaagaguuugauccccaaaaacaacacagugaaaggaaaagaccucuaucuagcaaguuguccucugaccuccacuuguacacuuuauacucccucuacacacaaaaaaauaaauaaauacagaaaacggaaaaauaaaucuaaagaaaaaacacccuaaaacacuuucuuggaagugucuuuuucugcaauaguauuuuguuuuaguuuucaaaauaaguucauuacugauucacagauuggagcuuaagaggccaggaccuuugcauuaagucaguauagaaguuagccacauggugggaaaguaacugcauggccgggagauuguuacagaaaguaugaaaaagccaaaagccccauagaaaguauuuauaggaucuaguccgaaaucacaacaaaacugcagaagagaaggaaaggaaagguuguuuuccuaugucaggauacaauaagaugagcagauccaacagaaccccauggcagcucauagggccuaaacuauggaggagaaacuuugggaagaaaaaguacaccaccucauuagagagauacuuauuucuccuacuuacuuauucucagaaggcagcgguaaggaacuuacacguuucugaccagcgcucccuuagccaggugacugacugacccaacuggauuaacucuuaugggaacauacaaugucauaucucucuaccuagagaucuaacuacugaaucucaaagggccucuucuauaagauaauugauauucucaucaacagguccaccacaggauucuaaaccaucucuguaaucucugcuaagugagcucuaguuauggggaaacaggcuauuaaguacacaaauaucuaaauuucuuaaacuucaauuaucuugauuauuauuuguuuaaaagccuuucauuucugcuggccuuuuauuuauuuuauucagaacuacuacgugaacacuaauacaucacuccaacuuccuuguguuuuccccaaaauucauuaucucuucuuuaauuauuauugucacaaacuauauaaauuaauaaacuaaauauaauaauaaaaagacaaaauuuagaggaucuagaaguacaugcacgucaucccagcacucagaggccaaaggcagaaaggucacuuuaaauuaaggccagaggcaguggugcacacaccuuuaaucccagcacuugggaggcagaggcaggcggauuucugaguuugaggccagccuggucuacagagugaguuccaggacagccaaggcuauacagagaaacccugucuugaaaaaccaaaauaaauaaauaaauaaauaaauaaauaaauaaauaaauagucuuaaaagguaaauuuguaauguaagguaaaucuuuggguuugaaguccuggcucugccauuuuccacaauuagauauaagccaacuacacaaagaguacauucgggaggcucaggaaggugaggcaaugggcaaagcacagcauuuaggacuugccuguagcuugcccucccccagagggaguuugguacuagagugguaccaaguauagaauaucaccuggccacuucucaacaucaacuuccucuuauauuuuacuuuccauuugugcuuccuguucauuuguacaugugacacacaacagaaaauggagagacagauaaauccaaugacauguuugcucuuaauauuaccuaaaccuugggggagggggggggaaagcugcugcgaagagucagaaggagaagucacucaccggggccuuuuugucaaugggcuugaugacaaauuucuuaucauugaaagagauauuccugauuucacuccacgggaagccaaucuuaggagucagucuguagaaagaaacagaggccaacaacaucaugacaaaggcaaagcaagaaggaaacagccuuagugccuugcccucaccaccacccaccccacucuauccccuaacacaaaccucucccuugaggagauagaccuauugucaaacucagcuacuguuaucccuuagugccaguuguuuuguuccacuugggguugaagcaauuaccuuguaagaaccuuccagagcaucuguggcccuacuuaacagaaaaccuauacaaaauuguuaaacuuggaaagauaaauaaugugcccuaaaacucagguaguggaugaaacaacaaucugaugauuucauccuuaccaagagcagaccgaggggaaaagaagacaauaugauagcaaggcuuauaggcuaaaagucacuucauuauaacacgggacuuggacuuugugaacccugacaagauagauucuaggucagcacucuucaaaaauuaucaggguaacauuuauaaauuuuaguagcuauauaaaaauggauaagaaggaaauauaaugaccuaauuaugaagguuuaacuaacucaauaaauauaaauacuaucauuuaagcauauaagucaacauuuuaaaaauauauuauacauauauuuuacauuacugugguuugaauuauauuugacugggaaagggaaugggacaaggucucacauagcccaggauagccauugugcugacuaguuuuaugucaucuugacacaagcuacagucaucugaaaggacagaaccucaaugcuguagggcauuguuuuaauuuagugauugauggaugaccgaccacuuugugggugguacaaucccugggcuguugguauuggguucuaagaaagcagucugagcaagccaugagaagcaagccuaagcaguaugacuucauggccuuugccucagcuccugccccuggguuccugcugugcuugaguuuuugcccucauugcuuuuaaugaugaauacaaaagugugaggaaaauaaacccuuuccuccccaaguugcuguuggucaugauguuucaucacagcaaugauaacucuaaacuaagacagccaugaauuaacuaugaagcuaaagcugacuuugaacuccugauuuuugcuaccugacucuucugagugcuaggauaacagauggguaucaccauacucagcaugguuuacauauuaaaugacucccaaaaggccauuuguugaaggcuagguccccagaaaaugguguuauuagugguggcauaacuuuuugagcagggccugguuggagaaagauuauugggaacaugcccucaaagaagacauuggaauuccacucccuugcucauuuacugucuauuucccagacaccaggaggugagcaauuauaugcucuacaccaugaaauucuaccuuaauacaggcccaaugcagcagcaucaaguaaaugcagacugaaaacucugaaaguacaagccaaaaucuaucuuuccuccuuuaaguuggcuucucccagguauucugucauagguacagaaagaugauucgcacuuuuuucucacaauuguucuugaaagugugguaugcaaguuuuguuuaugacauauaucaguuguaaugguauuucaaauguucaauagucacauauagcuagugacuaucauaauagacaguacaaccuuagucaauauaggaugaaggaagguguacaaucaucuuggcuggacuuaauuggguagaaaaauaacagguaggacucaagugacauagucuugcucugugguaagggaugacaccuauguuuaagagugauccaaauaggagagccccuuggucuuguuaagauucuaggccccaguauaggggaaugccagggccaggaagugggaguggguagauuggaagguagggcgacuggaaaggguauaggggauuuucggagaggaaacuaggaaaugggauaacaugugaaauguaaaugaagaaaacaucuaauaaaaaacaaaucuaaaaaaaauaugacucuuaaauauaccacaauaucccagagugcuaucagggcacugaaacucugaugucuauuuuguguaaucuuaacugaagauauuuaaaugccaauguuuguucugcuauauuuuuauucauaauugaguuagacagaaauaaaauauuuucauauaacuuuacaaaaaagagugauccaaauaagugagagaaguccgaaacacaccugucauucugcucauagauguugagacccaaggcauccacgcccagccauagcucugagccuuucuuguucuugaugcugaaauaguucacaccauacauuuccaggucuugagcaaucuugagauauuccaggacagcauccucccuauaugauacagaauaggagagggguauugucacaaaguagagcuuccauagcagacccagcaacagagaaagccagcuuucucuguuucuggcaauggucuugguagcaggauuaggaaauggaaaggacuuaagcaagugauuaguaacaagaaaacacaguauuucuguuaacuaaaaacuucugacaggaaccuaaagaguaagaacagucugucccuuguugaccucugcaauauuagcuguuacagaaaguauauucucccuccucugcauuucgacauccucuuaaaaauaagauuuguuucucaaauagacagcuauaaaaugcucuauuuagagagcuccuuucccauuuauuuuuaggggagcagugaccagaaacuuccuggagacccugaucuuccuuccuuuucauuguacucaaaacuguuuaggauguaaggagugguggaacaugcccguaauccuauaaucagccauacuguguguucaagaccaaccuaugcugcauaaugagaucauuucuuuaaagaauuccuagggcuggaaaguugggucaguuggucauagaccagcaagccugacaaccugaguucagauacugggaccuauaugguagaguagacaaaaacagacucccaaaaguuggucugaccuccacaugugcacccuggcauaaagcagagguaugcacgacguguggacacacacacauacacacacacacacacacacacacacacacacacagagagagagagagagagagagagauacugacagagagggcauaaaaauaaaaauaauagaaauaaaguccugauguuauaguuaaugaucuuuucaaguuacaguccuuugcaucaaaacuuugcucuuaagaauuuuaaaaaaaugccuaaaauaaaucacagucuuacaaugauucaagguugccuuuuauauuuaaauaucaaaauaaucccuagucucucuuucuuaaaauccaccaauucaccuaauaauuugucuucuuuguagacaccaucaucauucuccuuacaaggacggugaagcucauggcuaucaggggaggcuuaccugagcaugccccggugcuccucaugccacaccuggauccucucuucccacugguccuuguugaguuugugcugcuccaagacucuagaaagacagugaguggucaauaacguauaggcaggaagggaggaaggcucacuuagcucucuauagaguugaugcaaaugagaaguuagcccacugaaguauugcuggauucauacugaaaauuagaacugaacacacugaagcaggcauaacgaacuuccuaaaggaagaacuccaagaacagaugacuaaacagaacaauggaauuauccucuuuagucaccuauauggcuuuuuuuuuuuuuuuuuuuugguuugaggcagggucuguuuguuuguuugucuguuuguuugauauggguucucucuauuauauacagcucuccuguccuggacucacuauguagaccaggcuagacucaaacucucuuagcuuuacugccucagcaacccaagugcuggaauuaaaaaacaaaacaaaacaaaacaaaaaacaaaaacaaaacaguccagauccucuuuauaccauuaacuacaaugcuaauaauguguugcaucuccaaacucaacaggaauauacaggcgucugugaugaggaacuaacaguaaagagaggcaaaaauauucucuccuagauccucuuggagccaacaguugguguuuauaagacagcuuugcauacagaucagggaaguagucacaaaauacucugagggaaaacaagaggcccaguccacagcucuacuagauuguuaaacaagaugcuuuaaauaugccaucucagacuucaugccacugacgaggaaagagucccagggcacaauuaccaucccuaacaccaucuguggaguguguacacaccacagcucaagcuuaauuuuucuucuccuauucuaaucuaaaagccuguggaaacaaauggccauccgauacaaaaugaaacaaaccccucgugcauuaaaagaaauaaauaaagaaauuggggguucagaucaguacugccaaaaaaaaaaucugcuaugggagacagggcaaaucagagucaguagcucugcaucuuaauuuccugagccagaaaacaaggacaacgcuugccuuguuuauuuagcauugucaugauauuaaaauaaaaauaucaaguguuuaaaagcuuucaccuucgaaguuuacaaaaucagaaaacuauacaauggugcccgugguuugcauauuuucucucucuccugugaauuucuauaauaaaaucucaucagugaaagagaaauggaaccaugggagaggacaaaacaaaucaacucaucuuuccuucuacgucagcaccuauccccaggguaauggagcuuugauaucaaggagcaaaggggaaaagagccuuuugaagaccggaaauagaauaggauacaauaguaugugcaaaugugucucagcagcacaacacggucuuuagacagaacucaaugggggaaaaaaaaacccuuaucuggcagcccccguggaguggggauuauucagcuuugucagccaggucaaaggagggcagggcucuaccucaccuuuggggaagcaacuuaucuccagccagguagccagacuugugcacuuccuuauugaagucaccauacuuagacuggacggcauaagaagccaacaggaccgcaguuucagguggacaguaaaugucgucauugagaaugcccuccuucacuugcagaaagaacaggcgcugggugauauccuggaucaguucuucagauacauccucuggguagaacuuggcccggaacuugaagagcaauggacuuuccuuccgcacauccugugcagucaccugggaggagcaaggagguuacaaaggcucccucaaaauagaugcugaugaugggagagugucuguaaggcagucagaggacucggaaaggcugaaaguauggguuaucguccaaggcugggaggcaacucucauaacuaaaacuuguuucuuuguuuguuuguuuauuuguuuguuuuucgagacaggguuucucuguauagcccuggcuguccuggaacucacuuuguagaccaggcuggccucgaacucagaaauccgccugccucugccucccaagggccgggauuaaaggugugcaccaccacgcccaacuauaacuaaauuuuuaaaaaagcaaauaaacaaauaaaaucaaaaguaucacuuucauuggggaaucuuauaaacauuucuuccucuugagaauguucuucuuaaaaauuuuauaaaucacacugaugacagaagccaccacuaucugacaauauagcuuacugaucucaaauucugaggguagauuuaagaauguucuuuuuuuuuuaaguuucucuuguaaaacuuuuauuuuauauuuuuuucuguguguggacaugcaugcaugcauggcaccuacguuggccagaugagggcaucagauucccuggaauuagagucacaggcaggcgugacugcuaugccagugcuaggaacugaacccugaucuucuagaacagucagugcucuugacggcuaauccaccucuccggccccugaggcuccucuuucaaguguccuccaacccuacaaacuaucagagaauagcaagucugguugaaagcucagaauuggcuagguuagaccauaaaccagaugaccuucuaaacccgaaaauggcuccuaauuuauccagcaagugugcuacuuuuggggucagcaacaugacucagagggcauaggcguuugcuuccacaacucauuuagauccuggggacugacaaaguggaagagaaaauugguauguauaccauggcaugaauguaugugugcacacauucacauggacaggcauaguaaauaucaauauaauauaguaaauaaauauaauuuaccaaguuuuuauucuuuaauaaaacaagacucuuuaaagcagaaagugagauacccaccuccagauacaauuagcaaacuuagcuagagcacaguauugaguccuccgguuugaggaucugaagaggggagugugccaggugucuccagagauacgauuuggggcucucucuggcaagucuacagaucucacauuugaaagaaagguaccucaacauuuuaaaagcuuugcuccaaaacaaaucuaaaguaaagaagagucuccacuuccuuuggcuuuaccaucuugcucagaaguccucugccuguacuuugaugaaaguaauaaauaggacuauagugagggucuuccuguaaucacaaaacucugaaaguggaaucaagaagaucagauguucaaagucacugucuccugcaugcggagcuugagaccagccuagaauaugaacucuuuucucaaaauaaaaaagagagggugguuguucucuaagcuguagaacuagccaugcagacaaaugagaagcaaucuuuucucuacagaaggcagcaauccugcauaaaccuggaaaucuuuguccgacuucagacagccaagucuagucauucccuucaauacaacuuuuaacacucugaauaucagucccuuuguuguuuugcucaauacauagcuugauuaucacagguuugcuagcaagcauauguuauuaccuagaaaauuuuucuaaguaguaagugauuaccuucuuauugaguuucagccaaguagagaaagcuuuuguguccugguacugcagaccaaagaaccaaacuucccucaaaccaauaguuuucaccaccuggaaaaaaaaaacaacacaauaacugguuuaauaucuaccaggaauuaaagaacauaaagguggaacaaacuuaaucuaccuuuaaagggcuuaagguacugcuagucuuuuuuuaaaaaaaauaacaugaaaguagaaggggaacaaacuauuuaggaaaaagacaaggaccaauggaugaaaggaaugcccuuauaaucaaauauaugugcaugaaagugucacaaauccauuuuuuugcacaauuaacauguuuaguauauaauguaaaaagaaaaacauugcuaucaguuucuuugccuaccaaguacuacugugaaccccggugcacaccaagaaccuuacauccauggucaucuuuaauucucauaagagcucuauggcagaaguacaaugcggcucauuuuauagaagguaaaguuuaaaguccaggaaagaaaugacaugcccaacaugcagguaaguggcagagucaagauuuagcuuaugucauauuuccaaaucaagccaguucucauauguuccaucaaugucucccuucuacaaugcuauauagcugucuccucccagaauggauuagagacuauaaacuaaguuucuuagguuaacuccuguaucauauucuccgggggaacucucauauauuguccuucagcauuuuaaaacauaaagaauauuacauuggcauaguaauaccugccuauaauaccagcacucuagagaaggugaaggcagguggaucagaaguucaauaucaucauccuugguuacacagaaucuaaacccagucugggcuacaugagaucuugugucuaagaggggugagaugcuuaaugucagcacuuagagggcagaggcaggcugcucucugaauuggagaccucagucacgucaagcucuacuaggccagccagggcuacauguggaaugucugucuaaaauuaacaaaggaggcacauuuaaaaaggacacagaugaacaaacagaaaaggugcagagaugcaaacggagaugugcaaaguuucuauguccucaagcacaugucccuucagguacuuccacauguuuagcucucuagaagcuucccaaccuagcccuuuagguuucuagggaagaauuacaucauuauaauugacuguauugacaaucauugaugacaucaagucaaacuucacagcugucccaaucuuuagaaagugaggauuauaucaacaucuaagaccaagucucacuuguaauacuccaagaaagacaaagcagaaagcauacuauacagacagcucauagcccaaagauauagauaccaauauguuuggggccaacauuugucuugugaagaagcuaaagggcccuguauugcccagcacccuuugaaugaauagaaggcagaaaaggaacucagcaaggacuuggggacuuuuuuuugucuuuuauuuauuuauuuauuuauuuauuuauuuauuuauuuauuuuaauugagcaauugccaaaggcauguuuucugguugggguagaaugggguugggguaggggugguaugcaccccgggguagggaugguaugcaccccaagucaucuagaguuauccaaccacccacagcaccauucacgaaguauccauugucugaacagucucuucuagcaccucaaucuccagagggguaacuuucucggugaggacagcgguagugccuuucucacaucuguaccggccaagccuagucccuuucuuguugggcacugagaauggacgaagaaaguccagcuugaucuugcugauaacacacagaucaauguugcuuccagaccccaagucaagauggagucuguucaggggcccugacacuagcagauugaugguccaguuguaggcuccacaccaacaugcccaagacuagggauggccacguuaaagcuaagccauauccugaugaugucagaaugacaucgcagaguccucaucuuuucuuuuagguauaaaaggauggaaauacaaguuuauggugggauaaguaugaaaucuaagagacuuaacuagagacauaaacaagaacccagaguugccaacauuccuucuaguaaacaagccaauaccuuccugggacuaucucauauaauaaccacucugaggagaggccacauuccuaagauaucacacuuucucuuuauagaugucacauaucaggaaaucugaacaaaaaucuuuuaucuguaacuugcagccaguauacuucguuuugcuggucacaacuuccucauuaucuaauugggaggaaaguugucaaaugaucucacaugaaggguuguguaugggaaguucuuguccuauacuuaacauaggacccaaguaauaacucugauuuucaacacauuuucagaguuaugauugaaaugccaccggugggaagagaaagaguuacaaacuguucauauccuagagaaagaaaaaaacccacugaagauaggauaagcuacaggacuaacguaucuagguaccgaaggaguggagcaugaaaggaacagaacugggaaagcaacaacuggcuuuuaccuaaaccaagaggccaguuguggcggcucagaaaaccuaggacugaaggagauuuuguuaugagcacugcuucuucuuuuguaagcagaaggaaauaaaaaggguaugaauuuuccacuuccuuuaagcucuugagcuuggagagaugagcagucucucagccuaugcugaaguuccaaaguacagauaugggaggaaggaaaugcagucugaagucagaacugauacugaaaaaagaauaaagggcaaaagagaaggccugugacuaaaggcuacaaagaaaucuccaauuaaggucuaugcagugaugggaggcauuuguucaggcaacacuuggccccguuuccaauucuaagaacaaagaaacagcacgagaaauuacucacuuccaauguuuauagucaccaagaagucuauuucagguggugccggacuggagagaggaaagaccgugcuuuccaaguuaaagaagaaaaguaucuagcucuuuguucuaggaauaaaccucuguggcuccagugaguagauuccuuauaaagcugagaaauggcucccucccugagggggaaaaauguguuucguuugguacuagacauccuucuuauaagacuuaagcuaguauuccucaaagcugaccuuaagaaacccuuaagcagaagaacacaguuauuggcuacacccaagaggucugagaguaugguagaacugagguacacuaaaaacauuaugaaucaagauaacugggaaauuaucccaauaaacacauuuuggauaaaaaaaaaaaauuuucuagaggcugugaauucuguucuguacuauacccuacuaucccuaguagacuguagagagaaaacagggcuaacacaacacaagcuauuaaacugaaguccagugaugggccuaucaaguugccuucaaaugaaguguacacccccacauauaagcacugcucucagcuuuggucagaggagcuucuuuaugcugugcucggcaguaacuguggacuuuuaacuggccaaagugccaagaauaagugacuguuggcuguucagccuuaauugaaacaucuauaucaucuccuccaaggcaccaagaacaucaaaaagagagggcagaaagaucauaagagcaggacgauguggaggagagcugugaaaugaugccauccaggauggucauugcuucauugcagucaugagcucccagcaccugugauuacacacaugagaccugcauaagacuugaguuaacaucuuaucacggaaagggcacgugaagucacacccaucccugaagaucuguuacugguugguaaucauacuucugugaaugagccuaaggaaacucacugaggaaaggguagacaugaaagugaaaaaaggacuaguugaaauugaaaagagaucagcaggagugugaauugggacuagggggaagaaggaagggaugaauauaucaaaauucauuaaguucauuuauuuaaaauguuauaccaagugaggcaugguagugcucaccucuaaucccagcacuuaggagggaaagacaggugaaucugaggcuagccuggucuacaaugaggacuaauacuauacagaaaaauccugucucaaaaaguaacaacaaaaaagaaagaaaaccaauuauuauuauauguauuuaacacaugguaauuaaaaaacuacaaagaaaacugaaauccaaugaaaggaagagauuugccuuuaaaaaaaaucauugcuaacuucuaggagcuuugggguauaagacaacuccccauuuaccucuuucguuuuuauaacucgcagaagucaauucaagaaucagugcggccugccuuguauacuaccugcacuacuuguguaacaagcuagcgacaucaugagccaucuuagcagcccagaacuacaucauaaguaaggccagagccuuaagaaaaaaaucugcaugaggaauuaugugcaaaacuguauugcaucaaugcccaaacaucugagguaugcugagauucccucacaagcuggcagcaucugcauuaucacucaccuaaaagcaaauugaugguuaacuggaaaaaucugcaagaugcuaccacaucugcuucuuacgcuccacauagccuggaccacagugagcaucuucuccacauaacagacaacacucagcccaguuucugcuuggggaguaggcuaggcaaaggaaguucacacagggcauaguugacagaaggcacugggaaaauagaaucuaucaagauucaaggucgagucauaacacucccaauagcugugugagcuugaccagaacuuuucuccucacaaaaccucaguuucuaauccauaggauaguaauacaacuaauaugacugucauaauuaaguguuagucaugcuacaaaauaaaaucagaauuuagaaauccuaaugcaaaaucugccagcaauaaguacuucacugaagucagaaaagcuuuguuauuuuuauggaucccucaacugaacucacaugauggcugagaagccagacaggaucucuauauucgugugcauauaugcaugcacuagcaauuaguaggaaaagaggccuugaaucugaaggagagugaggagggguauaggagagguggggaggaaaaagaagggagagauguaaucauacuauacucucaaaaaaauaauguuauucauagugguagcucugccaccuaguggcauguauauaacucaggaugaaaucauuuggcaaaucugcuuuaagagauuaaaguaagccaaguacaacaugccugcagcaaaauguguucuuccucuuuccugucaaggaacacacucacagaaagaaacagaaguaagggguagcaauugugggccccacuuccauuucccaccaggcucugcgucuccucaagcuacgguuucccauuguugcauguuauuuaucacugggugccaagaaauauguuccuugaccagaaaggaaguuuaaaaaaaaaagaggaaguucaaaucucuucuccagugguuuuuaccuacaauauaacagcucagacccgucugcccucacagaggaugacuguauucucuguucuauggcuaccucucaaugaccuaagacacaucuaggagacauguccaaccuguaacacccucauucgcccaacaaagugcagugcaaugggaaaauaauauguuuguucagaucuguauuugaaacuccauaucacaacuugcuggugaugugaccuaccaagguauguucuuuguccucuuagggacagaaucgcugugaugauuaaagaauccagcuaucacuucaaagccaacucacuauuuuucaagaauacaauguaccugccgggcaugguggugcucgccuuuaaucccagcacucgggaggcagaggcaggcggauuucugaguucaaggccagccuggucuacaaagugaguuccaggacagccagggcuauacagagaaacccugucucaaaaaacaaaacaaaacaaacaaacaaacaaaagaauacaauguaccguuagcaacaggagucaccauguuguacaauagaacuccaagucacuuuuucauuuguaucuauguugagacaggauuucauguugcuugcucaggcuagccucaauuaaagcucucuaugcucuugggaaugaccuugaacuccagauccgucugccucuaucuucagagauuacaggcuaucauacccaauuucugacucacucuaaucugaaugaaauugcaucuaaagcaccuagccaagcguaguuuauaguaggugcucaauaaauauaauuccuaagacauugcuuauacaaaugagaaauuaucugguuuucucucucaguccuuucuuugaugauuaugaaagauuaaagucucuugaguacucugggaggcaauagucuuaagaguagcauaccagccaggaaccuaguacguguuuguaauuccaggaaucagcaggcuaagacaagaagauugucccaaauucuaggcagcauggacuacauaauaaauaccaggucagccagaguuauauagcacacacaaauuuaccauuccaaucugcacagggcucacagccagagaggccucccauggaacuccacguacaguacagaaagugaaccaacaccaacaaucaauuccugaguugaggcuuuuuuaaguuaauaaaacuuugcccaaggauuuuuuuauugcuccggucucuaagucaugucuucuuugccuucagcagccaucccccuccaauacaaaagaacaaagccccagcaccaagagcagggaaggaagaguauacugaucauuugguuugggagagaacuaaguagaaugagaacgcuggaaggagucuaagaagaggccaaaguaagauccaccacgacugauaugcucccuucugcaccucuuccugaaaucaagggacccagggauuuaugugguauaguagauguauccuauguuugucucauaggcuguuagaagcuaauccagaagagauauucugcaccagcugccugucuccauccaauucaagugaagcauuuuccuucuuuuacaaaaaaggguugucugaacucuaaacaauggaaauacagaagaaggagaagaaauuguauagaaaagaugucagggauaaauuuuugagggauaaccuaauuugagaaaucauuuugagauagggaaacugaagcccaaagaagggaaauaggggaaauguuugcaugaaacaacaaaaaauuagcuggcaaaaccagcucuagagaccagaauuuucuaucuaguauccagucacuucauaagucugucccuuuaaaaucucuccaauauaaaacccacaugcaaagagggaaugcaaaaccuuaauauaaucaaaaugcauucagucauugcagacuaguacuguaaucacuugugagcuaggggaaugucaacacauuauuuuuguguuuaaaaauuccucagacuaacuuguauuuucacaaauuaaccaucagugauuaccuuacaaauuacagugauugccuauucaaaacaaaaacacaaaacaaacucaagaggagaaguuccaacuaaauccaaaauaagaugauggcgcuuaucucccuauucuaguucauaaugaaacaaaaagcaucaugguauuugaaaggaagccgucauuuacuacucuaccacaugcauguacauaauacugccuucuaagcuauuuggguuuaggguuuuuuuuuuauugucuuguccaguucuggucuggaauuuuaugcaaacauauaugucacaguaaccaguauuuggauaauaguuaagauauaaaaaauacauuuuuauaaaaacaaaagaucugccgggcgugguggcgcacgccuuuaauccuagcacuugggaggcagaggcagguggauuucugacuucgaggccagccuggucuacagagugaguuccaggacagucagggcuacacagagaaacccugucucgaaaaaacaaaaaacaaaacaaaaaacccaaaagaucuauaugguaagcauuaauugccccccuuucuuucacauuuguauaugugugcugaugcucaugucacacacagucugcacauggaagugaaaggacaacuuacaagucuggaggcacacacaccuagaauccuagcacuugggaagcagaggaaugagaauugugaguuagaagucagccucagaugcacaguaaguucaaggacagccuggacuuuugaaaagagacuugucuauacauagauaaacagacaaacaaacaaacaacauccuuuacaguuugaggcuccauauauugauaguuucaguaaaucuaccauacaaucaugcucccggucucuuuucucccuuguucgagaucaaggauaggauguguuagggcaauaagauugagauuucagguugccaacauuuaaacuuugccuccuuuuuaauuaagucugcagucagccuuuguguucaccauccucagauaggcaaguggaaaagagaccuuuuccaaagcauagaaggaaugaguggccugcauugugaggagaccuauuaacagaaaaaguaguuaaggaacaagguccuccuuuaccuggucaaacagcugcuugccagugguguugggcugaauggcaaacuccagcucugcauccaugguggugacacgcacacugaucuagaaugagauaaaagcaagcagauuaauuguuuggcuucgugcucaguagauuuggggaaaaugucuacauucaacuuggaagaaacccaaacacuaaagugaguaaauaagaaauugguaugaagaaagguaaaauacugaccuaagucauaacuuaacuauauucacacccagauugcugaagacuaaaacacagccauggacaauguucuaccaagaggcaaagaauguaaaccauccuacuacaaauaggaaguauugacuauauuucuuccaaaagguauucacccuuuaacaacagccaguuccaucccacagcauucucuucuuaccccagaccuauagccuggcuuaucuauggcacgaguagaucucugcagaagcaagguaaaauaaagaacacuggauucuccacuauaaauuuuccaagcuacaacaccaaccuucuaagugaaauguacuccugauauaacagagcacaggcccucauccugugagucaugaccccuuuaggggaguugaauuacccuuucauagagguuuucuaagaccauugaaaaacacagauuuacacugcaauccauaacaguagaaaaauuacaguuaucaaguagaaaauaauuuuacggcuaggguucacaccauaaaaaacuguaguaaaagguuguagccuuaggaagguugagaaccacugcaauaaaggcaugaugguaaaugggaguaacuaaccauuucugauugaauuugaggucaacuccccaggagggaauugaugcccaguacuguaaaccugcucaaaagcccauggcuuggaaggucauaugcccuagugggacuacuguuguuugacucaauagaaaugcagucacauuggccucuuaguauguauuaauauccacagauuaguuuugcucugaagcuuaaagauguguuuuuuuugcaauggcuuucagcuaauucagacucauaacuggucaaaguucugagaauaagugauuguugaguaguugguccuaaacaaggaaucuucauggacccacuccuacccaagguccagagaaaacuauagaagauggaauagaaagacuguaagugcuggaggacagagaggagggcugccaacagucuucugcuuaugucacagcaguuacaaccaugaacucacagcaaugguggguauuuucaaaagaucugcacaauauggggcacaucaacauggauaggguaagggcuaaugacacuucauccuauccuaaggagcaaaagccaauuuauuguugcaggagagaggucauuuuuguguagccacugguaaguuguccuuguaaguaaucucccacacaugcucaugaaaacaacaguaauuaaauacagcggcggauuuacaaaaaacuauugaaaagaggauaagaaaggacaucaugaagaauaugaucaaauuguguugugugcacauguauauacaauaucuauacauacauauauauuugaaauuguguaagaacauaaauaauuuuaagaaaauuggguucaagguuaacaccacuauaaugggcucaauuuaccaaccugaauaucacuuauccuuuucuugggccuuaguuucccucaucaacacaagggcagacagacauggguugaguugcgggaacaacuaaucaaagcaaugucuaaggaucauuccaauaaugaaguugguuguucuauccacugccuuggucugcuagcacuuccuauauuugugucucaugcaggagagaaagggggcaucaguagaggugaauauguacaauauaaagcugcuguccaaaccaaguuaauggaaggacaaagagggauccagacacauacugacgaacuaccaggcaggaaggaaaagggaggggugaaaugauauaauuauauuuuaauccaaaaauacuuuaagugaaaaaauaauaacauauucuauuuuuaaaugaaaauagaaaaagaucgaguggcaauaguuuauuagagaagaacagcgagacacaccaccaccaccacccagcaaccaaaucaaagcuuucauauaaucucagaggaaaagaguuuagucacuaaauuuuagcacaacccagccuaucauuuuccucaagggucugaacugucucuucccaucccagauauacacuaguagcaaguuggauuuaugcugucuacagauugagacaaaaguucaacccaaagcaaccucacagacucuauugcuucucaguagaugcaagccagaaagcaaagaugauauucuuuucugcugucuuugguagucuugguaccucgcacaauuccugauauaucauaugaguauugaaaaccacaagccauuagaucauucaccagcauauauuuggccugaagauaaaagggaaugggaagaacucuagaacugcagacaagugugcagucacugauauggagagacagaaggucacacuuucucaaaauacugccacauggaaggaaguugaauuaaauaaauccuuacaagcuuuuuuuaaaguaaaaaaguauaacagauaaccacguaggacuucauuggcacuagacaauauagucacaaccuuagaaguagauucccugauauacaucaaugauaauugagauuuuauucugaaggaauuuuuuuaguaaaaacaacagcuuucauguaucuagauauacaagucacaauguacuuccuauguacuaccccucuuaacaccaacaaucacccugugauuguuucuacauugagggugagaaaauagauaucauauauauuauaucacagauacauaaucauaaugcuaguaugugggaguuugaauacaggucuacgugcaaaucuuacuauuuaaaccaauguuaauuuucucuuacagaauauggaaggcuuucauuaaaaaaaaaaaucaaagggcuggagagauggcucaguguuuaagagcacugacugcucuuccagagauccugaguucaaaucccagcaaccacaugguggcucacaaccaccauaacaauccguaacaauaucuggcgcccucuucuggagugucugaagacagcuccaguguacuuacauauaauaaauaaauaauuuuuccaaaaaaaaaaucaaagauaaauuuauacuacuugcuguuuugcucaacaauauagccaaaagauggcuugugauauagacauaaaauuucaugcuuuggggcuaucaagauggugcuuucuacuacccugaucaucugaguugaauccuuaaggcacacaugguggaggaagagagccagcuucuguagauuguccuuugaccuccauaugccugcccccucucucucauauacccaccaaagaaucgcaaacaaacaaaaaaaaaacaaaaaacaauauagagaaaguggaauggggacaguggucuuucuaauacauugguuuauucucauaucaauauuuauuucuaauuuagaauuaggugucuggaacacaaggcuaaguagacauaaggaaaaugcuggcuacaugaauagccaucaaguaagaagcuauaaaauagaugacuagagagauaaggauguacuucaguaacugagcaguuaucuaguaugguacagggguggagacaaaggcagacugaagauaguacauacagagagagaaaaggccauuuuacuuuuucaccuuuuuaugggagguaccauucuugccaaucucgcaaagucaauggaacacuugucaggauauuuuuacaucauaaaacaaauaaaacaagaccguuuaguuuagaauagaugucaaauuuaauaauguguacuuauauacuauauuaaguuaaucaccuaauauugggucuuaauaauuauuacugugguuuuuuaaaaucuuuugauuuugcaacagauccauacauuuauacaaugaauuuuagucaucuuacacagccugcauccccuccaucucccauugucacucuuuacaaugugucucucuccuuguuucuaugucuucuucuuucugucugcuccacugaguuuaauuugauuuccuugcccaagcauagacuggaaguuugucaacacagcaaggacaacuuaucuguggcaaugucacuuuaaaaagugacaacacuccuccaauaagcauuaauugucaauagucccugagagaggaaagugauauuuuuuucuggauacaacauagccacuacacuauuguaauuucaauuuaguauaaaugauauuugagagaucuauaauaacuaagugucccagacuuccgcugaugacaauaucauaggcacugcugcuacuacaaauuuaugcuuauauuuaugauuaaaaggcuaaaucuuuaguuguaacucagugaaaacaaaugcugccaucccauuauaucuauaaaggacugcuuccaggaccuccaugggcacaaaaucccacaaauguucaagucccuuaaaaauaucauaauauuugcauauagccuacaucauguguucucuaaaucaugccuaaauaauuucuaauaccaaacacaagggcugggaauguagcuuugugguacagccauggcuuagcauauguaaggguuuaguugcucacaaaauaaacaaauguuuuaauacaauguaauguuauaaaaauaagccacuguucuuuuuuguuugcggaauaauaagauaaagucugcacauguucaguauagaugcaauuuucccccaaauauuuucaacccacagcugguugaaagccaacuauauccacauucauaggucuuuccuguuucaaaugcuauucauggauagaaaaaugucugguuaaggaacuuucuagaaauguauuucaauucaccuaauacagauggagcacauuguuuaaagaauaaugaguguaggagaacuguagaauuauucugaccuugaggcaauuacugaauuaccaaagaacuguaaugguaauacacagggaagucccugaaaagcagaacagaaaaaaaaaaacuuuugugcaaauuaagaaucauauuaaggugcuuuuuccauagaccucuaaggacaggauugauuuugggaaagggacucaaaauagaaaaaacaaaacaaaacaaggggauuugaguaaaauaaauggagccuaaaaauugaugggaaugguaggaguuaguacugauuaaagguuggcuuguucuuugauaaucuggggugcaaauuacacaaaacaagcuauagcccagacccaugucacaugaggcccucuggacauuuacccuacuagguaccacuuuccuccuuuugaaauugaccucacucuuucauuggaggaagggagggaaggagggaggggggagggggggagggagggagggagggagggagggagggagggagggagggaggggcagagagacagagagacagagagacagagagaaacagagacagagauggggagaaaggagaacgaaguccuguuuggaaagguugaaaaaaagguguccagagagaacccaccacuaagccuuacaaccugagcgcaagcccuaaaucugaauguugagaggaaagaaccaacuaccauaagauguccucugaccucuguauacuaugguaagugcacacauaaguacacacagaaauuucuuuuuaaacccugaaauugaagcuuccaaauucagcauaacuuucccuggcagggcauaaaggagcugaucugaguaaacuagcaauuugaagcauaauuugcagcagagagaauuguuuacacagcuaaauccuugccuaagcugggccugaguaugcagacauagacugaggucaaagacuauaucuauguagaacagaaggcuuuaaggaacaugacaacaaaaaugaugggcaugcauuucaagagcgugucauccucgcacguacacuggccacugaugcuuacugaacauacauagauacuucccacaggaaaccucucugacaauuaacucuucuuggugguccaccauccaaaggcuucaacugggaucacucuuacaccucaaguuggauagccugaaacauaaccaggccagaugcugacucggacuuggcagcaguagcuggagugcuuuagucuaugacccaguggcuucaaagaggcccucccuuuccuuagagccaggaucacccagguaagcaggaguacuccacagcaaaguagucuagccauaacucacccccaccuguuauguguucuuaacaauaaaaucuuuuugucuggggggggggauggggagaagaaauaaucacaaguaacuugcuggaacaacugaacauaacuuuugucaguucauaagugaaaacacucaaguacauaggcacaggugacagaacacuuauuguaugccaacucggugccagccgagucacccacagccucagcucagucacuuaagccaaauuuccucugcuagcaguugguggaggcgggucuucuggacauucuuggagcuccuuccauaacuccacccaccucucuagucaugguaauuucacugcucucuucagacacugucuugguaacuauuuugccaaagcccacacacuguagcaugggaagccuggguacaucugggaaacacugcuuggauaggauucccuugucucccuggggcagaaccuguggaagcccaguugggucugaccucaacaaccuuacugacuaccugccauuucugaauucugagggaguggccuuucuuucugagcuuuccagggggcugauaaugggaggaagacaguuauaauuggagcagaggagcaagaggaaguacaggccuuacuagagcaaccccagaacuccaaucucuuccucaggcagagaguaaucaccagagucacucaaauaaccuucagccagcauuuccugcggcagggccuggacuaucuugauucuuaggggaacagagaagccucaagcacuucuuuucccuaagaagaaagcaagcacugccuugaucuucuauccccggagguggagaaccccuucacccggccucuugcccccaacauauauacacacacaucaacuuucccacaacucauucgucuuuguccuuaaugauuuggaaacagcaccuggcaugauuauccccuucccucccuuuugaccucuauuuccagaccuuuccagaccugccugggcuucacuuuuccuaugucugugucuguucucuguacuuucuacagaagaaaaccgcagcaauccugacccacacccauaccuucaugacucaacauuaguucuccagccacuccagcugcucgaaaagacacaggagacaagagucucuuucauuuguuuuggcucagcccugcccucuaaaaauuccaagaagcauuucaacugacagaguacacuagagacuugagugcuacucuuucaguuaccauguuugagguacugaaccuucucagcaaugaggauacagccaccuuaucagcaagaaacuacucguguuuguguguguguguguguugaauuaauuauggucucacugucaaaagcagcuuaucagucaaaacauacccuagaaacaaacaaugcccaaccccaggucggaucuuccuucaggcacauagguugccccacgauguccuuaauaugguuauccagaaacgauaagcagugugaauucccaaacccuuaaaccugaaaggaccucagugagcauuugacucaaauucaccaguucacagauaggaaaacugagggaugagaaagagaggcacugucccagggucacacagcuacuaggaaguuugagaacagggauuaaaaccugggcgcuugggcuaugagaguggcucagugcuccaacaccacaaauaauaucuaguuuuuaaaaacuagcucuugauuccauagcacauuuacuaugcccucaugccacccuagauaguagaaguaguuaguagacccuuuauacaugcuacuuugaaucuggagauacuaugugaaggaggcuggcuguaccaguagguuucaauuaaaaacacaaaagugacacuauuuggaagucuaguuuucaacagggcauagaucuaacuuucaugcugagauaaccacuaccacccauucuagggagacacaauauuucauaacaacauggaagcaaagacauaaagaauaaaaggaauggguccauaccuagguagccaagaauaacaauucccauaaaacuuugaaggugcugaaaugaaaaggaaguaagcccaucauuaauaaaauaagcauccaaaugugagaaacuguuauuuggagccacacccagcugggcuucacucucuccagucagcuuccugcuugacccaggcuccugccagcaaguuccacaggaaguuauuuguagacuggagacagagcauuuuuggcagccugaagacgcaggcucugcccagggcaccagaagagggcucuauucccccugcuuaggagcacaacacaucaaccuucgaugucaugucugucucugaagaacaaugcaguugauccaggcaccagcugaggucuggguguuaaaacugcuaaagccaggaucaguaaacuauucaggggccaggagaaggcuuacaggccucaucaaaaagaacugcuuucaaccccagggcuaggcuaagguugacuucuaucuacuucgguaugaaaguaguuguuuaauaguaguuaaagaugaucuuuaacuccuaauuuuccugcccuucacaccccugaugcuggaauuacauacaugcaccacaaagccuggcacagcauuuuuaaauguucucucucuuaggagagaugagaaauuuuccucaaaaaaaaaaaaaaaacagaaucauaaaggaugagugaacacagcagagcaguuacaguguuuuauucucuucaaaggcugucaugucuuccuuccuuguucugaacucugccugacuauuuuuuccugcagucuuuuauuacuaacccuuaccacucaguaaaacuuaccaagacucccaaauucucacagcugguaucacaaagaucauacaauaggccucaaaaugacucaauacaaucuaucaccugagguaaauuuuuagaagagucccuugccgauccacacagauucuggcuucuugggucagaaggggacuggccaucagaaaguaagaacuacuuuucaaggcccuuccgaguuuguaaaccucaugaugauaaaauggcuuggaaacuaucugauugagggaaacacagaaagcacagguuaacuagaagacauugagcaagugguuuaggaaaagcucuccaagauuaaacauauaacccacauccaccacagagaucaaggaugccauagucuuucuauagccacuacaucccucuauuuucuaguauccuuguuuauaaaguaugaugacaauaaugccuauucuucccuaccaagaagcaccacuaccuauacccauaaacuaaaguaguaucucaauagcagggagagcauggaauaauauccuaaaaacaucaauacaagaucuagcucuaccaacaaugagccaaaagcccuuaauaaagugagcauagcaaugccaguguagcaaacauguuguuugguacugaugagauggugcccuuaacugauugcaaacaccauuucugacauuagucaacaacccagauuccuaguugccaacgcaagauuacuauaauauauucuccagagaagaggcuugggaaucuguauuucaacaaauacccugagauacucacuaccugagcuuaaagaaacauacucuggcacagaugcuggugacaucagagcacaggaucaguaaccuagauguccaagauguuuucuggcucggaaaucuucauucagggaccuugaagauaagaugugacagaacaggugcuacaggcaggaggaggagauuuugaaagccuaaacagaaaauugugccaaaccuuugagcuauuguccagaguauucaaccaucuuuccaucuaguuaagaaccagacagugggagguacagauaacucagcagccaaaacauauugaucaaaaugcucuaauuuaaggccucugucaagagucuuccugaguucucugccucauaagcauuccacacuuacucauucucaggggaauuuucuggcaaugagcagaccuuaaacaccaaccuccccuucuuggauucucugagaacuaagggacaaagaacaaacaucaaaaguaaagcagagaugcaacucuucaugaaagaagaaaugggagggucacugagggaaaagcaauuugcuuaguuaggcuuuauggagacaauuguaauaucccagcaccauacuacagcagacuguucaagacuaguuugggcuacauacauuucucaggaggacaaaaaagcaucuaaugcaaauucagagguaaaacuacaguauggguuuucaaagcuaccaguacacugacuauuauuugcucuucgcaauuucuuuuaguuacaaguuauuuugacaguuaucauuuaacuuuauccaaguaaucuaguggccucuagccauaagcucucacauagggugcuauagcucaccagacagcuuggccaguuugaaacccucuagaauaacauggggaaauggagaguuccagucuggucuccuagaauucuacucaucuuagcucugccauaaauuccuuauaguauucucuggacccuuugucucucggccugaaauacgggggucaaacuagcuggcuuccgaagguguuuucagaggguccaucuauccucauugaaaagaggagcuaaagugaguaaauccccuuuuuaauaugccugcauauuccuucagccucgggucauuccgagcugaacccuuuaggcaguuaagugccgggugacugacagcugggggaggggggcgggcagacaagcaggaaggcggcagccccacccuccuuugaacaggaagcuagcuacauccucuuuuccccacccucagcaguacaucuccagacauaccaagcagaagcugugggggcagggggaagaugaggccuaaaaagaaacuaaacaugcaaaucacccccaauguacuaaggagccaucugagggucggaaaugaacuagggccaugagaaagagcagggaggcauccccaaugucuacuagggcuaagcuauucaaccucaccuugcuagccugacaggaacaauuaggaaugggcuaguacaguuagcagaccuggccgauccacugaacugcaggccaaacaucaggaccucauauacacagguguuucaccaguauauuuuucuuggguuaagaaugcagccaugucauagguaggaguaagguauacacaugagugaacauuugugaaugaguauaggggcuuuuaaugaaucucaaaguaucucaaagccaaggaagcccacaucaaccuucguggcuacaugccagcccacuuuccagggccauccccuacacccugugacugggccccagcccuccccacauccuguucucagagaacacguggcugccuagggaaagauaaugucauuaccacacuuccccucgguggaggaggaucugauugacuggagagggagccagaguucucugccucaacaggcuaaauaaucugaaguaaaucuccgaguuucacagagggacggacaggaagagugacuagauaaucuugagaucaccugauacagugaaggauacauaccuaaagacagaggaugacagaucacauugcuuccagaauaaauaaauaaauaaauaaauaaauaaauuuauuuuaugggguaaaaggccaacuucuuuuacauuucaagauuguaagacaaugccaguggaaggacaaugccaguguccuuccuugaucagugaaccagaagauacaaaaacacaggaaaauuguguuuucaaaagugucacacaagucucauacaguaauccuaaauaccaacacuggcauuucugcuaugacagcagugaguuaaugggccuagaguggcauuacccaacuuaggaaaagaaaaugacuuccaaucuguaagagcagcaaccaaacaaauuuagaguugugaaggagugccacagcccuacucacugcuaaugucuucacuucucgcuaaucagcucguucccuggcuccccucuguuuucccuuccuagccuauaaauauagugaagaauguggcugaacauuccauguuuagggagguccucccagcugauccaaggucagaagucagaagucagaugucaaccuucagugaugccugacugaacgcaccauucuucagugcaacaggagccucacugggcuucuaagaggaauuccagcuucccgugccuaaacagguuguuccuaacucucagacaaccugcucguacccacaccucaucuugcagcucagcucaacucuuggcugcauaaaguuaaucacauaggccuggagaaaaggaagagucucaaaaauccuccagcagagugucauacuaccuuggaaagccaggauuacuuuuggaaaaggacuuaggucaaacauaaaggguggguggaagcuuguuagacaauacagaacauccaacuuacuaguuuuggucaauccauagcuugagauaaccuuucuaaaauuguguuguuguuaugcccucuaaacuuacaagcucauccaccaauucacugaagccagugaaaacuuuucagccuacgcaacaauaucaacauuuuuagcaccccacccaccacauaucaauaucuucacacugaagcacuaaagugaaugcacaaaacacacucagcuaaauuuacaauauaaauauauugauauauuuaguucuccguguagaacaagaacauucuucuccaucaucuuaacuuucaucuaguguuuucagagccaaacagaaaacagguccaccagacucuccagaaauaaccaacaguuucucaaauggccuaagcaacaaauaucaucguguaauuuuuaggaagcagaagaagcccugacugagugaagucuugagugugcuguugacaugggcaccaacucagacucgugcaggaaugauaaagccuucccugcaggaugaggcucagagcaaaaguacaaaaccugcucucuggggaacugagugcaaguguugacaguuugaacaaacauccaccauagcaccgccaaccccacauucauggccugaagaucacuccccuacagaggccgcucccgcugagacuagcuaaaccagaagccuugauccaguuguaugccauaaacccugacucccuguucauguguauguaacaacccugccucaaccaucuucagcuggaugcaguaauaccaccuuucuauucaaaucuauauaauacauacacugagcuuccagagugcugucauuucuccagcagagaucccaaaccaacagaccccaacuauuucuguaucucugcguauuugucuuuucuucauuuccuggcugcccuagucaggucugucccuggaggccauaaagagacauggcauacaaucaaauacaacucuauacaucuaucuauaacucuaacagacuuggauaaucaacuaaggcuaccucucaaucuacuaugaacauuuuaaaaaggaaccacacauaauagugugugugugugugugugugugugugugugugaacaugugcauguacaugugcaugugcaugcacaugcaugauagagggugcagaacgcucaaguucagaaaguacaagguacuuuucaccacaccuuacugaaagaaauuuuuguuggauggagauaauauguagauuagugaauggggaaacuguccuucuacguaguaagggcagagguaaaaauaaucaaaagcaauggagaaaacaaaaagaauccaaacaauggagagcaagaugaaaauacaagggagauuucuagauaaggaaacuaucuagacagauaacuuuuuacaauguguacauaagucucucucucucugucacucucgcucugucucuuucucucuuucucucucugucucucucuuucugucucucuuucucugugugugugugugugugugugugugugugugugugugugugugugcgcgcgcacccaagugcaggaaucugccaaaccaugcaagggcaaccuuugagagucaguuuucuccuucuaccauguggguucuggggaucaaaaucaagucaugaggcuuggcaaccagcgccuuuaucucccugacccaucuaagcacauuucuaaaaagcuaaggaguucugaaggaugaaagauaaagcuaucacacaaaauaaaugaagggggugggguacuuaaaauguuaugcagaaaccaaaacgaggagccaggacaaagaaaaacaauucaugucuuccaaaugucacaaagauacauauaauaaaugaaaaccuuacaaagggcaucaaguuaaauguuaaggccuccgaucccgucucccagaccuuggcagaauuuaucagaagagaauaaauuagaccuucucaccauguugguuuucuaugccaauuuaucagauguaggagcgaggugugucacaggcagaaaaggaaauaguaaagaaaaaccugacaaauuggaugaauguacaagacagagaggaagcucuacugcuuuacuaagauaccaguguagccuaacaccuacagaucucacaggaacuaagucaucaaaguuaaggagcuacuacaauauaccucuuacagagaaucuauuuucuuauggauagaucgagaggggcaaucaugacaaaaugcucaacccucacccaauucacccccaaccacacagagaaaaaaggaaaugaaaucuaccgacacagaaaggaccugggugugggccccagccaaggcugccugaccuucuucagaagagcaaggauucacugauuucacaaacuauuuuuggccucuuguguaaggguuccucuaaucaucgucucuuaugcacauucucuaucucccucauaccauaaccacccauucuagccuggaucucacauacuucuuucccccaacuccuucaaccugagacuuuaaguuuauacaugagguuccucuucacaaaacaauaaauacccacagauucucaaucuguccacccaucuacccaaaaaguaguaguggaggaccuaaagagaggugugucuccuacaaaacagaucagucauggucaucacuagcucaaaugucaguuuccucaucuauuaagagaaaaucaagcagaacuacugcucuccagggggacacaccuacaacuuccaggcagaggggcuggagagguggcucagggguuaagaguacucacugccagagaaagaccugaguucaguucccaguacacaucagaugacucacaaacaucuauaacuccagguccaaaucaugagcaugugaaucagucugucugucgcugucugucugucugucugucugucucucucucucucucucucucucucucucucucucuuccucucucuuacacacaaauaaauaaaauaguaaaaaaaacaguuuuaucuuaaauauuuagaggguaaaauaugauauuuagggaaagaugacauuauuaagcauguagucauguauacucucauacucauguacuuuucgcauaaauuucaaugaagaucccuacuaaucugcaacuggaaaacagugugugucaaagguuaauguacuacacccaaggacuuacagcuguaaguaauuguugaggguuagucuacaaaugggucuacuucauuuaucuauggcuacaacuuucccuucccucaaaucaccuuaaugcugaccagaucccaaacccugaucuugaagaagugaucgccauugucacuagaaaaucauuuacaucaaccucacucacucacuacucacaaaucacaugucaguccugaagagcagaaggaucuuuacauauuccuugcaacuacucugucccugggguagagguagaagacuuggaaaaagaguaaggacaagacuaagaagccuggaugagaacugcucauucauuugugcccuggagguaaccauuggcagaaauuccagugguuuugucuccuagaauuaauagcauaaaacuaagugagcaccuauaauucuaggucugucuggaaaaggcagauaaagcagccaggagaagagaaggcauuccuaaaucaacuccugcuacaauucucacauuuacaggggacugagugacauggccuuggaaccauacucacucuacaacaaaauucccaaaauaaaguaugguauaacugcucaaacaggcauguacccaaagagccauacaacggguaacagagcaaugaguaaaaggacuauaaagaagugagaaugccucccuugacauguaggccuacuacuacagacacaccaggguauaaccucacaacuccacagucugucuuccuccaaaaggauucaggauucuuucugucaacaacaacacaaggagguaccuucucaaaaagacagguuagauuuuuaggugacucaacaagagccaaggauggaguauggaggacaagcaagacgagcuggcugcaauccuagaauucuacacugaaugcagcuuugcguuuuuguguuugcuuucaaaucucucuaauuacuaucuaucaacagcagcugccuacuuaccagauuucgggccaucuguaauggaaagcaacgguguauauacaaaggaagagugaggugaaggaagagcaucuauaggggauuuuuccuacuccaaagauucaauuuuaauucuaaucuuagguaauuaugaccuccaacuguaccccagaaggagacauaguaguuuaguuaguuggcaaccaacaugguuucuaauuugcaacaagcagccaaauuguaacucagaauuaaaagaccuagaauguaucugguucaagaaaaaggauuucugaauaucuaagaaauagcuauaaggcugagcauggcauauaauccuaccaucuuagcugcugagguagcaggagcaaccagccugagcaacacagggagaacuuuucccaggggaaaaaaacuggauaucuaauaaauuggcaauccaauugacacagucuauauugaugauuggcaacuguuucuuuaggccacauacagccucucuguuuuuucuuaacaauaccuuaaaaaaagauuuauuucuaaucauguguagguguauaugucuguaugugggaauguguauaugaaagcaggugccauggguauagucuuagauccccuaaaacuggaacuacagccaguugugagcagccuagugugaguguugagaauagaacucaagucuucugaaaaugcaacaaguguuauaaccacugaaccaucaucccuccugcugacaauuccuucuuauuauuuuuuaauuaccauacgaagugauguuucacuauggcauuuguauccacacugcuuuugccccucacuaaauuccuccuuacuccccuaaccuguccugcuccugcugaacccugcuccacuaacucccuucugcuuucauguuacauguguucuauuauccuuuuccccuucugcccauccgcuaaagucgcucuauauaucugcacuugcucauauacauguauguaugacuuaaaacccaggauucacaugagagaaaacauguaaguaugaguacucugcuuaguaggauuuccaguucuacccauuuuccugcauuauuucaugauuucuuuuuuuuucuuacagcugaauaaaauuuuuuuauauauacuauuuacuuuuuccauucaacugauucuuucuuggcuaucaugaauggcauagcaauaaauauggaucuaaaacaauugucuucugccaugcauggugcugcaagccauuaaucccagcacuaggaaggcagauguuggauuauuucugugaguucaaggucagccuggucuacauagugaauuccaggauagccagggcucugucucaaaagaaaaccaaaaacaaaaaacaagcaucaaaaauaauggucuugcccaguacuagacucccauauguuaagaguauugacaugcuggccagaugugcccaauuauaaaaauaguagcaugacacuuauagggauaaccaacugcuuccugauuagaugaggccuccuccacagcaaggguuccaugucugguacuguaaccuggucaaaaguccaugccugagaucguaggcccgaaaggagaaccuacuaaaugguguuuugcuaaauggucaugcaugguaacaugcagagacugguccaaguggccaaaacaaggaucucugagugcucaguuagguauuaauuaucauuaucagucuccuccaauucaagucucagaaaacauugcugaaaguggagguaaacagaacguaggaacugaugguugaggggaagagcuguaaaaugcugacuucuagaaugguauggcuggugugcacacaaacucacagaugugaagcagggaaaguggugaguggauaugaaagauggacacuguauaaauguacuaaaaugucaaaggauuaaaacaaauccuuauaauggauggaaaguaucucugugguaguacuuaaaagugauuuggguaauauugcuuagucauauggcaguucuauuuuuaguuuuaugagaaacugccacacugauuuccauaguuacgguaccaguuuacacucccaacaauaaaagaauaaggguuccacuuuacccacaucuugaccaccacuuauuugucauuugacauuuuuauauaaaauaaccauucugacugugguaaaguugaaucucuaaauaauuuaaauuugcauuucauugauagcuaaggauagugaacauauuuuuuuuaauuuauuggugggcuagugagauaguucagcaugcaagagguagcgacaacuaugcccggcaaucuuaguucaaucuccaggauugaacccacguaguagaaggcgagaaccagcuccgacaaguuucccuccugugacuaggcguaggauacucaugaucugguuaggaauuucccucacaggacuagagagaagaaacucaucacugagacaugcccauauuaugugucucacugugguucuucacaacuuuccuucuauggguaagagagggggguggggacaagcaugguaucacaggucuguaauccuagcauucagaagucagagaaauuacaaugggaguucaagacuagguuaacuacauaaugguauuugugugaagaaaguaagaggaggagaaagggauacagggaagaggagcucccuuggaagcuguuuagagaaaagaaacccuaaaguauccuugauuuuuuuccacauuaaccaucuucucaugacccugggaagacaagcuuauucuuuaaucagggucacucacguggagcagugaggaaacaaucacagacaacacuauggaaugguaccagaauaugugcaaggguuugaugcucuuugaaugugcuguagcagcagggacugggaccuagcagaggcggaucuauggguggcccuacucccuaaugaggaauaaaggcuacuggguuaaauaggaaguagaacacaaacaguguucaauucccaagugcccugucuuggacacaagacagagcaccaucccagcauuuccauauagagcugaagagugaagucaccaaguccuugggcucuuacucaccaacugccuguuguguuauguuccuacuuacugaaugccuuggugcccacagcauuacucaccucccauucugugcuauucccacccccaccccagcccaauucugcaacaugcccagacaaugaacucacccuacaaagagagcuacucauuucccuuggggcuacuuaguuacuuugaaccccacaccuuccccagcauuuuugggcugagggcuacaauucccauuuccucuaaccaugaccaaguuuagggaauucccaauugagcuaucagggccauuuccaccuccagguaccauaguaugaagaacccagaguaaauuuuuaguucaucuuaacuguauucuugcuguauguccacugggauagaacucuccuuccucgguuuauuuuucuugcaagaauuuguaacaaagagaagcucuuauuagagguacaguuaccuuaacuuuuacccaacauugggaucccuuaggcaguuaguuagaaaucccuaugccuagucuuaacccauaccaccuagagccuauaugaaugccuauaaauacgccaauauguacugcacagguaaauugaguuucuugagcacaaggucagaagacaagucuagcuucuuccacccaaagcucagauuccacuguaagaagaggugcucuaacaaguaaucuccagcuaccuucuuagccacuaaggucaugaguuuagaucaccaucaccauugguagggguguugguugaauuauuuuuguuuuguuuugcauuguuuguacauaguccuggauggccugcugcucacuauguaguccagaacagccuugaccucacagaaaugcuccuguuuugagcaagaggaauuaugguuugaauaugcuugguccagggaguggcacuauuuggaggugugggccuuguuggaauaggugugucacugugggcccgggcuuuaagaaccucauccuagcugccuggaagccagucuuccacuagccaccuucagaugaagacauagaacucucagcuccuccuacaccaugucugccugaaugcagccaugcucccacuuugaugauaauggacugaaccucugauccuguaagccagcccuaauuaaaugugguccuuauaagaguugccuuggucauagugucuguucacagcaguaaaacccuaacuaagacaggaguguagcucccuuggaagcuguuuagagaaaagaaacccuaaaguauguucauauuuuuccacauuaaccuuuuccucaugacccugggaagacaagcuuauucuuucccucaaaugaagcauuggggaaaguuucuuaagguugagauuucugacagauacuaacaaacccaaaacuuccacuccuuucauuucuucagcaguucggauccauacacaugcacguguuaggcaagcacuccaugacaaagcuacuuugcuugcacuaaguucucucucuuuugaaaucuuucauugaguccagaaggaaaauuuuacaauauauuuucacuaacauauacguaccaucuuuuacaaagaauucagagaacuaacuaguagaucaaaaaugugaaaagaaccugguuguguuagcccaugccaguuggaaaacugaagcagaagcgagaggaccaagaguccaaggucauccuuagcuauauggugggugaguucauggccagacugagcuacauuaaauucugucucaaaauaaaaaagaaagaaagaaaacuaaaagacaggaaacuaaaauccauguucacauuccuaguaagguauaagacccuauauugguuaggucuaagcaaaugccaagcaauucucacuugauaccaagcaacugugugcauaacaaagccaaauaaguuacuggcacagccagauggaaagggcaauuagccuugagagcaauggucugacacuagcaacuggaugggugacaugggaagacaacugccaggcccuaagaaaaagaaaacaauggagcagcuggccaaccccacaagcccuuaacggcaagaauuucucuaaacuucaucuuuuuaaacuucacuucugauucaaaauuuaagagacugggggagauuagccacgacuggaauggggaaagggccaaauauucaaaagggauucuuccuugcaaaucucagaacgcuggccuagccaugacuagagagaaagucuaggucucuaugaagcaauguuugucucccuuucccacaucaaauccugcagaguccgagacucaucuucuuccucucuuuugcaaccuguccccaugagggauuagauaagcuuacagcucuuuacucacucugagccuugauuucccuauaugaagagauaacuccuaacuugcuaaccagaaaaaguuaguaaguauauauuaagaacaguaaggggguagaggugggguuucacaacuacaaagcauaccacaaaugaagagaauuacuaccauuugugcugguguugucuugucuagaccaccagugagaaggcuagggauggauguaucucucaauugguagaauguuugaauaccacccaugaaguccuggggcuacuucacuccccaacaccguauuaaccagguuuuagcuuaagcugauaauuucagcacuaggcuaucuaucucaaaacaaaaacaaaaaauaacacaacacagaaaacagacauaggauaagaaagcaauaaaguuaggggcacuugacaacauuaauagagcaagaccagaaaaccugaaaagagguaucuaauucauaucagacuuggccauuuuaaaaagggaacuacuauuuuaaguaggaguugccuccuugaaguagaacuucacuucagcuuccuaaucuuaguguuuuccuuucugagcugcucaacagcuaaaagaucuugcuaugaaagucuuaaugguuuuaaagauuuugugagcuuggcucuuuguaccaaagguuaaaucccaguaaaguauagggaagaaacauucaaaccuucccuggaacacagcccaugcaggacguacucaggucuagguuucuacccuucuaauuucuaccucauaacuuugccaacaagaccuagagggacaagucaaggagguuacaaaugaucuacaaaggaaaagccuaucauaauccuuguucuagauggugaaguuggccauuuccuuugugauuaagaucaguuauucacaucaauuuaagaugggucaauaauccuaguacuuggaagacucaggugggaggauugccagaagauggagaucagccuggccuaaauagugaauuucaaggcagcuagggauauacaaaacccauuuuaaagauaaacacacaugcacacacacaagggguuaugguagcaacagcaaucuaacaaaaucuucaagagcauuauuuacucaacuaaugacauauuuuuguacuauccuuugaaagaaccaacagaauuuacaugcccuauggucacaugccuuaggacaugugguagagagaucaaagcugauuauacagcaaugccucauugaucccaaauggucuaugaauaagcugauccaaagugaacuuuuuucugauaacugaagcuuacccuuuuaaauauaauaaccaucccuaaugaugagcugaacguuuucaucugacaugcucuacugccuuugucaacagaggccauuaaaacaugauuuaaacuucucugagcacucgaauccuauaugcuugauuuucuacagagcuaacaguugagagcuuuccaauuugaccuuauccaacuugcucauuaacucugaggcuagcaugaccauccuuacuuuacuaacaggagaauauaaagcugaaccaaguuaaagaacuacccuaagguuauaaagacacuauggaaguacugaccuucccacaaggcugacccacaauaaaugccagggauuaccuuggaugaaauucuuaugaagcuaaauaacaaaccacacagacucccacauaggguuuagcucggaaguagagagagcucucuuaccugguauccacaaagacacagauuuaaucccuagcacaguuuauagcuuagucacacacacccauaaaucccaagccauuuuuucuuucugggcuugguggcacaccacauguaauuagcacuuugaagucggugaguucuaggccagccacagcuacuuacuaaaaccgucucagaaagaaaggaagggaaggagggaaagagggagggagggagggagggagggagggagggaggaaggcaggcaggcaggcaggcaaaggagagguaaaaagaaaaaugucuuuccuuucuuuccuuuuccuuucugggaagugaucucagauauuugcuuucugugcuucacaacaagucagaaaguuccaauacucagucuguaggcuacucuguuugucuauaaggggaaagcaaaaauaccuacaguggcccagcacagccaaggucagccucuggucauagaggcugcuugauuaaaaggagagcaagcagaagcucuacucuauacacuauggaagucugacaaaugaauacacaagagugagguggagcuugccacaaaugggaagaaggaaaccagcauuucugguacuucugcuuuuccucucuugguuuggcaucuucagaugaucaauauacucaguacguuucuaagacuaggagcagcaauaaauaggcuagauuuacuuauuguuuacuuguuuguuuguguuuauuuauacauuuguauuucauaagucaccauuucccucaacugggugacucaagcacaugugaacacucugcagagccauucuuauggacauaguaugcauguuaaaaggagaaaagagaggagauuuaacuuugcuucacuguugacaggccuucacacuggucuucuuugcagaaacugcaaaggcaacugcccaccaaugcacauauggaugcacucacagcuuuguuucuuucaucucacacagcuucaucuuccagcauucuucagauaaucaggccuuucauuuaagugcugcuuagaaacaaacuauuccaaacuggaaagucacaaaacauugaugagaccauuauaugcauagguaugcaagcugccuuaccaauaugaacucuacaaagaucauuugaaacacacaugaaaucauagcaauuucucuuccaaggaugagcauagaaagagaagcaacucucaacauccuuucuugcaguagaaagguccaaaacucccguaucaguacaccuuuucuccuaggcaagcaaaugcccaugauguacuuuuuauuucccauuugauaaaguguaugggcuaugcacaacauaguaacucaagcuuaaaaugccagcacggaggaggugaagauaaacagcuacuaaauucaaggucauccucaccuacauagcacaaaagaggcuaaaccuggaguacaugagaccuugacacagggagaaaaaaagagggcaggggauggagauagcuaagcaguuaaaagcauguacuacuguuccaaaggaccugaguuggcuuaucggcagaaguucuggauagcucauaaccaccugugacuccagcuccaauggccucuucuggaccacaagaucauuugcauucacaugcacauacccacaaaaagacacauauuuuuuagauuaaauauuuuaaaaagaaaagagaaauauauggacuuuuuauauguacagaguucuaccuauuuacucauuugcuuauuuauacccauucagaauuuaacaugugauuuaagauaacuacccuaaaccuaagaaauguuuccuuuagcuacauggaaacaaagccaauugaagaacaaugcagauuagugcaacaugcaugcuuaaagauuccugugugcaaauguauuuaaaauagucuauacauuagcaggaugugguagcacacaccuguaauucuguaaguagaagcuaaggcaggaggaugaaaaaaagucaaggauaaucuuggcuucauguacaaaacguugucaagaaagaaagaaagaaagaaagaaagaaagaaagaaagaaaggaaggaaggaaggaaggaaggaaggaaggaaggaaggaaggaaggaagaaaggaaggaaggaaggaaggaagaaaggagggaagagagaaagaaaaggaggaggaagaagaaggagggaggaagggagggagaaaggaagggagggagggagagagggagggagggagggagagaggaaaaaguaaaaaggaaagggcuagucuacauucacauuaguuaaaaguggucuccucagaagaguagucaggcacaagagagacuuccuauuuuucaguuuugucucauuucuugucauuuguuuguuuaauuuagaggauguggugguuugaaagaaaauggucccauauguucauagggaguggcacuguuagguguggccuugguggggcagguguggccuuuuuaaaggaagugugucacuauggguucaggcuuugagguuucagaugcucaagccaagcccagugucacucucuuccuacugcaugaggauccagauguagaacucucagcuccuucucaagcacaaugucugccuucauacuacaugaugauaaggacuaaaccuaugaaccguaagcuaauuuccuuccuaaguguugccugccaugaucauguugucucacuauaguaauaaaauccuaacuaagacagagagucucacuaaguagcccuagcuguccuagaauucacuguguaaacgagaauuguauuguucucaaauuuauaauccuucugucucucucugccucuucauugcuggaauuacagauguacaucaccaucccuagcccuauguuguuugcgguuuguucauguuuuucaucaaaucaaauaauguauucauuucauaaugaaaacaauggcacacaucucuaaucccagcacuugggagucaggggcacauauaucucucuguaugucugagacuagcuuggucuacauugaaaauuucaggauaggcagggcuacaucgagggacccuaucucaaaaaaucaaaaaaggaaggagagaaaaaaggaaggaaggaaggaaggaaggaaggaaggaaggaaggaaggaaggaaggacaaaaggacaaaaggacaaacaagcaacucuguaguaacaauguuggaguuuugguuucuuuggaaaacacagaaauauuuuauguuuucaucuuaaucccaugugugggacauggggcugcuucagauugucuaccgaagcucacugugauuuuccuugugcucuugcaggguugugauuuugccaguugcaaacagugucugugauugugaauuccagggacuuuucagaggguauguaaacgcuagggcccugagaggcagaguagguugguguuugguguuuaguugcaguuuguuaaguagucaugcacaaagaagaaagaacaaaaagacauauuagauauccuaauggcaaagaucaaacuugccccaaaggaaccugaugcuccuaaccaguuagaaguagccuaaugauaaugucacccccuuuccuuucuaacauuuuuucucucauauauaguauuaggugguugaaaggguaggaaaaggguagauaaauguggaagaaagaagaaccuacaaagcagcaaauuccagcuauacaaguccacaucugggccuauuugccuauaauccuagcuacucugugggugggcuaaggcagcagaguuucaaggucaaggccuacuugaccuacugagagaguugaaguuuaauuuaaagagaucuuccaaaaccaauuuauaaggcacaauaguacacaccuguaauaccagaagucaggaagcagaagcaaaaagaucuuaaauucaagguuauccucaacuuauacagaaaguuuaaggcaagccugagcuccaugaacuaucucaaaaacaguacaugauaaaauauaaauaaaaaguagaaugaguacugggaaugugguuuagaaauagagugcuugccuggcacagucaaggcccuagguugaauuccuuguacugccaaaagauaaaguccaaaacugucaaaugaaaacaaucuggauuuaaaucuauccuacauucuaugucuauuaacauucuuggcacaaugucuagcucagcacuuuaaaacaaauggaaaaaaauccuuuaacaccaaauguccuuuaauaacaagguaacuguugggugugaucacacacaccauuaaucccagcauuugggaaacagaggcagacaaaucucuuugaguucaaagccagacuggucugcguuccaaauccccugccacccaacucugcauagugagaucuugucucaaaaacaaaacagaacagaaaaaaaaaaacaugguaaccuuccuaggcucuauuuuaugacauacaaccuuaccuacuaagcuuaauacugugucuuccaaugcaaaccacaucucuaucucagaagugaauggaagaaaauccucuccauuucccauuuuuuaaaaagaaugcugcuuugacuacaauuuguccagaucugcaaagauaugcagcucugggcucucaggcagccauggaguguguggcuauagcagcaauaacuguuggguacuccaacaauaugaucuccaggguuuccuuguuaucccauccaucuaugcugggcucuacccaaaccucuccagauuugauuacauaauucaguccugccuacuggcagugccauaaugagcacuacacauaccaaaaaaaaaaaaaaaauacacuagguaaugccucaaauauguacucuaaagccaaauucugggcugcuccacaaaggcagauugaaaugcucacacagcugccuauuagaagccacuaaaggcuuugauuucaauacucccccuuggcaugaaaacuacugugugaagacauggaaaagggagguagaaauugacugugaucaggcugaacacucacagauaaauggacacuauaagguacacaagaaaaacaaugccuuuccauuuccuggcaccauuauacuccaaccugccaggauccaaauaaauccaccuuaggugcuuuccaggagacuauggaguuguucagcuugcuggcagaucuauuuaaugaauacaaaauguaucuauucaacaucuauuucuugacacaguaguagauucagcuuguacucuaguacagugguucuuuaccugugggucuugaccccuuuggguggcauauuagauaguguaacauacguuacaauucauaaaaguagcaaaauuauaguuacgaaguagaaaaaaacuaauuuuauaguuggggucaccacaauaugaggaacagagucauggcauuagaaaaguugagaaccacuggggugggugggucuggcuaauacaauaugaagaacauaaucccgaaaguggucucaacuucaaaagcagcuuuucugacuuuucuuugauaugcuuugugacaggguuucacaugucccaaauuggucugugugugugugugugugugugugugugugugugccucuguguguguguguguguaucugagaaugaccuaaacuucugagucuccuguuucuaccaccuucaugcuagcaguguguaugugugugccugacugucugcugguauaugugccugugugucuucaugcuagcagugugugugugugccugacugucugccgguguaugugccugugugugugugugugugugugugugugucugagaaugaccuaaacuucugagccuccugcuccuuccaucuucaugcuagcaguguguguguguguguguguguguguguguguguguguaucaccacacaugguuuaugcagugcuagggaucaaacccagaguucuauugauuaaacccaacacucuacggaguuauauccccagaucuacuacaagacuuugaacaagacccuuacaguugugcuuuacaguugaccaagauauuaucuacagauuaaaauaaaguuuaaacguuucuuuauaggacacaaagcccuaguauagauuacaauuuugcaaacaaccaaaacagcagcaaaaaguuauguguaguaugguauaguauaugcugaauacaaauagcauacuacaucaagaauaucuacacagggauagggauguggcucaauugguagaauacuugccuagcaugcgaaaagccuuaggugcaaugcccagcacugcauacaccagacaugguggcaugugucugccauuccaaaacuugugugauagagguaggaagaucaggaauucuggguuagcuugaauccuuggcuaagaaacaaacuaagguuggcgugaauccuuggcuaauauauaggcuaagauacaggcuaagaugggcuuaaauccuuggcuacauauaggcuaggacacggacaaccuuaugguugacuugaauccuugguacauauagagucaugggucaggcuaagauucaugacacccuauuaaaaaaaaaggaaaaaaacaaaagaaaagaguaucuauccucaaugccuuugaacuuugaugguucccucauaagcuguuugcccaaaacagaugggaugagcaggccucugaaaacuguauaaucagugacagacauaaaaguguucuaacaauacauagaauauuugaagccaguagaccugaaaguccugguuuuacugcaguuucuauuaauacaucuacauuuaucuaaaagagggucagguaccccucuucuguagcaccacucacuuaaagcuaaagagccaagaagggaccaccucccaccccagcuacuuguaacuauucuugagcagggccaugcugggccaguuggaaccaggcucuauauacuuccuucuaaaaagaacuaggcuauaagguuccugugagggccucaggaaccacaccaucucugcauucugaaagggauaugaugggauaugcauacgugaaagaacuuuuaagaggcuguuuaguaauucaacaugguauuauauuuacaaucccaguacuugggaggcugaggcaacaugauaacuucuaugaggccaaucuccuuuuucaccuaaugaguuccacacuauccuggguuauagacugaaaucuugucucaaacaaacaaacaaaaaccaugguguggugguacacucaacaagcuccuauaaaucaagaccagaaaaacuuggguuucuaugcacuggcuugggccguuuuucauuauaauacaccacacacauaaacacacauauaaacacacacacacacacacacacacacacacacacucaccaugucuuuuaccuauuaucagugccuccgaugucucaugcaggauccuuuacauauacuguugcugcuucuccuacucugucuauugcuaauuaaauacccuucaaaaaguuugcccaugcuaaguaugauaacacauacuuggaauccuauuacucaagaaucuaaggcaauaaaauggucaaccuacacuacacuguguaucaggccaugaugagcuacagaguggcauccuaucucaaaacuaguugggcagaaagacuuauggauaaggugguacagacauguaauccugcacuugguagauggaggcaguagaaugaggaguucaaggucauccuuggauccuuggcuacauacugaacuuaaggauauaauggacugacuauaagagauccuauaucaaauacacauaaaacaagaaagaaauuuuguaugucuguaacaauggccaucuaaagauagucacuucuugagguaaggggaacuagaaguuauaaaauccacaaguuuacuaaauaauaaaaagucuggaagcucaauaugucuauaaaacauugucauuugauggaauuuuauaaggccauuaaaauauucuuuuuuuuuuuaaaggucagguaucacguaccuuaggcaggcauacaacucacuuuagaaugaccuugcacucaauccuaaggccugcacccccccaccaagugauuggggaauauucccagggccugagauaugacaauuuccccaaguuaaaggccaauguggacuaaacaguaaguuccaagccagcuuggaauagcagcaauauugagaaaaauaaucucaaauguacauuuauccagucaucuuuuuuaguaauggauuugcuaggguauaaggaaguagguauguacaaaucacugugccauagaaaaacuaagguacaaauguaacaccuaacaagaaauauaaauaagaacuaauauguuaaaguaguaaguuuuugaaagauuguucucugugugugcuaaccauccucauacgccauggggcauuuuacaaaaaaagaggaaauacaaaaauaaagccccauucucuuucuguuuaauuguacauuacuuuccuucacugaccuuguugccuacacucucuuaccaaaagccauuuugacuuaccacuucaauuaguagauaccaugugggggccaugaaaaaaaggagacgcugccuuuaugacccagaaacauuccagcacgauucugggaaagaaacaugucccaaacaauauuaucaagcuucauacaacuaagacaucuuuagguuagcugccuuagcuaauuguucuaaaaggaagaaaauaucaauacuucagaguccaggaaguucaaguucagggccacuuuuuaaaaggcugggauacagagugggauugauaagcaaguccuagaccaaagacagagaggauagggaggaaguaaaagcauauccguucuuaugcuguaucacuguaacauaccuucauaacaaguuuauaauuucaucacccuugaucuacaggucuaacacaauauucauauaaugcagaaucagaugaaagcccaacacuaagcauggaaauagagauuaugugguaauaaacucccuggcuagaaauuauuccucuguuccacccgaugccacacauauagcuuucccucuauacgggcagcagagacaacagugacucagacaagagaaaaccuuaguaauuuaagacucaaaauaaaaguaaucccauagccccaaaaaggcuguuauaugaagaggggggaaauaagaucucugcaaucaguuugguuuuguuucuuggucauccccuuuccagauaaaaguauggcuauuccaagggucuucuauucucucuggagucaacaauaaccaaaaauagucagcaacucuagucuucagaguggagugaaaugcuuugcccaagguucacuguaaauagcuguuuccccaagucauuguccccacaguaggacucuuggauauagucuguuuccauacugauaucuaggaaagaaaacauugucaauguuauuuuaaaggagacaggacaacuucaaacacuuacuguucucuguuguuacacaacuaucuuccuagucuacaagaguaaacacauuaucagaauaucuauuucacauguaaagaaauuaaggugugaaaauuauuuguucagggucacccagacagaggcuaaaaccagguacccugauucagccuacugcuucuucuacuucggggugggggggccuagagaaaugacuccacaaucauuugcuguugugguagaggacccagguucaguguccagcauacacaugacagcuuacaaccauccuuaacuccaauuccaggggaucugaugcccucuucugauccccucaggcaccaggcauacaagcguugcccagacauacaggcgggcaaaacacauaaaauaaaauaaauaaaucugaaaacaaaaauuuuaaagcaggaaaaaaaauaaugaaugagacaagugccugaagcuguaugcaucaaaaucucuguucuucaaaccuaaucugagaaagccuaguaacaccuaggcauagaacaaggacaugccaagacuuggccuuucuacuuggaaggcuuuaccuacuccaaaaaauacuuucagaugcugagagcacuagcccuaccccaccuccuaugccuuuucaggccaagcaagacaacacuuaagcugucagagagcuugguaaaaaacuaaagacagguaacuaugcagggacaagugggaaagaaaagauaagaaagcaggguggagaaaucacagucauuccagagccugugcccucccuccuccccaacccugucucauccuucucacuucccauuccuccccacuccuccuccuuccuccuccccccuccuucuccccccuccuccuccccccccuccuccuccuccccccuuccuccuccuccuccucucagggcccuaaggagaaaaguuuacagguagcacagcuaaaccuugaagaagguggucccuguuaugaagaacaggaaauugguugaggagaggugaguauuugaggggggugaaaauagccaaauaaggucacucgacuugaggggaaucauaaggaaugguuccagaaggugacaucacagggaggaagccuuuagucacugguuuccucuggcaacuggccuuuggccagaggcaagcucccaaucauaggaaaaugccuagguuauugcagaaaggcaaauaggcuaaauuguucccagacccagcucaggcacuucaugagcagcucuccgagcacauaagagagaaauaaaguaaccccgaagcaaaauagccaauauucuugccaaguguauucuagauucaccaugccccagggaccaagggaaauaaagaaucuggggaaguucuccuuuuauuauuucugauguugcugauauuuucaugcuggagggaaaaaaagcaaauucaagggggaaaaggccauauaacuuuugguuuuaguaaaauaacauuuauaggcuugucagucuccauuaccgacaaugaugguugagacacagaguuuagcuuacuuuaaacccuugaagauagcaaggacuuguguauaguaauuaauggcaaucauacuggauguucccuugauaccuccaacccuauaccacagauuaauuaaacaguauaucaaggaagaaagagccuuuugguguacuuaaucaaauacccagccugagauuuuugagaaaaaaaaaaaaaaaaagacuggacccggggauuggagcagacaagagcaaaaugguaaaaucagaaacuacuucagcuaucuuaaaaauaguguggcuuuuccaggcuccguggaauaugcccuuaauaaggaggcagaggaagguggaucucugaguuucaagucaccuuggucauaugcuaauaccuugucucagaaaaauaauaauaaugaggcuauauuacccauccuauauuucuaagggcaaccagaacuaaagggaauaaaauguuccaugccccauacauaugcuguacucccucucacagguguuggccccuauuaucuccuaaauauguaaccaagacauaauuguucgggacucuacuuugcccuguaucaccaaauguucaaaccucagugauucccauaauuuguaucaauuaguaucauaaucacacacacguucuaucaaaauuucacaggcaaaaaguaaauuugaaaacagucuuagaucugcuauuuccacugucaggcauacccaaagagcuguacuugaaaacuuacaccaaaauaucugucucccaguucaaggugcccauucugcagggaggcuacauuuggaaagcaucauacuccuccaucucaauuacaagcagucucugagaaaccguccuccauuuuuuuuccaccaaaccacagcacagccaauggacaagaauagacagaauagaaagucuucacugaguucuauuucuuaauuuaguucaaaaagauacaugaaggaaggaaccauuuuccaucacgugugcguauagguacaugccacaaaaugcauguagagaaccagaggaugaccuuaauuaucaguccuagacuuccucuuaugaaggagaguaucucucuuauuucuccuacuucauuccaggucauguggcccauaugcuuccagaauucuccugucucugccucccaucuagcaguaggaacucaggaacugcagauguaucuuuaacauggguucugggaugccaaacccagguccucacuucacccacagaaccaucuacuggagccauuuagaauccuacuucagcaagaaaaauaagauuuuacuagaauucuccugguuucaaaaaaccuuaagguacauacaguaucauucacagaccuuucagaagguuuaccaauaaagcaagaacaauuuaaaagggacacuggccuacagcuaccuaguuuaaaccauuauauaaaaauccuauaauucccccccgccagaauggccacuggccccaaguauguaccucuuuaagaucccauuaauguaccaguaaacuccuuauuaaaaucuauagaaaauacaauacauuuuuaucaaauuuuuucuaagaaugaguuagcccuaaaucuucaauuaaaugggaaaauuuuaaagucaugaauuauauucucuacucauuguauuuacauucuuuacaguaauaguaacaaucaauaaauuaugaaaaucgagcucuuaauagauuguugaacauauuaauaauaauuggugguuacauuuauaugagacuauuaauuguuagacacaguuauaagcaccuucuguaaaucaucucacuuaauuggcacaacccuaggaagcaguuauuaucuuuaaauuacaguugaggaaaagaaggcucagaaguaaccuacugaggaauauuuguuccauaccuaugguccuagcuauucagaaggccaaaacagaaggggaccacuugagaccagaguucagagacaagcuugagccaccuaauaugacuccauuuacacacacacacacacacacacacacacacacacacacacacacacaaauccaggcauggaugguagcacucaggaagcaggggcagaaggaugauugcaaguucaaggccagcuuauucuacaaaagaagauugucaaaaaacaaaacaaaaccaaacaaaaaaccaaacaaauaacaacaaaacagauguaagggacuggagaaaggggauaaggagaagggggcuggagaggggauauucauagacucuagaaccagacaguuuggauucaaauugcagcuaugugaguagugaguuauaccuuggguaaguuacuuagcuccuuuuacuuuuaguucuggagauucaacccaggggcuuguacauguuaggaacaacucauuggucacauaggugagugcuuagaaugugaauccaaguagucuaauucuguggucuguaucuuuuaauacuauacccuuucuauguaagccugaaaacucuccauccccccacuagcaacccaagacuugacccacuagcaaaguaccuaaaguugagggucgagaucaguugacucaggauuauauuaaaaugguuacuacagcaccaaauacuaucauuaaauuagaaagacaaguguucuucuauccauaguguccuaccauaguguucuaacacaccagacaagucaagcuugaauucaaagaggucagaccuugauaggcauggaggucaagucuguauucccaacacuuaggagaaagagguagaaccuagcaaguucaaggccaaccugagcuacaugagaucuauuucaaagcaaaaaccaaggacauggagaugucucagcagguaaaggaacuggcuacuaugccugauggacaugaguucaacaugauagaaggagagaacugacucuugcaaguuauccucugucuuccauauaugccauagccaaugccacauguggauggaugcacacaaacacauguacauacaaagauguauaguacccaaauaaauaacuuugaaggauucagaaaacugucauggcagugaucaccuguaauucccucaguugaagggcacaugaaagcaugaggauaaucaaggucauccuuagcuacauaacuagcucaaguucaaccugggcuagaaauccuguugcaaagagaaguaugacucuuaggacaguaaggccuagucucaagaaguaaaauggccaaacauccucucccuaugucccuucaaccaucugugcucuaccaccuuccacagucaagaaaaacaucuaggaagcacuacagacuuccaaagaaacauccaagauuugaaccaucuccaucuuucaaacucccuggggauugcuguacagucacuaacaggauggucaagucacccucagcugagucagaaaacacuaaacauccucucuaaauacugguaucaggcaagaugcccuggcccuauucuuaacucaagaaauuucucccuuauugugggauucagugugcucaucuaaaacaugaaggcuaaacuagaaggccagcucagauguucuauagcucaguauacuccugugagaaacccugucuaucuaacaacaauuagcucaaucaaaucuugaggcugaggaagcucugggaugcucuaaguguggaugcuuuuuugaaaugcuauaccccaugguaccuagcccucugcucauugguagcacacaccguacaagauuuguuuaucuucaccaccuuuuuaauaccuacaaauauaucuaacuacucaacuguauuuagaaauaaauuagagauaguucuucauaacuuccagcuagaugugaugaugacacaugccuguaaucccaacacuuggagacaaaagcaguagggucauccuucucugucuuucucuccccugcuaaaagaagccuacccuuucaguaaaacuagaggaaaucuauaugaugcugucaaacaggcacuauacaauguaagaagagaggaagagaaagcuacaaagguacuauuucuuucuuuaugaagacaggguuuuguuauauuauucaggcugacacugaauucacuauguagccuagacuguccucaaccucacaacaucuuccugccucaguugcagagugcuggaauuacagguagaagccacuacaccuaacucuuuuuuuuuuuaaugucaugaauauuuacucuuuuuauuaaucauacacuuaacucuuuuuucuaauuagguauuuuccucauuuacauuuccaaugcuaucccaaaagucccccauacccuccccccaacuccccuacccacccacucccacuuuuuggcccuggcauuccccuguacuggggcauauaaaguuugcaaguccaaugggccucucuuuccagugauggccaacuaggccaucuuuugauacauaugcagcuagagucaagagcuccgggguacugguuaguucauaauguuguuccaccuauaggguugcagaccccuuuagcuccuuggguacuuucucuagcuccuccauugggggcccugugauccauccaauagcugacugugaacauccacuuauguguuugcuaggccccggcguaaucucacaagagacagcuauaucaggguccuuucagcaaaaucuugcuagucauacauucaacucuuauaaagcuuuuccugcuugccgagagcucuucgguaaacuuaccaccuucauaaugcaguuucacuuauuuucuuuguuuccuuggggaaaaaaaauacagaacggaugugccuacuccugcuuugacuuuaugucccaaggugggggugguaccccaggggaagguacccucuucucuggggagaaggagagaggauaaugggggaaggguaaugagggugggacuaggaagggggcuucaaucgggauguaaaguaaauuaaauaauuaauaaaaaacacacaacagccaaaagcuuaaaacucaauagagaaauaaauagccaagaguccucaugccaguauuauuagcaagaucuaaugcaauguaucagaaacucuacauucuaaacugguacucaacaaacaauagugcagaaauauagaaagacaaaauaaauacccuugggcaagcacuguguuaacucuguaucucuaguauacuccaauacaucaaaggugcucacauacuaaagaaugucugaaaguaugcauaugaaaaaagauauacagugccauauaccacugugccaucaaggcugucaggaauaucaguauuacaagagucccuaaaguuuaccuauuacuggcacaggucccuuaugacaaccucgaagaaauacugaacggacagaaaggaauuaacuaauggcauacuuuauuuggauaaccuuucuauuguuuuuuaagacauguagcccaaccuggauacaaacucauuauuuuguagggaauaacacuaaacuccugauugcccugccucuacuucucaaguacugggaguguaggccuauaccaccaugccuagaucuucuucaucagcuagaacuuuauuuucuuuauuuuuaguaaaccuugcugcugugaaaauuugaugagcacaaauaauuuacacuaacucaguuguauauauuuguagauuuaacaaaauauuaaggaaauugagacacguagaauauuccccagucuucugcuuaauaugacaacuaaagauauuuuuaggaggcugagccaggagauuaucaugcauuuuaggccaaucuagaccaacagaaacuuuagguuucaaaaaccagaaacaaaauuuaggaggauaucuauuuaauuuuauagacucaagcaagacuuagaauuucagcuauuggcagguaucuauauauucacagaacuccuuaaaagguccuaggaucguguucaaggaaauuguuuguuuguuuguuuguuuguuuguuuguuuguuugagacagaguuccucuguguagcccuggcuguccugggacuaauucuguagaccaggcuggccucaaacucacagagaucagccugucucugcauccggaaugcuggaauuaaagaugugugccaccaccgccaagcuucaaggaaauuucauuuguucaaauauaaauaacacauaauaaaucuuuaaaaaucaacaacaagcaucucaucuccuuauauagaaugaaaacaaauagucgaaguugaguuuuacuuucuauuucccaacaaccaccauccacguucauguaaugcugagcuaacuccaaacuaagagaucuucuaucacaaauuagaaccuggaauugaaaaguuuuucagcucuaucaagcaugaaguaaaagggaugaacagcaaagccagucaauuaugaaaaccauccucaucaugaccugaccaacggacagccccaaggaagaccaccuuuguacugcuaguuuguuuguuuucccucuuuagggacagaagaaugaggcaggguagcagaaaagauuguaaguuaagaaagaagcaaaugauaaacucaguucuaucuuucaaagaucauacagagucaggaucuaucuuggacgaucagagccuguauggccaugaaaagcccaacccugacaguacugcugggagccagaucucccccuccagggacccugagucuagaaauuccaguggggguagggguagacucccaggaauauacaauggaaccuaagaaagacuguugcuaagcaacacuauuagaacagaguucagaauaauuguagcugucaucacuucucauccauagagaauuagauuuggaagcauggggaaagacuaaaugaccucuaaaugucccuuccacuuccacaaucucauaaagcaguuggauuacaguaacaguccaaagaaaaggcaccaccuauuuuuauguuguuuuucuuuuugggggguacuguuaggguuuuuggggggagggaguuagacagccuuacucuauauagcucaagcuggccucaaacucacuacaaucuucuauccucccaagugcuacaauuacaggcaugagcuaccaugccuggcaacacuucccuuacaggcugccauuacaggcacuuagagaauaaugcaguagucaauaccaccccaucacugacugacagagcaaccuuccucccaagaugaaaguagaggcuauuuugugccuugacuuuucccucucugugcaagagauuuuccaugaauaaguauaaaugaaauccccaagaugguaccgguucuguucucuacuaucuacacuuucacaaaggguucagcaaauuggaaaaucaagacuggagagaagauagacaagguaacacucaucuguuaugcuaguaugagggaggcugagguagaaagauacagaguucaaggucauccuugccuauauaucuaguucaaauccaaauugggcaacaugagacucagucacaaacaauaaaucaagugacuuccaagauggcucagagggucacccacuuaccagccaaagcugaccacuuuauucacagaugccauagugaagagaacugacuccugaaacuugcccuuugauguccacugguguguguguguguguguguguguguguguguguguguguguguguagagaggcuauauaauuucauaauuggugaggcagaaauaggauugccuggaaucaaggcuaauuugcacugcacagcaugacucugucucaaaacaaacaaaacaaaacacccucaggagguaguucacaccuguaauuccagaaauucugaagcagagucaagaggauugcugugaguuuguuuguuuaaaaaaaaaaaaaagguauuuuauagggcccugagggcuacacaacaagaaauuguuuccaaaaaguagagagagaaggggggauggaggggguggcagcgcagcagacagaggcagaagccucccacacaaccuucauuccugauccuuugccccacccucaagucuacagacagggcugguucaaggguuagaagccugaaauucugcccccuauuagucaaguaccacuuuagugccacuucaguggcucaagcaaugcuaggaauggcaggaaaaucaacaguucauacagccccuguuaaaguuuagcugaaugcggggccagaaguuuucaaauacuucaaaggagcugggcucugucuaucauggaugauacuauccaauaagcacugaccacuuuuuccccugacuugcuaaaucccaguaaaccaaacagguuuuccaagacugauaccucccccucaaaaaaagaccuaaccccaaguuguagccuuccuguugguaugcaacaucacucauggccggguccguccuccucuauagccaguuucaaucuagacaacgggaagagucguucuugguaguaugacaacaaaucccagcauuuaggugguggaagcaagaggauuagaaguucaagccuagccugggauuuaugagacccuguuucaucaaaccaguuaaauaaauaaauaaauaaauuguaacaauaaaucauaaaguuugaaauaaaaaacucaaaaucuugaaaaauuaauaaucucuuuuuuagguaauccaaguggaucuccuaaaucuuugaaauuaaacaaaaaaaaagugaaaguggaauugagagggaaagaccuucuccaaaaaagguuuauuuauuuuuuuauuuuauguucaugaguguuuuggcagcaugcauguauacgaaaacugugccugauacuuaaggacaccaaaagagagagucagauucccuggaacuggcauuacagacaguugcaagcugucaugugggcacugagaucagaacuugugagagugccuuguugggcaaucucuccagcaccaggaaaagcauuuuaaauagaaauucucuucucuccagaagggauagaugggcuggucacaggggagccugugaucuuagcacucagagggcucuguugagauggcuaggagcuggagaccaaccucugcuacaacaguauaggaccuugucuugaaaaacaucaaagaccagacuuugggaacuagcaaccagagacaguccaaaaaagguguauuucaacauauuuaaaguaggcugccugcuagaacaaauuagcuuuaacagcgaaacugacuuucucuaacacaaacgaagaaaucugauuuuacacuacuauuucguaucuuucauaauuuagaaaugguugaguacacgguacagaaggaguggaagccggguuuagugguggcuacaaucccugcacuugagaagaacuacuuccaaaagaguuuuuaaguauaucucaggcuacaaugugaguucaaaccagccuuggcuagaaucaaacccucuaucaaaacaaaugaacaagccaggcaugauggcucaagccuguaaucucagcacuguggaggcugaagcaggaagacuggcaaaaaaaaaaaaaaaaaaaaucugaaagccaccuacauuacaucgggagucccaugccagccuagguuauaggguaagauccugcccaaguaaaaagccccgaaauggaauacaugugauaagaaaacagaagggaagacaacugaggggaggaaggaaaccugccugccgaacggaagucuuggggugaaggaggcgacaggagggcaguggaggaggggagcaaauuguaauuucacauauguauauacuuucacaaaguauacuuuuauauaagaccaggagacucucucaaaaaauaaaaaauaaaaaaaagaaaagaacccccccaaaaaaaaaccccaccuugguauuucuuaagaacagaguucugagaaggcaaggacgauuaggcaguguagcuagaauacaguaaggguagcaaggaaacuucaauauagacacaaagaccuccuguaucuauucacucuccucucuuccgaggcacccucaucccuucuccagcauccuagucacugucucaguucuaccaggcucaggcaguacuagagagauggguaggcuagcaauauacaacaugggagcccagcaagccccauuaccuaagaaacauaauucacgguggucauagggccuucaugagcaaggaccuggcgugacuugcacaaaagcaagcagagcucauuagucaagcacauaccccucccccaccccucccuacugggcauccggccccccuaggccucacucccuggaggcuucugcgagcaacagccagugggguggagaccagaucucaaaucaaccaccacacuagauagguguggcccccacaggagaaaaccuauaccucacaaaacgguccugaggggauagagaggcacuaugucugacagggauuuaauagaggaagagaaaccugcccugucuuccaguggguugugugggccccuccacagacuugugccuaaugaaguguuuguaccccuggguaaaguaacccaguugaugagacccuucacaaaucuucauuucccuggggaaagcaguuggggcuaagacgcgguggaaggggacagagcagaagugggguagaagaggggcgguuaugggaaagguggaugggugugcgggauccgcccugggcaacuuccucucuccuccccgcuucucuguaagcuugggggcucuucugagacagugauagcuuugcuacagaaaggcgccaauuccugggccggggaaauguucucaaaaguaaagucguuuccccaguucccaacgacccuuuagaauaggggauugauccagucccucaaagaguuuccacugucucaucccagaggcggggaacuggaacccgagaaaggcuggcuccuccuuauccacacuucuaguuuguacacccugucacccucuagagcgcucaaauuagggcuccacuaucuucuccuuccuagggccuuaguggacagcccagcauccccggcaggccugugagcaaccaagcccgaagccauaaaguggcaagggucaagcuuggagcccccagggccgaccgcgcuaguugucggcacucaccgucuucggcaugguggcggcaagggcagaggaguuggugaaguuuggcuggaaacugucgggcugcucugagcgcgcaguacacuucggcaaggacuccggagaaccgggugcucagauugggucccacucuagcguugggcgacugcuccgcuuccugcuaacgggccacgacuuuacaaaccccacccaggaaagagccgcccccguugcgcugcucgcuccuuuauguggccgggcuuccgcgccu
